United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 8

SEQ ID NO: 29386 - DNA, 410 bp, Glycine max
  Peptide Sequence Number=SeqID_146164
gtagagttttaggcagagctttaggtagagaggttagtggtgatgaggaagaagctcctctacgtcaaagactgacaccattggcacatagacaatgggcaactgtagctgttgtcgaggatattgaacatgtggatgatgttgctggcaaagctcatgaggactctcacgatctagttatggaggatgaatgtactgagttgaagttagcctctcatgagaggaaggtcgagaaattaggaatgtctacacctaaaattgaaggtttagtggttggtgccttccatacctatgatgcaatagatgtagaccaggctgcgaagtttttagttgagttgcttggagtgactacacaagaagtaatagacaagacaaagcaatgtagaggagcatatgtttgccttatctga

SEQ ID NO: 29387 - DNA, 510 bp, Glycine max
  Peptide Sequence Number=SeqID_146165
atggttagaataagagaattgcatcgggatttaggtagagttttaggcaaaactttaggtgaagaagttagtggtgatgaggaagaagcccctcaacaccaaagaccgaaagcatcagcatgtagacagtgggcagctacaactattgtcgaggatattgagcatgtggatgatgccgctgacgaggctcacgaggagcctcacgatccagttacaaaggatgtagatgttgattcacagagctttccaagtgagccccaagatatatcagtgttgacatcatatgttgatcatgtggtagccaaagtttatttgcaagattgtaccgagttgaagttggcttctcatgggaggacggtcgagaaattaggaaggcctgcacctgaaattgaaggtttagtggctggtacctcccatacctatgatgcaatagatgtagaccaggttgcacaactgttagttgatttgcttggagtgactacacaagaagtagtagatgagacaaagtaa

SEQ ID NO: 29388 - DNA, 237 bp, Glycine max
  Peptide Sequence Number=SeqID_146166
atggtttctcttgatttgctgaaggagtcttatgacgaggttttgcagcctggacacagaggattggctgtggttgctctttatccccacagtacgtacacggtcacatgtcccttgctgcgcttctccacacaaggtctcttcgctaatcttacccgtgtaggaaaaacatactcggttagtagaattatttgcacctacttgcccccaaaggtattacgattatacttaatttga

SEQ ID NO: 29389 - DNA, 430 bp, Glycine max
  Peptide Sequence Number=SeqID_146167
atggggttggggatggagaaatcggcgaacatgagaaccagcaagccaagcagaaagggaatcgacagaaagaagaggaaagggaacaaaatagcgagaacccatcgcaggttagggctcggcggaatcaaagtgctggtgatgccggtcaccggtggccggaaccatttaaccggtgatcggaggaaagggatgtatgtcttgaaaactgtcatgtattcgttggatagggtttttagtaaggcagttccaaagacactttttgaactgtggacgaataggacacctagtataaggcaccttataagaattgtcaaaagtggaaatgtaaggttcattgaaaatggtgaaattagtgggagtatagttccacgagaagtgaaaattaaagaagttagagtgcaaatccctttagtttgtacctctagca

SEQ ID NO: 29390 - DNA, 822 bp, Glycine max
  Peptide Sequence Number=SeqID_146168
atggtatctctttatgttgatgatctaggaagtcataatgagcttattggtaagttcaaagaaagaataaaagatgcctttgaaataacagaccttggaaagatgacattctttcttagtatgcaggtgcaacaaaagcataatgagatatttgtgtatcgacaaaaatatgcgaaaaaagtccttaggaagttcaacatggaagagtgcaaaccaactgcaactccaatgaatcaaaaggaaattttttgcaaagaagatgaagctgaaagggttgatgaaaggttgtacaaaagcttaatagggtgtttgatgtatttgacaacaaccaggccagatattatgtatgttgtgagtttactatcaaggtacatgcactgtgctagtaaaattcactttcaagctgcaaaaaaaatccttagatatgttaaaggcacaattgattatggaataagattcagtcaagttaaaagtttcaatcctcttggttattatgatagtgattgggcaggatgtgttgatgatatgaggagcacttcaggttattgctttactttaggttctgagtatatagatgttgctgttgtggtaaaccaagctctttggataagaaagctcatgatagacttgcacacagaaccaacagaaagcacacagatattttttgacaaccaaattgtaatttcaattgcatatgatccaatgttccatggcaaaacaaaacacttcaagatcaagtttttctttctaagagaagttcagaaggatggaggagtgcaacttgtcactactagaaaatacgcttttaacatcggttattaa

SEQ ID NO: 29391 - DNA, 339 bp, Glycine max
  Peptide Sequence Number=SeqID_146169
atgtatagaggattgggctgtatttccgagctagaacctcacaaaactttactggtggaatataaagatcatttttctggtcagacacaagttgcatttgctgaggcccccaatgaggcccttcctctttattgcaggcctaattttggtgctgcatggtcaatgagagttatgattgctggtacacatctggcaattccaaagttcatttacatcaagataatctttttggctgtgatgcccacgagcagtctactcttgagaagagtagacagtattctaccatcctccataacagaattctcaaactccccatcttacttggtggcagctcagtag

SEQ ID NO: 29392 - DNA, 165 bp, Glycine max
  Peptide Sequence Number=SeqID_146170
atggatgaacatcaacaaaactggaaggaaatggctaacataatgatgaagattaacaaagaatcagatgaaatgttcaacattgttcatgttattgatcagctttacgatgaagtgagtaggtcatttgctataagatggaaagatgaactagaccctatgtga

SEQ ID NO: 29393 - DNA, 255 bp, Glycine max
  Peptide Sequence Number=SeqID_146171
atgactgctcatgtgagtgattttgccatagcaagacttctctcaaccatcaatgggtccacttctaagcaaacaagtacacttggaataaagggattgttggctatgctcctcaaggccttggggtcggtagcctccgccatggcttgccaagcctccatgggccaactctccacctcgaatgccgtcgcatcgaagggaacgaagggtgcaaagaaaagagggattgaggaagttggtgttgagcataaatag

SEQ ID NO: 29394 - DNA, 666 bp, Glycine max
  Peptide Sequence Number=SeqID_146172
atgcatggctcacgaaggagggagtcagggacaagcgcacctgggtgcggggccaatgaatccccattgatgaagatgccattaatctattcttggggcatctgttggtcctggaggagggccaatgctgtgaattcattcaaagaaggagccaggcctcggggttcgatgaggaggccatcagttagcagctatgtgttccagggcaagacttcgcccgaagcgtggcaaggagatggggatcacgccttccagacacccagtggacccggagaagtccaacagggcactagggtttccagccttgatcatgggcctttgccagttctatggggtgtcggcaggcacaatagcaaggttatgcaacagggggaggaccagcagcagccagctgtagatgcaccgccgccacctctattgcagccaccatctctaaagtccatctttgctcacctgcgaaggatagagctccatatgcatgcatatatgaagcatgtgaccgaccagcaggcagccaatcataggggtcagttcagggcaacaattgcatggctgggagataagcctaattttcaagcaggggaaggacccgcaacggccctcggggatgaagatagagctcaggaagatgatggcacaaccaatgtgatggaatacttcctttga

SEQ ID NO: 29395 - DNA, 528 bp, Glycine max
  Peptide Sequence Number=SeqID_146173
atgaaagataagagggatgaggaagaaaaacttgaaaaccaaaagaaaaagaaggatagtaaggccttgtctacaaaggccaaggggaaggaaaaagaggaaaaagattcctccaagaagattgttaagaaggaaaatcattttgcaacaaaatgtgatatcaaaagagcactccttcttaaaaaatctttctaccttctcctatcaagggaaacatcctttagcatctccataccacttgagcttgaggttattcctcaagtaaaggagttgttggatgagggtttggttcgtaagagcttaaatccttgtgctttattggtgcccaaaataggtattatgaggcaccaaatccttatgataggaggaataataaacctgaaaataaagaaaaaggttgtcgcaaccaactcttcggcgggagggcgacgcgtgactcgcgggtgcgtattccaagaaaggaatacgcgcggagttgccatcaacgtttatttaaggaaaacgtcgaaaaaatcggaaaagacgtga

SEQ ID NO: 29396 - DNA, 207 bp, Glycine max
  Peptide Sequence Number=SeqID_146174
atggcaggcccttcagatatggccttagttctcgttactagaatggagaaagagaagagtataaaagcaaaaggaatagatgaagagaaaactcttcatcaatcaaatcagaggtctccattctctttgcatacacaccaaagtcactcctttgaagtaatcattatacaggaaaccatgaagaggataagaaaccacttcatctga

SEQ ID NO: 29397 - DNA, 1140 bp, Glycine max
  Peptide Sequence Number=SeqID_146175
atggaagggagggggttttctggcttatacaagaattcaagtgaggagttgttcctgaagacagtgatggagagccctattggtatgccagtacctacaatggagatgttgggtttcaagaatgtatctcaaagcttccgcaccgacagcgaggagctctttaaacgttggctaacaaatggagaggcaagccactatatgatcatgatctccaccgaactagctaataatgtgtctaatcagcaacatgttggtgtagcttcagagggaagaaacaatgacaaactatacatgcaaaataaccttttggcaaatgatgtttcaggtgacatcaattttccaatcagagatcctgttaatagagaactgcaatctagtagtgacctgtttctggctaaggcctggtttcttagtgatcaaagagtaacaagaagccggtcctctgaattgcggcgcaggtatactgaaatgcaaaattctcaaacaaaacaaggaatggaatctatgagcatgacccctcagcatgtcgtggacactacaaaacaagaaattgcacattttaatggttttgattacattactatgaccgagcttccaagccaaaagggatcattcctgtctccatccaactcatcttcatctaccttccacactcatcaattggttgatgcagataaagtctcatcttgtgtaagtatgctaaagggtacattacaacgcaagaggctcggcaaccaagttgagattgagagagaagctgcatcagatagcttaaatggactttttggtcctcaagaacctattttccaaaatggttttcatgaaggcctagaaaattggagtcatcaaaagccaataaatgttcaaggagcctgtactgctcgagttaaggatcctggagtttacattctctcagatggttttgcaaatcagacaaaccaagcatacgtggatgcttcccgagaaccttctcaaagtgaatcttctgctgctgcaccagtaatctcctccggtttggatgcatgtgaaggtcccagcaattcaaaccaaaatctttgtgaaagctcatggaaaccagtgggagtgaatagaagttcagaaaatactcaaaatagagtcaaaggtatggattttacatga

SEQ ID NO: 29398 - DNA, 219 bp, Glycine max
  Peptide Sequence Number=SeqID_146176
gtcaaagaccaaaagggtgtcccccaacccactgtattagagactaatttcgcttgtggtggagtggctggcaccatgactcgtgagtctgctatgagtctgcgggtttacaaaaacctgaaacgtcgtcgtgttggtgctgagctacttacttacgaaaacccaaaactcacgactttgtctgccactctgccttgttcgagttctgcttttgtttga

SEQ ID NO: 29399 - DNA, 2013 bp, Glycine max
  Peptide Sequence Number=SeqID_146177
atggtgtcaaaatcctattcaaacctattggagttggcctctggagaggctccgtcatttgggtacatgaacaggagaattccaaggattatgactgtggctgggttgatatctgatgttgatgatgacccagtggagagtgtgtgctctgatccgtcgtcgtcaaccgcgcaccgagaccggataatcatggtggctaatcagcttcccataagggctcagaggagaccaaatgggaataataggagttgttggtcttttgagtgggatgagaatgcacttcttcagctgaaagatgggttaggggatgatgatattgaggtcatttatgttggatgccttaaggaggaggttcatccaagtgaacaagatgaagtttcacagacacttcttgagaccttcaagtgtatcccgacttttctccccgctgaccagtttactaagtactatcatggtttttgcaagcagcagttgtggccactgttccattacatgttgcccttgtcacctgagctcggtggcaggtttaataggtcactgtggcaggcttatgtgtcagtcaataaaatttttgcagataggattatggaagttattaaccctgaagatgattatgtgtggatacacgattatcatctgatggtgttgccgactttcttgaggaagagattcaacagggtgaaactgggcttcttccttcacagtccattcccttcatcagaaatatataaaacattgcctgttagggaagagatcctgagagccctccttaattcggatttgatcggcttccacactttcgattatgcgcggcatttcctctcctgttgtagccggatgcttggccttacctacgaatccaagcggggatatattgggattgagtactatggtaggactgttagtatcaaaattcttcctgtcggtattcacttgggtcagcttcaatcggttttgaggatgcctcagactgaagaaaaagtttgcgagctcattagacagttttctgataaaggcaggacattgttgcttggtgtggatgacatggatattttcaagggaataagtttgaagttgttggccatggagcagcttctcattcagcatcctgagtatcgggaaaaggtggtgctggtccagatagctaatcctgcgagggggcgagggaaagatgtgaaagaagtgcaagccgagacgaaggccacggtgaaacgaattaatgaaacatttgggaaacccgggtatgatcccgtcattctgatcgaggagcctctcaagttttatgagagagttgcttactatgttgtcgcggagtgttgtttagtcactgcagtaagggatggaatgaatctcataccgtatgaatatatcatcagtcgtcaaggaaatgaaaccttggataaagttttgggtctagcttcctcccctaagaagaaaagcatgttagttgtgtctgaattcattggctgttccccatctttaagtggagcaatcagagtgaacccctggaatattgatgcagtagctgatgcaatggactcggcgctggaaatggctgatttggagaaggagcttaggcatgaaaagcattatagatatgttagtactcatgatgtcgggtactgggctcgaagcttcttgcaagatttggaaaggacctgtagtgatcatgtgcgacgaaggtggtgggggattggttttggattaagctttagagttgttgcgcttgatccaaacttcaagaagctctcaatggagcacataatttcagcttacaagcggacggcaactagggcaatccttcttgactacgatggtacactaatgcctcaatcatccaccattgataagagtccaagcagtaaatccattgaaattcttagtagtttgtgtagagataagaacaacatggttttccttgttagtgctagaagccgaaagatgctttctgaatggttttgtccttgtgagaatctgggagttgcagctgagcatggttactttctaaggcaa

SEQ ID NO: 29400 - DNA, 294 bp, Glycine max
  Peptide Sequence Number=SeqID_146178
atgaatgacttagtttatgtcatgtacaacttgaagctcaaaagtagacaaacaagaaaaaatattgctcttccatttgaagatatgaaatctgatgatgagtggataacaaaagagggagatgatatttttgatgaagacaatctccaagttgagcaagagcaacctttaggggaaagtggtagcggaagtagtattgacttggttggaggaagtttaaccgatccaactttggatgcatttgatattgacaatttggtattgaatgacaatgtgaaagatcacttcaactga

SEQ ID NO: 29401 - DNA, 243 bp, Glycine max
  Peptide Sequence Number=SeqID_146179
atgatttcattgccttctaaatggatatgttcacatcttcaggtagggaacccaaagactgatgattactatgactataaaggccttctagaatatgcatggagccatgcggttatatcagaccagcaatacgacaaagcaaaacaattatgtgattttaaacaatttgaatggtctaatgaatgcaacaaggccatgaatgaagtgttccaagattactcaaaaattgacattgttgaatga

SEQ ID NO: 29402 - DNA, 564 bp, Glycine max
  Peptide Sequence Number=SeqID_146180
atactatgcaagtcatatcctgtggaatttgcttcttactttcattactgccgctccttgacatttgatcaacggccagattatggtcttttaaagcgcctgtttcgtaatttgttcactcgtgcaggatatgattctgactatttatttgactggaccattctaaaatatcaacagatgcaacaggaaaagacacaaagtcaaccacctgctccactagctgtgcctaccagtcttgaaccagtggatgaggataatcataaaggagtcaatgattccattaaaattgctgtggcaacaccaaaagtcaatgttgatcatcaacgtgtttttaagacaacggcatctaatgttcagaatcttaatgccaagattccagagaaacatattgtgaacaatggttcatctgtgccaactgctatgcccagagtttccatagaaaatgccacaaaacaagtaaggcctgcaggaacctcaaatgtgggtcatggattagggaataagactggtgcttcaggatgcattgttccttcactacgccgaacttcgtcaaccagacaatag

SEQ ID NO: 29403 - DNA, 705 bp, Glycine max
  Peptide Sequence Number=SeqID_146181
atgtatgatctggagaacaggaaaaccaatcagccacagctacagtttgaggccaagttatatagtactcttcaaggaggaagtggtattccaagaatgaaatggtgtggtactgatggagacagcaatgttcttgttattgaacttctcggaccgagtcttgaagacctctttttcttctgtgggaataaattttcactcaaaacagttttgatgttggctgatcagttgcttacaaggatagagtacttgcactccaaaggatttttgcatagggatatcaaaccggataacttccttatgggtcttgggaagaaagcaaatcaggtttatatgattgattttggactagcaaaagaatatagggaccctttcacaaataagcatatcccttacagagagaacaaaggcttaacagggactgcacgttatgcaagttacaatgctcactcaggaattgagcaaagtcgtcgagatgatttggagtctcttggctatgttttaatgtactttttaagaggaagctatgaagggcttgacttcttggttcttgcattttttagccttccttggcagggtttgcaagctgtcaccaaaaggcaaaaatatgacaaaatttgcaaaaagaagttatcaactcccattgagttcctttttttttgtcataagtcagagattacagatgttcctcaatccactaggtaa

SEQ ID NO: 29404 - DNA, 117 bp, Glycine max
  Peptide Sequence Number=SeqID_146182
atggcaaccatcatggctatcgagtttgatgccagcaacaaccggtctaagctatggctggaaacaaattctcagctccttgtccatgctttcactcatcctacgatagaattttaa

SEQ ID NO: 29405 - DNA, 1134 bp, Glycine max
  Peptide Sequence Number=SeqID_146183
atggcagaatcgtcaaagaaacgaaagggttcttccgcctccgcttcggcttcaagagctcatcgttctggagccactagcgcatccacagcaccaattccaccctcattgtcctcttccccaatgttttcttccgacgaacagcagaaacggtactccaatcttttctcatctcgttccattatcgaccctaagtttattgatatggaattcttttctgctgaaacctttgattgcattcaagcctttcagaacttaggtcttctaccttttatgtcattacaattgcctatttatcctgaattggttaaagctttttattgtaatcttgaaattcaggacatcactctgatttctgaaatttttgggataaaaatggtcattgaccagtcccttttctatgacttaaccaaattacccagtgacggtgtaccatttgaaggcacactgaatgacgactggaaatttgatttctctgcccatgatgcccgccagttggtttgcaccaacaatgcggatatgaccggacgtcttcttgctgggtcattggcttttgaaagatgcatccttcactatttaattgtgcgcattttgcttccacagtcttccaaccttgcccaggtttctgaggaagatctaattatcatgtgggcctttcatacagggcgtcaacttgactgggcacacttagtcagatatcgcatgcataaggcattgcgattaaatgctccactaccatatccacagcttgtcactctctttttccgccattttcaaattcctcctgattctgaaccttacgttccaatcaagagatcctttttaattggtgctgctgtgattgcttcttttggttaccgcaaagagcatgatggctcttgggtcaaaaagggtgctccacccgctgatgatgaaggcaaccaaccagttgaagataattcctctcttcttcgaaagcttttagaaaagttcgatggtcttcaaacttttgttggtgataagtttgataatatggaattgcaagtcaacatgcggtttgatgccatggaatcaaggatcaccaaagttgaagaagatgtctccttcatccgtacttgctttgatccaccaccaccgcctccatcatcctcttag

SEQ ID NO: 29406 - DNA, 348 bp, Glycine max
  Peptide Sequence Number=SeqID_146184
atgttggtgcgcatgatccgcactcgtctctttgcagcggcacgggtgaaatcttgccccagtatgcatagtagcagtgtgatagcctccctctctggttgtgctcgcacagttggtcgtcctccaatatcagggggtggcccaagaaccgttaaaaggaaactactggtgcggatgtggagcacactgaaaatgaggacacgtagccctctaaaggtgagggcgtgcaaccctctcaaggcgaggatgtatagtcctctagaggtgagggcgtgtagtcctctcaaggtgagggcgtgtagccctctgacggtgagggtaactagtacccaaggtgaggacgtgtag

SEQ ID NO: 29407 - DNA, 165 bp, Glycine max
  Peptide Sequence Number=SeqID_146185
gtgttgatttgcatcacgagttttctgctgaggctgagcaaaaagggcggagacagcgcgcaagaagaaatcctgatcgtgaagcctgaaggtgggatcgaccatgtggcacatcctcacgccatcacggacaccataatgaatgattttaatgtctctgtttaa

SEQ ID NO: 29408 - DNA, 486 bp, Glycine max
  Peptide Sequence Number=SeqID_146186
atgggggcatactctagggacgagaaactgctgatgcatttcttccaagaaagcttggccggggtggcagtcatctggtataccaatttggaaacttctcgcatgcgctcatggaaagacttgattactgcctttattaggcaataccaatacaatactgctcctgacacaacccagctgcagaatatgagcaaggactttgcagcgcaagtggcaccccccatggtagaaagagagattatcacaatgatagtagacacgctgccggtattctactatgaaaagttggtgagctacatgccctctagcttcgcagatttagtgtttgcgggtgagaggattgaagtaggcctggaaagagggaagttcgattatattgcttcggccagtatgagcaatagaagattcagagcaactggggaaaagaagaagaaaggggatgcccatgcagtgacttcagctcctacttggccgaagccccaataa

SEQ ID NO: 29409 - DNA, 264 bp, Glycine max
  Peptide Sequence Number=SeqID_146187
atgtatattcgcttaagtaatggtgtgttgttgggtgaatgttggctgacgttccaagaggacggtccaaacataaagacaaactctcttgccagtcatgggggaccagcagttaatgcggtagaggagtgcagacctcagaggccgaagcaaatgaaagatgtggaaacctctaggaggtttgtactaaaggcgttgcacgaggtgggcatcgttggctttgacgggggatacctgcttagtacactcgggggcagtgcatga

SEQ ID NO: 29410 - DNA, 357 bp, Glycine max
  Peptide Sequence Number=SeqID_146188
atgacttttcctgaatttaaaacacagcttgatctcctacgcgagtgtcggcagatcgtggcgattgtttccgaagtagcgaagcagagttttaagaagaaagggatgcacgctcctgcggagaaggagaagcaacccccgtcctcctctgtgcaagttgtcgtcaccgtcgcggtgccagaaacggtgtcctacggtgacgcgatgtcgatggagagcaatagcaatgagttggagctgagttttagtgagaaaatgtcatcgcagcctgaatccgatgaggttaaggcggtggcgacgacatcggtgtggcaatcgcaggtgaagccgaagagtgttgagagagctagggactaa

SEQ ID NO: 29411 - DNA, 549 bp, Glycine max
  Peptide Sequence Number=SeqID_146189
gaagaaagggatccagaaagcaatccattgaatgagccacttctcaagaggaacaggactttgtcttccaatccacttgctcttgttggagcaaaagtttcctacatagaaagcttggactacgagatcaatgagaatgacctgttcaaacaagattggaggagcagatcaagaactcaagtgttgcaatacatattctggaaatggactctggcattccttgttggacttctcactggtgtcatagccactcttatcaatcttgctgttgagaacattgccgggtacaagtttcttgctgttgtcaactttatccaaaaagaaaggtacttgagaggtttcctatatttcacgggcattaatttccttttgacatttgttgcttctattctgtgtgtgtgttttgcacccacggcagctgggcctggaatacctgaaatcaaagcttatcttaatggtgttgatactcccaacatgtatggtgccaccacattgtttgttaagatcagcatttatggaattcaaaccttaacatttgcacttgtctaa

SEQ ID NO: 29412 - DNA, 129 bp, Glycine max
  Peptide Sequence Number=SeqID_146190
atgctccacaaagccatgattgtaggggcggaattccgaaagaggtttataggatgtttcaaacgtacgatgaatgatatgtcggacacgggaaatctgtcgcagcaactccaagccaagggaaagtaa

SEQ ID NO: 29413 - DNA, 1818 bp, Glycine max
  Peptide Sequence Number=SeqID_146191
atgtcatttagagagttccatgcgaatggaagccgcatggttacatctgaagttgaggccaagcttgatcaaggaaatattcaagaggcagaagaggcattgcgagaagggttgtcgctcaattttgaggaagcaagagctcttcttggaaagttggagtatcagagaggtaatgtagaaggtgctcttcgtgtgtttgatgggattgatctccaagctgccatacagagattgcaaccttccttttctgaaaaaacaccagtgaagaaaggtcgcactcgcactgaatcaccctcctcagtctctcagcatgctgctagtttggtgcttgaagccatctacttaaaatccaagtctctgcaaaaactggggaaatttactgaggctgctaatgactgtagacgtattcttgatgccgttgagaagatattttatctggataatcctgatattcaagtggataatagattgcaaggaatagtcagccatgcagttgagctccttccagagctttggaaacaagctggttgctatgatgaggcaatctctgcttataggcgagcccttctcggtcaatggaaccttcataatgatttctgtgcaagaattcagaagtcatttgttatttttttgctatacagtggggtggaggcaagtccacctagtttagcagttcagattgatggatcatatgtgcctaaaaataatcttgaagaggctattctgctattgatgaatttcttgaaagatttttgccttgggaagatgaaatgggatccttcagtcatggaacacctgacttttgcactttctatatgtggtggaacttctattttagcaaagcaacttgaagaattgaggcctggagtataccatcgaattgattgttggaatactttagctttatgttatagtggagctggacaaaatgacagtgctttgaatctgctaaggaagtctttgcacaaacatgaacgaccaaatgaccttacatcattgttgttagcagccaagatctgcagtgaggatccctatcttgctgctgagggagtgaaccatgcacaaagggcaatcagtaatgctcatggcccaaatgagcatttaaaaggtgttgctcttcggatgttgggactttgtctgggaaagcaagctaaggttgcttcctctgactttgagaggtctcaccttcagtccaaagctcttgagtcattggtggcagcaattagattggagccaaacaattctgatctgatttttgaactggctgttcagtatgcagagcaccgaaatttgcctgctgctttgcgttctgcaaggcatttctttaacaaaacaggcggttctgtatcgaaatcttggagattgcttgctctaattttgtctgcacaacaaagattttcagaagctgaagtggtgacagatgctgctttagatcaaactgcaagatgggagcaggggcctctgcttaggctgaaagcaaagttgatgatctcccaatcacgacccatggatgctattgaaacttatcgataccttcttgcattggttcaagcccagaagaaatcctttgggcctctccaaattagttcaaaggttgaggaggacaaagtaaatgaatttgatacttggcatggtctggcaaatttatatgctagtctttctcattggaaggatgctgaaatctgtttgcaaaaggtcagggagttgaaggaatactctgcagcattgatgcacactgaaggcaagaccaaaacctttttgctgtttgaagttttctattcaagcatgttgaacttaaccccaccccttttgatctaa

SEQ ID NO: 29414 - DNA, 693 bp, Glycine max
  Peptide Sequence Number=SeqID_146192
atgggtaatccacggaaaccgagtaccgccgacgagcttcacacggcggcaaggtccgcaactttggacaatagtctgcatttagctgcattttctgggcaagcagaggtagtcacttatctctgcaagcagaaggctgatgttggtgcttctgcaatggatgacatggctgcaatacactttgcttcacagaagggacatttagaagttgtccgcgctctactttcagctggggcctctctcaaagccaccacccgcaaaggcatgacttcattacactatgctgttcaaggttcccatatggaactcgtcaagtacttggccaagaaaggggcaaaccttggtgccaagacaaaggcaggaaagacccctttggatcttgctaccaatgaagaaatccgctcctttctggaggaatatgagaagtcagcaaagaatggagaattgggaaagaaagacaaagataaagctgaagaatctgatccaaagacatccacattgggatctgaaggtgatttgagttctgaacctgctgcagctgctattgatgaagaagacaatgtgggagagaagaggaagaagggtaatgaagatggcacaagagaagaagagtcatcacaaccaaaaaaggctagagttaacttaagtcatctccaaagttccgacgatacccaagaagaagaaaacctgtag

SEQ ID NO: 29415 - DNA, 243 bp, Glycine max
  Peptide Sequence Number=SeqID_146193
aggtttgtgtcggagatcgaacgcacgttgaagcccgagggggtgtgcgttctgcacgtggctctgtcgaggcgtgctgataagtactccgctaacgacctctacagcgtgcagccactcgtggagctattcaagcgttctgctttggttcacgttcgcagcgtcgatggttttggattggacaccgaggttgcgtttcggaagaagggggaacctcctcctgctgctcatcaccgtttgtga

SEQ ID NO: 29416 - DNA, 234 bp, Glycine max
  Peptide Sequence Number=SeqID_146194
atgcagaatcaagcataccagcaagttatggatgaagcagagaaggaatacaaaaaggtgtctgaaagaataacggaaagcagagatgcaatgaaggcctcttatgaagaattcatggcagaagcacaagccagcgcttctcgtgcatgcaaaacttcaatcgttgagctttcgcagtcgtttgagaaggctattgactctcttcgaaaccgttacggaattccatcaaattag

SEQ ID NO: 29417 - DNA, 327 bp, Glycine max
  Peptide Sequence Number=SeqID_146195
atgaagaaaaccggaaagaaaaccaaaccgacggtggcggatcttctgaaatcaccgtcgccggtggcttcaccgacggcgaattctccggcgattttcaagagagcagtttcttcctcctccaagggcgcgaagagaggttcgcgagttgctctcgccaccagcacttctccacctcgcggtcacagagctccgagcaacatctccgacctcaggaacttcgcctcttccggcgtcgacgatctcaaacgccgcatcgatcgctctcactccgagatcctcaaggatctcgaggcttctaactctcgtctccacaaacgcttcaag

SEQ ID NO: 29418 - DNA, 753 bp, Glycine max
  Peptide Sequence Number=SeqID_146196
atgagtactaagaagggttgtccaagccatgcagaagcaatgcaattgaagcaaccaggggcaccattcaaatgcagtggatgtaaacaaatggggttcggacccagttaccactgtgaaagcagcaactgcagttacgtcctccatgaagagtgtgcaaacgctgtttccatagccttccatccctttttctcgaagagcaatttcgagtttcatgagaaagcacctgggaaacgcacaaggtactgtgatggctgtggaaaagatgtgttagggtttgtgtaccactgctccaccacaggatatgatcttcatccatgctgcttgaagctgaaacacaacatttccgaccaagaggggcgcgtgacgcttgaactgtgccagaaggttccatccaagtgcgtgaagtgtaagcataggaatgttgtggagagagttaaagggtggtcttatgtgtcttctgggggggattgttgttaccatgtgtcttgtgtgaaggaactgattcttgagaattggaagaagggttatttctctcaagaaaccaataattcaattgggatgagtagtgacagggagaacactcaagttgcactgagaagcatggagattgttccaagtggaagaaggtcaaggagaatcaacaagtacaccaagattgctgtgttggtgttcaagctagtggtttcggctatttttggaaaccctatatctgccattgctgctcttgtggaagcccttgttactgattga

SEQ ID NO: 29419 - DNA, 312 bp, Glycine max
  Peptide Sequence Number=SeqID_146197
atggcgaccatgacgagcttgattggactcatcaacaagatccaacgtgcgtgcaccgtcttgggcgaccatggcggtgagggaatgtcgctgtgggaggctcttcccaccgtcgccgtggtcggaggacagagttcagggaaatcgtcagtgttggaaagtgtcgtgggaagggattttctgccacgtggatctggtattgttacacggaggccactagttcttcaacttcacaagacagatgatgggcagcaggaatatgctgagtttcttcatgcatcaagaaagagattcactgactttggtaaatga

SEQ ID NO: 29420 - DNA, 1902 bp, Glycine max
  Peptide Sequence Number=SeqID_146198
atggctccctgtgcggctgcggcggagtttccggtgggtctccgggttcttgtggtcgacgacgacgccaccacgttgaagattatcgagcaaatgtccattcgctgccgttaccgcgttaccacatgcactgaggctactgtggctttgaatcttctgcgggaaaggaaaggttgttttgatgtggtgctgagtgatgttcatatgccagacatggatggctataaactccttgaacatgttgggctggaaatggaccttcccgtaattatgatgtctggtgatagtactacaagtgctgtcatgaagggaatcaggcatggggcttgtgattatttgattaagcctgtacgtgaggaagaactaaggaatatatggcagcatgttgttcggaaattctggaatgacaataaagaactggataattctggcagcatggaggacagtgatcgaaataaatgggggaatgatgacgctgaatatacttcttctgttgctgatgcagcagaagtagttaaagcaccaaaaaagaggagcagtttaaaagaagaagatattgaattggagagtgatgatccagctacatctaagaagccccgtgtagtgtggtcagtagaactgcatcaacaatttgtcagtgctgtgaatcaacttgggcttgacaaggctgtgccaaagagaatacttgaattgatgaatgtccctggtttgacaagagaaaatgttgcaagtcatttgcagaaatttagactttacttgaagcgattaagtggagtggcacagcaacagaatgggatgctaaatgcaattccagggactatagaatccaagctgggtgctactggaagatttgacatacaagctttggctgctgctggccatgttccccctgaaacacttgcagcccttcatgctgagctcttaggtcacccggcaactcacatgatgtctacagtggaccagactaccctactgcaagcatcgatacaggggctaaaacattcccatgctgaacatgctgtggcgtatggtcagcctcttgtaaagtgtcattccaacattggcaagaatttctctccatctatcttaactgtaaatgatacgtcatcaggatatggtacatggccatcatctaataatacaattggtttagtgagacccaatagtagtgttgaaagggtgggtattcagaataacaacatgctgatggatatattagagcaccaacaaagccagcagcaccagcaaaagcaacagctgcagcagcagtcactgatacatgatcaaagttgttcaatcaatgttcaaccatcttgcatggtggttccctctcaatcctctgacactttccaggcagtaaatagtcctgcttctgtcaaccaggatttcagttttgccaggaatgccattattgattatagtctattgtcacaaaaatcaaagaattcatttagtgcatctcaatttcctggtggggacacaaaagctcgaggtgttctctatgggtattctacaccctccacttgttcaacaagctccagcaatggcaatagacaacagcttcaaaactccactttaacatttggtgctgcaagacctttgcctagtcttttgcccatgtctgacagaaaagatccctatggttttaaatcaggtgatttacttgatcaagtatgctttaggaatcttgggtttgttggcaaaggtacctgcattccgagtaggtttgtagaaaatgaaattgagtcatctgtaagtgattttagtcaaatgaaagtcaatgtagatagcagtggcaacacacggaatcaggagccaaattttataaatattccaaaagtgagccaccctatcatagaaagatatccatctcgtgatcattcacgtgtgttcactgaatag

SEQ ID NO: 29421 - DNA, 372 bp, Glycine max
  Peptide Sequence Number=SeqID_146199
atggcttctctgctgaacctcccgtccttgagctccgttttcttttcccaaacggcggagccgagggcgcaccagcggcggggggtggagagggtggggccaaaggaccaggttttggtgagggggtggaagatcaaggggcgggggagggccggggagaggttgtgggtggtggcggcgaggaggacgaggcggttagcggcggagacggactggacggagaggttgcgggagaggaaggaggggtggcggcggaggagaaggtggtggaggggtgggtggggagggagggggagccacgtggcggagatgggatcgaaggtgtggaactggatgacggcggaagagtgggagtgggagagaatggcgtag

SEQ ID NO: 29422 - DNA, 585 bp, Glycine max
  Peptide Sequence Number=SeqID_146200
atgtaccataccacacatcccatgaaaagtgtggccaaatcatggacaatgatgatgccatcacctatgcagcatataccattaccatcttctctaatgaataatatttccactcacaattcaatcttgtgttgtgactttaactatgtgaatttgagcaaccaaagaggtacaaggcttttgtgttcagcaaggaggcaaattagataccaagatgatggggatgataaagatagtgatgaagagtatgggcacaatgaggagattgccaagttggagtcttatagtcaatcagcaaaaggagaagtactccttgtgcatgcacttgtggaccaggaggaagttgatgtgcttatcttcaagaaagatgtctcccaacagaaatttgattgcaacacttttcaggggttctcttcatgcttgagctacagtacctcccctgacccaacaagaagcattcttccagctagggcagtgatagtgtccatagatagaatcaaaggaccttttaaccctgccaatattgagtatctacaaaagggtgtaacatgggaagaattcaagacaaatctcctctctaattaa

SEQ ID NO: 29423 - DNA, 1437 bp, Glycine max
  Peptide Sequence Number=SeqID_146201
atggatgtcaataacattaaatctcataactctgctgtgagacaggaaatttcagatgaaacagatcgtataactggcaagacaaaggcaatctcaaacgttccaattcaactgagcatatattctccaaatgttgtgaacttaaccctcatagaccttcctgggttgacaaaggttgctgtagagggacaatcagacaccattgttcaagatattgagaacatggtccgttcctatgtcgagaagcccaattgtattatattggccatctctcctgcaaaccaagatattgccacttcagatgcaataaaaattgcaagagaagttgatccttctggggaaaggacatttggggtggttacaaaacttgatcttatggataaaggaactaatgccgttgaggttcttgaaggaaggcaatacaagttgcagcatccttgggttggaattgtcaatcgttcacaagctgatattaataaaaacgttgacatgattgtcgctcgcaagaaggagcgtgaatattttgagactagtcctgaatatggacatttggcacataaaatgggtgcagaatatcttgccaaacttctatctgagcatttggagtatgttattaggatgaagatacctagtatcattgccttaataaataaagccattgacgagcttaatgcagagttggaccgaattggcaggccaatagctgtggattcagggatgtgtcgagcatttgacaaagtatttaaagaacacctggatggaggacgtcctggcggggatcggatatatggtgttttcgaccaccaattaccagctgctttaaaaaagctcccttttaatcgccatctttcctcaaagaatgtcgaaaaagttgttatggaagcggatggttatcagccacatctaattgctccagagcaaggatatagaagacttattgagggatctattggctatttcaaaggcccagctgaagcctcagtggatgctgtccacctcattttaaaggagcttgtaaggaagtcaattgcagcaactgaggaattgaagaggtttccaacccttcaagctgatatagctgctgctgcaaatgatgctttggaacgattccgagatgaaagtaggaggactgtgacccggatggttgatatggagtctgcctatctaacagtagaattttttcggaagatgcatcttgaaccggaaaagaatgcagatcaaaagaaccccagtcggaataatcctaatccccccgtggacagttacacagatactcacctcagtaaaattggatcaaatgttaatggctatatcaacatggttttggatacactaaaaaattcgataccaaaagccgtggttcattgtcaagttagagaggcaaagagatcattgcttaaccatttttatgttcaagttgggaggagagaggtatga

SEQ ID NO: 29424 - DNA, 813 bp, Glycine max
  Peptide Sequence Number=SeqID_146202
atggtgctagcgcattcagcaatctcacacttacttggtttgtttgcaggcgctggtcaagaagttggcaagagctgcgtggtggtaaccatcaacgccaagcgaatcatgttcgattgcggaatgcacatgggctacttggatcatcgtcgttaccctgatttcacccgcatctcccccagtagagatctcaactctgccctctcttgcatcatcatcactcactttcacttggatcacgttggtgctttagcttacttcactgaagttttggggtataacggaccggtttacatgacgtacccgacaaaagctttggctcctttaatgttggaagactatcggaaagtgatggttgatcgccggggggaggaagagctattctcttctgatcaaattgctgagtgcatgaagaaagttattgctgttgatctgaggcagactgtacaagtagagaaagacctgcagatacgtgcctattatgcaggacatcaaaaccatcttatacagcaagtgggagtgcacacggattctgggtgggaatgggactttaggtggaggagatcattatttgacagtgaggttatcaatgctgacagctttttaaatgatattgagggcaagacagttcacccatgtagaagagatgagtgggtttggaaagctgagccaagcggcatctattcgacacaaagcgcgtataatctgctgcaaggggaaatcatagaggccagtgatgatggagtttttgcggagctatggaaattaaaggtcccaaagaaaatttcagtttttgcttggagattaatttga

SEQ ID NO: 29425 - DNA, 399 bp, Glycine max
  Peptide Sequence Number=SeqID_146203
atggtcaacgtcaagggcgacgccgcgaaagaaggggttgtgtatgacgtggcggaggatgcttggaaggagatgccggaggggatgttacacggttggagaggacccgttgcggccatggaagaggaagtgatgtacgttgtggacgaagcgaaaggtgttctcagaagatacgtggaagaagaagactcgtgggaagagattctcgagaacgagagactcaaaggagctgaaaaaattgttgcttggagagggaagttgtgcgtcgtttcggcttcttccgggatctccgtcgtcgatgtcgctgcgccgtcgccgcggatttggtcggttcggctgccggaagggttcgagccggtgactgttcacatcttgccccggataccggccggtgtatga

SEQ ID NO: 29426 - DNA, 1863 bp, Glycine max
  Peptide Sequence Number=SeqID_146204
atggccaaaaaatatgagggatgcgcagtgggaatcgaccttggtacaacttactcgtgtgttgcagtgtggctggagcagcactgtcgagtggagatcatccacaacgaccaaggcaacaataccaccccttcttgtgttgctttcacagaccaacagaggttgatcggtgaagctgctaaaaatcaggctgccaccaacccagagaacactgtgtttgatgctaagaggttgattggtaggaaatttagtgaccccgttattcaaaaagataaaatgttgtggccattcaaggttgttgctggtattaatgacaaacccatgatttcccttaactacaagggccaagagaaacaccttttagctgaggaagtgtcatctatggtcctcataaagatgcgggagattgcagaggcatatttggaaacacccgtagagaatgcagtggttactgtgcctgcttatttcaatgactctcaacgtaaagccaccatagatgctggtgctattgcaggcctcaatgttatgcggataatcaatgaacccactgctgcagctattgcatatggccttgacaagagaactgattgtgttgaagagcgaaacattttcatctttgaccttggtggtggtacttttgatgtatctctcctcacaattaaggataaggtctttcaagttaaggctactgcaggaaacactcaccttggaggggaggactttgacaaccgaatggtgaactactttgtacaggaattcaagaggaagaacaaagttgacattagtgggaacccaagagccctaaggaggttgagaagtgcatgcgagagggcaaaaaggatactctcatatgcagtgactaccaacattgaggtagatgctttatttcagggtgttgatttttgctcctcaatcactcgtgcaaagtttgaggaaatcaatatggagctctttgaagagtgtatggaaacagttgataggtgtctttctgatgctaacatggacaagagcagtgtacatgatgttgtccttgttggtggttcttctaggattcccaaagtgcaggagctattgcagggcttcttcgatgggaaggttctgtgcaagagcatcaaccctgacgaggctgttgcttatggtgcagctgtgcaggctgctttgttgagtaaaggcattgtgaatgttccaaacttggtcctattggatattacaccactgtctcttggtgtatcggtacaaggagatctcatgagtgtggtgattcctagaaatactaccattcctgtaaggaggacaaaaacatatgttacaactgaagacaaccaatctgctgtcatgattgaggtttatgagggcgagagaacaagagcgagtgataacaatttgctgggtttcttcacactttctggcattcctcctgctcctcgtggccatcctttgtatgaaacctttgacatagatgaaaatggtattctatctgtttccgctgaggaagaaagcaccggcaataagaacgagattaccataaccaatgagaaagaaagactgtcaaccaaagaaattaaaagaatgattcaagaagctgaatattacaaggctgaagataagaaattccttaggaaggccaaagcaatgaatgatttggattattatgtttacaaaatcaagaatgctttaaagaaaaaggatatcagctcaaagctttgctcaaaagaaaaggagaatgtcagttctgcaattgcaagagccacagatttgcttgaggataataaccagcaggatgatatagttgtgtttgaggataatctgaaagagcttgagagcatcattgaacgcatgaaggccatgggaaaaattggttag

SEQ ID NO: 29427 - DNA, 1803 bp, Glycine max
  Peptide Sequence Number=SeqID_146205
atggcggaggtttccggcgacggcggcggcgccgcgctgtcggtgtcgggatcgttcaaggaggggagaggctcggcaaggcggcgcggcggcggaggaggagtgaggccgccgagcatggacgccgacgagttcatgaatttgttgcacggttcggatccggtgaaggtggagctcaatcgcctcgagaatgaagttcgagacaaggacagggaattatcggaagcacaggctgagatcaaagccttgaggctctctgaacggcttagagaaaaagccgttgaagagctgacagaagaactgtcaaaggttgacgagaagctaaaactaacggagtctcttctagaaagcaagaatcttgaaataaaaaaaatcaacgatgaaaagaaggcatcaatggcagctcagtttgcagctgaagccactcttcgaagggtccacgctgcccagaaagatgatgacatgcctccaatagaagcaattcttgctcctttggaagctgaactcaagcttgctcggcaagagattgctaaactacaagatgataacaaagctttagatcgtcttaccaaatctaaagaagctgcactacttgaagctgagaggactgtccaggttgccttggctaaggcctccatggtggatgacctgcagaacaaaaatcaagagctaattaaacagattgagatttgccaggaagaaaataaaattttggacaaaatgcatagacagaaggtggcagaggttgaaaagctcacccaaactgttagagaactagaagaggctgtccttgcaggtggtgcagctgcaaatgcagtgagggattatcagcggaaagttcaagaaatgaatgaagaaagaaaaactctagacagggagttggcccgtgccaaggtaacagcaaacagagtagctgttgtggttgcaaatgaatggaaagatgccaatgataaagtgatgcctgtcaaacaatggcttgaagaacgccgattcttgcagggagaaatgcagcaacttcgtgacaagcttgctatagttgagcgcgctgcaaaatatgaagcacagttgaaagaaaaatatcatttacgacttaaagtgctagaggagagtttgagaggaaattctaacagtagtaatcgcggtacccccgagggaagaagtatgagcaatggcccttctcgtcgtcaatccctaggtggagctgataacttctcaaaactaacctcaaatgggtttttatctaaaagatcaccatcctctcaactgaggtcatccctatcctctagcacagttttgaagcatgctaaaggaacatctaaatcttttgatggtggtacaaggtcactggaaaggagtaaaatgctgttgaatggaacacctccaagttactcatttaaccaatctatggaagaaaccaaagagagagaggcaagtgataattggaaaggaaattcagatgataagccaaatgatttcccaactgtggattcagtggatagtgttcccagtgttttatatgactttctgcaaaaagaggtcatagccttgaggaaagctggtcacgagaaagatcaaagcctaaaagataaagatgatgctattgagatgttagcaaagaaggtagatacattgaccaaagccatggaagttgaggcaaagaagatgagaagggaagtagctgctatggagaaggaggtagctgctatgcgtgtggagaaagaacacgagaacagagcaaagcggttcagcaatataaagggccctgtaaacattgctcagcaacagctaatttctggaaggtaa

SEQ ID NO: 29428 - DNA, 243 bp, Glycine max
  Peptide Sequence Number=SeqID_146206
atgaatgtgaatagaaaagattttggaggtggagagaaagtgcctgtcaatttcacatcaaggcttaaagtggaggcacaaccacataagtgtataagtgaagttcaaaacgaatcacaaaaagatgaggcaagtggaccaaaaggagttgggtcaaaagggaaacaaagacaactaaattcatcgtgtataagtgaagattcatctcggttatcaaagtgttttgaaggcaaaagattttaa

SEQ ID NO: 29429 - DNA, 1032 bp, Glycine max
  Peptide Sequence Number=SeqID_146207
atggccgacgctctctcggtgattccggccgccgtgcttcgcaaccttgccgacaagctctacgagaagcgcaagaatgctgcacttgaggttgaggggatagtgaagcagcttgctggtgctggggatcatgataggataactgctgtgatcactttgttgactacggaatttacttattcgccacaagcaaatcatcgcaagggagggttgataagcttagctgctgctactgttgggttgactactgaagctgctcagcatcttgagcaaattgtaccacctgtattaaattcttttgccgatcaagatagcagagttcgttattatgcttgtgaagcattatacaacatagcaaaggttgtgagaggagattttattatattcttcaaccagatctttgatgccttatgcaagctttctgcagactcagatgccaatgtacaaagtgctgcccatctcttagatcgacttgttaaggatattgtgactgaaagtgatcagttcaggtgccccttcttacttctatgctatacgtttctctgtatcctgtttattgaagaatttataccattgttgagggagcgcatgaatgtactgaatccatatgtccgtcagtttttggtaggatggattactgtattggacagtgtcccagatattgacatgcttggttttcttcctgattttcttgatgtgctactcttgaagtctgtagattatggtcgaatggctgaaatactggtacaaagggcaggttctccagatgaatttactaggttaacagctatcacatggataaatgagtttgtcaaacttggtggagatcagcttgttccatattatgctgacattcttggagctgttttgccttgcatatctgataaagaagagaaaattagagtggttgctcgtgaaaccaatgaagagttacgtgcaatcaaggccgatccagccgaagcatttgatgtaggagcaatcctctccattgctaggagtgctttgggaatccaagaatataaagggaaatga

SEQ ID NO: 29430 - DNA, 894 bp, Glycine max
  Peptide Sequence Number=SeqID_146208
atggcagagcgcggaggtggcgaacgtggcggcgaccgtggcggtttcggacgcggcttcggcgggcgagggcgcggaggcgacaggggccgcggccggcgtagaggtccccgccgcgaggaggaggagaagtgggtcccggtgactaagctgggacgcctggtgaaggaaggaagaatccgaagcctggagcagatctacctccactcgctgcccatcaaagagcaccagatcatcgacacgctggtgggccccaccctgaaggacgaggtgatgaagatcacgccggttcagaagcagacccgggccgggcagagaacccgtttcaaggccttcgtggtcgtcggcgacaacaacggccacgtgggtctaggcgtgaagtgcagcaaggaagtggccaccgcaattcgtggcgcgattattctcgcgaagctttcggttattcccgtgaggaggggttactgggggaacaagattgggaagccccacaccgttccgtgcaaggttaccgggaagtgtgggtccgttaccgttaggatggttcccgcgcctaggggttccgggattgtggcggctagggttcccaagaaggtgctgcagtttgctggtattgatgatgttttcacctcctccaggggatccaccaagacccttggcaacttcgttaaggctacttttgattgcttgatgaaaacctatggattcctgacaccagaattctggaaggagactcgcttctccaaatctccattccaagagtacacagatctattggcaaaaccaacagggaagactctaatcttggaggaggaaaggctaagtgacagattgcagagaggagcaaatgagtttctgcgatgccctttcaagcttttcagtagaaatacagtataa

SEQ ID NO: 29431 - DNA, 1959 bp, Glycine max
  Peptide Sequence Number=SeqID_146209
atggtatcagatgcaagatttttgccacctgccgctgctctatgttcactattgagtgtcgcgagactcatgcataatgtcttcctccaacgctctcagatcatcaaaactgactgggaggctgcagcaaaccctagcggattgcgtggagcggcaaggcaaggcgttgcattcgggaaaggtttcgacggtgagactgtgtcccgaacgcgcttcccgaggcaggtctcgcccctctgcaccactctgtacaaaggcgggttccgaattcgaaccgtggagcacttgctttcggctttggaggcttcgggtgtcgataattgcaggatcgagattgaggattcggatactcaaggacacgacgcagagattcctatatttgatgggtctgcaagggaatgggtggctgcagtggaagaagttggtttgacagtggccactgatcttgatggcaaaagtgttgagaaaatggcaccacatgtgaatgaaccagtgtatgcttggagaaatgattcttttgttgctgcatttccttcagaagtggttcgaataacttatggcattaacttttcgcaggcacctgttattggctgccagtggttttctacaccccccttggataatttggtgtattccatgcagatagctttgtcaagaaccttctgcatttatgaagaggttgagcaaatgcgcaatgctggacttatcaaaggaggttctctagaaaatgccattgtgtgcagtgccagtaaaggttggttgaatccacctttgcatttcagtgatgaaccatgtcgtcacaagatcttagaccttattggtgatctgtcactgtttgcccagtttgggaatcaaggactcccagtggctcatatcgttgcgtacaaggcatgtgacttcgttggagtagttgttcaacctgatgcttctgagctcttatttatgtgcagccaaggtggaagaagaaatgctgaaattcctaaacatcttagacctcgccctgccatgtcatcacaaaccgcgcccacggaggcgccggagccttatacgccgcttctccgctcccgcaccgatgccggccgaggtcccgcccccgcgctggcgctccttctcggccgcgccggccgccgtggcccatccatgctggtacgtgagacggcggcgcgtgagctcgaggagcgccgcgctgactggggctactccaagccggtggtggcgctcgacatgtcgtggaacatggccttcgtggtcgtctcggcggctatgctcgcatgcaccacctccgagcacccgaccacgccgatccgcgtgtggatcgttgggtacgcgctgcagtgcctcgtgcacgtgttgctcgtgtggctcgagtaccggcgccggagccggagggactctcgcagcggcagccagagggcgcgggacgtggagagcgacgccggcagcggcgacgatgacgactacagtgacgacggagatgggagctctggcaacacgtctcgctccaggttggctgttgtctttctggcatttgatgtcttttttgccatcttttgtgttgtcttggcatgcttgattggcattgctctctgttgttgtttgccctgcatcattgctattctctatgctgttgcaggacaggaaggtgcgtcagaagcagatcttagcatgcttccgaaatacaaatttcgaatattaagtgatgtggataaacctagtggtggagctggatcaatggttcccatagaaaccagcagtgcttacttggaaaatgaacgaacacttctactcgaggatgcggaatgttgtatatgcctctgttcatacgaggatggagcagagctgcatgctcttccctgcaaccatcatttccattcgtcgtgcattgtgaaatggctgaagatgaatgcaacttgtcctctctgcaagtacaatattctcaagggaaacgaacaagtgtga

SEQ ID NO: 29432 - DNA, 348 bp, Glycine max
  Peptide Sequence Number=SeqID_146210
atgaaacaatccagtttccgtcagaaaagaaatgaacaacctacaaattggacatctctgaatctaacaaaggacgaaataattctaagtagactacagttgctaacttattcgtcaataaatgctctatatatcttttctctacagaaacagctaaacgaaacaaccatcaaaacccagcgagtagggaaagaggacaagttgcattcatcttcagccatttcacaatgcacgacgaatggaaatgatggttgcagggaagagcatgcagctctgctccatcctcgtatgaacagaggcatatacaacattcctgaaaagcaacaacagcagataataataaaatag

SEQ ID NO: 29433 - DNA, 612 bp, Glycine max
  Peptide Sequence Number=SeqID_146211
atggtggcagcacataatgctgccataaaaaatatggaagatgatggttaccagttacaagtgaagtattgtgtgcctggaacaataggtcataaattaatgtcagataagcatgacaaagttgacctggatcctaatacaaaaatagatgtgcgttgccagattcatcagttggcttttagtcctcacacggattctaaagggataatggatcttgtaaattttctctccccgaagcatgttatactagtgcacggcgagaagcataagatggcttcccttaaagaaaaaattcattctgaattggggattcaatgttatgatcctgcaaataatgaaactgtaaccattccttcagctaactatgtatatgcagagacctcagacactttcattcgaagctgcttgagtccgaacttcacatttcagaagtgcagttcggtggacttatgtaactcaactacggtagacagaaacttaatgcctgagcttcaagttgaagatgaaagggtagcagaaggagttttggtcttggagaaaggaaaaaaggcaaagattgtacaccaggatgaacttttgcttatgttggaggaacagaagcacgatgcttag

SEQ ID NO: 29434 - DNA, 144 bp, Glycine max
  Peptide Sequence Number=SeqID_146212
atgccaagaccagacaaacccaattggcctacgatgcattcgcgctcagcgccacacctcgcgcttagcgcgttcagatcgtgcgctgggcgcgccatgcacgctgggcctgtgcttctgttggatcgggcactgggcgcctag

SEQ ID NO: 29435 - DNA, 1659 bp, Glycine max
  Peptide Sequence Number=SeqID_146213
atggactcaaactcaaaggctgtgtgcttcataacccaccaagccattttcaacgcggttcgatgtggggaccttgaagggctgaaggagcagctgaagaacaagggtgaagagggggtttctgaggtgatgtctatgcagaacgatgcaggggaaaccatgttctacatagctgctgagattggtcttcgtgaggtgttcagcttcttgtttggtttatgtgacatggaggtgctgaagatcagggccaaatcggatttgaacccctttcacgttgcagccaaaggtggccatttggatattgtaagggaaattttgagtacttggcctgaggtttgcacgttatgcgactcctctaacactagtcccctatattttgctgctattggagatcatttggatgtagtgaatgcaatattggatgttgatgtgagttcaatgatgatagtaaggaaaaatggcaaaactgcattgcacaatgctgctaggtatggcatccttcgcattgtaaaagcactgattgcccgggatcccggaatagtctgcatcaaagatagaaagggtcaaactgcactgcatatggctgtgaaaggacaaagtacttcagtggtggatgagatattacaagctgatcttaccatattgaatgaacgagataagaagggtaacacagctcttcacatggctaccaggaaatgccgtcctcaggttatagacagtgtcgttgtcccctcccctcccccgactggttttaagggtgcagggttttatttctactgtaaatctatggtagtaagcattttgttaacctacacagctctgaatgtcaatgccatcaataatcagaaggaaacagccttggatttggcagataaactacgatatggagattcagctttggaaatcaaggaggcccttgcagaatgtggtgccaagcatgccaggcatatcgggaaagtgaatgaagccatggaactaaaaagagccgtgagtgatataaagcatgaggtgcagtcacagctcatacagaatgaaaagactcgcaaacgagtttctggtattgctaaggaattgaagaaaattcatagagaggcagttcaaaacaccatcaattctgtcacagtagtagctgtcctttttggctcaatagcattcatggccttattcagtctacccggtcaatatcgaaagaagcaaccagaggcagggaaggcaaatatagccgatgatgctgccttcagtgctttctgccttttgaacgctacagctcttttcctttcacttgcagttgttgttgctcaaatcactttggtggcttgggatacaaggtctcaaaggcaggttgtgtcagtgattaacaagctaatgtgggctgcatgtgcctgcacttgtggtgcttttcttgctatatcttttgtggttgttggagatgaaacatggctggctattagtgtcacagttttgggggcaccaattctacttggtactctagcatacttgtgctactttgtttttaggcgacgctttggactccgcagtgattcccagggattagtcaagagaccaagtggaagcaagtcattctcatggtcctactcagttaatatatcagatgtggatgattatgattctgatcatgtgaagatatatgctctataa

SEQ ID NO: 29436 - DNA, 228 bp, Glycine max
  Peptide Sequence Number=SeqID_146214
atgtggctgaaaggggtgaagacccctgtggttctgtctggaaattatgaagaatgcgctaagtgtgcctcactaagtctggcctgtcaagctaagcgccactttgcttctgttaagcgcaccctgtgtgctaagtcggagtgtcattatgatgaggctgagctaagcgcgccatgctgtgctaagctcagactctcttttgttttgaaaattgtagacttaggctaa

SEQ ID NO: 29437 - DNA, 378 bp, Glycine max
  Peptide Sequence Number=SeqID_146215
atgttcggtggcggaggggaggacgcgctggcggcgcggctgggcatgatgccgccgtcgctgctgaatccagcgtcggtgatgtccggcgagatgtctccggcggttccggcggcgagggaggagagggggccggcgcagccgcagtggagccagcaggagacgcgggagttcatagcgatacgcgcggagctggagagagacttcactgcgtcgaagcggaacaagacgctctgggaagtggtgagtgcgaagatgagggagagagggttcaggagaagccccgaacagtgtaaatgcaagtggaagaatctcgttaatcgctacaagcatttcgtttggtcaattgtggcgttttccgttgttgatgaattttga

SEQ ID NO: 29438 - DNA, 576 bp, Glycine max
  Peptide Sequence Number=SeqID_146216
atgaagcgaggtccaacccctatcatcggtagcaaaagcagatctcaagcgcctcctggaagggctcttcctgaacaaaacaacaggctcaatcaacgcaacgcaaaaacgacgacaaagaaaagcaaaacgacgacgcgtaaccgaagtaaagtaacccccaaaaaaatagaccgaatcaaagacggtgtcctccgaatttacatgttcggagaaacggagaaggagaagttggagaggaaaaagaaagggaattgtaatttagcgagaggaaagggaaaggaaaagggagtgattggcgatgcaataaggtgcgaagggattcaagccgggaccgaagacgcgaagggaaatcggaatcagatgaagcctggtttcatcgcgacggaggtggaagatgcagaaaccctagcacagcagaaacgcacctttggaatcgatgccagatggatgatgaccaccacgaaaaacgcaatggcgacgacgtcgttacagtcatcgtcgaaaccccaaaacaaccatcagtcgacgacgaagacactagtcgacaacggtgccattatggccaaccaataa

SEQ ID NO: 29439 - DNA, 273 bp, Glycine max
  Peptide Sequence Number=SeqID_146217
atgaatgagaggttgggggtgatgtggagaccaagaaagggtgttttgcaaggaaataaaaccgagggtgttttcttttcgatgcttctatgtgatagacttcaacaagatactgcaaggagggacttggtagttcggcaaccacaaattggtgttacggtgcccaaagatcaatggcagcagaatggagatggaagaaagatgattagagatgccacttcaaggagaagaagagtcaagaagaagctcaccaccataggaagccatggataa

SEQ ID NO: 29440 - DNA, 546 bp, Glycine max
  Peptide Sequence Number=SeqID_146218
atgacaaacaacttgctggatatatcacactattacagggctattattgctgaagactatcatgaaaggaatacacgtgcctatcgttggacctctacgaagacattaccagtgtcgatgtattggaagcgtctagatcgagtgacgtctgatgattttggaaatgttcagatgattcctccacactctccatgttcaagattatgcttagaagatattgacgacagatggatgcacttctctgactaccttgcaccgcctggggatccaatcagacatccacctatcgtgccagatgacacgtatgtcgaaccaaatatgcctcagtacccgatggcggcagtagctatagaggaagcacctgtacatgcattttctcatgccgagcagcctagacatgcagtgttgctcaacctaaggatagtggctgaagccaccgaaacatacgatgtcatgcaagactgtctaaggatcgctagaggtgtgactgtgaattgcaatgtatatgtgcggtcacgacaaaggcggcacatggaggacgcataa

SEQ ID NO: 29441 - DNA, 177 bp, Glycine max
  Peptide Sequence Number=SeqID_146219
atgactgaggtctcgaaaggcgtccaagaacaccacatgtacagtctcgaagctatggaaggcgcctgtgatgggcagatgaagcaaagaggccacatcatcgagggtgatggtgacctctcttattggaagatggaaaccgctagtttccttatgccacatctccacaaaaactga

SEQ ID NO: 29442 - DNA, 789 bp, Glycine max
  Peptide Sequence Number=SeqID_146220
atgaagatttttgaatggatgcaaaacaggatcaatgggagcaatggaaaaaagaaacaaagtggctcaatttcaactactagtaattacaatatgaggcatgaaccttgcaaacaagagttcagtgactggcctcaagcactccttgctatcggaacatttgggggaaacaacttgaaagaagattcgggtggaaggagtaacaacaccgcagaggattcgtcttcctttcaggattgcacacaagagatcactcttgaagatgttggcaatcttcagaatgagttcagcatattctttaaggggccaaatttggcaggtgaacaagaagaacacaccaatgatcttatcaaagaaaatgagtctccttgtgatggctccaatgttagccgtggtaatttctgtccaagcaatagtataatattcagcaggggaaaagattgtagtttggatcatagcagtaagaaaggtgttgggaagaaatcactttcttttcttcttaagaagatgcttgcttgcaaaagtggatttcaacctacccctttgttcaaagatctactttccactgagtccagaatggaaaagattttgagggcaatacttcacaaaaagatatatccccaaggttcatgttcaacaacaccgtttgtaaagaagtatcttgaagccacaccaatttctgatgatggggaggatgatgatgatgaagaggagcttgctgctgctgcagcagaaaatggatgtaaatgggtcaagactgattctgaatatattgttcttgagatataa

SEQ ID NO: 29443 - DNA, 342 bp, Glycine max
  Peptide Sequence Number=SeqID_146221
atgacgcggggaaagcagaagatcgaagcgcagaagcgaaacgcagagaggaatcagaagggaaagggctctcagctcgaggccagagccgttggcctcaaagtcatctgccccatctgcaagctctttcagcagctcttaaaggtgaatggctttgttgatgatgcaaaggggttggattacttgttagtgtcctttctttgcattgattgctttactttcaaacttcattctctttctgatgagaaaatcaacccagcccaacttgcaaatcaaaaccaactggttgatcattatgcttccaaacatccgaaggagaaacctcctgcagagtcaagctag

SEQ ID NO: 29444 - DNA, 329 bp, Glycine max
  Peptide Sequence Number=SeqID_146222
aatgtgtcacaattgacatggttctcaaggccgagaaggaggtcgaggttgcgaaggccaaagtcagcatcgatggcgacgacggagaagccgaggcggacgagggagaggctaacgttggcagtggtggtggtctaggccatgtcgcccttgctggaggtgatgacgataacaagggggtggagccggagagggaagatgggagaatgagggcggaggaggaatgtagagttgcaggtgatggtggcgtcggggaaaaggtggagagagggcactgggaaggggaaagagggggaggaagaagaagaagaaacacaatggttaagtga

SEQ ID NO: 29445 - DNA, 186 bp, Glycine max
  Peptide Sequence Number=SeqID_146223
atgaataccacgagattgactcctagatataccattcacatctcatcaaatatgattagtttagctttgcaaagcgagggtattggcaaattaaggaagggattgggattgttaatcaaactagcgtcaccacatataaaaaaggtgtggaatttacgccgaaagggatcagtgtgttgcatctaa

SEQ ID NO: 29446 - DNA, 369 bp, Glycine max
  Peptide Sequence Number=SeqID_146224
atggcatcaaatcacttctcaaactttgaaggaacatacaagaatcttcgcccacctgctctcataattgcggggtgttctgtgcttgtagctctagtgctctccattcttctcattctgcaacatcttcgatcatataccaatcctgcagagttaggaataacttcggctaacccgaaattggtttacattcaggagcagaagtggattgttgctgttatttcaatggtccctatctatgctatcgagtctgctggtagaatttggctttgcttttgcatcaaccacgaccactacccttacaaggcagttttaagggtggaacctgaggtagccttggcagaggaaatagttaataggtgtatggag

SEQ ID NO: 29447 - DNA, 219 bp, Glycine max
  Peptide Sequence Number=SeqID_146225
atgcacgaaacacaatgtggaccaccatgggtgcatagaatgaatcgaaaagcttggttcaagaaaaataggggaggtggttgccgcccagctcgcccaggcgagctcagctcgcccaggcgagccaggttgcttcctccagaagcaacagccttctggaggaatattctggagggcccaagtgagcctgggtgctatttgcacccccatttttactaa

SEQ ID NO: 29448 - DNA, 306 bp, Glycine max
  Peptide Sequence Number=SeqID_146226
atggcagttaggaagttgagaactgcgatcgacgtggaggatgtctggcaagaggtggcgatcatgttgatgctgccagagcatgctaacaaggtaaagctaaaggcgacttacaaggatgaagagaatgttcatctcgttatggatctctacaccggcggggagcccttcgactggatcgtcacgcaggggcactgcagtgagcgtgccactgcgaacgtggcaaggaccattgttgaggttgttaaaatgtgtcatgccaatcgtgttaaaaatgcagtttgtggttgcattgcaatgtgttaa

SEQ ID NO: 29449 - DNA, 159 bp, Glycine max
  Peptide Sequence Number=SeqID_146227
atggctgttcccatagctagcgggtgtagttctacgtgtctccttacgttcgcacccaatcgatgcttcgcgagcttggacgattctagtaaacaagggaaaattgatgaaaatatacctatgtacttaaatgaggagcatgatcagcatgggttatga

SEQ ID NO: 29450 - DNA, 228 bp, Glycine max
  Peptide Sequence Number=SeqID_146228
atgacgaaggaagtgatccacagtcacaactctgtagcgcctcggctccacttttcctcttctccttcttcttctaaatttttctctcagctttcagaaaaagccattttgtgtaggggaaacatgcccaggcgagctgcttgcttagggttgaaggtatcaactcgcctaggcgagttagagctcgcccaatttttggatgccctgtctggtgcactcctcggttaa

SEQ ID NO: 29451 - DNA, 345 bp, Glycine max
  Peptide Sequence Number=SeqID_146229
atggtgccgatcttgcatccaaccaagaaggagaaaatgagttctatcaatgccttatccatgaaacttctcattttcactctcaatttatctttaacctgcacaagtctaggaagggttgctgaacttcagaggaaacaagacaaactcaaccgccaattgatacctcaggtcgatgctgttgaacctccgctagctgaagttgcttcacaacctcaacccattgttgaagatgcattggcaactatcaacacttcctatactcctcgtgaggtaactcccttgaccacctttgccccaactggagtgcctaaggagagaattcaagaattgttgcacctttaa

SEQ ID NO: 29452 - DNA, 186 bp, Glycine max
  Peptide Sequence Number=SeqID_146230
atgatcgctggtcacgcccagcagccagccggcacagtcgacctgctccggcagcatcggcagcttacgtcacgcaccagcggctcctgcagatccggcgcctgctcagcgaccagcaccagccgcgtgtccggcgttagcgtgacggcaatttcaccttgcagcacgcgcggacgtcgcagctga

SEQ ID NO: 29453 - DNA, 441 bp, Glycine max
  Peptide Sequence Number=SeqID_146231
atgacagccatctctttcatcacccctgatttacagccgcggctgctggagatcgagcgccgcgcgcatgcgtttccgtggagcgagcagacctttgccagcaatcagggcgaacgttacgtcaatctttgcctgcacgcggacggccagctggccggcttcgccatcacccaggtggtgctggatgaagcgtcgctgttcaacatcgcggtcgatcccgcgttccagcgccgcggctatgcgcgtcagttactacagcagctgattgccgaactggagcagcgtgcggtaatgacgctgtggctggaggtgcgcgcctccaatcagcccgccattgcgctgtatcagcagctggattttcatcaggtcagcgtgcggccaaactactatcccaccgccagcgggcgcgaggatgccatcattatggcgctcacgctctga

SEQ ID NO: 29454 - DNA, 621 bp, Glycine max
  Peptide Sequence Number=SeqID_146232
atggatctctttgggatttatcaaggactaaagactgtccatcttcaaaccttgaccaaggataggcttgaaattattctgagcacttggattgagtgtggatatgtgccatcccctgcagaagtgagcgagaaagaaggaattaactttctgggagttaaaggtggtaaatgcttgtggccaattagaatagggtgcttaaatcccaaggaccaaataccaaagtggtcaatgaagacaatacaatgtataacagatgaggattattactttgtatgcgtggagatctttgaaggattaaaaagaattggaaagccgtctatccttctttccatacgcgaaggagctgaagcagtacatataatcatggggatgttgcaggcttgctacatcagaagggctctacttatgaataatactaggtgggagattattatagaggaaagccatgcatcagattcaacaatggaggattggtttgtaattgttgaggatgcaaagaaatctgcagaaagggatacatctaatttgattgaacaaatggtgggaaagggttggatggcgaagaacattctattatcaacacaggagcagactcgatacagttttatatgtgattaa

SEQ ID NO: 29455 - DNA, 327 bp, Glycine max
  Peptide Sequence Number=SeqID_146233
tcaataggggctgctatcgcactggagcggcccctggccgcgacagagacctctgttgtggggcggattgaagtagcggctgtcgcatccgctatcgcgccggagcaggacggcgctattgcgggctctacagcagttttcaactgctacttggatttcaaaagaaaacttgcaaataccctcatgccaccactgtgccggatagtctttgacttcccttgtgccgtcgtcgccgacctcccttatgccattgtcagcctacctcttccatttgagtgtcatgattttcaatttttcactatggctgagcaaacagaacatgggtaa

SEQ ID NO: 29456 - DNA, 381 bp, Glycine max
  Peptide Sequence Number=SeqID_146234
atggttggtcatatagggtgggggcgaacacaggtaaaaccaaagcaccctgatttcaaacgcaaggatcgcaattctctctggcttggcaaggatgaaaagtgggttttgcctaaattggaaggacttcaatttgatgttccaactgctatatccaaaaaaggtgatggtggtgagccctgtaatgatttggtgcaaaactatgctaactggtgggataatagattaaataagaggaatgcaaaagctcccgatttcaagcacaaagaaaccggtaaagggttgtggcttgattcttcatcagagtgggttttggaaaaattgccgccacctctgaagcctaaacaaagtgtagatactgaaaggacactggtttcataa

SEQ ID NO: 29457 - DNA, 480 bp, Glycine max
  Peptide Sequence Number=SeqID_146235
atgggtcaatgttcccggccaacttgttttctacttctttcacgggtcgaagttggcggcttgaccgcacaacaccactccactgccactgcttctccggtgacgccgcaatctctcgaaaacgacaacgacaaagacgacaacgaggatttagcgctttatggtggcttattcgacaatgaacagaaaagaagattttggagattaaagagaaactcgaagagtctgagcaagtattgttctgtagaagattcgaagagtggaaaggggaattcagctatttgcgaagctatatccctaattttcgagatgatggttgagggagtagaggagacaaccgaaggggatgaagaaattggatgcgttttaagaaagggtggtagtgtgataaagagaatggcagctaagattggtgaacagctttggatccttcctaaagacaagattccagtgtttgtgcatcagcttttgatgagatag

SEQ ID NO: 29458 - DNA, 738 bp, Glycine max
  Peptide Sequence Number=SeqID_146236
atgtatcaaccaattttctggtcggacctataccttctgatggtgtccttgccaactttactggaagctcgtgagcatagtttaggatattacaaatttgaattgttattggggagtgtgaatagctttgttgggaatcgtggtttgtgtggagtgaaaataaattcaacatgtagagatgatggtttgccggataccaatggtcaatctactaactcagaccaaaatcaaataggaaagaagaaatattctggccggctgctcatcagtgcatcagcaactgtgggagctctacttttggtggcacttatgtgcttctggggttgttttctttataaaaagtttggcaaaaacgacagaataagtctggcaatggatgttggtgcaggtgcatcaattgtgatgtttcatggagacttaccatattcttcaaaagacatcatcaagaaactagagactttgaatgaggaacacataatagggataggggggtttggaactgtttacaagctagcaatggatgatgggaatgtgtttgctttgaaaaggattgtaaagttgaatgaggggtttgatcgtttttttgagagggagcttgaaattcttggtagcatcaaacaccgttatctagtgaacttacgaggatattgcaattcacccacgtcaaagttgttaatatatgattacctaccaggtggtagtcttgacgaagcacttcatggtaagatccctatttga

SEQ ID NO: 29459 - DNA, 2412 bp, Glycine max
  Peptide Sequence Number=SeqID_146237
atggctgcaatatatactttctcgttgatccttctctctcttgttatgtgtctacaattatcatattcagcagtggacaccatgcatcaaggttcatccctctcagtggaggaaccaaaagatgtcatgctctcaccaaatgccatgttctctgcgggcttttatgctgttggtgaaaacgcatattccttcgccgtttggtattccgaacccaatggccgacccccaaacccaaccttcgtatggatggcaaaccgtgaccaaccagtgaacggcaagcgctcaaagttttcgctacttggcaacggcaatctcgtcttaaacgacgctgacggctccgtcgtttggtcgacggacattgtttcatcttcctccgcagtgcatctatctctcgacaacaccggtaacctcgttctccgtgaagcgaatgacaggcgcgacgtcgttttgtggcaaagctttgattcccctacggatacccttctgcctcagcaagtgttcacgagacactcgaaacttgtctcttctagaagcgagacaaacatgtcctcgggtttctacaccttgttcttcgacaatgacaacgttcttcgtcttctttacgatggtcctgatgtttctggcccttactggccagatccatggttggccccttgggacgctggaaggtccagttacaacaacagcagagttgctgtgatggacacactcggcagttttaattcctcagatgatttccatttcatgacttctgattacggcaaagtcgtccaaagaaggttgatcatggatcacgatggaaacattcgtgtttacagtcggagacacggtggagagaaatggtctgttacgtggcaagccaaatcaacaccgtgtagcattcatggaatttgtggccccaatagtttgtgctcttatcatcaaaattctggcttgaagtgctcttgccttcccgggtataagaggaagaacgatagcgattggtcttatggctgtgaaccgaaagttcatccatcttgcaaaaaaacagagtctcggttcttgtatgtacccaacgttaagttatttggttttgactatggggtcaaggaaaattacacgctcaaggagtgtaaggagttatgccttcaattatgcaattgcaaagggatccagtataccttttacgataccaaagggacttatacctgctacccaaagttgcagttgcggcatgccagtagtatacagtattttactgatgatttgtatttgaaactcccagcaagcagttcatattctaatgaggggtccacagatgagcaaggtcttaattgttcttcgagaacgataaagattgagaggacatatgacaagggtcatgaaaacaggtatgttaagttcttggtttggtttgcaacgggagtgggaggacttgaacttctgtgcgcatttgtggtttggttttttctggtgagaacaacggggaaacaagattctggtgcagatgggcgggtctacgctctggccggttttagaaaattcagttattctgagctgaaacaagccaccaaagggtttagtcaagagataggaaggggtgcagcaggggttgtatacaaaggtgtgttgttggatcaacgagttgcggcagtgaagagactgaaggatgctaatcaaggagaagaagagttcctcgcggaagtaagctgcattggaaggcttaaccacatgaacttgattgagatgtggggatactgtgctgagggaaaacacaggctattggtgtacgagtacatggagcatgggtctcttgcaaaaaatatcgagtccaatgcattggattggaccaaaagatttgacatagcccttggtacagcaagatgtctggcttatcttcatgaggagtgtttggagtggattctacactgtgatgtgaagccccaaaacatacttctagattctaattatcatccaaaggtagcggatttcgggctgtccaagttgcgaaacagaaatgaaactacatactctagtttttcaacgatacgaggaacaagaggttacatggctcctgagtggatttttaatctaccaatcacatccaaagttgacgtttatagctatggaattgttgttttggaaatggtcactggaaggagcataacaaaggatattgaagccacagataatggagtagtaaaccagcatctcagcatggtcacgtggcttaaagagaggcagaaaaatggatttacgtgtgttagtgaaatcttagaccccacggtagaaggagtatatgatgagggtaagatggaaactttggctagagtggctctgcaatgcatagaggaagagaaggacaagaggcccaccatgagccaagtagtagagatgcttcaggaatctagccgcgaaactcataatcggtga

SEQ ID NO: 29460 - DNA, 483 bp, Glycine max
  Peptide Sequence Number=SeqID_146238
atggttcgttgtgcttctcgaggaaacgaggctcgcttgctccgtgactgcttggagagtaagaagggtgtccgttggggaatcgaagctttgccaaatgatggtggtattggtggatttggaagcgaggagaacgaggagagggtggcggttgcccagatgatggttccgcctgcgtcggtcaaaacgacgttaccgtctttccagagggagaggtgtgagcctctgccgttgacgggcttgtcgcggttggccatccataaaacggtgggtcgttcggaccttgtgaaccataccgagaagcagaaggcgttgtcgccgacttggaagaatccagctgagaaatcgccgttggatgaaacgatggtgtcgttttgtttctcaacggaaagtgaggaaccttctgggagtctttctattgtcccaaaggaggttgggacgaagaggagaaggaggaagagtagaaccatgcgcatagcataa

SEQ ID NO: 29461 - DNA, 291 bp, Glycine max
  Peptide Sequence Number=SeqID_146239
atgaagtgttacctcaactacattgtgatcgaggtcatcactggggaccaaggagtggtaagtgacaacaacatgagtgtgaaaggtgggtggcgagatttgccacagtggcatagcacgatgttgtctggaattgttgttgggcctatgacaacaacttcacaaaccacattctcttatgtgaaattgtcgtttcgatatcccatcatgagctccacgaccatacttgcatcaaagacaaagaaagagaaaaagaagaaagagaatggaaagaggaggaggaggagttaa

SEQ ID NO: 29462 - DNA, 1191 bp, Glycine max
  Peptide Sequence Number=SeqID_146240
atgaagcagccatcaaagccatggagacccttcacggcaaattgctgctccacagaggaccaaaccatctttaagaacttcagcaggtgcaagccatcacgttcagatttgtcaaagaacattgcacctttgccatcattcaggaggctctctttctccgatctcagccgttcgtcgtcgacgcgaatcaacgaggatcttgcacagtcttttggctcggatttgtttgattttcagctgagtgagctgcgtgcgataactcagaatttttctagcaatttcttgctgggtgaaggtggctttggaacagtgcataagggttacatagatgacaatttgaggctgggtttgaaggcacagcctgttgcagttaagcttcttgacattgaaggattacaaggacaccgtgaatggcttgcagaagtgatttttcttgggcagctaagacaccccaatttggttaagttgattggatattgttgtgaagatgaagaacgactacttgtctatgaattcatgccacgaggaagtttggagaatcacctcttcagaaggctaacatcactgccatggggaacaagattaaaaatcgcaacaggtgctgccaaaggcctttccttcttgcatggagctgagaaaccagtcatttatagagacttcaagacttccaatgttttgcttgattcagagttcacggcaaaattgtcagattttggacttgcaaaaatggggccagagggatcaaacacacatgtttcgactagagtcatgggcacttatggatatgcagccccagaatacatctcaacaggcaagattaataaatcagtgatttgcacctatttcctggccatatgttttattacatctataatgagaaccaaggaggttgaggtacattatggatccaaggctttcaggccaatattctgtgaagggtgcaaaggagatggcacatttggcattgcaatgcataagttgaatcctaaagacagaccaagaatgccaacgattgttgaaactcttgaaggcttgcaacagtacaaggacatggctgttaccagtggacactggccagtgtcaccaaaatctaccaaaaatagagtctccaacaataataaggtgaatgtgaaagctagagccggtgcaaaccacaagcaaccttcaccagttcctagcagaaaaacttga

SEQ ID NO: 29463 - DNA, 1155 bp, Glycine max
  Peptide Sequence Number=SeqID_146241
atggatgctataaggaagcaagcaagcaaattgagggagcaagttgccaggcaacagcaggctatacttagacagttgggccaaattagcaatgaaccgctcatgactgatgaatctgaaattgaatgtctccagcaacttcaaaagttatacacttctacaaagacagccaaggaagctttgcttggttatgtttataaccaatgtgttgctcaatgctcacagcattttcagcggcatattgttcgtgctattgaaggattcatttctgttagctccaagcagatggagatagtgaggaggatggcaagggactgctgtaagtatgggactgagaatctaggtagtagttacccccttgcaagggcttctcttcaatttggtaacacatacgatacaatggaaaatgagagggaaactttgctcgggatcttgggtgatcagatctctgagccactgcgggcacagataacaggagctcctttggaggatgcacgccacctcactcaccgctatgacaaacttcatcaagaggtagaagcccagctatcttctcatcaggctgctgaagttttgaggcgccgatcaaagttgaggaattcttctgtttctgcagagagtgctgtgaggcttcaaaatgcagaaacaaggttgaaagaacttaaatctgccttggcagcacttggtagagaagcaactgctgctatgttgtctgtcgaagaacaacagcaacagatgactctccagagtcttcgtacaatggtggatgctgagagatcctatcatcagcatgtccttgttattctagagaaactatatactgagataattgaagagagacaaccaaaagaggctacatcatttccactgccaaaagatggatataatcaacctgcagatgagaatgctaattcaaatggcatcgattataaacacaacagtcaaacaggcacatacttttttgcaaaggtcatacatccatttgatgctcaagctgagggggagttaagcctatcagttgatgattttgttgtagttcgtcaggttggccccaatggatggtctgaaggagaatgcaaaggcaatgctggatggtttccctctgcttatgtacagagacaggacatgataccagccagcaagataacagaataa

SEQ ID NO: 29464 - DNA, 1185 bp, Glycine max
  Peptide Sequence Number=SeqID_146242
atggagcgccatgcatacacccttcacactgctctagctcaacgtggccacaaggttcatatcttcacctctcccccacaagaagaaaccacttcaaccttctcttcagacacaaccaaagaagcagatgctaacgcaccctcttcaccttatatccattgtcatgaaggggagccgggtaagtggcgctacaacaaagcatgggaacagtttctggaacaaaaccagaaagaaccattcgatgttgttcactcagaaagtgtagcactccctcactggctcgctcgcgaacttccgaaccttgcagtttcatggcatggcatagctcttgaaagcttgcaatctagtatcttccaagacttggctcgtacgcaagacgagcctagatccccgaatttcgacaaaggcttacaaggtgttctccctaagattctaaatgagataaggttcttcaggaaatatgcacaccatgttgccattagtgatagttgtggtgagatgttaagagatgtgtaccaaattcccaacaaaagagtgcatgtaattctcaatggggtagataaggatgaattcagagaagatgtggaattgggaaaggaatttagaatcaaaattggcattccaagcaatgctagtttagtgcttggtgtagctggaagattggtgaaggacaaaggtcaccctctccttcacgaagcatactctatgctaataaccaagtaccccaatgtgtatttgattgtagctggctcaggaccgtgggagaatcggtatagggacttagggagccatgttcttgttcttggatcaatgagtccttccatgctaagagcattctataatgctattgacatttttgtcaatcctacacttaggccacaagggcttgatcttactatgatggaagccatgatgagtgggaagccacttttggcgtcgaggtttccgagcatcaaaggtagtgttgtggttgatgatgcatttggcttcatgttctctcccaatgtggagtccctcttggaggcactcgaagcagtggtgaaggaaggaaaggaaaggcttgcaaggaggggaaaggcatgccgtgaatatgcaatttctatgtttactgcaacaaagatggcgttggcatatgagagactattcctatgcataaaagaagatagattttgtaactatccttga

SEQ ID NO: 29465 - DNA, 771 bp, Glycine max
  Peptide Sequence Number=SeqID_146243
atggtgggattctacgacctctccgacaccgacaacgactccgccgtcgaagaaataatctcgcaggcccaagacgcagtcgttctggaccaagtctccgccatcaactgctccgccttcactgacgactcccttctcccctcccaccttgaaacccgtttccgcaacctcaaatccttccctcccaccaaacccaaacccaacaccatcgccaaagctcgcaccttttcttccaatctctcttcagcaaacccccaaagtcccaatttttcaccacccaaacagaacccagattctgggtacacctcgtcgcacgagaaaaagagtttcagagaaaaaactaaagacgggtctctttctgtttctgcttcttcacccccgtctgcttctgcttctgcttcttccccttgctctgatgaaagttccatgtcttccttgttcaaaccgaagcaaaaggaagaaggttccaaacaggactcttctgtgaggtcttcgaattctccttcgcctcctcggaggaggggttgtttgtggttctttccgaagaagaagaaggaggaggagaaggagaagaagaagaagaaaagcaagcagaattggggtgatgacttgttgtcggaattgggaagcttctcgaggaaggaacaacaaaaaatgctcaagaaggcgatgaaggaagaagagaaggttagccgcgaggctgagaagatcgtccagtgggccaagcaagcatctgcaaggttcaaccttgaggatgagctcagtgattga

SEQ ID NO: 29466 - DNA, 481 bp, Glycine max
  Peptide Sequence Number=SeqID_146244
caagttctactttgcaaggaccggatggctagccattggacttgttccaaccccagttgcattcatactgcttgctgtatcagacagtgccgcggcacttaaaacaggcactgcactgattggtttgagttctggcttcatattcgcggctgctgtggcagttacatcggagctatttggacccaacagtgtgagcgtcaatcacaacattctcataacaaatatccccattgggtcgcttctgtttggttttctggctgcgttgatttatgatgagaatgcttacaaaatcccgggagagttaatggctgacacactgattttagcacaggccatggaattgttgatacttgaaggtggatgtataggggttatgattttggaggcagagctgaagcaagggagagtgaagattttgtttctctctccagcaatgcaccaaacaggaaaaacatggaagctttggaagcatgaggtttga

SEQ ID NO: 29467 - DNA, 126 bp, Glycine max
  Peptide Sequence Number=SeqID_146245
atggagatggcctttcaacctttggataagatgaaagtaattgggattgaatggagtatggaaacaagaagctatagatcacatctcctggaggagtgcacgacacttgtggaatgtaaggattaa

SEQ ID NO: 29468 - DNA, 330 bp, Glycine max
  Peptide Sequence Number=SeqID_146246
atggagccagagtacacaggagaatcagcatgttgcttttgcttcccgtccaccaagaagagtgttgcaaggaatggtaaaagaagcagtggagtgttgttgagttcagaacacgttgagtggggtaagaatgatgaaatactctcagacacgagcaccttttcggtgaaagaacaagaaaggaggctgaagaaagcgttggaagaggaagagagggcaagcaaggaagctgagaggattgtcaaatgggtgaagcaggaatcagctagaattgatgtttctgcaatcaaatcaattctcagtgacgagaaagaagcaaatgttaagtga

SEQ ID NO: 29469 - DNA, 412 bp, Glycine max
  Peptide Sequence Number=SeqID_146247
atgtcatgctctcataaaaaaaatggcatgttctctgctggcttctatgccgttggccaaaacgcatattcctttgccgtttggttctccgaaccctacggccaaactcgaaacgcaaccgttgtatggatggcgaaccgtgaccagcccgtgaacggcaaggactcaaagatttcgctacttcgcaacggcaatctcgccttaaacgacgttgacgagtccctcgtttggtacacaaacaccgcttcactgtcctcctctgtgcgtctatttttcgacaacaccggcaacctccttttgcatgaaacgcaggctactggtgtcgttttgtggcaaagctttgatttccctacagatacccttttacctcaacaagtgttcacgagacactcgaaacttgtctcttctagaa

SEQ ID NO: 29470 - DNA, 536 bp, Glycine max
  Peptide Sequence Number=SeqID_146248
aaagagctgagcaactagactgggattcacgcttgaatataatcatgggagctgcaaaagggcttgcctacttgcaccatgattgttcccccaggatcatacaccgagacataaaatctagcaacattttacttgacggaaacttggatgctcgggtctctgattttggacttgccaaacttctggaggatgaagaatctcacatcaccactattgttgctggaacgtttggttatctagctccagagtatatgcaaagtggcagagcaactgagaagtctgatgtgtatagctttggtgtgttgacacttgaagtgctgagtggaaagcggccaacagacgcagcattcattgaaaagggtctcaatattgttggggtgcaaatggagagccttgatgccttgctctctgtggctattcagtgcgtttcctcaagtccagaggatcgacccaccatgcaccgagtggtgcaattgcttgaatccgaggtcgtaactccatgccctagtgacttctatgactccaactccgattag

SEQ ID NO: 29471 - DNA, 1250 bp, Glycine max
  Peptide Sequence Number=SeqID_146249
atggcggggcaatcgcggaagtggatgattctggtggccaccatatggattcaggcattcaccggcaccaatttcgacttctccgagtactcatcttccttgaagtcccacctcaacatctctcagctgcaactcaactacctcgccaccgccagcgacatgggcaaggtcttcggctggtcctccggcctagctctcatgtacttacctctctccctcgtcttgttcatcgcctcctccattggattcatcgcctacggcctccagtggcttgccatcaaaaatctcatcaccttgccttattatctgttctttcttctgtgtctgttgagtggctgtagcatctgttggttcaacacagtatgttttgttctctgcattaggaatttcccagttaacagaccccttgcattatcactcactgtgagtttcaatggtgtgagtgcagcactctacacacttgctgcgaattcaatagacccttcatctgatgcattgtacctgctcttgaatgcccttgttccccttctcacttcccttgcagcactagtcccaattcttctccaaccccctttagactctctcaatagatctccagaagcttctcgcaggaactcagtgatatttctagtactcaacttcctagccattttcactggcatttacctccttctctttggctcatcaacttctgatgaatccacgtcgaggctctactttggtggtgccattttgttcctcatatccccactatgcatccctggcactatatatgctcgagattggtttcaccatgccatccattccagctttcggatggaaggctccggcttcattcttgtccatgtcgatgatcttgagctgcataaggaactcctcacgcgtcaaaacagcactctcagtctcagcaatggggacggtcatggcctgctgagtgagaatggatccaagtatagaagtcagagtgcaaaatctagtgatgtgtgttgtggcaagatgtttggccaggatcagttggcaatgctaggtgaagagcacactgctgcagtggttgtccagaggttggatttctggctctattatgttacatacttctgtggaggcacaataggacttgtttacagcaataatctgggacagatagctcaatctttaggcctcagttcaagtatatctacccttgtcacactctactcggcattttccttctttggccgcttgctttcagctgtaccagactatattagaaa

SEQ ID NO: 29472 - DNA, 732 bp, Glycine max
  Peptide Sequence Number=SeqID_146250
atgaagaattgcaacacagctccagtatccgtgatgcctaacttgaaattaacagaagaactatatgaaaagctggttaatgcaacattgttcaagcagattattggctcactcagattcctgtgcaacaacagacccgacattagttatggagtgggattgcttagcagatttatgggtaatcctcgagctcttcacatgactgcagctaagcatatcctgagatcatgcattgaagcctactctgattcagactggtgtggtgataaggttgagaggaaaagcacctttgggtacttgtttaagtatctggatgcaccaatatcctggtgttcaaagaagcaaagtgtagtggcactctcctcttgtgaagctgaatatatagggtcagctgaagctgcttgtcaaagtttatggttggaagccctgctcgaagagatgaaattacagtatgaaaggctagtacaaatgtatgttgacaataaatcaaccattagcttgtcaaagaatccaatttatcatggaaaaagcaagcacatcaaaaataaatatcatttccttagaggtcaagtaagtaaaggaagattggagcttgtatattgcagcaccaatgaccaagttgcttatgttttcaccaaacctttgaaatatgaaagatttgagaagttgaaaaccttactgaatttagaatcagctgaatgttttggattaagcggaaatgttggagtgtaa

SEQ ID NO: 29473 - DNA, 723 bp, Glycine max
  Peptide Sequence Number=SeqID_146251
gtgaggcaagttgaataccgcaacactaaaggatggcaattcctcgttcactatcttggttggaagaagagatgggatgaatggcttgacctggatcgtttgatgaaacacaccgaggaaaatatgcgcaaaaaacatgaccttgacgagaagcttggcaatgataagaatgcaaaagtcccgcgtggttctctggcgaagtccaagcctactaacgtttcaagaggcaggaaacgaaggaatgaatctgtcatcaagggaaaacctgcagttgatcctgacaagcttgttaacattcaaattcctccaacactaaagaaacaattagttgatgattgtgagtttattacccatctcggcaagcttgttaaactccctcgtactcctaatgtgaaaggcatattgaaaaattattttgattacagattgaagaaatgtggctcggtgggtgattcagttgaagaaattatgaaaggattgtcttgttacttcgacaaagcactgccagtgatgcttttgtacaagaacgagcgccaacagtaccaagaggcttgtccagccaatgtctttccttctgctatatatggtgctgagcatttgttacgtctctttggttcttgcaaaaaaaccagagcacattcttcctttctacttatcatgttgcagaaggtattgagaacagcaccaacaaacaaggtgactaggcttgtgaacaacaattga

SEQ ID NO: 29474 - DNA, 708 bp, Glycine max
  Peptide Sequence Number=SeqID_146252
atgctagtagggattagggtggatgagttatccttggctagattcgctggcgtccttaattgtaaatgtggacggctaccttttgtctacttaggtattcctatacgggctaaccctagaaatgaggtgatgtgggaacctgtaataaggaaattgaagagcaaattagctgtgtggaagcaaaagtcgccttccattggagggagactgactctcactaattcggtacttgcttcattgcctttatactatgcatctttctttaagattccaccttgtgtgattaagaagatttttaggatacaaagagggtttctttggggtggagaggaggatggggggaaggtggcttgcgtgaagtgggatgatgtgtgtgtggccaagggagatggatggcttggtataaaaaatataaagacttttaatgttgcacttttcggcaaatggagagattttggggaggtatatggccaaaatggaggtggggatgaaccttctaggtttgatagaaaccttttgtgggaggtgggcaatgggaaaaaaatagatgtttgggtggatggtgggtgggttcggaagttgggatggcgtaggaactggttcacatgggaagaaccaatagtggatgatctcaaccaaattctgcaacgtgtcatgttgtcccaagaacgagaggataggcttatatggaaggcagcatcatcttga

SEQ ID NO: 29475 - DNA, 756 bp, Glycine max
  Peptide Sequence Number=SeqID_146253
atgaagcgtccactgtcaccatcagcgagcggcgtgaacgttgaggacaggaagatgaagaagaaggcgaaggcggtggaaaatgaggacgataacggggagcgcgtggaggggctggcgcatttcgacgacaaccttctgttcgaggtcttgaaacacgtggacgcgcggaccctggcgatgtcggggtgcgtgaacaagcagtggcacaagacggcgcaggacgagagactctgggaactgatctgcacaaagcagtgggcaaacactggctgcggggagcaacagctaagatccgtggtcctcgcgctcggtggcttccgtcgcctccacgcgctttacctcttccctctctcaaagcctcaacaaacaccatcttcttcatcttcatcgacctcgtcctcttcctcctcggcctggggccccaccataccccagaatagattagggtttggatctgaggggattagagagtgtaagggagaattggcgaaaggagtgattggcggtgcggggagtgttttttttttttttccgaaagtgaacaaggagacagaggctgaggcatgcatgagcaagagcaacacaagcatttcgtgtcttagtacaagtttacaaatattttccttcatgatagttgattggattagaagaaatgaagaattagcctcgtctcaaatggctggaatgtctccatcacagcctcaaggtcacccaacaccctggtttaagaataatcctgtttgcattgtgtga

SEQ ID NO: 29476 - DNA, 204 bp, Glycine max
  Peptide Sequence Number=SeqID_146254
atgggagggttagtgggaaagcaaggatggatgatgggtaatggggcaggtgaagtaaaggttaaggttagggtggtgcacctgcttttgatggttttcgaagacgacaaagagagaaatgaatgcgtttcgattctttggccttctcttcatgttcctattcgccttctcttcattcttactaccggggaatcaatcaattga

SEQ ID NO: 29477 - DNA, 2265 bp, Glycine max
  Peptide Sequence Number=SeqID_146255
atggcggaggaattctccaagtccgtggaggaggggctgcggctctccaagcgcatatacttcggcaacgacagggccgtgtcgccgccgaagccgccgccgagcatgtcaaagtcccacaccgcctgcctccccacggcgcccatgctctacgccgtcattcacgaccctgccattgtcgacaaccccgacgttcccagctaccagccctacgtgcatggacagtgtgaccccccggcgctcattcccctccacatgattggaaatgttcaccttcaagcacattgctacgtcaatgccgtcgcgttcgtcaccgtctccggctcgtggagactccactgcgtctccggcagccgcacctgcgattgcatcgttgccctgcccgtgccacctcagggttcaattctaggtgtggaggttagcgttcataggaagtcttattctactcagctagttgatatgaaagacaacaatggtaaggagaatatgatccgagctcaagatggaggctttgtcgggctgaatttgtttactttgcgtataccacagatcgatggaggttccaatttatctgttaaaattagttggtaccagaagatactatacagcaatgatgtgttctgcttgaatgtgccgtttaactttccagattttgtcaaccctgttgggaagaaaatggaaaaaaaagaaaagatagaaataattatgaatgctataactggaagtgagattctatgcaagacaatgagtcatcccctgaagaaagtgaggcataatgctgggagtatgggtttctcgtatgagtcagatgttctctcatggtcaaaaactgatttcagcttttcatatgctgtgcctgattcttcaagtcatataagtggtggtgttcttttggaatctccatcggtggatgattttgatcaacgagagatgttctgcatgtacctttctcctggaaatcttcagggtaggaagatattcagaaaggacatcgtgttcgtgattgacataagtggaagcatgcggggaaagctaatcgatcatacaaagaatgcactatcggctgctctctctaagctcaatcctcatgattcatttagtattatagcattcaatggagagatatatcaattttcaaaatcaatggaattggcttcaaaggatgctgttgaaagggccatcgagtggattaacatgaattttattgcagggggtgatacaaatattttgcatcccttaaacacggcaatagagatgctatctgatgctcaaagttcagttccaattattttcctagttacagatggaactgttgaagatgagagacaaatttgtgatatgatgaagaatcatatgaccaatggagagtcaatatccccccgaatttacacttttggcatagatttgatcgagcctcagatgctgaaattgtttgacaaagcttcatctcttgttcttgcaaatatcacaatggacatattcaatgatgtggatgaagttgaggtgtgcccctctcacattccagatctttcctcagatggtccattgcttttatgtggaagatataagggaagttttcccaaagatcttgaaattaaaggtgtcttgcctgatttcagtaattttgtgatagatctgaagattcaagaggctaagggcatacctgtacaaaggatttgtgcaagagatcaaatagagtatcttactgctcaagcatggctctcaaaagatgaaaaattagaacaaatggttgccaaactaagtttacaaactggctttacatcggagtacacgagtatgacaattcttgagattgatcttcgaaagaaagccaaggaatcagatggaaagaaattacatagttctattaaaatagataaaatctctcacttcctttcttctaaatcatggcaaaaggtgtcaaaaaagagcaatcctcagagtggagcaaaagaacaagagcagagagttattttgctccctcccctaggtataggatttggcaacttaactgcaactgctgaaaacattcaaccaggatctgaagaaacaaaagggcctgatggggctgaaatctttgttaaggctgccacaaattgttgtggcacctgctgcaattactgctgttgcatgtgctgcatccaggcctttacccggataaacaaccaatgtgcaattgcatttactcaactttgtgttggcttaggatgcttcagctgcatcaactgttgtgcagatatatgttgttctggaaatgaaaactga

SEQ ID NO: 29478 - DNA, 995 bp, Glycine max
  Peptide Sequence Number=SeqID_146256
gtggtgaaggaaaggttgtagaagtacttgaagatgaatctgcagaacaactaagtaaatccttgttggatggttcagatgagaatcacggcatagaaaatagatcattttggaacttcttttggtatccatccaagcttggaaaagatcttctcacaacagaaaaatttggtcttgttcaatatactgtttgtgcattgttagcatttatattggaattggctggtgtttatggtgatggggaattcaagtggtactacgggtatccatatatagcagtggtattgaacttcagccagatgtgggcattatactgccttgttcagttttataatgttactcatgagagacttcaaccaataaaaccacttgcaaagttcatcagcttcaaggccattgtgtttgctacttggtggcaaggtgtaggtattgcagttttgtgtacatttggagtactacccaatgaaggaaaatttcaaacgggactgcaagatttcttaatttccatagagatggccattgcaggtgttgctcatgtgtttgtattttctgcaaaaccatatcattttcttcctcctcctgcatatggaaaagtctcaaaggaaacaatagaagcagccttggagatagatgaagggaacaaacagaaatcagctgtgcttaaagagaaaataactcaagttgaggctccaacaactagtgtcacagagagcgtccaggatattgttgtggaaggtggtcaacgagttgtcaaggatgttgtactaacaataaatcaagcaatagggcctgtggaaaagggagtgacaagaattcaagaaaccttccatcacaaaacggtcgtttcatcggatgatgatgatgatgatgatgatgatgatgatgatgatgatgatgatgatgatgatgatgatgatgatgatgatgaagaagaagaagaagaagaagaagaagaagaagatatacaggttgagaaagatgtcgcaaaatcttag

SEQ ID NO: 29479 - DNA, 1497 bp, Glycine max
  Peptide Sequence Number=SeqID_146257
atgccgacactttggacaagagaggtgtccgtgcttcataggttcttgtattgtctccagagtgatgctgacatggatgaggatttttcatttctacaacctctggatcttatcacaaagggcccgactgaactacacaatatagtaaaagccaaaaaggaaaatctacgtcagcataaatttgaatcaaataaaataatgaatgacttgagtcaggatgactcaaggagggaacgagttcaggaaacagacaaagagatgaaagaaaaggaaaatgaacacagactggaaaaaattaggttagagaaagagaaggagcaaccaaagcttgagtataaagaaacacaacacattgatcaaaaccatacagagaaacaagaagataagattactgtcgaaaatctagaaaatagagcacaaggaggggctgagccaatggagatctcacagagctctatgttgtcgcctgatgatactccatgcagtgatgtaaaacttttgaaaggccatacatcagaggtttttgcttgtgcttggaatccatcagctccacttcttgcgtctgggtctggagattcaacagctcgaatttggaaaattgctgatggaacttgtgactctagtgtgcaaaatgaaccagtaaatgttgtggtgctgcagcactttaaagaaagcaccaatgagaaaagcaaggatgtgacaacactggactggaatctgatatcttttgctatgctttttattacaacaaagggggatggaacactgttggcaactggttcctatgatggccaagcaagaatatggagtatagatggggagttgaattgtacactaaacaagcacagaggtccaatcttttctctaaagtggaacaagaagggggattatcttcttagtggaagtgtggataagactgctattgtatggaatataaagactggggaatggaaacaactatttgaatttcacactggcccaactcttgatgttgattggcgaaacaatgtttcatttgctacatgctccactgataaaatgatacatgtttgcaaaattggagagaatagaccaatcaaaactttctcagggcatcaggatgaagttaatgccattaaatgggatccatcaggttctttgttggcttcctgctccgacgatcacactgcaaaaatatggagtctaaagcaggacaactttttgcataatttgaaggaacatgtcaaggggatatatacaatccgatggagccctacaggccctggtaccaacagtcccaatcagcagttagtactagcaagtgcctcattcgactcaacaataaagctctgggatgtggaactagggagtgtactgtacaccttaaatggccacagttggactgtgtggatgaagatatctaggaatcctatcttggacataagcagcctgaacaagctgcttagcagagcttttgaggatatctgcttattggtgttgggatttaatgtgaagtag

SEQ ID NO: 29480 - DNA, 597 bp, Glycine max
  Peptide Sequence Number=SeqID_146258
atgggggtggatggcttctgctgggaagggaagagatcaagagcgtttggtagggcgatggcaatggtgcctttggatggctcgctgtcatgtgtctcaacaaagatatcattcaaaagttttgtccgcatgaacatgctctcactggagatgcgggttcagaaggatgtagttgaatccttgcagatgcaaaatccattaatgctcaagtcttcatttaatcgtcctaatatatattatgaagttagatacaaagatctgttggatgatgcttatgctgatttatctaatacactcaaatctctgggagatgtctgtgcaatagtgtactgccttgaacgttcaatgtgtgatgacttgtcaactaatctatcccaaaatggcatttcatgtgctgcttatcatgcaggattgaataataaaatgcgaacttcggtgttggatgattggatatcttccaagataaaagttgttgttgctactgttgcttttggcatgcaattacatgttgctttgtggtggtggtgggggtggggggaggtgagttttttggctcctgttcacagtagcggccataacagctatgaattacaatga

SEQ ID NO: 29481 - DNA, 666 bp, Glycine max
  Peptide Sequence Number=SeqID_146259
atgcagaagtcggcattgccactgagcgacgcgaatgcgaacaagaagagggaggaattgcgccgcaaggaaacgttggtgaagcttctgagatggcattttgggtaccccgatttcagggacatgcaattggacgctattcaagctgtgctctcagggaaagattgtttttgtcttatgccaactggaggaggcaagtcgatgtgttatcagatccctgcattggcaaaagcaggcattgtgcttgtcgtttgccctttaataggaaaaccaagtaatggcactaaaggagaaaggcatagcggcagaatttctctcctcaacgaaaacaacagatgcaaaagtaaaggcaatctgatgcatgagactccctgctcctacctagtggggtctggggtagatattcatgaggaccttgattctggaaaaccttctacgaggctgctatatgtgactccagagttgataacaacaccagggtttatgactaagctgacaaagatttataccagggggttgctaaatctgattgcgatagatgaggcgcattgcatctcatcttggggtcatgatttcagacctagctaccgtaagctatcctctttgagaagccacctaccagatgtaccaatattagctttgactgctactgctgtgcctaagtga

SEQ ID NO: 29482 - DNA, 126 bp, Glycine max
  Peptide Sequence Number=SeqID_146260
atggtggtggcggtgttgacaagacactggttaacagcaggacaagcatatgacaagatacatggtgggaaaaatggaaagagagagggagaatgcatggacatcagccaatggtggttatgttaa

SEQ ID NO: 29483 - DNA, 1179 bp, Glycine max
  Peptide Sequence Number=SeqID_146261
atggtggtccggggagcacctgctattgcaattgcagcggcactctctttggctgtggaggtgttcaatttagattttaatgggtcagctactgatgctgtatccttgctgcagaagaaattagaatatcttgtcacaagtcggccaactgcagtgaacctatcagatgctgcgacaaaactcaaagaagtgatatcaaatgctgctgctaccacttcagagggaaggagtgttttccaagtgtatatagatgctgctgaagttatgcttgaggatgatgttgcgtcaaatagagctattggttcttatggagctagtattattcaacaacaaacagagaaacaaaagctttctgttttgactcattgcaacactggaagtctagccacagctggatatggtactgctctgggtgtcatccgtgcacttcatagtgccggagttctaaaaagggcttattgcacagaaacacgcccatttaatcaaggatctagacttactgcctttgagttggtgcatgaaaaaataccaggaactcttattgccgattctgctgcagctgcattaatgaaggcaggacatgtggatgctgttgttgttggggcagatcgggttgcatcaaatggtgacacagccaacaaaattggaacctacagcgttgccttgtccgctaagtttcataatgtacctttttatgtggctgcacccctaacttccattgatctatcactttcttctggacaagaaattgtcattgaggagaggtctcccaaggaattgctgaacacacatggaggacttggagagcagattgctgcctcaggaatttctgtgtggaacccagcttttgatgttactcctgctaatctaatatcggggatcatcactgagaagggtgtcattacgaagacatctgctggtgatgcatttgacatcaaagccttcgtacagaaaacaggcttgaaaagtattggagtggtagggttctttaagagcctctttgtgataacaactttaacaagtgatgataacaatgttatggcgatgataaaggtgttagtaatgatagatgtgacaacaatggtaatgataacaagtagggatgagaataggccagaccagcctacaggggcctacggcctgacctacataaagtctggcctgaactggcctatttaa

SEQ ID NO: 29484 - DNA, 255 bp, Glycine max
  Peptide Sequence Number=SeqID_146262
atggacctaatacaagcagttaatgttgtgagtgagtatatgggtaatcctaggaaggaacattggcaacctgtgaaatgtatattcaagtaccttaagggtacaactaatattggactcgtttaccatgatggcgcatcttgtgctctcgctggttactcaatttctaactatgcacatatttggatgcaaggagatatgctattggatgtagagtacatggctttggcaaaagtaacaaatgaagggatgtga

SEQ ID NO: 29485 - DNA, 1056 bp, Glycine max
  Peptide Sequence Number=SeqID_146263
atggagactcgtgccgccgcaaagagaaaggcaaacgccgccatcgtagtggttgtcgaaaaacaacaccccaaaaggcagcgtgttgtgttgggtgaacttcccaatttgcaaaaccttattgtctccaaaattcaaaatccgcgcaaagaaaaactccaatgtcggaagaatcccaatgcgaataaaccatcacccacaaacaacaccctttcttcccctcagctcgacggatcttatgtttcggacatccacgagtatcttcgtgaaatggagatgcagaaaaagagaagaccaatggttaactacattgagaaatttcagaaaatagttacaccaaccatgagaggaatattggtggattggttagtggaggttgctgaggagtacaagcttctctcggatactcttcatctctctgtttcatacatcgatagaaaatatgaggaaacggacccaccaagtgtggacgagttttgcagcatcactgataacacgtatgacaaggcagaggttgtgaagatggaagctgacatactcaagtccctaaagtttgaaatgggaaatcctactgtaagcacctttctaaggaggtatgctaatgttgcttctgatgtccaaaaaactccaaattcgcagattgaacatttgggcagctatattggtgagctaagtttgttggactacgattgtttaagattcttgccttctattgtggctgcctcggttatatttcttgccaagttcattatctggcctgaagtgcatccttgggcacttaaagttgagaacctattgcagacttcttccttgtgtgaatgctcgggttacaagccagctgaattgaaagaatgtgtccttatcctgcatgacttgtatttgtcaagaaaggcagcgtccttcaaagctgttcgggagaaatacaagcatcaaaaggtttgtgtcgttgaattgcaagggcagcaggatcacattagatacgaaagttcaattgcctttcctgatgaactatcagggacaaggcctttaaagaaggatcaattaacaagatcttag

SEQ ID NO: 29486 - DNA, 537 bp, Glycine max
  Peptide Sequence Number=SeqID_146264
atggctgcattcaaactcaaagatcgctctcatcatattgttattgtggccaacacatatttattggcaatgaaggatcctgattgggctgatgtcaagcttgcacaagctaaatatcttctatcccggatagcaaaatttaaaacactgatatcagatagatatgagtgcatacctgaagtcattttggctggtgacttcaattctacgccaggagatatggtttatcagtaccttgtatcaggcaatccttcatctaacctgactccagactgtttagaggagtctcctagtcctattcccttatgtagtgtctatgcttctacaagaggagagccaccatttacaaactacacacctggcttcactggaacacttgactatatattattttccccttctgataacattaaacccattagttttcttgaacttctagactccgatgcagctgatattgttggtggactgccaaacttcagttatccaagtgatcatctaccaattggtgctgaatttgaaatcatcaaggaataa

SEQ ID NO: 29487 - DNA, 1692 bp, Glycine max
  Peptide Sequence Number=SeqID_146265
atgattcacgatgttggacaaaagtcttttcaacaagcacatgctcctttgtatgatacattacaaagtgatttgaagaaacctttgtatctagggtgcacaaacttcacacgattgtcagcggtgttagatttggtcaatttgaaggcaagatatgagtggagtgataaaagtttcactaaattgtttgacgtgttggagaagatgcttccaaatcaaaacacgttgccgaaaaatcactatgacgcgaagaagataatatgtcctccaggtccaagacaaccaagaaataacattgatgattatctaagtcccttggttgaagacttaagaaagttgcgggaggacaaggttggcgttttggatgggtaccaccaacagaccatcaagttgcatgcaatgaaaaatgtatgtgatagtttaatcaacacacttcttaacattaaaggcaagacaaatgatggtttgaatgctcgtcaagatttggttgacattggtatatgtgagcagtttcatccgataacaacagaagaagaagctatagagttttgttcagaatacatgaaaaaggaaaaatctatttggtttcttgagtctcgtcatgacaatagatggggaggtaagggttcacggggttttaagattgtaaccatgggtcgtttggaattcaatcaagttcatttgtatatattgaataacaccaaagaggttgtcccatacatagcgtctcacaaagggttttttaaggtgttgcaagagcataataagactttcataaaccagtttaaagatacaatctttcatgatgacaatgcttctgaaacattgagagcattagcagatggaccaaaacgaaatgtgctaacttcgaagggatatgatatcaacaactattccttttacacaaagtcacaagatgagaaaagtacagtgcaaaacagtagggttagtattgatgctcatgctaaacactattgtagtgcatcagataaccccattatggtgtccataccttactttggagtgattcaacaaatctgggaggttgattatagtcatcttagagtgcctatttttaaatacctttataacgttgcttataaggacaaacctttcatcatgagtgaacaagcaaaacaagtgttttatgtccaacatttgtgtagctcaaaattgtcaatggttctacaaggaagaataagaggtgttactcatgaaaatcaggattcaacacttgatttttgtgacactcctttctccacacatatgtcttccatacaagcaaaacatgaagtgcatatggttacaccaccaagctcccctcctcaagatttttcatctcctttagagtctacctccagaaggaggaggactagacaatgtactcaactcaaaagattggttgctaaacacttagatccgtcaaggccagtggttcatgtgaaccttccactgggaaaacttcatacccacatatgggagcaattttctgcaaaccgtaaaaccccttctcagcagaaggctcaagaatgccaaaaacacaacatgtggcaacatgtattgtctcgtgggggttatgacttgcttgagaagaaactcatggctaagaaaatgaaaaaacgacaagaggaatcaattgcaattgggagttcaggagttgttaaccctccatcgcctattaaaggcatgtga

SEQ ID NO: 29488 - DNA, 330 bp, Glycine max
  Peptide Sequence Number=SeqID_146266
atggattatgattgtataagattcttgccttctaccgtggctgcgtcagttatatttctggccaggtttattatctcgcctgaagtgcatccttggaataagctattacccgattttaaggcactcaaagttgagaacttattgcagacatcttccctgtgtgaatgctcgggttacaaacctattgagttgaaagaatgtgtcctcatcttgcatgacttgtatttttcaagaaaggctgagtccttcaaagctgttcgggagaaatacaagcaacccaagggatctcaaatcactgatgctttttgcgagctgcttgttcgacgataa

SEQ ID NO: 29489 - DNA, 552 bp, Glycine max
  Peptide Sequence Number=SeqID_146267
atgggcattgatagaaaggatgtcagaattgtatgccacttcaacattcccaagtcaatggaagcattctatcaagagtcaggcagagctggtcgtgatcaattgccatctagaagtctgctgtactatggggtagatgatcgcaaaagaatggaatttatattacgtaaatcagtgagcaagaagtcacagtcatctagttcacaagaagaatcatccaaaatgtccctgattgctttcaatctgatggttgaatattgtgaagggtctggatgtcgcaggaaaagggttctcgagagttttggggaacaggtaactgcatcactatgtggaaaaacatgtgatggctgcagacatccaaacttagttgcccgatatttggaggatctcacaactgcttgtgctctacgccagaaaaatggttcttctcgagtttttatgaccagttccactgatgcaattaacggagaacagttatctgaattctggaatcaggatgaggaagctagtggatcagaggaagatatatctgattcagatggtagtacctaa

SEQ ID NO: 29490 - DNA, 459 bp, Glycine max
  Peptide Sequence Number=SeqID_146268
agcaacaaagttgacaaaaatgctatttctgatccaatgcgaggatcaagcaggcaaaggttacaaaatgctctaaaacaggttcagcaacggcttgacaacttcaagattgaaatggaaacatcagcatctttccttgaagaagaatgctacaagaaatatggcaagctgaaaacctcctcatcccagctaatcagcccctcacaccagctgaacagcccctcacatcgccaacctgctttagatccttatgcaagagataccagcaatgaacactcaggcactgctagatcagaaacttctgcatgtgtcttgccaatggaaggttcttttagtaccaatttgccacagataccatccttctctgaattcgtaaatagtaggaaagcaaaaggggaccaattacatgacaccaaaaggcattcatcaagagttgaaaagaagatgaggatacagtag

SEQ ID NO: 29491 - DNA, 873 bp, Glycine max
  Peptide Sequence Number=SeqID_146269
atggcttccaatctgattagagtgagcacaagcttggttctagtagttttagtagctctcacagttcaaattttctacatttcacccatagatccagttttgctggatataaaacctgctccttcaaccaaagacaatcaattacagaatatcattaagcttggagaaggacttttgaaggaaccagaagatgttgttgtagataaagaagggactctctatacagctactcgagatggttggattaaaagattgcgcaggaataatggaaaatgggagaattggaagcatatagatagtcatactttgctaggaatcgcaacagcaaaagaaggtggtctcattgtttgtgatacttccaagggtttgctcaaggttacagaagaagatggttttagtgttcttgtttcacacgtaaatggttctcagttaagcacttttttgtttttatcacagaatcacttgcatatggcagagttgcacgtgaggcctgctagccagtacaatccgtcacggaagagagttgttattggcactattgattttattacgattcgttatacactggacaaaaacggaatcgtattccgttggacatcccggatcaccggaacaacaaccaccctgataaggtttgcagacgatgtgatagaaggctcaaacgggaatgtatattttagtgttgttagtacaaaatttgatcttcaagattggtatttggatgtgttagaggcaagacctcgtggacaagttctcaagtacaatcccacatcaaatgagactgttattgttcttgataatgttgcatttgccaacggcgttgcactctctaaggacgaagattatcttgtggtttgtgaaacttggaagtaa

SEQ ID NO: 29492 - DNA, 669 bp, Glycine max
  Peptide Sequence Number=SeqID_146270
gagtcagaagatgtttgtgtggataaagaagggactctctatacagctactcgagatggttggattaaaagattgcgcaggaataagggaaattgggagaattggaagcatatggatagtgataccttgataggaatcacaaccgcaaaagaagttggtatcattgtatgtgatgttaccaaggcaagctctcatggacaagttctcaagtacaatcccacatcaaatgagactgttattttcctcaataatgttgttgcctttgccaatggggttgcactctccaaggacgaagattatcttgtggcatgtgaaatttggaagtgtataaggcattggttaaaaggagcaaacaaaggcataacagatgttttaattgaaaacctccctggtgcacctgataacatcaatcttgctcctgatggatctttctggatccctttgattctgttgacttctaaaggactggagtttgtgcacaagtacaagacaaccaagcacctggttgattcatttccaaggctaattgtggtgaatgtggcaactgatggcaagattattagagagtttgatgatgctgattggaaggttattacttttgtgacttcagctttggagttcgaggaccacctttacttgggtaatcttaattgcaactttcttggataa

SEQ ID NO: 29493 - DNA, 756 bp, Glycine max
  Peptide Sequence Number=SeqID_146271
ctagtagctgaagttcttgagaggaacaaattacctggtgcaatattcacctctttctgtggaggtgctgacattggtcaggcaatagcaaaagacactcgcattcccctggtttcatttactggaagttcaaaggttggcttgatggtccagcaaacagttaatgagagatttggcaaatgcttgcttgagttaagtggtaacaatgcaataattgtcatggatgatgcagacatcaaattggctgtacgctctattttgtttgctgctgtgggtactactggtcagcggtgtacaacttgtcgtagactgggagggaaaatcctaaccggtggatctgtattagagtcgggaggaaattttgtacaaccaacaattgttgagatttctccagatgctcctgtagttaaagaagaattgtttggtccagttctgtatgttatgaaatttcagactctagaagaagcaattgccttgaacaattctgtacctcaaggattaagtagttcaatctttacccaaagacctggaactatattcaaatggatcgggccacgaggtagtgattgtggtatagtgaatgcaaacatacctacaaatggagctgaaattggtggtgcctttggtggagaaaaggcgacaggtggtggccgtgaagcgggaagtgactcatggaagcaatacatgcggcgttctacatgtaccatcaattatggaagtgaactaccattagctcaggggataaactttggctag

SEQ ID NO: 29494 - DNA, 315 bp, Glycine max
  Peptide Sequence Number=SeqID_146272
ataccggcaccgaagagaggtgagattgtgagacagattggtgaagcattgagggccaaattggatcctttgggtaggctggtgtctcttgagatgggaaaaattctcccagaaggaattggggaagttcaggaaattattgatatgtgtgattattgtgttgggctaagcagacaattgaatggatcaattataccatcagaacgtccagatcatatgatgtttgaggtatggaacccactaggaatagttggtgtaatcagtgctttcaactttccatgcgctgttctagctgctcttcaatctttcatataa

SEQ ID NO: 29495 - DNA, 186 bp, Glycine max
  Peptide Sequence Number=SeqID_146273
atggcacaaatagttatgtcctttgttgtctcatgcgatgatgcatggaccaaactaaagaaggcttatgccaatcgctctcttgctaaaatcctgtccttcaagctcaaggagcagcttgccacgatctccaaaggttcaccttttgtccatgattatcttcaccagtgtaattttgctctctaa

SEQ ID NO: 29496 - DNA, 315 bp, Glycine max
  Peptide Sequence Number=SeqID_146274
atgttgttttctaagagatcgtatgaaaccatcatgctaagaccgttgttggagagaatagctgttccagcagccatattgatagccgagggaggcgctcatccaggtgcaggtgaacttggtggtgctgggatgggggggtgcagtggcggtgagggaggttcattaatgggagtagtagaggacctggaggaagttcttggcgatggtggagcaaatgtggttgtttgcagaggcgtccatgatggattgcaccttggatcacgcgaggagaaggtcaattcctacgattttagtctattaaaattcttttaa

SEQ ID NO: 29497 - DNA, 503 bp, Glycine max
  Peptide Sequence Number=SeqID_146275
ccacaggatgcacgcttagcgcacttgcatgtgacagcttgcttccaaggtggcttcttgaggtaagtgggcttcttggactgagcggtcctgatgtgctaagcgaggtcaatatgccacccaggaatagacatgctagtgattcaatttctgatgagacttctactcaaccccaaaatgtagccccgagggaccatggacgtggcggcagtcatggtcaaggaagacatggtaggggtggtggaatgccaaatgttgaggttcctagagctactcgtgggaacccaacacttgctcaattaactgctaatatgaaaaatatgcacgaaacattgcgacaattagctcatgcggaccctcaagctttcatagatgaagagtcatggatatttcgaggtctaggttcttctcctactcagatgagttacttgtttagggtgattgcaagacaaggtgacatgacttatggtcaagccttgaatagggctataactgctgagtga

SEQ ID NO: 29498 - DNA, 930 bp, Glycine max
  Peptide Sequence Number=SeqID_146276
atggtagaagtctctgtggaagcaattgcatcccttactcagtattatgatcagccgctaaggtgcttcacgtttagggacttccagctggtaccaattgtggaagaatttgaagagatcatgggatgtccactgggaggaagaaagccatatctcttttcgaggttctacccctccatggaaaaagtagtcaaggtagttaaaatctcgatacaagagttggaccatgtgaagcaaaataggaacggggtagtcgaaataccaaggaagcatttggaggaaaaggcaaaggcattggcagatcaaggggaatgggcttcgtttattgacatcttgacactattgatatttggcttcgtcctctttccaaatgtggatggattagtggacctagaagcaattgatgccttccttgcttatcaccatagcaaggaaagcccgatcattgctattttggccgatgtctatgacatgttcgaccgaagatgcgaaaaaagcggcccaagaattgtttgctatacactggctctctatgaaggaataaccggggttttttcctcatgcgaaggatttccaaatgttcccttattgggaacaaggggttgtattatttataatcccgtccttgccataagacagcttggttaccccatgagaggagcgccgtcggaggaaaacatcacgcctttcatcgcatgggatttcagtgaccctaatgcgagggtacttcaaggagtctgcaaggcatgggatgcagtgcaaaggaaagataaaaagctttggggaagtagtaatgggatcatcgacgactctcataagtggctgagagcccagacaaaagagttggattggctcccaaagctaatggttgcaagagaggaagagactgaaactctagaggagagtgaggaagtacaaggtggaacttga

SEQ ID NO: 29499 - DNA, 615 bp, Glycine max
  Peptide Sequence Number=SeqID_146277
atggtggaggaatgggggctggaggaatggtggctagctgaggtgccagaggagcctcctaagcaacatgacctcgagtctttttggtccccagtaaaaccaaagaaagatctactgggttcctgtagttttccgtatatacgccaagttaatgatagggctcagagacttgaagatgagatcatgctcgccagatccatgtccatcttcatgataatcttgtatatcatctgggctctatccatgttgaggttggaggtacaagaggtgggagagaatgctccatgtctgagccagagtagtcatatccttcctcaagatcttccatggcctctcgatgttcagaatgaaatggcctctgagcaggcagagcttggttttaatggcctagtggtctgggtaagtatggaggaactgggagaagccatcctctgggtcgtagatgttggaatagaattccttcaccaaggccatgatgttcgagagatgaacgttgtcttggtatttgtgctaggcaaccttaaatgtgaacctggtggaatcccagactggttccacttcctgagggtggctttgacatatggaggcttggcgcttcttagaggccatctataa

SEQ ID NO: 29500 - DNA, 234 bp, Glycine max
  Peptide Sequence Number=SeqID_146278
caatcttccaacatgaagattgttctaaatcagtctcttattctggcgtcgcctccgtcggtgatttatcagccatcatctttttctgctctggcagtagatttggcttcgacagtggttgttaacatgccacgcacgatggaggaggatgatgctttgcgggacccatcattacccgaagtagaatgtatgcgagttcgacttcaagggaataaggagggagcaaatcattga

SEQ ID NO: 29501 - DNA, 576 bp, Glycine max
  Peptide Sequence Number=SeqID_146279
gtcatcattttcacagatcatgcaacgattaagtaccttccgacaaaggttgatgccaagcccaggctaatcaaatgggtgttgttgctccaagaatttgacattgaaatcaaagacaagaagggatgtgagattctggttgttggccacttatccaggatgcctatgtcaatatgctacactgtgatcagtgtcagagaactagagctatttcgaggagaaatgagatgcccctatagaatatcattaagagcactcatcaatgatggtgggtccacttctgtaatgcacaattgcagaaagtcttgggacacaacaatgtcagacataaggtcgcttcttcctaccatccttaaacaaatggtccggctgaggactgcttttaaaaccccaattggtctatctccatttcagatagtttataggaagacttgtcacctcttagtagagatggagcacaaggcctattcggctctcaagttccttaactttgatgagtccttatcaagggagaagtggaagttgcagttgttggaactagaaaagatgaggctcaatgcttatgactcctcctaa

SEQ ID NO: 29502 - DNA, 330 bp, Glycine max
  Peptide Sequence Number=SeqID_146280
atggcgcctcctctaacctcttctccatggtggaaatcaccattgaaggacctcattgaagctcaaagatccatcctccatagaagcttctcaagcaagcttcctccaatggttcctttgagttttgtcttgcaattttttgtggctgaaacctacatgtcgcaacatgcccttttgtgggcgagcgaggcgaggctcacgggtgcactttccaaaggaggaaagatgcgtggagtcgccaccaacgtttttttgtggaaaacgtcggaaaaaccgaaggaaaccggtcaaaacgaaaattctaagtttgggagttgtatttacgtttga

SEQ ID NO: 29503 - DNA, 231 bp, Glycine max
  Peptide Sequence Number=SeqID_146281
atgacttcgcatggctccagactcattggtggaggatgcatgaacgacaatcaattcatggggctccaaataaaagtggagaatggagaattggcgaatagcgctaggcaatcaattagaggggctccgaataaaagtggagaatggagaattttggagattggagaattggagaacagcgctaggcaatcaattcgcggggctcctgagtcgttggtggaggatgcatga

SEQ ID NO: 29504 - DNA, 354 bp, Glycine max
  Peptide Sequence Number=SeqID_146282
atggagtctccactgcatttggcattgttgctttggtcattagaggaggtgtttgttgatggtggccgccaaaggggacgatgcaagggtatttgtgtccaatcagattattttgggtgcaagaagaaaaaggggtgcaagaagacgatgcgtaggggcaccttgacggagaaggggttgtcgaaagggtatgttgacgacaaggacgaagttgaagatgatacacttatatttgatacacagaaacttatgaaatctctattggaggtttgttgtctagtgaagaatcatgtagatgaaggagaaaaagaagaagaggaggaagataaagaaaaaaaaggatacattttgtga

SEQ ID NO: 29505 - DNA, 981 bp, Glycine max
  Peptide Sequence Number=SeqID_146283
atggaaagagcaaagtcatcgattgaacaaattcagcctcctacttatggaaacttggtaaccattcttagcatcgatgggggtggcattaggggcatcatccccgctaccattattgatttccttgaatctcagcttcaggaattggatggtccagatgcaaggcttgcagactattttgacgtgatatcaggaacaagcacaggaggtcttgtaaccgctatgataactgctccagacaacaataatcgacctctttttgctgccaaagatattaagcctttttacatggaccatagtcctaaaattttcccacaacatagtggccttggtgggacgatattagcaaaagtagtaaaatctctgctgggaggacccaaatatgacgggaaatatctgcatggtgtcgtcagagagaaacttggagacattcggttgcatgagacactcaccaatgttgtcattcccaccttcgacatcaagtctttgcaaccaatcattttctcatcttatcagattaagaattccccttccttggatgctaagctctcagacatatgcattagcacgtccgctgcacctacttatctccctgcccacaatttcaacaaccaagattcaaatgggaaggtacacgaattcaacctcattgatggtggtgtttgtgcaaataacccgaccttagttgccatgaacgaagtaacaaagcaaatcattaagcaaaattctgatttatttccaataaagcctctggaatatggtcgcttcctaataatttcaataggcaccgggacagcaaaaaatgaggaaaaattcaatgcacaaatggcagccaaatggggattattggattggctaacccaaagtgggagtactcccttaattgacgttttcactcaatccagtgcagatatggtggatttccatttatctgctgtgactcaagcacttcattcacaagataattaccttcgaattcag

SEQ ID NO: 29506 - DNA, 2010 bp, Glycine max
  Peptide Sequence Number=SeqID_146284
atgtcactttatattggtaatctgtcagaacattctcaaagagatgatctcgagcgtgttttccgtcgatttgggcattgtaatgttcagctgaaaagagatggctatggctttgtagtatttgatttccctcccgatgcggaaaaggctctgagagcactgaaaggtagaaatatatgtggtgaaccgttgacactaacatggtccaataaacagcctagtacacatttttctagaattcctagtggtggcagaagaaatgtgtatgagttacaacatgcgaggaatcctgaaagagtcgggtatgtgagaaggagatctggtttcagcgggtggtcgaatcagaagatgggaaggggaaaatctgtggaaatgcccagtgaggagaggggatatcgtcatgatgattttaaagattatgttggggaagaaaaaaaatttgggggagactttccctatgaaggcggtggagttgttcctaacaaggaggatgagccagttcatgacccgttagttgacaatgggaatggaaatgctatagaatttgatcgttatgaaccttaccagggcaatgataggaagcatgacaatgaagattatcatgtcggttactctggtggttctcctgcagcccattccctagagaatgtgagcagagccattggcgaggatacctcaaatcgtccaaatgggtcaaaattccagcaaatttgttttagatgtggtgatcctggtcataaaattcgaaattgtccaaaagaacatacttcacagaggaaatataacaggttggatgtttggcagaataatagaatagacaagaagcataaaagtgaagatgtgaataaatttgaatctgattccttggcaaagctgcagtcaaatttggagccgttgtcactgaggcaccagagagatgggaggaggttgtctggttcacgacatcaccatgcaccatggagaaatgaatcattcccgggagcaagggaaactgataggcataaaaaaaaggaatatgtaggaaagaaacgaagcagaaatgacatagaattgcctaaacaatctaatgcaaagatatccaagcggtcagtctcatcctctttgctatctgattactctgcatctcactttctttcaaattctcagtcatccaagtcattgcgtaggtctagttcccattctagatcaagatcagtgtcttctagatcacattcttcatcatcaaaatctcagtattgtaaaggtaaaagtttgaattctaggagatcaagctcccctatgtctctgtgtctatcactcaatcagactttatcatcatctccaaataaaatacagttgaattcaaaagcctcgtccattaatggtactgctcttgaatctgtggagcatttggttgcacagggacaacaaattggcagtaaaatggaattggataatcttcaatccaagggtacaggtgttgctgtaaatggaaaagctgcagtgtataccacagtggtggatggtgtggaaaagggccaatttgtacaggaggacaatcatgaaaatcattttatcttaaaatcatctgacagagtaacagatttaaacgaaccacttgttgggaatttatctccaccgatagaaaaagagacaaaggatattgagcattctggagcaatgatgttggatgatatttcaacagaaattcagaagtctgcttctgaaactaatgtcaatctccattctaacctttcaaccattgtatccacagaggagatttgcatggttcttaatacctatggcttggaacttccaaaagacgatgaaaacaatttaacaattgatgccttatttggttgtgctcggttgtggccttggcatgttgtttattaccgtaggttgaagaaaggcccaatttcaactgagaactatgccaggcgggttgctcagaatcaggaatttggcattgttgataagtatgtaagaagcagtagtggatggggagagttcagtcttgagaatgcttaa

SEQ ID NO: 29507 - DNA, 1101 bp, Glycine max
  Peptide Sequence Number=SeqID_146285
atggagaggcttcagaggatgttcgctggtgcaggtggagcgctgggtcatcccccaccggattctcccaccctcgattcctccgagcaggtctacatctcctccctcgcccttctcaaaatgctcaaacacggaagagctggagtaccgatggaagtgatgggtctgatgttgggggagttcgtggatgagtacaccgttcgcgttgtggatgtgtttgcgatgcctcagagtgggaccggtgttagcgttgaagctgttgatcatgtttttcagactaatatgcttgatatgttgaagcagactggaaggccggagatggttgtggggtggtatcactcgcatcctggatttgggtgttggctttctggagtggacattaatacacaacagagacccccaaacctagacaatgcagctggtattgtggttgcggagctttttaaaaccttggattcatctcttaaatattactgcagattgaaagagggagagagaacgagagggggtagactgggaagtgcaaaagttgagggtgatgggttgcctggtgtaggattgagtagttttgaggctttaaatcaacgggcagtggctgtggtggtggaccctattcagagtgttaaaggcaaagtggtaattgatgctttccggctgattaatccacaaactatgatgctgggtcaggaaccacgacagacaacttccaacctgggccacctaaacaagccatctatccaagctctgatccatggcttgaatagacattattactcgatagcgattaattacagaaagaatgaacttgaagagaagatgttacttaaccttcacaaaaagaagtggactgatggtttgacactcaggcattttgattcacattctaaaactaatgaacagactgttcaggaaatgctaagtttagcagccaagtacaacaaggcagtgcaggaggaagatgagctgccgccagaaaaacttgcaattgctaatgtggggaggcaagatgctaagaagcaccttgaagagcatgtttccaatttgatgtcatcaaacattgttcagactttgggaatgatgcttgacacggttgttttctag

SEQ ID NO: 29508 - DNA, 708 bp, Glycine max
  Peptide Sequence Number=SeqID_146286
atgtggccttgcatggatgctaagctctcagacatatgcatcagcacgtctgctgcacctacttatctccctgctcacaatttcaacaaccatgattcaaaagggaacgttcacgaattcaacctcattgatggtggcgtttgtgcaaataacccgaccttagttgccatgaacgaagttacaaagcaaatcattaagcaaaattctgatttctttccaatcaagcctatggaatatggtcgattccttataatttcaatagggaccggaacatcaaaaactgaggaaaaattcaatgcacaaatggcagccaaatggggattattggattggctaacccaaagtggtagtaatcctttaattgatgttttctctcaatccagtgcagatatggtggattttcatttatctgctgtgactcaagcacttaattcacaagataattaccttcgaattcaggatgacacattgactgggacggattcttcggttgacattgctacaaaggagaacttggaaaaactttaccaaattggagaaaatctattaaagaaaccggtctctagggtcaatttagagaatggtctctttcaaccactgaaaaatggggaaaccaatgaacatgctctcaaaaggtttgcaaaaatactttcacaagagaggagactccgagaaatgagatccccaaacactaaaaagaccttctag

SEQ ID NO: 29509 - DNA, 405 bp, Glycine max
  Peptide Sequence Number=SeqID_146287
atggagagagcaaagtcatcgattgaacaaattcagcctccaacttatggaaacctagtaaccattcttagcatcgatgggggtggtattagaggcatcatccccgctaccattattgatttccttgaatctcagcttcaggaattggatggtccagaagcaaggctcgcagactattttgatgtgatatcaggaacaagcacaggaggtcttgtaaccgctatgataactgctccagacaacaataatcgacctctttttgctgccaaagatattaagcctttttacatggaccactgtcctaaaattttcccacaacatagtggccttggtggaacgatattagcaaagataatatataagatctctgggaggacccaaatacgacgggaaatacctgcatga

SEQ ID NO: 29510 - DNA, 408 bp, Glycine max
  Peptide Sequence Number=SeqID_146288
atgaagtccaagacatggttaggatcatggaagaagccaccaaactctaagcagcaaggaaatacaatacaaaagtttaaccacgtgtctttcaacccgacgtcctcgtgtggcgagtccaaggctaagccagaaaagatccccaagcggaaaagcttggtcccaactaggaagggcaattcatggtcgcaaatccaaaatgttatactctttttcctattcaagtatacccatagtcgtagctccaaggcttttaaaacccaaggaccgtccttggtgagccgtccttctaacactaagtctccagtacgtgccaccactagaattaatgaagcattgggcttgaatctagaattgggcttgggcttgaatccagcattggccttggacttgaagagggcagactaa

SEQ ID NO: 29511 - DNA, 636 bp, Glycine max
  Peptide Sequence Number=SeqID_146289
atgggtggtgtcttctaccatgaagaagagccaataaaccataccaagagatgcaaattccttgcagggactttgaaagaagtattttcccactgtcaaactttaagttgtcggaggctttcaactgcaagccttgaggaggagtgccccatcattgatgatgttgatgaggtggttgtttcagcggttagaagtcgagttatggagaaacaaaagcacaagccaagcccattgagagaaggcttttccatggcatattctcctgcaacaagggaactgtatgtcactcacagtcacacaatggcaccacaagcaaaggtggtagtaggtgatgaagaacacaacgaaagagaagagttcttttcggttaaaagttgtctctcgtgctgttcttcttcgagtgctgtgagtgaccaagcattttattctgtgaagacaaacctgtctagatgttcaagcatgaatgaggttgacatctcagaatgttggcggcgttcgataattcaagagttttgtcactgcgagggatggccttttggtctgtgccgtaaagctgtgttacttccaccactgcctaagtcgccgtctgagtcatggttgtcacgcaaaatacaacgaagtaccaaagttacctga

SEQ ID NO: 29512 - DNA, 1380 bp, Glycine max
  Peptide Sequence Number=SeqID_146290
atgtcaaacccggtgtttctcaagcctgcagatggcactgaatggaaaatacattataccaagcatggtggtgagatttggtttcaaaagggttggaaagagtttgcaacatactattctctagatcatggtcacttgctgttctttgaatatgaaggaacttctcattttgatgtgcacatatttgacagtagtgcccttgaaatagactatccttcccatggtactcatgagggaaaggacaatcttgtggagatcagtgatgattcggtggaaattttgggtgagcaattttcctgccaaaacactagagggtcatctcctcaaccttgtaagaaaatgaaaaatagcataactacaaatgtcgaaagaagccccaatgtggtaaacttgcatcagcatgtcccaactataagtaatagctctcaaaaggcaacattcatgaagcaaatgttagatgaagatgatggcataggcatttttaacaccgaatacccaaaagtagagcagtcaacttctacggctttaaaaaaagcctcaacattcagatctgaacatcccttcttcaggcttgtcatgaagccatcctttattaatggatattacctggaaataccacctcaatttgccgaaagatatttgaagaaaacacatgcaattgtcatccttgagattttggatgggagaacttggtctgttatttgttctgcaactagacttactgagggatggcagaaatttgcatcagaaaataatttgaatgtgggggatgtttgtgtttttgaactgatccagaagatccagggcctttgttttaaggtttccatctatcaaggtgctgaagaaccaatttgccccatttcacaagctagaactgaattgagtgaaaatgcaaatattgttcttttaaaatgctgcatagtgcatccttcaaccaactggacaggtggaacttcaagtcaaagatcttcacaggtgaaaagccgctccaagttgaagatcttaacaatcagatacatagcactaaaaagagctagcaaattcacatcagaaaatccctttttcatggtcactttaactacaaaattaaagtcaattataaccagagacgtgcatgtgccgatggactttgtcagaaagcatttagtaaacgtgaagcagaagttgatgatgatacactttagaaagaaattgtggccggtaaggtttgtcgtccgtgaaagttctactgtttcaggcaatctctctactggttgggcctggtttgtaagagaaaatgaactgcaacgtggagatgtgtgtatctttgagcttttcaacagagaagatgcaacatttgatgctcatgttttcagaggacaccgtgaggtaatgcattag

SEQ ID NO: 29513 - DNA, 315 bp, Glycine max
  Peptide Sequence Number=SeqID_146291
atgagcgagttgagtttagagagagcggcggtcttatcgggggggcacttcgagagagagaggttcagagatcggagagcctcgtcgagcttgccggcggccagggcggcgcagcccgccttattcgagatcgcggagtcgatctccgccatgagcgcctccggcgtcgccgtgattatcttcacgccgtcgaatacgttccagtggaccgaacccgaacccatgtcggtggtgactctggtacacgagattttgttaatcggtaagagcgatttgtcacgaaaggaggtgaatgatgaatgtgttgctgtgtaa

SEQ ID NO: 29514 - DNA, 213 bp, Glycine max
  Peptide Sequence Number=SeqID_146292
atggcagaatgttttatactgtctgatggagttggtagaggagcaacaagaggaagagatctggcatcaaactcacatataagatgtggctacaaagtagaggcaacaaaaagaatgggaaattgggcagggagtaatgagggctgggctcaaaattcagcttcttctttgttaaagaggatttattggccaaaggatcataaacggtcctaa

SEQ ID NO: 29515 - DNA, 846 bp, Glycine max
  Peptide Sequence Number=SeqID_146293
atggcgagagaggagtggaggcttcaacttcaccaaagagcgaactcgatttgttcctacaagaaaatcactcttctgatttgctttctcaacattgttgttgctctctactctcttcgctctctctatgcttctctctctatttactctggcagcgttgcacgaaacattgtggtgtataggccagatcagatccggaagatggaagagtctaaccgaatccggaaggcatacaaaccagtggagttgatgaaattggtgaaggaatttgaaggtgagttttcaagagaaaatgtggtggttgagttgccgcggcatttgaaacagaaaataagtgatgaggtctcgcagagactagggagcttgaatgaaagtagcaaaaacatctttcacccccaggtcatggctaaggagcgaggaatgctagtaagagctttggagtctgattgggatgtgctttctgaagaaattggcctttggatacctattcaggttgctaatgaagaacataatgacaaacctgagagcacaacagagatagaggaggaagttcttcccggcaggccccttcaacctgaatgcaatcctgaacttcatacggactatgatggcactgcagtaagatggggtcttactcatcacaaagatagtgcagctgattgctgtcaggcttgcttagaccaggccaaacatgccaaagaagaatgcttaatagcctttgattctatattccctgctgagaaatccaaactaaattttaaggatagatatcctgaatggtatcgaaattcacacccatctgcaccggtgatcgttccatgggcatctggagttgtcagtgcatga

SEQ ID NO: 29516 - DNA, 870 bp, Glycine max
  Peptide Sequence Number=SeqID_146294
atgtatcctgaatggttttttgcgctaagaaatggttttgggcttctgatgtatggctttggatccaagaaggttctgattgaagattttgcttcaacggcactgaccgagtattctgtagttgtcattaatggatatcttcaaaccattaacttgaagcaggttgttatagctttagctgaaattctgtgggaacaagtgaaaacaaagcaaagggtttcctatcgggacttacccaagagccaacagtcattcaattcaaaatccatggaagatcttcttacatttttggatcaagcggaaatagaggcgggtgctttttttgtttgtgttgttattcacaatattgatggatccggattaagggactctgaaacccaacaatatcttgctcgactagctgcatgtgcccagattcgtgttgttgcctctattgaccatgttaatgctcctctgttttgggacaagaatatggctcatacacagttcaattggtgctggtatcacgttcctacttttgctccttacaaggtggaaggcatgttttatcctatgattcttgcacatggtagtgccagccaaactgtcaaaacagctacaatagttctgtcaagtttgacacgcaatgctcagagtgtattcaaagttcttgccgaacatcaactctctcaccctgacgaaggcaatgatctctactcagtctgtcgagaacgtttccttgttagcagtcagattacgctgaattcccatttgactgaatttaaagaccatgaactggtcaagattaagaagcattctgatggtcaagattgcttgcacatccctctgacagccgaagcacttcagaaagttgtgctcgagatcatttag

SEQ ID NO: 29517 - DNA, 411 bp, Glycine max
  Peptide Sequence Number=SeqID_146295
atgtcgttagggtttcgattccaggtgtcgatggcggtggagagggtggtggtggtggaggaagcagggttgtggaatctagggtttcaaaatcaagggtttagggggaacaagggtttggtgagacaaggtcaagggagtgttggtggtggtggaagaggagggaatgttaatagggttggtggaaatggtgttgggaacagtgtgagtgctattagtagtgttaatattggaggagttagaggtggtggtggtggtggtggtactactgttggttttggtggtactatattgtttgtgggtgattcgcattggtggactactgatgttgagcttagtaagtacgggccggtgaaagtggtgaagtttttcaatgagaagacaagtgggaagtcaaaggggtattattga

SEQ ID NO: 29518 - DNA, 363 bp, Glycine max
  Peptide Sequence Number=SeqID_146296
atggcttggtgtcaatctggtcctgccagaatcagtggagatgcatttctggcagcatggagggcttatagggagaaagaaagggaagtggttatggtggggcatttgggcaaccgtattatgtgtatatctgctaatggggcttcgggaactttttggagtgtctatgtggatttatatggccaaatatggattctgttggtgatagagagcaggttcgggtttctttgtggcttaagctttacttgcaaaaatatcgaaatctttgaccaaaggattttctccgggagggggattggatgtatcactttttcccaaaatgggctaacttggtgggagggggattacttgggtgttaaataa

SEQ ID NO: 29519 - DNA, 786 bp, Glycine max
  Peptide Sequence Number=SeqID_146297
atgtccctatcaaaccttatcactcacatcatcattgaggataccaacagaaaggaatatgctactgcaagagccaatgctttgttcgttaaggcaaatatggtgcaaggcaaacccgctcagagaaggtatggtcaatgttgtgaccaatatgagcaaatgagtgtttatcctggtgattccaagactactccaattctaggtaaaggaaaggttcttctcaagctcacatttggtaagacactggctttgagtgatgtgttacatgttcccaccattaaagctaattcggtctctgtagcactgttgaggaaggacatattccctttaaggtctaatgctagttctagtaccaatactagtcatgagcaacctattgaaacatgtagtgaacctatgtgtgaggatttgagaaggtgtaaaagacaaagggtagagaaatattttggagaagatttttatacatatcttgttgaggatgaccctttgagcttttctgaagcaattagttcttcatatgctaacctttgggaacaagtcattaagattgaaattgactctatcaagaagaacaatatatggactttagtaggcttacccagaggagcaaggccaactagatgtaagtggatctttaagaggaagtataaccctgatggatcaatagacaagtataaggctagattggtagccaaagctgccaccgatatgctagtgattcatcagatggatgtgaagacaactttcctaaatgatgatttcaacctgaagggtgtcaagttcccg

SEQ ID NO: 29520 - DNA, 273 bp, Glycine max
  Peptide Sequence Number=SeqID_146298
atggtggtggccgatggaatgtgtcatgacactgacaaggacgcgtgtcgaacaccggacacgacaagggactgggatcgaatggtgttgtggtcgtatccgccgacggcaaggcaaatggcggtgaccggcggcgtatttgtcgtcggcggtttgctcttcggcgtcggagcttatttctcgtttgttaacgtggctcctcaacaggagcgtcttaagtctcgcagggaagcaatgaggaattatatcaagaagcgattcggagattcgtga

SEQ ID NO: 29521 - DNA, 342 bp, Glycine max
  Peptide Sequence Number=SeqID_146299
atggccttgatcatttcaatgcatacaattgcaattaatgcgcaagagattcagtcaaagtctactctaaaaactatcctaaatgaatgtaatgtaaaaagtaagagtaagaaagcttggttgcctccctgtaagcacttctttaacttcactagcttgacatttggtgtcgctctaagaatctttgagcttgatgactacggtgtgttgtgggacttctccgccaagagcttggatgattcatatgcgttgaggcgcatctcttcaagttcctatggttgtaccttcctcttctctttggatgttgtagagttaaagttgaggaacttcatgacccaatga

SEQ ID NO: 29522 - DNA, 231 bp, Glycine max
  Peptide Sequence Number=SeqID_146300
atgcctcctaagtatgctactcgtggacatttctcagtgaaatcagatgtctttagttatggtgtgatagtactagatattataagtgggaagaaaaatatggaaatttcaaactcagataacttcaataatcttcttggacatgcatggagattatggatagaagagagagaattggaattgttggatgaagtgttaggagaacaatgcacgaccttcgaagtcatatga

SEQ ID NO: 29523 - DNA, 1035 bp, Glycine max
  Peptide Sequence Number=SeqID_146301
atgtcgacaaaccactacaccatggaccttcccgaaccaacactctggtggccacacccacaccaacaacaactaaccttaatagatccagaccctctccctctgaacctcaacaacgacgacaacgacaatggcgacgacaacgacaacgacgaaaaccaaacagttacaacaaccacaacaggaggagaagaagaaataataaacaataaagaaccgatgttcgagaagccgctaaccccgagcgacgtggggaagctgaaccgcctcgtaatcccgaagcagcacgctgagaagtactttccactgagtggtggtgactcgggcagtagcgagtgcaaggggctgttactgagtttcgaggacgagtcggggaagtgctggcgcttccgctactcgtactggaacagcagccagagctacgtgctcaccaaagggtggagccgttacgtgaaggacaagcgcctcgatgcgggagatgtcgttttattccagcgccaccgcgccgacgcgcagcgcctcttcatcggctggaggcgcaggcggcagagcgacgccctgccgccgcctgcgcacgttagcagcaggaagagtggtggtgatgggaatagtagtaagaatgagggtgatgtgggcgtgggctggaccagagggttctatcctgcgcatcatccttatcctacgcatcatcatcatccctcgccataccatcaccaacaagatgactctcttcatgcagttagagggtcccaaggtcagaaccaaaggacgagaccagtgggaaacagcagttctagttcgagttcgagttcaagggtacttaggctattcggggtcaacatggaatgccaacccgaacatgatgattctggaccctccacaccccaatgctcctacaatactaacaacatattgccatccacacagggcacagatattcattcccatctcaatttctaccaacaacaacaaacttctaattccaagcctccccctcatcacatgatgatacgtcaccaaccatactactactag

SEQ ID NO: 29524 - DNA, 2613 bp, Glycine max
  Peptide Sequence Number=SeqID_146302
atgggtcatggcgttgttgtgttgattatcgggcactcaacactatcaccgtcaaagacaaattccccatgccaaccgtcgatgagttactcgatgatctcgggaaagccacagttctctaaacttgacttacggcaaggttttcatcaaattcgtatggcggatttcgacctttccaaaactgcatttcgcacgcaccagggccactacgaatttcgtgttatgccatttggtctctgtaacgccccctctaccttccaatccgccatgaacgacacactcaaaccttacctgggcaaatttgttgtcgtcttcttcgacgacatcatggtttacagtcaggacctcctttctcacatcactcacctggagtcggtcctctctaccttactcactcatcagttttacttgcgcgaatctaagtgtgtcttcgctcagtcacgacttaactatctgggccatatcatatccgcagaaggcattgcccctgaccccgagaagatccaggccatggttgactggcccattccaacttccactaccaaccttcgcggtttccttggcctgacaggcttctacaggaaattcatcaaaggatacgcatccatcgcagctccaatcaccgctttgctccgaaaagaccaattcatttggtcccccgaggctacctccgccttcgatcacctgaaaactcagatgacccgtgcccctgttttgtccaccccagacttcaatattccctttgtattggaaaccgatgcctccgcagttgctatcagggcggtgctcattcagcagcagcatcatatcgcctattacagtaaggtcttgtgtccccgtctccggcgagcttcagcatacgtcagggagcttcatgcaatcacatccgcagttcgtaaatggcgacactatctcctgggcacctccttcacgatacttactgatcacaagagccttaaggacctcatgtcccaggttattcagacaccgaagcagcagacttatctggtgaagctcttgggatacgactacgagatacgttacaaaccaggcgtttccaacgttgtcgcggacgcgttatcccgccttccctcaggggagttcttatccttcaccgtgcctcattttgacttcttggacactttccgacgttctctgaccgccgataatcaatactgcgacttacttaccgccattcaaaccagaccggcagatcacccatctctttcagtccaccgtggtctcatcttcaaagaccaccgcatatggctacctttccccaccccttttacatcctccttgctcgaagagttccacacatctcccctcggcgatcactccggcgttgccaaaacccttcatcgccttcagcagagcttcgactggccaaacatcagggctgacgtccgtcattttatctcgcactgcctcatttgtcagcaaactaaatatgagacaaagaaaccttcaggcctcttacaacctctcccaatttcggcgagaatttgggaggatctgtcgctagacttcatcaccggtctccctccttctcacagccacactgtcatattggtcgtcgtcgaccgttactccaagggagcccatttcggcgcttttccggcacagcacacagctcatcaggtcgcggttcgtttcatggacatggtgtgcaaacaccatggatttcctcggagcttggtgtccgacatggatgcactcttcctcagccatttttggagggaactcttcagactcaatggtactcagctgcgtatgagcacagcataccaccctcagtccgacggacagacggaagtcgtcaactgcacactggaacaatatctccgagcttatgtccatcacaaacccaaccagtggttccggtatttatccctcgccgaatggtcgtacaacaccaccgtacattccagcaccggtttcactccgtttgaaatcatatacggccgtccaccacctaacattgtcgactatgttatgggttcctctcccatcgacgcggttgattcattcctcacggatcgcactgaactccatgtcgtgcttcaacgtcgcctcctcaaggcccaatttgtgatgaaggtcaatgatgataagcaccgccatgacgtacattacgtcgtcggcgattgggtcttcctccgcctccgtccataccgccagaaatccatgaccccaacttattcaaagttggccaaaaggttctttgggccttaccaggtgactgaacgtatagggcccgtggcatacaagctcgccttacccactgattcccgtatccacaacgtcttccatgtctccctcttgaaggcacatcatggacctccgccttccaatgataatcccctcccttccttagcagttgatcaccaccccgtggtcaaacctttgacaatcctggactggaaatgggatttgtcagtcacacctcctcaacgcatgcaatcgtacaacctcgaggacgaggttgttttcggaggcgtgggtgttgatagtaatacgcagaacagagaaccaaataacaacatcaatggcgacactagcaggcccaagagggtgacccgcaaacccacttacttggaagatttcaagtga

SEQ ID NO: 29525 - DNA, 153 bp, Glycine max
  Peptide Sequence Number=SeqID_146303
atggcgccaatgcttcactcaaaatcttccaagccaccagcgctcaacaactacagcttcatttcagttatatctttgtcatcagttgatgcgcatacacttcacatgacagaactcagacaaccacctaggcttgtggcttcaagcttctaa

SEQ ID NO: 29526 - DNA, 1315 bp, Glycine max
  Peptide Sequence Number=SeqID_146304
atgtcgtcaagaacaagtttttccgtggtgcatggtgagcctgaactggtggtgccagcaggaccaactccgcgagaattaaagaacctctctgacatagatgaccaagaagggttacgttttcagcatcaggtaataatgttctaccaaaagagtcatgttatggaaggaaaacaccctgctacggttataaaatatggtttggctgaagcacttgtacactattacccactagctggtaggttgagagaatggcctaatagaaagttaacagtggattgcagtggtgagggcattttgttcgttgaagctgaggctcatgtttcactcaaggagctaggcaattccattctgccaccatgcccccacatgaaggaactcctccttgatgttcctggatcacaaggcattctcggatgccctctgctgttgtttcaggtaacccgtctaacatgtggaggatttgctttcgccgcacgcatgaaccacacaatctgcgactcactcgggctagttcaatttctcaccatggttggtgagattgcaagaggtgtttctatatcacagttccctgtgtggcaaagagaactattcaatgcaagagacccaccaagaatcacttatgcacaccacgaatatgatgaaaccaaacattgcagcaacaaagatacaatggactttgaccaaatggcccacgagtcatttttcttcggcccaaaagagattgcaacccttaggagtcaccttcctcagcacctaagaaaatgctcaacttttgagatactatctgcttgcttgtggaaatgtcgcaccaaagcacttgggctggagcccaatgagatagtgggcttatctccctttattactgctcgtggcaaagtgggcctacatgtgcccaatgggtactatggcaatgcctttgcctttccaatggcgctttctaaggctggacttttgtgccaaagcccattggaatatgcattgggtttgataaaaaaggcaaaggcccaaatgggtctagaatatgtgaaatcagtggcggatcttatggttctcaagggtcggcccaaatacaaaacaaaagaaaattaccttattggggatactacccatgtggggttctatgatgtggattttgggtgggggagtcctatctatggagggcctgcaggggctataccttttgttagcttctatggacggtttagaaacaatgaaggtgaggatggggttgttgtgccaattttgttgccacaccatgtcatgaagaggtttctctttgagctggtgaagatcacaagtgaggtacctgtag

SEQ ID NO: 29527 - DNA, 1737 bp, Glycine max
  Peptide Sequence Number=SeqID_146305
atggggtccagtgccagcaaggccacgtcatcatcgtcctcttcggggagttgcaggaagggtcgatctaagggacaccgaggtttcccatcttattgtctgggagcctcgtctggatctcgtgacattgatagtgacgaccagaataaagtaaatggagaggatgtgacatacagtagtggcaatgaaatagattcagatgaggtgaagacagagtcttttagaaaggttaaatctgataaatctgatgaagtgccttgtgtgccttccaacattgaccttgaggagtggggccacactgcatccagaactggtagcagctctgcacattcttcttcaaatcagtccttgaacccttcaagccgattcctttctcgctttagccttgttcctggtaatataagcttcagacttagcagaaccacaagtttggggtcatctaggccttgcccggtttcttcagagagtctctcaatatttaacaatgaagatgagcttaatctgcctccagggcttcctggcagcttgatcaatagaaatgaaactcaacaccgttgtgacttgcttaatgcatctcttgctagtcaagtgcctatacagtgtcatcaagaagcttccaataatttaagatccaataccctgacattggtttcccctggcaacttggttagcagtcgcatttcttctgttcaggatgtggtcagagatggaaatggtactagagaagtgccggatatgaacttgttttctccaagaattcatactgatacagaagatattgagactagacatactgatagacggaatggagctcgagagcctgttgaacgtaatgttcgttttagccggacattaagtgttggaaggctccgtgacagggttctccgccgaacaacagtatcggacttcacattttgccctctgcaacgagagagagatgctagtcaagataatggaagacgggcaggggagagagacacaagactgtcaccatctggtcgtaatgctacaaattcttctacacctagatatcctctacccagtacacctagctccttgtttggcatccaagactatgaagttgagacttcacgatctagagaaactaggtatcaggacctactggagcataggtccaatttcctcgaacggaggagaagaatacggtcccaggtaatcagtaactgggctgtggcacatccacctagagctaaaaaggtccgtgctcttcagcggttgggtagccggtttgaaaatctttctggacatgacagatcatgtatcttatctggtcaacatagaaatggtcgttgtgcatgcagaatcaatagtcgtgataccaattcaaatgatgataccaatgcaagagctagcatatcaagaattgttatgctagctgaagccttatttgaggttctggatgaaattcaccagcaatctatggttttatcttctcgcccttctgtgtcatctatcggttctgttcctgcacctaatgaagttgtggaatccttgcctgtcaaattatacactaagttgcacaaacatcaagaagaacctgtacaatgttatatatgccttgtggagtatgaggatggagacagcatgcgagttctgccttgtcatcatgaatttcatacaacatgtgtagacaagtggctgaaggagattcacagggtgtgcccactatgtcgaggggatatctgtgcatctgattcactgccaagggagaactaa

SEQ ID NO: 29528 - DNA, 1977 bp, Glycine max
  Peptide Sequence Number=SeqID_146306
atgaagagcataaacgacgacgcttcaacccaagatgtcgaccctcagagcgaccacagctccgattacttagctcaccctaactcccaccccgaaccccaccctcagccccgccgtccgcggggcttcgcggcggcgccggtcaccaccaataccggcggcaaggggaagaaggagagggagaaggagaaggagcgcaccaagctccgcgagcgacaccgtcgagccatcaccagccgcatgctcgccggactccgccagtacggaaatttccccctgccagcgcgtgccgacatgaacgacgtactcgccgcgctcgcgcgtgaggctggctgggtcgtcgacgccgacggcaccacctaccgccagtgcccccctccttccaacgtggggtcatttgcggctaggtctgttgaaagtcaactctctggtggttctttgaggaattgttctgtcaaggaaactattgagaaccagacagctgtgcttagaattgatgaatgcttgtcgcctgcatccattgattccgttgtaattgcagaaagggactcaaagaatgagaaatatacaaatgctagacccatcaatacagttgactgcttggaggctgatcagcttatgcaagatattcattctggggtgcatgaaaatgactttactagcacgccatacgtttctgtttatgtaaagcttccagctggtattattaacaaattttgccagttgattgatcctgaaggcataaagcaggagctcatccatatcaagtctttaaatgtagatggtgttgttgtggattgttggtggggcattgttgaaggctggagctcacagaaatatgtctggtctggttatagggagctttttaacattattagagaattcaaactgaagttacaggttgttatggcatttcatgaatgtggagggaacgattctagtgatgcattgatttccctcccacaatgggttttggatattggaaaagacaaccaagatatattcttcacagatcgtgaaggacggaggaatactgaatgcctttcttgggggattgacaaagaacgagttctcaaaggcagaactggaattgaggtctattttgatatgatgagaagctttcggacagagtttgatgacctgtttgcagaaggtctgatttctgctgtggaggttggacttggagcatctggagagctaaaatatccttctttctcagaaagaatgggatggaggtatcctggtattggtgagtttcagtgctatgataaatacctgcaaaatagtctgcgcagagcagccaaattgcatggtcactctttctgggctagaggacctgataatgctggacattacaattctatgccacatgaaactggattcttttgtgagcgaggcgattatgacaactattatggacgcttcttcttacactggtactcccagacattaatagaccatgcagataacgttttgtctcttgcaacccttgcttttgaggaaacaaaaataattgtcaaggtagtcttcttggttcctgctgtatactggtggtataagactcctagtcatgcagcagagttgacagcaggatatcacaatccaacatatcaggatggatactctcctgtgtttgaggttctgagaaaacatgctgtcaccatgaaatttgtctgcttaggatttcatctttccagtcaggaagcttatgaaccgttgattgatccagagggtttgagttggcaggtgctaaactcagcttgggatcgtgggttgatggctgctggagagaatgcactcctttgctatggtagagaaggatacaagagattggttgagatggcaaagcccagaaatgatcctgattgccggcacttctctttctttgtttatcagcaaccatctttgctgcaggcaaatgtttgcttgtctgaactggatttcttcgtcaaatgcatgcatggtaaggatccttag

SEQ ID NO: 29529 - DNA, 1266 bp, Glycine max
  Peptide Sequence Number=SeqID_146307
atggagagtccccattcactgtctccctcttcctcctccgacggcgtcggcttcgagacggaggagccgcggacgccgctggccgtgcgccgcgcgctgcagctcctcaactccggcgatcccgacctgcgcctccaagctgctcgcgacatccggcgcctcacgaagacgtcacaacgttgtcggcgccagttatcccaggctgtcggtccactcgtttccatgctccgagtcgactcgcccgagtcacacgaacccgctctcctcgccttgctcaacctcgccgtcaaagacgaaaaagatggttcagatctctgcattgaacgtgatgttcaaccactgaaaggcttttttcatactcatgagtcatgtcctcattatttttgttcaagtggggtgaaaatgggaaggaataaaatcaatattgtggaggccggtgcattagaaccgataattagtttccttaagtctcagaatctaaatctgcaggagtctgcaactgcatctttgctcactctatctgcctcttcaaccaacaaaccaatcattagtgcttgtggtgtcattcctcttcttgtgcagatccttagagatggaagccatcaagctaaagctgatgcagtaatggctctctctaatttatcaacacacactaacaatctcagcatcattctcgagacaaacccaatcccttacatggttgatcttctcaaaacctgtaaaaaatcctcaaaaacggctgaaaaatgctgtgctttgatagaatccttggtggattatgacgagggcagaactgccttgacatctgaggaaggcggggttcttgcagttgtggaagttctcgaaagtggcacactccaaagtagggagcatgctgttggagcactgttgacaatgtgccaaagtgaccgatgtaaataccgggaaccaattcttagagaaggtgtcattccaggacttcttgagcttactgtccaaggaacaccgaagtctcagtcaaaagcacgcaccctcttgcagttactgagagagtctccttatccgagatctgaaattcaacctgatacccttgagaatatagtatgcaacatcatatctcagattgatggcgacgatcaatctggtaaggcaaagaagatgctggctgagatggtccaagtcagtatggaacagagtctgagacatttacagcaaagggctcttgtatgcaccccaagtgatcttcctatagctggctgtgctgcttctgaagtttcttcaaaatga

SEQ ID NO: 29530 - DNA, 252 bp, Glycine max
  Peptide Sequence Number=SeqID_146308
atggaactttggaatagaggagggactagaagaagaaaaaacaatgcaaaatcacataaatccaaaaacatgcaaacagaattgcaagaagaagagatgaatcagaggtttaggaaaatggacgaagtctcagatcagaggtttcaaacgttaatgtgtggatgtttggagaagacaaggaagaggagcaaaacaggactgaacaactctttagcaaaattgaaagcgggttcatcagacatcaacgtttga

SEQ ID NO: 29531 - DNA, 886 bp, Glycine max
  Peptide Sequence Number=SeqID_146309
ttggatggtgatgtgccaactgaaggtgtctttcgaaatgcaagtgggttagtgctgaatggaaatagtaagctttgtggaggaatttcaaaactgcatctaccaccatgccctgtcaaaggtaagaaacttgcaaaagaccaaaagttcaggttgatagcagtgatagtcagcgtggttgcttttgttcttatactatcctttattctaactatctattggatgagaaaaagaagtaagaaaccatctttggaatcaccaatagttgaccaccagttggcacaacttttataccaaagcctacacaatggtactgatggcttctcatccacaaacttgatagggtctgaaagtttcagctctgtctacaaaggaactcttgagttcgaagatgaagttgttgccataaagtacttgagaaatggaagcttagagcaatggctgcgtcctagcacactaaatgcagagcaaccgagaacattgaatcttgatcaaagattaaatatcatgattgatattgcttatgcaatacattatcttcatcatgaatgtgagcaatcgatcgttcattgtgatttgaagccaataaatgtctttcttgatgatgacatgatttctcatgtgagtgattttggcataccaagacttctctcaaccattaatgggaccacttttaagcaaacaagtacaattggaataaaagggactcttggctatgctcctccatgtaaaatcatagggagaccagtcaatgtcacattgttatgcgaggatgctccaatcatatgggatcaacataggcttaaagaaacactcaaaccgggtgtatttacccccaaggcctacactctgaagagtccgtcagggtctctccctcctaattcag

SEQ ID NO: 29532 - DNA, 2037 bp, Glycine max
  Peptide Sequence Number=SeqID_146310
atgtctgcctttgcatcaagaaatgaggttgatcatttgacattgcttaaattcagagaatccatatccagtgacccatatggaatcttgctctcttggaatacttctgctcacttctgtaactggcatggaatcacatgcaaccccatgcttcaaagagttacaaagatcaacttgcgaggatacaacttgaagggatccatatctcctcatgtaggcaatctctcttatatcaaaagcttcatccttgcaaataacagcttctacgggaacatcccacaagaattgggacgattgtcacaattgcagattctctctatcggaaataactcattggtaggagaaattcctacaaacttgacaggttgtgttcaactcaaaatcttacacttaaatggaaacaatttgattggcaaaataccgatccaaattttctcgcttcagaagcttcagtattttttggttgttagaaaccagttaactggaggaatctcatcattcatagggaatctttcatccctaacttacctccaggtgggaggtaacaacttagtgggagatattccacaagaaatatgccaccttaaaagcttgacaaccatagtaattggtcctaacagattgtctggtacatttccttcttgtctttataatatgtcatctcttacagcaatctcagctacagtaaatcaatttaatggttctcttccgcccaacatgttccacaccctccccaatctccaagaagttggatttggtggcaatcaattctcaggtccgatcccaccttccatcataaatgcatctttccttacaatatttgatatcagtgtaaaccatttctcaggacaagtttcaagtctagggaaggtacaaaatctttttttgctaaatttgtctgagaacaatctaggtgacaattcaactaatgatttggactttttaaaatcattaacaaactgtaggtttgttcctagtgcttttgggaaatttcagaagatgcaagtgctagaacttggtgggaacaatctttcaggagatattccagccttcataggcaacctcagtcaattgtttcatttgggtataggagaaaacatgttagaagggattattcctcgaagtatagaaaattgccagatgttacaatacttgaaactttcacaaaacagacttagaggaaccatacccttagagatttttaatctttcatctctaacaaacttgaatttgtcacaaaactcattgagtggtagtatgtcagaagaagtgggcaggctaaaacatatctctagcctagatgtgtctagcaataatttgtctggtgatattcctggaatgattggagaatgcctaatgctggagtacctttatttacgggagaattccttccagggatttataccaacctctttggcttcattaaaaggtctaagaaaattagacctgtcacaaaatcgcttgtctggaacaattcctaatgttttgcaaaatatttctactttggaatacttgaatgtatctttcaacatgttgaatggtgaggtaccaacagaaggtgtctttcaaaatgcaagtgagttagtggtgacgggaaatagtaaactttgtggaggtattccagaactgcatctaccaccatgccttgtcaaaggtaacaaacttgtagaacaccacaagttcaggttgatagcagtgatagttagtgtacttgcttttcttctcattctgtccattattctaactatctattgcatgaggaaaaggagtaagaaaccatctttggattcaccaataattgaccaactggctaaagtttcataccaaagtctacacaacggaactgatgggttctcaactgcaaacttgatagggtctggaaattttagctttgtctacaaaggaactcttgagtcagaagacaaagttgtagccataaaggtcctaaaccttcaaagaaaaggagctcacaagagtttcatagctgaatgcaatgctcttaaaatattaaacatcgacatcttgttcagattttga

SEQ ID NO: 29533 - DNA, 204 bp, Glycine max
  Peptide Sequence Number=SeqID_146311
atggaatgttacataataccagtacggtctttgtttggagacgaaagagtcaagtttttgaataattgtggtaagaattggatgttctacgccgtgcatagcgtagcccaactctgcaacattatgcacctccactccaacaaagaagtgcccagtctagaaaggcataccatgaccggaactgcacaagcttttgacggttga

SEQ ID NO: 29534 - DNA, 618 bp, Glycine max
  Peptide Sequence Number=SeqID_146312
atgagcatgatggccatcattagcaaactatactgttcatcttctcagacggtgcttggggtcaggaaaagacctcatgtggtgaatggagggggttttgtggtcacggattgtagtggccagagggttgttttcagagttgatggttgtgggattcatggcactaagggacagttgattctaagagatggggaaggagatgctttacttctcatgcgtcgaaagggaggcatggttgaagcccttagcatttacaagaagtggaatggttatagtgtaaactatgaaggattgcagagcctggttttcagcttgaaagagcccaacagttgttgtttggttaggaacaatgccattagaatctccattgagccaaggaatgctagtaacaagggctgggactttgaggtaaggggttacttccccgatagaagttgcagcattgttgacgttagaggcaacgtaatagcacaggttggggtgaacaaggaagtggagaaattgatggaaagcaaggatttgtatcatgttgttgtgaaaccagggatcgatcaagcgtttgtttttggagtcattgccatccttgacaacatttatggcgaatccacgcactgctga

SEQ ID NO: 29535 - DNA, 576 bp, Glycine max
  Peptide Sequence Number=SeqID_146313
atgagcacttccacaagggcaacttccaacatccttctctctctgccactgccctctcctaaggcggcgcctccttcgtgcccagatttgtatggaaagcgtcgcgaaatggccaagattcagatgctggaaagagagataagtttcctcgaggttgtgacatcccttgctttaacttgtcttggatctgccattggtgctgtgatgggtgctttgaacatcaaaacatgtcaagttgttgttcccactgcatgccatgcaattgctgttctagttgtcttccatctaccaattgctcttgctgccctaatggaatatcacattgctgcaaagatagttgtggttgcaaaatttgttgcactctcccaagttgcaatattgggtggccttttccctcttgctgcatttgcaaatgctcttgctcttgctcttggtcaggcccaaaaaaatgtcccaaggttcgtccatgttgctgttgtacaaattcctgttggaacccctgttcatgtttctaaagtttataattataaatgtcctgttaatctttttcatcatgtggatactactacttactag

SEQ ID NO: 29536 - DNA, 1101 bp, Glycine max
  Peptide Sequence Number=SeqID_146314
atggcggtttccaaactcagaaatgatgcaaagattagggcttcgttctctatcgaaaccgcgagccaagttggacggttccactccgatcgacgggttccaaggctacaagaaaaggctttgggagaagaagcttggcacattggaaatggatttgggaagaaagaaggagaaggaaatgatgtttttccaagtctacacgaaaagcaaaggctgaaacactcaagtgcttatgctcacgggaaaggaagcgttcctcacacgccggacgtcgtattcttaactagccttcaacgacttgaagaatgcaattacgacagctctggtcttgcttctgcccaatttcgcactaccctttattctggaaacaaacgcgtccaacgtcagaatggaactcttcaccattactactgcagtaaagaaatgacatcaatatttattgggccatcacttaatcatcctcacggaccatcggagcctcaaggagttgatgactcaagtgccatctctgatgacccagccgcttatccagataacactattatccaatatttcatcatgaaaggcggtcgcatttgtctacctcaaggatcaccattcattcacactctattaacagagtttcattcatctcccagaggtaggcacatgggaatagcaaaaactcttgcacggatccgcgagaacttcaattggtccgggattcaacaggatgccaaacactttgtagtagcttatgtcgattgtcaacatacaaagtatgaaaccagaaaagtagtggggattcagttggggatgcttccacctcatcatacttcttacactgttgcgctcctttttatggacatcgagtatctccatgcttttgtgcacaagaaacctttttcattagggaagttcttgaattgggttgaatggtcttgcaatacctccatacattcaggctatggtgtttctccatatgagactacctttggcaagaaacctcttagcatcccacagtacattgttggaacctcaaacactaaggttgttgatgacttcatgaccaagagagaggaggtgttcgcagatctaaggaaaaagcttttgaaagtctag

SEQ ID NO: 29537 - DNA, 207 bp, Glycine max
  Peptide Sequence Number=SeqID_146315
atggttttgatcatgaaatgtaatggtaacagactaacaggtgctaaaagtgaagaggatttgcatctgaatcttggccatttcgcgacgctttccatacaaatctgggcacgaaggaggcgccgccttaggagagggcagtggcagagagagaaggatgttggaagttgcccttgtggaagtgctcatcactgctctctcaattga

SEQ ID NO: 29538 - DNA, 387 bp, Glycine max
  Peptide Sequence Number=SeqID_146316
atgtcaacaagtgattacgagttaataaagatcgagacgtttgttcttaaaacacagatgaactgtcaaggatgcatgaacaaagggggggtctgttctgtgttggatgccgccatttgcatcagcggttcaggtggtgccgccactaactgtggcaagaaagggctgacgtggctggtgctgccagcaccaactgcggcaccagcgagacacttgacaacccgccaatgccaatggcgggacattatgcaagaagagagaggagtcgtattgcacagagagaaaactgggtgttttgagataataatgctgaggaagaggaacaggtctgttgcaaatgtcccgccactggcattagcgggttgcccagtgtctcgctggtgctaa

SEQ ID NO: 29539 - DNA, 267 bp, Glycine max
  Peptide Sequence Number=SeqID_146317
atgcagtggtttagggttaatcttcaccataaacaccatggaacgggagatctcatgactgcacttcttcttggttggagcaataaatacccagacaaccttgagattgctgcggaacttgcagtgtcaagcttgcaggcagttttgcacaggacactcagtgactacaaaagtgctggacatgatcctgagtcaaccagtttagagattagattaattcaaagtcaggatgatatttgcaccccacagaaattggaaagttattaa

SEQ ID NO: 29540 - DNA, 303 bp, Glycine max
  Peptide Sequence Number=SeqID_146318
atggggcaaaccgggtttgtagtgcttgcaggaatgtgggccaggaggaatagaggtggagtggtgaggaactggtgtggggttgtttgtggaagagggggtgacgggagcaatgtgggtgataagctcgtccattttttagggtcatcgagtgcatggtatcgccaagacgagcaaggacatcctcgagatggctggagaagcctgcgtgcttgtgggtgtcggacatgtggacaacgagaacaccaaatgttagctctccctagctattggcttcgaggaaccagaacctccaacaattaa

SEQ ID NO: 29541 - DNA, 213 bp, Glycine max
  Peptide Sequence Number=SeqID_146319
atgacatggacggtcccgtcatcgcggttggcgagacaggctaacgtggttgtcccgtcattgctcttggcgagtctgatgacgtggagcgtatcgcccttcccattggcgagacaagcacaacacgggcatactagggttgcagttgcagcagcaggttgcagaggcaacagtagaagaccagcttttttgaacatatattgccattactaa

SEQ ID NO: 29542 - DNA, 1161 bp, Glycine max
  Peptide Sequence Number=SeqID_146320
atgggttgcttctttagtgtaccttcaaagatcaaagctgagagccctccacgtaatggtttgaattcaaaggatggtagcaaagaagagaatgatttgagttgtttaagcagcaaggtgtcctcttcagctatgcttctaactcctcaaagtgaggatgagatattgcaggccagcaatttgaagaacttcacattcaatgagctaagaactgctacaaggaactttcgtccggatagtatggtgggcgaaggtgggtttggttgtgtgtttaaggggtggatcgatgagcatacacttgcccctactaaaccagggacaggaatggtcattgctgtgaagaggcttaaccaagaaagcaaccaggggcacattgaatggttgacagaaatcaactacctggggcagctcagtcatcctaatcttgtgaaactaattggttactccttagaagatgatcaccggattttggtgtatgaatttgtggccaagggtagtttggataatcacttgttcaggaggggttcttactttcaaccactctcttggaacatccgtatgaaggttgctcttgatgctgctaagggtcttgcatttcttcacagtgatgaagtagatgtaatatatagggacttcaaaacttccaatatcttacttgattctaattataatgcaaaactctctgattttgggttggcaaaaaatggacccgaaggtgataagagccatgtctctacaagggtaatgggcacctatggctatgcagctcctgagtatatagccacaggtcacctaaccaaaaagagtgacatatacagttttggagttgttcttctggaactcatgtcagggaaacgtgcactggatgacaacaggccaagcggggagcacagtttagttgaatgggccaaaccactcctcaccaacaaacacaagatctcccaagttatggatgctcgcatagaaggccaatactcaaagcgcgaagcaaagagaatagctcaccttgcaattcaatgcctatctacagaacagaaacttagaccaaacataaatgaggtggtgagattattggaacatcttcacgattccaaagacacaagctcaagcagcaatgctactcctaatccaagcttatctccttctcctcttcgttcatag

SEQ ID NO: 29543 - DNA, 871 bp, Glycine max
  Peptide Sequence Number=SeqID_146321
atgactagtgataatggtgaagtgctgaccaagaaggcactgcctccaattcttgaccatcgaggtgatagcaaacaattctcggacatatgtggaagcacggaggagtttcatattgaatggtttgctgaagaaggcaatgagggcagtggaaaacgcttgtttcagttgctcaaaagccaattgggcttgcggggtccatacaaatggctcaatggtggcggtcttgaccatgggggctgcaatagtggcatagcatatgatgaatctccggtgagcctcaaaggaagcactgtatatgaggatattgtcaaagaagatgatgatgaagtggtggaggtatggccggaaaatcaagttcattgtggcttggaaggaagatggcacgttgcacaacccaaacaacattactttgaactcgtaatggctgtgatgggttctgaaggtgggcttggggatatcagcatcatggaacctatccctgaccgtcaccacgttaagagcacggtagtcgatgcaaaacctccacgtaccatcctgcttctggacaagcaacaccggcgacgagaagaggctcgtgctgggttgaataagccctttctgaagcatggaatcaacctgaagctcaatctcctgcttttgatagtgaggataacagtagggcctcacgttgactggaggggagtttgggaccaagtgaatataatgatcgatggacctagccggaggaaggctctggggaggatcttcaagaaatacaacaatatggaagtaggaaacatcgtcgtgtttccgatagaggcgacgaaactggggttggacatggaggtcgaggacgaagacatggttctgaatgggcaagctcagggcg

SEQ ID NO: 29544 - DNA, 456 bp, Glycine max
  Peptide Sequence Number=SeqID_146322
atggcaattgggtttatggaggtgcagcttgtgaaagcaaaggggttgtgtgacactgatttctttggtagtatggacccgtatgttgtgatacagtacaacggtcaagagcgaaggagtagtgttgctaagggacagggcaataatccggtgtggaatgagaaatttgagtttaaggtagaatatcctacaccaagtaactcatacaaggtcatcttaaaaatcatggacaaggattcgttatctgcagatgactttgttggtcaagccatagtctatgtggaagacttattagccataggggtaggggatggtgcagctgagctgcaacctctcaagtacagagtaattcgtgaagatcaatcttattgtggagaaattgatgttggtataacttttaaggttgaagaagagttcaatggagaaactaaacgaggaaggaaggacagcaactag

SEQ ID NO: 29545 - DNA, 1392 bp, Glycine max
  Peptide Sequence Number=SeqID_146323
atgacccttatgaaaatcctatggaaatcactcttccccggttgttacaagggtgaatatccctctccaaagccaaagaaagtggtggctacaaagccaaattcttcacacaggatttctgtgacggatttgagttatccaagcacgactctttcggaggatctctctatttctctagcggggaccaacctccatgttttctcaatcgctgagctcaagattatcactcaacaattctcttctagcaattttcttggagaaggtgggttcggaccggttcataaggggttcattgatgacaagcttaggcatggcctcaaggctcaacccgtggctgttaagctcttgaacttggatggctcgcagggccacaaagagtggttgactgaggttgtttttctggggcaacttaggcatccacatctcgtgaagctgataggatactgttgtgaagaagaacacagggttttggtgtatgaatatttaccaagaggaagcttggagaatcaattatttagaagattctcagcatcacttccatggtcaacgagaatgaaaattgctgttggagctgcgaagggcctagcctttcttcatgaggctgagaagccagtcatctatagagatttcaaagcttccaacatcttgttagactctgattacaatgcaaagttatctgattttgggttggcaaaagacggtcccgaaggagatgacacccacgtttcaacccgagttatgggtacacacggctacgcagctccagaatatgtcatgacaggtcacttgacagcaatgagtgatgtgtatagttttggagtagtgctattggagctgttaacaggaagaaggtcagtggacaaaaaccggcctccaagggagcaaaacctagtggagtgggcaaggccaatgctaaacgattcaaggaaactcagcagaataatggatcctagacttgaaggccaatattcagaaatgggaacaaaaaaagcagcagcattggcataccaatgcctcagccacaggccaaggagcagaccctcaatgagcacagtggtcaagacccttgagccacttcaagattttgatgacattccaattggaacatttgtgtacacagctccaccagataataataatgaagtgcagcataaggatcaatgtgagacacctaagaggagggaaaataataataatggtcacaatattcataggaatggccacaggcatcatccacttaaatcccccaaggccccaaggtcacaatcacaatcacaatcacagtcacatttacgtccaaatgaccacaaacacagaaatggaagaggaagtggaccaaattctcctccatcacatgtgaaaataattaggccaggagttattgcttgttag

SEQ ID NO: 29546 - DNA, 491 bp, Glycine max
  Peptide Sequence Number=SeqID_146324
atgcttgttttgacttctgaagtgttgcaaaactttacggattttgcaaagatgcttgttttgagggttccgaagggagcaaacaagacttgttcacctctggctgacgaaggtgcggataaccacgaggtatctccacatgctactagacccttgagtctggtggtagaaatgagacttttttgcagtctcggccgaaagacactgacatctccgagaatggtgcagatgaccatgttggtctctgcgtgctaccggacccttgagtctgacggtagaaacgagaatttttcgcggtctcggccggaagacgctgacatctccaggaaaggtgctgatgatgacaagacgctgacatctccgggaatggtgcagatgaccacgttagtctccgcgtgctaccgaacccttgagtctgacggtagaaacgagactttttcacggtctcggccagaagatgctgacatctccgagaaaggggaaatgacgac

SEQ ID NO: 29547 - DNA, 201 bp, Glycine max
  Peptide Sequence Number=SeqID_146325
atggtcatctgcaccattctcggagatgtcagtgtctttcggccgagactgcaaaaaagtctcatttctaccaccagactcaagggtctagtagcatgtggagatacctcgtggttatccgcaccttcgtcagccagaggttttacctttgtcatccagagacattcaagtccgacgacgcgcaagactcttctctactag

SEQ ID NO: 29548 - DNA, 168 bp, Glycine max
  Peptide Sequence Number=SeqID_146326
atgccgggatacatgttggagaaaaaggttgcagaggcgggtaggaaaatgctggaaatcaccagagaagaacggtgttcgtctagggagacaacacaaagttatgtcactgaaagcatagggtttcagtttgaaccttttgctttaatgaaaggggatgagaaataa

SEQ ID NO: 29549 - DNA, 795 bp, Glycine max
  Peptide Sequence Number=SeqID_146327
atgacttccttccatggctgccataccaccctccactacctcaacccataccactcaccatacgaagcgcccatggccgcctaccaccatccacactacctgtcgtacgaagcctccatggctgccctccacaactgcaagaccaccctccactaccacccacaacaccaccttgaatttttgtccaccaccgaggaccgccttgaggctgccttagccaaacttaccctcagccaacacaacctcgccgcttccatcgacaccctggccaccaccatcgacaaccttcttcagcgactgccttgcaatctcactccacatttttcatcttcctttccgtcgccgactccgccgcagcctccgctgttcaagccaactccatcacccacgcgcaccgcattcacgaccgtgccacctccgccagccacgacacctccaccgccacctccgccaccacttccgcctttggtacccatacagtcgcaacccacaacttggtcggacccgcttcctaggcctgttcttcatctgtccgatctcgttcgccccaccatgcccttcaccaagctcttcagcagagttcctcctcgtgggactgccatggccggatacacgcttccagcaatgaccgttgcattctgcacaattgctaaaccagccccaacacctagaggacaaggtgtttttgatgagggcaggaatgatagggatagtaatatgggactgcaggaagtaaggggtttgcaagaagcaaaaagcatgagacccaaaagggaggcaacaatacgtggctag

SEQ ID NO: 29550 - DNA, 450 bp, Glycine max
  Peptide Sequence Number=SeqID_146328
atgaaaaagagtttacatcaactactcaataagaatctccaactgagggttttagcctttcatggcaaggaagatccttttacactgaagaagaggaatcaagagaaattgtttgcttacaaaggagtgaggatgtctcctccacctctaggaatctcacaatcactcaaaaactcactaatctccctaaaagatgaaaacttggccccttgctctgctctacgctctcttaaattctcactcttccagcctctgagtagtgaactgttctcttggctcccctcacaattttgtgcaaatcaggctttaaaagggcttcctgatcttgacgtcgcgtttagcatgaacaaggtagaaggagataaactgtacatgctcaaggttcaatcaaacaaccatactttcagctcaaactgggtgcaagtgataaatcattcatacacaaggtaa

SEQ ID NO: 29551 - DNA, 342 bp, Glycine max
  Peptide Sequence Number=SeqID_146329
atggcgcgacgatgtgcgacggtagtgagcgtgcgactgcaacctagcggtgtgaccatgagtgtgaaagctttcaaaatttgccaaaaggaagtgattgagggtggtgatggtgtttttggggatggttgggtcatgattggcattgttgggcttcttgaaggtggcacaatggcttggaggttgcatagtttgggttgctatggtggccgttgggtgtgtgttggcgttttaggaggagatggtgacacactagttgatggtggtggtgtcaacattttgggagaagatggtgtcatgctagttgatggtggtgatgtatggcttggttgtcgtggttag

SEQ ID NO: 29552 - DNA, 153 bp, Glycine max
  Peptide Sequence Number=SeqID_146330
atgcttgaaagaaagtggagttcctattacctgaagcgtggaacattattcatcaacgtcaacaacctgaccaacaacaataagagaatgaccaacaacaagaagtcgatcaccaaccagatggccaatagcaacaagacgatgactagctag

SEQ ID NO: 29553 - DNA, 1281 bp, Glycine max
  Peptide Sequence Number=SeqID_146331
atggcgcggttgatcacagtggtgtggtgcgcggtggcggtgctattatgcgccgcggccggtgcgtcgtgggtggaggaggcggcgaacccgatacgaatggtgtctggcgtggaggcggaggtggttcgggtgatcggggagtgccggcgtgcgttgaagtttgctaggttcgtgagcaggttcgggaagagttaccaaagcgaggaagagatgaaggagaggtacgagatattctcgcagaatctcaggttcatccgctcccacaacaagaagcgtttgccctatactctctctgttaatcattttgctgattggacttgggaggagttcaaaagacacagactaggagctgcccaaaattgctctgccactcttaacggcaaccacaagctcaccgatgctgttcttcctccaacgaaattgtgtgttcctcgtggaatattggaaattagggtgcagttgttgggtaactcaacccaggcaagtaaagactggagaaaagaaggtatagtgagttcagttaaagatcaaggcagctgcggatcatgctggacattcagcacaactggggctttagaagcagcctatgcacaagcatttgggaagagtatctctctttctgagcagcagctagtggactgtgctggccctttcaacaactttggctgccatggtgggttgccatcacaagcctttgagtacattaaatacaatggtggactagagacagaggaagcatatccctacacaggaaaagatggtgtctgcaaattctcagctgaaaatgttgctgttcaagtccttgactctgtgaatatcaccttgggtgctgaagatgaactaaaacatgcagttgcatttgttcggccagttagtgtggcctttcaggtggtgaatgggttccatttctacgagaatggagttttcactagtgacacttgtggtagcacttcccaggatgtgaaccatgccgttcttgctgttggatatggagttgaaaatggtgtcccatattggctcataaaaaattcatggggagaaagctggggtgaaaatggctacttcaagatggaattggggaagaacatgtgtgaaccctgcccccaacaaataccaaacctaaaaataacttcaatcaatttccctttacaggtgttgcaacttgtgcatcttatccaattgtggcataaattgcataacaatatggtccctggtgactaccaccttgtcatgcttcagagtttagagcgtattgctgatgccagtattgatgaatga

SEQ ID NO: 29554 - DNA, 483 bp, Glycine max
  Peptide Sequence Number=SeqID_146332
atggctttgctgcaatatcagcgtgaaaatcttcattttttgagtgaggagattcttcgattgcaagagtgtctaagcaaatatgagggaactgatgatcggagcacaccacagtattttattcctttctgttacttcaacagtgatccgaaggttgaccttgcccatctactagctgctcgtgatcaagagttacggacactttctgcagagatgaaccaagtgcaatctgagttgaggcttgcccgttccttgattgctgaaagggactcagagatccaacatgttcgcacgaccaacaaccagtatgtagaagagaatgaaagactaagagctatcttaggggaatggagcacccgggctgccaagcttgagcgagcactggaggctgagcggatgtcaactcttgaattacaaaggaaactttcaacgcttagaagtcaatcatatacagcagatgaagcaaacgaacttggagcttaa

SEQ ID NO: 29555 - DNA, 1026 bp, Glycine max
  Peptide Sequence Number=SeqID_146333
atggatgagctaggttcagctttgcggcatagtgatgaaccaaatttcagagtggcaccctttctgttcatgccaaaaggcaatctatcatcagctgtgagtttttctattctatggccaacacagaatgttcagaaaggtgataggtgcacacgcgattttcttcttggtattggggaggataaacaacgttctgccaggcttacagcctggttccacactccagagaattatccatcaaaggaaccgaaagatgcagatatagtatggacaagtgtgcaggtagatgaggatatgaagaaggccgtgggaattacagaacagcaatacattaatcaatttccttttgaggcaagtcttgttatgaagcatcatttagcagagacaattcagaaggcacatggatctcctcaatggttgcagcctacttataatcttgaaacacacctatctcaacttattggtgactattgtactggtccaaagatttgtcagaagtatattgaacaacctgctttgttccaggggagaaagtttgatctccgttacatagtactggttcggagcatgcatcctctggagttattcctgtcagattgtttctgggctaggatagccaacaaccaatattctttggacagaagtagtttgtttgaatatgaaactcacttcactgttatgaattatcgcggaacaataaatcataagaatgcgaatgattttgtgagggaatttgaggaagaacatcaagttaaatggttggatatacacacaagagtaaggaaaatgattcgatcagtgtttgaggcagctgctggcactcatcctgagatgcagagtccaacatctcgggcaatgtatggtgtagatgtcatgttggacagctcttttcaacctaagttactagaggtgacttactgcccggattgtacaagagcttgcaaatatgacatggatattgtggttggagagggaggcgttgccaaagctagtgatttcttcaacaatgtgtctctttttgaatga

SEQ ID NO: 29556 - DNA, 216 bp, Glycine max
  Peptide Sequence Number=SeqID_146334
atgggtgagagagagagagagataatgagatactgcagggcttttggacttcacacgtctgctttgagagtcgtatttgttaagagggcaagatggagaacctgcaaaacaaaggactctgacgctcaagttaaagataacctgtcggccgaacatccgtgcccctatgtcaggactaacttggagggtggacacatgtttcggaatgccatgtag

SEQ ID NO: 29557 - DNA, 630 bp, Glycine max
  Peptide Sequence Number=SeqID_146335
atgggttcatacttagcctatgtgcccaaaatctaccttaaggctcatcagaatcctagggccttcttctatatctctggcctaattttcttggagtcttctatccaatgcccttggggtggtaggattgcatcaaaatcggccatgaactatgtcttcatggggcctcgggcttcgtattggatattgaattcaaagttctacgaaccaggccaccatcctccctgcgagttcaggctttcgcaaaacctgcttgatgggatagttcattttgactaccacttaatgactttggaagtaggttctaagtcgtctggtcgagctcctggaaagttggccttgagcgaaagtggccatttggtccacatagcgtctggtctctactatttcgcctgcgaagccaaggagtggactggcatgggggtggacaatttcaagggagacctcgagcctctagaaagttttccaatacaggatatcgatggagctgccctagtcgatgaggaccttagacatcataataaagtttacaatgatgataaagacaaccatgggatcgtcctagttgatggggttaatacccttgaagtccctatatgtgaaagtgataggaggaagactttgttgtga

SEQ ID NO: 29558 - DNA, 429 bp, Glycine max
  Peptide Sequence Number=SeqID_146336
atgctcctcgccctacggcctgacaagttcgcgagcagtctatccaaaaaaaccctagtagcatggacgagttgcacgaacaagccaagggctacatccagatggaagaaatgtacagattcaaaaatgaagtcagacaagttggatagaagtacgacaagtgcgaaggaaacagcaagatcgactcacacaagtcagataaaaggcacaagccatacaagcgccgacctctcccataagggcctaggtcagacaaccaccaagcaagagcaagacctagaggacaccaagaggagcaacataggaatcacgatgcagatagaagaagagatagagcgaaagatcgaggtagacagagacataagaaacaatgatgcaagcggaaacctccacaagaacaggaacccacccagcaaatcagaggtgtaa

SEQ ID NO: 29559 - DNA, 264 bp, Glycine max
  Peptide Sequence Number=SeqID_146337
atggtgatatccgaagcccaagaagtcaaaggttgtagctcccagctccttgcgcatgcaccctacccctggagctcttgcacccctacccctgcgctgattgctgccctcactcaagtcgccagtcaaaccagcgggttcacaaccactggctgtgtcgccagtggaagtggcgacatgtcacgtgtctcatcgcagcgaaggcgccagtggcgctggtggtttgcgtgtcacgtgtcacatccgcagcgaatgcgccagtag

SEQ ID NO: 29560 - DNA, 417 bp, Glycine max
  Peptide Sequence Number=SeqID_146338
atggccaatctcaccggcggtccagctgctgccgctgaacacctcgccgcgctccaccagcgcgccgcccacgccgtcggcgatgcgcagatagaaatggctctgcgctttattgagctccagctgctgcaccgccagcagcgcggccgctttgacgttattcatgatgcgcagcggcagctcaacgccgcgccgcagcggcgtcagcacatcgacatcctgccagccgagcggcgcagaaaagtgcacccgcccgcgctgagaatcaatgatgccgggaaaaccgatggccacgcccagcagcgccggatgcgccgcgcgcagcgtctgacacacttccgtcagctcgtgcagcagcccgtcggcatcggccgtttcggtgcgccagtttgctcggccaccacgcgcgaaaagtag

SEQ ID NO: 29561 - DNA, 933 bp, Glycine max
  Peptide Sequence Number=SeqID_146339
atggcgcagaccggccgctatctcggccatgcgctgagccaggtgatgcagctggtcaatccggccagcatcatcattgacggcccgtggaatgcgcaaccggcgtttgtgcaggcggtacagcaggcggcacaggccggcacgctggcgtttacctttgcccataccgcgctgcactttctgccacagcgcatcgatccggccaacggtctggcgctggcggtgattgagcactatgaacgagcggctctctttgcggaccgcgcaatgaaaacgcagcgcatcactctggacgatattgcgactctcgcaggggtcaccaagatgacggtgagccgctatctgcgcacgccggaaaaggtcagggcggaaacggcggctaaaatcgccagcgtcatggccgaaatcggctacgtcgccgaacaggaaaacaccgcggcgtcgcggcacccgccgccgcgcatcggcgtactcatcccctcattcaataatcaaatctttgccgatctgctggccggtatcgaatcggtcaccagcgcccacggctatcagacgctggtggtcaactacgactacaatccgcagcgcgaagaggagcagattgccacggtactggcttttaacgtgcagggattgattctgaccgagtcggtgcacaccgtgcgcgcggaaaagtatcttaacgcggccaccattccggtcgccgaagtgatgggactcagcgagacgcgcgggcgcatcaacgtcggctttgataattaccgtgctggctacgacatgactgcgatgctgctggccagcggtaaacagcgggtgatttattttggctcgatgtccgatcgccgcgatcaacaacgctatgccggctattgcgatgccgtggcggcggccggattgccggccggacgcatcgtgccgaacaaagtctcttcg

SEQ ID NO: 29562 - DNA, 915 bp, Glycine max
  Peptide Sequence Number=SeqID_146340
atggaaactcatcatcatcatcagcaccaaaagaacacagaaaacgatgtacaaaagcaacaacatcaaattgaagaagaagtagcaccaccaccaccacagttaaggcaacaagaaaatacagaactagaccaaatagcatcatcatcaccacaatcttcaacaccctcttccccttctcaagagttttccttcacaatctctcttcaccactccacattattcccatctgataactccaaaaacccacctaattcatcatctcttgcacttgatttatctcctgctgatgacattttcttccatggtcacttgctccctctacaactcctttcacaccttccttcttcgccgcctcgctcttcgaccaattccatggacagcttccccctccccatcagagagttattagaagatgaaaatcactccattaaggacactagtggcagcagcaacaatagcacctcagacagcaataacagcagcaaaagagaccaagacaacaacaacaacataggaaaaaagggccacaaagggtaccaagataaggaagataaagtgaagcacaagaacaaggtgaggtttgatgtgatccatgcaataaaaaagtacttgagaatggtccagcctaggatgcttttcaaaggacaaagagagaaaattaggccccggggacagtgctattcttattcaggaaatgtaactccgaagaattataagctgcaggattggagaggacaatattcagcaccggcatcaatgaggacttctcctacaaacagtggtttattgattgcaaccacgcctcttcctcctgctagtgacagtaccatggaagagttgcaagcagccattcaagctgcaattgctcactgcaaaaattcaattgcaaaagaagagaatctcaagtgctga

SEQ ID NO: 29563 - DNA, 1261 bp, Glycine max
  Peptide Sequence Number=SeqID_146341
cgtgctgattgtcacggtggccgatctgatgtcgagcatgaaaggcaccttcagcggcggcagcgacctgaccgaagagcggctgctgcaggatctcagccatgtcgatctgctggtgatcgatgagatcggtatgcagagcgaatcgcgctacgagaaagtgatcatcaatcagattgtcgatcgccgttcgtcgtcaaagcggccgaccggcatgctctccaacctcgatccggccggcatgaacacgctgcttggcgaacgggtgatggatcgcatgcgcctcggtaatagcctgtgggtgcgttttgactgggaaagttaccgcagccgcggtgcgatgaaagcagccgggaaaggaccagcggtacttcgactgaacaacctcaaacgggtgatgacgcagctgcgcaccacccgcatcacttcccgccaggatctggcgctggcgctcgacctgagcaaaaacaccgtttccctgattattgatgacctgctggcgcaggggctgattcacgagcttggcccggtcagcgtggctgcggccggtcggcccaaaattgagatcgaactgcgcgcgggtcagctgaaaagcgcgggcatcatggtggagcgccaggcgattcactggcgggtctgcgactacttttcgcgcgtggtggccgagcaaacctggcgcaccgaaacggccgatgccgacgggctgctgcacgagctgacggaagtgtgtcagacgctgcgcgcggcgcatccggcgctgctgggcgtcgccatcggttttcccggcatcattgattctcagcgcgggcgggtgcacttttctgcgccgctcggctggcaggatgtcgatgtgctgacgccgctgcggcgcggcgttgagctgccgctgcgcatcatgaataacgtcaaagcggccgcgctgctggcggtgcagcagctggagctcaataaagcgcaaagccacttttatctgcgcatcgccgacggcgtgggcggcgcgctggtggagcgcggcgaggtgttcagcggcagcagctggaccgccggtgagatcggccatctgagcgtgcagcccaacggcgcgcgctgcagctgcgggcgacagggttgtctggagacgctggtgagcctgccggcgatccagcagcagctggcccggcgtaagcccggcttacgctggcagtctggcgacagcgaaccggagatcgtgtatgagctgatggcgcagaccggccgctatctcggccatgcgctgagccag

SEQ ID NO: 29564 - DNA, 735 bp, Glycine max
  Peptide Sequence Number=SeqID_146342
atggccgatctcaccggcggtccagctgctgccgctgaacacctcgccgcgctccaccagcgcgccgcccacgccgtcggcgatgcgcagataaaagtggctttgcgctttattgagctccagctgctgcaccgccagcagcgcggccgctttgacgttattcatgatgcgcagcggcagctcaacgccgcgccgcagcggcgtcagcacatcgacatcctgccagccgagcggcgcagaaaagtgcacccgcccgcgctgagaatcaatgatgccgggaaaaccgatggcgacgcccagcagcgccggatgcgccgcgcgcagcgtctgacacacttccgtcagctcgtgcagcagcccgtcggcatcggccgtttcggtgcgccaggtttgctcggccaccacgcgcgaaaagtagtcgcagacccgccagtgaatcgcctggcgctccaccatgatgcccgcgcttttcagctgacccgcgcgcagttcgatctcaattttgggccgaccggccgcagccacgctgaccgggccaagctcgtgaatcagcccctgcgccagcaggtcatcaataatcagggaaacggtgtttttgctcaggtcgagcgccagcgccagatcctggcgggaagtgatgcgggtggtgcgcagctgcgtcatcacccgtttgaggttgttcagtcgaagtaccgctggtcctttcccggctgctttcatcgcaccctcacctga

SEQ ID NO: 29565 - DNA, 648 bp, Glycine max
  Peptide Sequence Number=SeqID_146343
atggcaaatctgccaaaagaaaaccagcaagtaacaagttccacaccatccatccagaaaagtgaggaggatcaagcagccagcactgctatgggctttaaagattcattggaaaaacaatatctaaaagtcaaagagcatgcagaaacatacccttatgtttgggcttcttatattgttgtatatggtggctttgctctctggactacctatagatggagaaagcttcgcaagacagaggacagagtaaaaactctccaagaaagactacgtaagcacgttgaagctgaagaatcttctagttctaccaaagtggttgaaaagggttctacatcttctgataccaaagctattggaaagggttctgcatcttctgataccaaagtagttgaaaagggttctacatcttctgataagtcttccaacttcagaaattcactgctagtgttaacaaatttgtggatggactgtgttgaaggtgtctgccagcggcagagggaacaaggtggaccactgccaacacctatgctggttgaggttgccattctaactcttccaacaaaacattcggcatggaatagttgccctagtggctctactaagttgaaaaacattgaaaataggatgaatatgagggtaaaccaatag

SEQ ID NO: 29566 - DNA, 1005 bp, Glycine max
  Peptide Sequence Number=SeqID_146344
atgtcactcaaagctatcgcctccgcccttggcctctctgtgaccaccgtgagccgcgcgctgaatgggtttgatgatgtcgccgctgctacccgcaaacgcatcgaagaggaagccgaccggcgcggttatcgcccgaatgccgccgcgcgtcgcctgaagaccggccgtgccaatgcggtcgggctggtgtttccggtcagcaatgcctcactcaacgacagctactacagtgaaatgctgctgacgctcgatcagcgccttgccctgcacgagatcgatctgctgttgctccccgacaaaccgcaggatcagcagcgcaatttgctgcgcatgctgcgcagcggcatgctggacgcgctgattgtcacccataccacgccgcaggatgtgcgattgcagcgcctgcagcagaagggttttcgctttcttacgctggggcgcagtcagctgccgcagccttacgcctggtttgattatgataaccatgccggaacgctactggcggcgcagcactgccagcagcagggctatacgcgcatcgcttatctcggtggtaacgagcccagcacctacattcttgaccgccggcaggggtttatcgacgcgctgcccgccacgccctgcgcgcagcaggctggctggatggccgcgctgccgccctcgcgccgcgcgggctatcagcaaacccgcgcctggctggcgcacgatatccagcctgacgccatcatcaccgactgcagcccgctcggcgaaggcgcagcgattgctctgcagcaggccgggcgtctgagcggcgcgcaggcaattcccctgtacgtgtacgatggtttgccgcatgactcgatcatcacgcaaccggtcaacgcgattctgcaatcatcacagcagcggattggcgaacgcgtcgccgaaatggtgctgcagctgctggagggcgcgccgcccgcgcagttacagacgctgtggcagccaatgctgcgcctcacttctgacgcacagtga

SEQ ID NO: 29567 - DNA, 1278 bp, Glycine max
  Peptide Sequence Number=SeqID_146345
atgcagcgatgtggctgggtaacacaggatgcgctttatctggcgtaccacgacacggaatggggcgtgccgcagaccgataagcgcgccttatttgagatgctgtgtctggaggggcaacaggctggcctgtcatggatcaccgtgctgaaaaagcgcgagaactaccgccaggcgtttcatgattttgatccgcaggcggtggcgctgatggatgaggccgatctgctgcgcctgctccagaacagcggtttgatccgccatcgcggcaagcttgaagccatcatcaataatgccaaagcactgctggcgctggaggccaccggcgaagacttttcccgctttatctggtcatttgtcgataaccagccgattttacaccgttacgcggattataagctggcgccaaccacctccgaaccggccattgcgctgtctaaagcgcttaagaagcgtgctgtttctgccatcccgataatctttaaggcaaaagtttacaaattaagactgtgcctcacgaatttccccatcattgaacggcataatagtgccgttttggggcattttccccgtttccgtatgagggactttttcatgaaaaagcgtgtactggcgctggccttgttaatgagcggcagcgtggcgctgtcgggttgtaccaccaatccttataccggcgaatcgcaggccgggaaatcgggcatcggcgcgggtctgggcgcggtgctgggcgctggcgtgggcgtgctctcttcgtcgaagaaagatcgcggtaaaggtgcgctgattggcgcagcgtccggtgcggcactgggcggcggcgtcggctattacatggatgtgcaggaagccaaactgcgcgacaagatgcgcggcaccggcgtcagcgtaacgcgtcagggcgataacatcgtgctgaacatgccgaataacgtgacctttgactcgagcagcgccaacctgaaaccggccggcgcaaatacgctgaccggcgtggcgatggtgctgaaagagtatccgaaaaccgccgtcaatgtggtcggctttaccgacagcaccggcacgcgcgcgctgaacatgcgcctgtcgcagcagcgtgcagaaagcgtcgccagcgcgctgatcgtgcagggcgtggcgcagaaccgcctgcgcacccagggcatgggcccggataacccggtcgccagcaacagcaccgaagccggccggtctgccgctgcaggccggcttttgacgtgtttttacgcgcttattgacgcgcaaagcagcagataa

SEQ ID NO: 29568 - DNA, 656 bp, Glycine max
  Peptide Sequence Number=SeqID_146346
atggcgatggtctacatcgacgtcaactggatgaacgatgcactgcacgaaacctctttcaccgaagcgacacaggagctgatgctggcggccattgccgcactgttctttttcgccgcctggcagcgaccgcagcagcgcagcgcgctgattctggtcgcacggcgcatggctgtggtttgcgctggcaacgaccgcggcctcgctggcgatggcgctgcgtcagccgcggcaaatcctgccgggcctggcggcactgctgcagcatcgcagctggcaaatgatggccgccgggctgctggcggtgctggtgttctcgcggctagggcagcgagctgtttggctacagcctgtgtctggtggcatcgctgcgctatctgtggcaaacccgcccggcgctggcagcagcacgcgccagccgtcgcgtggtacactgaccgcttagcaccgggtcgccggtgcaccgggccgataacggcacgctggcggtgctgcacaacaatgttcccggcgttttacgcgatcacgccgcagcgcctcgcgcacctgctggcgctggaagcggcggcgcagcagccgaatgatgtcacgctggacgacagcctgtttcacagcgacgccgcgccaatcgccgtaccggtgggcaagttcgccat

SEQ ID NO: 29569 - DNA, 267 bp, Glycine max
  Peptide Sequence Number=SeqID_146347
atgacaaaattagaacacaaggcagagatgaaagtggctgaattcagaagtatagaacccaaggaagagaccagattgcagttgcagatagccaaaatcagaacacaaggcagagatgcagatggccaaacagcccgaacccaaggcagagagatcagaatgttcagcaatcaaaaaggcaacatggcatctcaagaattgaatgggaccaaagattgtacatttttcttgagtttgggtagggatcgacacacaatagcacattaa

SEQ ID NO: 29570 - DNA, 771 bp, Glycine max
  Peptide Sequence Number=SeqID_146348
atgggtgccgataataacgtcatggacgttcgcgctgcaaccgggccaacccgatcccttctggctcgtcaggagtctttcatgtggcagaacagtcagcggaccggccagcgtctccttgcgctggcctttagcggtgggtggctactggtggtggccctgccggcgcacgcgtgggatcaggccagcgagagcagcgcgccggattacaatgcgatacttgccgaaaaaatttccagtaatcatctgatgttgacagaaaaccgcgacagcgatctgcttgatgccgcgctcaatccgcccggcggcggcatggcgctgcacagcgaaacggccagcgtcggcaactcgccgctggtgaaccgctactcggcaggctggaacctgccgatgaatgaccgcctgcgcaccggtccggtggcgcagtttgctgtcgatgattccaccctgagctgcgccgcctgcgcgccggtcgatcgtaataacgccgaacacatcgcttcactgggctggcgcgtggattccagttttggctggatatcgccgtgggcgcaggtgagttacagccatcagctcagctttgacggcacggccgcgccacgcgatcggccggaagagatgaaccgggaaacgaactggatggatgtcagcgtcggtgcccgtctgccgctcggccagaacatggcggcgttcgcctccttcgcccagaccggcgcggtcagcagtggcgaacagttcatttacaacctcggcgtcagcgccagcttctga

SEQ ID NO: 29571 - DNA, 357 bp, Glycine max
  Peptide Sequence Number=SeqID_146349
atgaacgtccacagattcaacaacgtacacgatcacacagcaaaattcattgacgctggtggtgagaacatggcatttatggatcgtaatgtaacgagtgatgggaagcgcgtgatgaatctgaagcagttcaagcagtggctgaagacatcatttgacacaaacaaagatggtcgaatcagcaaagacgaattgcatgaagctttcaagctcactgttggtctctttgcttcgtggaagagccacaaggtgttgaagtatgcagacaccgaccacgacggtttcattgatgaaaacgaattcataaaccttgtacagtttgcagagaaccacttcaacgtcagaatcacaaagtag

SEQ ID NO: 29572 - DNA, 462 bp, Glycine max
  Peptide Sequence Number=SeqID_146350
atgaggtttgacacacatactggtagtagaggaagaagttcatttgtgttaattggttgtgaaaggagcgatcattataagtgtaggaagaaagaatttgttaaaagagacactgggagtaggaaatgtggttgtcccttcaagcttcgtgggaaaccagtgattggaggggaaggttggatggtgaagttgatctgtgggattcacaatcatgaattggccaagtccttagttggacattcatacgctgggcgattgactaaggatgagaagaatattattgctaatatgacaaagtcaatggtgaaaccaagaaacatcctactaacttcgaaggagcacaatgccaacagttgcaccacaatcaaacaaatatacaatgcaagaagtgcatatcgttcttctattagaggaagtgatactgaaatgcaacatctaatgaagcttcttgaacgtgattaa

SEQ ID NO: 29573 - DNA, 174 bp, Glycine max
  Peptide Sequence Number=SeqID_146351
atggaaggaagtagtaatagagtgattacttatgttagtgttcgatcagtctgggagatatatatgctaatattgaaggtgcaaatgcttttacttggaaggttgtactcacaatctaacaccggcaaagaaaaatttggcaaagcaaggcataattcaaatagacgagattag

SEQ ID NO: 29574 - DNA, 153 bp, Glycine max
  Peptide Sequence Number=SeqID_146352
atggatattggtggcaatggctcctggatgaagagaattagcagtaatatctaccccatcttcctgatcaccatgcaacatcaaacaaatgacaccgaaggcaccagtgagaagaatagatcacatgaattttattccaatgaaaaggaatag

SEQ ID NO: 29575 - DNA, 306 bp, Glycine max
  Peptide Sequence Number=SeqID_146353
atggatcaactgatctgtgtggaaagaaaaccagcaacaacaacccgcgtacctctgatgacgttgctatcgaaccaaccaccacaacaatcaccactggccagtaacactttcacctccacccaagtggcacctcactcaatgggaaaaaccaacagagcaaaaagcgaagcacgcacaaatggcaaaaacagtacaaacaagttattaaatgaagaagaagacgcaaggataattctagacttactaaaaattattgggtgtacaagcaataatgttggtgcacctagcaacacccctcaactg

SEQ ID NO: 29576 - DNA, 1116 bp, Glycine max
  Peptide Sequence Number=SeqID_146354
atggcactgatttccgagctactggctaacacaatactcttggtgatgaggcatttttctctacttagactggcatgcttgtttggtatcagaatcgcattaactgtcatatatacttggacggagttgatcggaacaacaattagcttccatgcaaacataatattaagaattatcacatggacatttgggcttatctccctgcctgcaagagttgtgtatgcctttcaaagggagaggcaggttcgcaaatgttgttgcctgttaccaagaaaggggaaaggaattggggatgggctggaacaaaaactacatgaaatgcagatagagttggagaatttagtgtgggataagaaggaactacaagaacattttaaaatggctgtcaaagagcgcaaaatgatggagatgctactagtggagcttgaagaggagcatgatatggccattgaaaaaattgaaaagttagagggaaagttgcaggatcagacaaatgaaaatcttcggctgaaagaaattcaaggaaagagatactggagctccaaagatcaaagcaacagcgacagagtccaaaccatcaatgacagcaactacaacatttctcatcctatactctcactgaactccaactacaacgggagtggaatctctcttcaggatcttataatgtgcaaagatatttgggaagatgagagcaaaaccagaagtgagttgcttaaactcttaaaagcagtaccaaagtccgggccagtagttaagtccaaaacgagcgaagcactagactaccatcgagacgtagctctttcacaatctctcttcagtgccattatgtcacttgtggttggagtcactgtgtgggaagctgaggacccttgcacgcctcttgtggtggctctctttgccgtagtaggcatgtccttgaagagtgtggtgcagtttttctccaccattagaaataaacctgcatctgatgctgttgctcttttaagcttcaattggtttattcttggcactctaacctaccctaccttaccaagggttgctcgcatgctggctccactagtgttacgccttatggaccaaaccatgacacctggttcggtctcctttccatag

SEQ ID NO: 29577 - DNA, 601 bp, Glycine max
  Peptide Sequence Number=SeqID_146355
atgaaactgtcacagacattggtgcggacacccttctcaacaacatcaccagcgttactccgcactcaaaattccattttgtcctcaaatggaaaaagggtctctgtgttggagtatcaaagcctcaggctcccgagttgcgcctgcagcaactcgggatccgctgtttcttcttcttcttctgcggcggccaagaagaatccttcgccgccggcgccgcaggttgtttccaattctggatatgattctgcggtgactcaggagctgccagggaagttggaggccttagaggaaggcattgagaaggtgtcggtttatggctattctgggtgtatttgggtctttaactggttcatttctgtgttttatcaagatgtctatcttttaggaactgtgatgctggtctttggaatgggtctctatgagctctttgtcagtaatcttggagtagatcaaaaaccttctgacagatcaagtctctttggtttattccctcttaaggaacgaccaaaatggctggatataaaaactgtggatgaactgaaaaccaagcttggtcacgtcatagtgatgctgcttctgattggattgtttgacaaaa

SEQ ID NO: 29578 - DNA, 2229 bp, Glycine max
  Peptide Sequence Number=SeqID_146356
atggcacatagggcatcgatgatcgacctgcgtggaggagaacaccccaagaagaatgcgcttcctctgacattgtcccaagctgaggaagaacatttcatcgttatactcagtgataccgagccgtcacctccattcattcatgccttcatgtgtcttttgagcaaggtgatgggtctggaaaagaatcctcttgtgtttttcgatgtctcaattgatggggaccctgtggaaagaattgttattcagctttttgccagtatagttcctaggacagcagagaattttcgggcactctgtacaggtgagaagggcattggagaattgacggggaaacctttgcattataaaggaacaagctttcatcgtataattagaggttttatggctcaagagaagattttgatcttgcatggtggtgatttttcaaggggtaatggcacaggtggagaaagtatatatggagggaaatttgtagatgaaaatttcaaactaacacatgatggacctggtgttctttctatggctaatagtggtcctaacacaaatggatctcagttctttattacattcaagcgccaacctcatcttgacgggaaacatgttgtttttggaaaagttgtcaacggaatggacattttgaagaaaattgaaccagtgggaacatctgatgggaaacctacccaaccagttaaaattattgattgtggtgaagtctctgaaacaaaaattcagcatactgccgacaaggagaaagggaaaaggagaaaatcaggaaaatccctatcttctgatgatggttctgacaaaaaatcaaggggaaaaaggaaaaaatcttccaaagacacgaggaagagaagaaggagatactctacatctgatagcgatagtgatagctactcctcagattctgagtcagattcagattctgaatcggattcatcagtttctgattctagttactctagtgatgggaaacaccagaagaggagaagtaagcgcaagcatgggaagaagaggaaaattggacgaaaacagagaaagagaagccagcacagtagaagtagaagagcaagacgcaagtctaggcggtctgattatagcctacctttagcattccccttatttcttatagtagcactcctccagagttctgaggattcaagtgatacagatagtgctagtggcagcagttctggcgatgagaaaactgatcgtcatgcctcaggtcgtaaaacacttgctgacaatgaagcccgaagaaatctagacacaggaaaacaatcttctagccctcctcagcaaaggcaaactattcctgaacaaaaaatggatcccaaggttagaagaattgtggacaagcaatcacatgaagaaggtgaattgtctccagagaatggtgcatttgtgaataacaggcatgatactgaagctgaatttagtaaacctgctaagcaacatgctaattcagatgatttaaatcacaatagaggtgcaagtcctcgaagaagtcctaccagggattctagggagctaaaccaaggacatgcttcattgttggctagtcctggccaaaaagtttctgaacctgctgcccccaaacatggtcagggcttttcaaaaagcccttcaccaaatggcatgcctaagcgtatcaaaaaaggacgtggctttactgagcgttatgcctttgcacgcagatatcgtactccttctccagagcggtctcctcgtacatatcgttatggtgatagaaatataagaaggaactttgatagaaacacaagctacagaagttattctgggcgctctccaccacgacgttttcgaagcccgccaggtggcaggaatcgtccaagataccaaagcagaagaagtcggagtaggagcaactcgcgcagtcctgtgcgtggccatttcagcgaccgtgaccgcagccggagtccaagacgtagtcctagtccagaagacaggcgtcctcccattagtgaccaattaaaatcccgacttggtccaagaagtgatgaacgattgccagacagggggaggtcaaagtccaaatctaggagcaatggctcttcttgctccagatccccagatgctacaccaccaaaacgttatgataaaaggacttccgtgtctcgcagcaggtctagatcgagctctccatctggacaaaggggtttagtttcttatggagatgctagtcctgattctgggtcagggtaa

SEQ ID NO: 29579 - DNA, 522 bp, Glycine max
  Peptide Sequence Number=SeqID_146357
atggggaaaatactttgttttggatggatgaatggaatgggggaggtggtggcaaatctgggatcttgggagaataacaattggtcatggagcttctggtggaggagggacactggtggcaaagggaaactcaaatgtctgaaacagaaccaagaggaccaatgggtgtggactgctgatagctctgtcattttttcgtatccattgcaacattccacgttcttttcagtcatatggaaattgaaggtgcctcccaaaatcaagtttttcatctggaggattgcactgaacagggttgctacacgtgataacttgaggaagagaggtatacttatcacagatgacgagtacaagtgtcctttctgttctctggttgaacagtccattagccacttactctttcaatgcccgtgttcttcccttatatggggtcaatggtattctaaggtgggtattttaatagcatctccatggactgttgaggcacattttaatcaacattatgtgttcttaagaaactag

SEQ ID NO: 29580 - DNA, 399 bp, Glycine max
  Peptide Sequence Number=SeqID_146358
atggacgcatctgaacccgacaatgtcgatgactactcgccttcttcaaccgtcatcaaattcgaccgccccgttcctttgctccggggaccgttaccggcgggtccctccgacgacccgtcggcgggaccgtacgtgctggcattccgagactcgcgcgcgtgggcgtcctcgttcgcggcgtgcgagcgtaaaatcgttgagcagtgcgaggagggggcgaggatcggttgcgccgtgagcgcgtccagaaagtgcaagcttccatggtggaagtccctggcgggtcccacgctctccgatctgaaggagcgggagcagtgcgaagtgcgcgagatggcggattgtgaagccgcggcgaaggagaagtgcgttggcttcgccagggacaagtgcttg

SEQ ID NO: 29581 - DNA, 900 bp, Glycine max
  Peptide Sequence Number=SeqID_146359
atgcctcccatgtccacgattccaattcacagacctgaattttgtaccttattcttcaatgggtctccaagcccttataaatgccccagaattactgcctcatggatcatggccatggattcgaaattttcttcaaccatcaagaataatagtgataatgattataatctgaagaagaagaaggatgaagaactctctgtgcagatttcaaccccacccatttccaaagttgaaactttaaactccaatgacctccaatttgatcgattgcagccatcggatcaagaattgggtcgagtcaaaaggtttgagtttgggcaatttgtcgcacgagaaactgtgcttgatgaagagtattggacagcagcatggttaagggcagaaagtcactgggaggatcgaccattcgaaagatatgttgataactacaaaaggaaatttgcggagcaggaatttaatgcattaaaaaggcggtgcaaggtgcaaaatggtgatagctgcgcatgcatcatcacggtgaggaaggagcagaaaaatgcaaagcactcaatattaaaaagtgttgtaggaacccttgatttgaatatccgatatttgctgcaaggggagacttatcccggggaacgggtaaaggcccctcttttttgcagcatcaacagaacaccaccaagcagatatggctacattgcaaacttatgcgttatcaaatcagctaggcgacagggaattgcaagtaacatgatgtcttttgctattgaagctgcaaaatctaatggtttgacacaggtgtatgtgcatgtagacagaaataataggcctgcacagatattgtaccaaaagatgggctttgaggtaacattgttagttcatgtgtatttctcattgtctatgatggattga

SEQ ID NO: 29582 - DNA, 177 bp, Glycine max
  Peptide Sequence Number=SeqID_146360
atgaagggaaagaggggagaaagcgaagaaggtggaaaattaccctctattttgttgttcttcataagattgagaattggtgttgatggtgaaggcacttcatttcatggtagttgtacgccaggacttgagttctggattgatggtattgatgtggtggggcatgctatgacttga

SEQ ID NO: 29583 - DNA, 444 bp, Glycine max
  Peptide Sequence Number=SeqID_146361
atggatgcaaattgttttaggctgaacaagagctcagcactatgttcaactcactggaacaccatcaaacgtaaaccagaacatcctttgtggctgcaatgctcagaacgccctcagacaaacatcacaggagaaacaagaaaaactaatgcctacaaagataacttgtttaatcgtttagcaatacatcatctttcaaaaagcgttcaagaagccacaggactcggtaacaataagagtgggtttgagagcttggttgaggcagctactgtggctaaacagaaatttgaccctattcagcagcaagaggttatcattcaagctcttcacaaagcattcccaaagccaatactttcattggcaaggcatataaaaagcatggaacggactgcctcactagttaatgcagagagtatggaagatagaaggatatatgggttctaa

SEQ ID NO: 29584 - DNA, 141 bp, Glycine max
  Peptide Sequence Number=SeqID_146362
atgcgtgacgagggaggcaggagagtgattgatcgactgaggaaggagaatggtccagtgagggaggagagtgatcgagtgagggtcgacagatcaagtgtgagcacgagcgacggaggtaggcacatagatggtaaatga

SEQ ID NO: 29585 - DNA, 258 bp, Glycine max
  Peptide Sequence Number=SeqID_146363
atggctaagaaaaacatgttattgacctgttgtcttgtcttccttattgtgcaagataacgttggtttatcagtgcaagcatcaaggatgctaaacattcaccctccaccacctatccctagagtcttattgaagagtattcaacctccttcccttgatttgtggtattctataaacgatgaaaagggtaatgatgcatttcgtccaacaagtccaggtcatagccccggggtgggacatcaaacaccaccaccatga

SEQ ID NO: 29586 - DNA, 489 bp, Glycine max
  Peptide Sequence Number=SeqID_146364
atgaggggcttcacatttaacgctaagcctactttaatctatggtgctcctaaggttgggtcgtcttctctatatatagggaaagaaaggaattcaagagtttttgttagcaaagatggaaccacattgtttttccttcttccctccaccactacggatggcgttcctcaccgagttaacagcccgcgttacactgggtcgatgactcgtccagctcactcattcaaacgcaacaacaacaacagtgagattgagcttcaaatcaactcacccagatcacccttggtttctgctgaagggtctgtttcaaaaaggaatcagcatcatcaaaaggagaaaaagaacaaatttggttgttgggtgttcttgctcttctgtggggtgtgcttgtttctgggtcttctcatgatttgtgcttctgcctggtggttccgatctaaagtacatagtacacatgaatccattattcaggtttcaatcatgccataa

SEQ ID NO: 29587 - DNA, 309 bp, Glycine max
  Peptide Sequence Number=SeqID_146365
atggcaaaggcagtacaaggccataggggcttcaaaaacttcaagaagactatcaaccaagacaaggtaaattttgttaaactcgttgataagttggatgaaggaaaaatttcttggaagaagttcagctccaaggtaaaaaggctccatgaagaccgaatcggtgctccatatcctagggagcacggagaaatacctaagctagaggaaagtttttattcaaatcctctgccaggatgtatatgtgaaagaagatttaaaattattcaatatcttttcatgccaagaaaagatggcgagactgaataa

SEQ ID NO: 29588 - DNA, 747 bp, Glycine max
  Peptide Sequence Number=SeqID_146366
atgaaagaaaagaaaaagaaagcatcaggcatagccagccaggacgaccctttggtgtttggatcttcaagaaagagagacccttgggatttcgtcaccatgagtctcttcggtcttggaaacagaaaccaaaaaacatttcgtccaaaaaagagtgctccatctggaagtaagggtgctcaacttcaaaaacacatcgatgccacgttgggtagtgggaacttgagggaggctgttaaactgcctcccggtgaagatattaatgaatggctagctgtaaacaccgtggacttctttaatcaagtgaatatcctgtttggtactcttacagaattctgcacgccaagtaactgcccttcaatgactgcaggaccaaagtatgagtatcgatgggctgatggtgttactataaagaaaccaatagaggtgtctgctccaaaatatgttgagtatttgatggactggattgaatctcagctagatgatgaaacgattttccctcaaagattgggggctccctttccaaccaatttccgagatgttgtcaagacaattttcaagcgattattccgtgtatatgctcacatttaccactcacattttcagaaaatagtgagtttgaaggaagaagctcaccttaatacttgcttcaagcattttgttttatttacttgggaattccgtttgatcgacaaagcagagttggcacctcttgaggaccttgttgaatctattgttcagttatag

SEQ ID NO: 29589 - DNA, 1218 bp, Glycine max
  Peptide Sequence Number=SeqID_146367
atggcggctgctaatgtgagcaaaattgcttttcaaacccatcatggacattatgaattccttgtaatgcttttcggcctctacaatgcaccatcatctttccaagccactatgaacaatacctttgggccctatttgtgtaaattcatcattgtcttcttcgacgatattctaatttatagtagatccttctcagaacatctcgagcacttaaagacagcttttcagattctcagagataacaacttcttcctcaaattaccaaaatgctcgtttgtaacccaacaagtagaatatctgggtcatgtcgtctccaaatgcgaagtggaaccagtacctacgaaagtcgatgccattcaacaatggcctacaccacaatctgttgaactttgcgagggactaccggacttttacttgccattcgtggtggagacagacgcgtcgagggtaggcatctgggcgattttatcacaacaaaatcaccatattgccttctttagtaaacccttttgcacgaaattgcttcacgcatccacgtatgtgagggaacttgccgcaatcacggtagcggtcaagaaatggcgacaatacttgttgggtcaccatttcacgatcttaacagatcaccgaagcctcaaggaactcatggtgcaagcaattcaaactccagagcagcagatatacctcgcacgattactgggatacgactatattatccagtatcacaccggcaagtcaaacctaacggaattaaaagcaaatttattgaccaatcaggaacttttggggtatcgacagaagataaaggatgaaccccataatcatcttgactatgttctccgacatgacttaattctacagaagggttgcatttggttgccacatggagctcattcaataccaactaacctcgcagagttccattcaatgcccaccggcggtcacatgggaattgtgaagacactggcactggtcggggaaaattttgtttgggcaaccatgaaaaaggatgtccatcaatatgtcaccagctatatcacctaccaacagacaaagtacaatcatcatcgacaaccagggctactatgtcccttacctattccggcacgaccatgggaagatctctcattagatttcattgtgggctcaccacctccggcatggcaagaaccttcattgacatttcggggaaaattcatggcatgccctgcagtctag

SEQ ID NO: 29590 - DNA, 606 bp, Glycine max
  Peptide Sequence Number=SeqID_146368
atggaggatggtgacgttcggcattcagtgttggagtacattctccggactgatgacccactccttcctagtaccctaatcaagaaaacccttcttctcggaacccttcaagaccacttgtactccggtgccggtgctggggagggaacctttctgctctcgttggagttggagcagtggaggagcaacattgaagcttccctttcggacttgcaagtgagagagaggtttgccttcgttgataccagaagggaggccgccgtcaagcttgagctagcagcgtcggagcaaataaacaacaatgtcgtagccgagaaccgattggaggcccaacaccaggagagaggagaattgactaggggtttaagcaactctaggagggaatatgattctgcggagttacaaaagttggctgatgattctctactcaattcattggaagtgaatgaggaggcacctactcaaagtagagatgcagattgggatgattcgatagacggcttggaggatggaacatcaaatcatgcaactagatttcatttgcctagccccaaggggacaaaagtttctccattggaaatgtataaaccagaaagcattacatag

SEQ ID NO: 29591 - DNA, 210 bp, Glycine max
  Peptide Sequence Number=SeqID_146369
atgaggatgattctaaccctcttcttcatcatctcatccctcctctccctctcccacgcctccgtggtcgcggtgacgccggccttcgacgacgcgcaattctccggcgtaaaaggcctgggaatctccattgcgcgcctagacctagcacctggtggagtcatcccactccacactcaccctggagcctcagaactactgttgttgtga

SEQ ID NO: 29592 - DNA, 843 bp, Glycine max
  Peptide Sequence Number=SeqID_146370
atgatgagtgggtatattggacaagataggtttaagattaaaagcattaaggagaacgttcggatgggtgctaatgtactgcaacttgaccaatgtgggcgctgtttgcctgattatgtaatagttgctactttggcacagtcacctaggcattatttagatggaggtttgctcgcacttgtttcttctgctccagctcttagatcgataaatctcagccagtgctcccttctcacttctgctagtatatatattttggctgaatcatcaaaatctcttctgaaagagttgcaccttgatgattgccaaggcattgatgctgcactaattttgccagcattaattgagcttgaacatttagaagtgttgtcagtagctggtattcaaattgtttgtgatgaatttgtcaagaactacattgttgctcgtgggcaaaatatgaaagagcttgttttgaaggactgtataaacttgactaatgcatcaatcaaagccattgttgagcactgtccaagattatctgtgcttgatcttatgaacctgcacaaattaacagatttatctataggacatcttacaaatggttgttgtgcacttcatacactgaaactttgccgtaacccattcagtgatgaagcaattgctgcatttgtggagaccactggagggtccttaaaagaattgtcacttaacaacattaagaggtattacaaattgttgtgttttgggctttacattgctttgaaatctggtggggctcttgctttttctttggattggttcattagccttattgaccgtggtggacaggagttgaaccccaataatgttgtttggcggtga

SEQ ID NO: 29593 - DNA, 453 bp, Glycine max
  Peptide Sequence Number=SeqID_146371
atgagatattttgggccatttcctattgtggccaaaataggtagcgtgccttacaagttacaactacatgcggccaaaatacatccagtttttcacatctctcaactgaagcctttcaaaggaattccacaagaacagtacatgcctttgcctctaatcacaaccgatacaggtccagtaattgccctaattgccattctgcaaactaggtccatcaagaaaggctcaaattttataccacaggtgcttgtgcaatgggacaacacgactccagctgaagccacatgggaggttttaatgagatgcacgttctcaaccaagtcagctaaaggggacccacatggagaaaaagggaataatgttgttagcattggtcgggaaatgatgaggcaaaggaaaagaatgaggaatcgcatgactagcaccaagttgagggactacgtatgcaattga

SEQ ID NO: 29594 - DNA, 831 bp, Glycine max
  Peptide Sequence Number=SeqID_146372
atgtttgactttgctaacccacccagtggtgaaatcctcttgaggtcctatgggaaccctgctaattggaagctggagcaacttatgacaccaaagttcagattagcagcaacctctttagataatcaggtagaaccaccttcatttatcgttaacctgacctatacttgttttatgagaaaagataactcaaattatccccatatggacatgccaatacatgctataaatgtcattgaaaacctaagtgcggtagagaaggcaggtttggctataaacaagaaaggtttgactttaaaagaacttctccagcaaacatctcatcacaatccaaaagttcgtagaggctgcacatcaactcaaaagagcagcccaatacatactggaagcccagaactagaagaacctttaaaaatcttatcagcaaaagcccaaactgcccaagaatggtgggtgacacacaacaagctttccttcccttgctgtaagggcttccgactactgtctgctcttttatttagtaggaataatgatcagcggattgagatgattaacaagataaaacaatggtctaaagggaaagaaggaaacatatgctccctgttatcgacattacaatatactaacgggaattggggaatggatttacaaatcatcatgcaattccttggaagtttagattgctggaggagcttgaacgtggtgaacaactcattggagatggcacagttagctatggaggacatactgacccagctgaagaaggaaatggccgcaccttggaggacataccttggatcgaattgcatatttgatgtatgcaatatatag

SEQ ID NO: 29595 - DNA, 1893 bp, Glycine max
  Peptide Sequence Number=SeqID_146373
atgacctaccttgaacctgacctagccacaaatgaccatcatctttctctaaatgcaatgaaagggaccgatagcatgggtattttgcgattcacaagccaaattgggcaaatcagtgtacaagtcttagttgatggaggaagttcagacaattttttacaaccccgaattgctgaatttattaaactcccagtggaaccaggtccttgtttcaaagttttggtgggaaatggccaatctatgattgctgagggagtgatccctaatttgtccatcacattacaaggacatgagttgacaatacctgtattcttattgcctgtggtaggagctgacattattttgggatcttcatggttggctactttaggcccacatgtggcagactatgcagctttgacactaaaatttttcaacaaaggaaaatttatggcattacaaggagagagaggcacaccacctaaactggctcaattcaatcattatagaatgatgcgaaatactgatgctattgctgattcatttaccgttcagctatttcagttccacactgaggatgatgctttgaaatatttaccacaacatatagctccagagattgccctgttgctgcacacttatagttcagtgttccaaactccaacatcattaccacctcctagaagtcagaatcatgctattccacttctggagggtacacaaccagttaaagtcaaatcgtatagatatcctcatagccaaaaagaacaaattgagaagatggtgcatgaaatgctagaccaaggtattatacaacctagtactagtcctttttcttcaccaattgtaccggtgaaaaagaaagatgatagttggaggttttgtactgattatagggcctatgttgtgacaataaaggatagttttcctatgccaactgttgatgaattactagatgatttatttggtgcaatttcttttttcaaaactggacttaagattaggttaccatcagattttgtccttcaacaacatgtactatttgtgaagttgtccaagtgttcatttggagtattgaaaattgaatacttgggacacatagtttccggacaaggagtatctatggatagtagtaaggttcaggcaatctatgagtggccaccacccacaaatgtgacacaattaagaggatttctaggtctcacaggctactataggcgtttcatcaaagcatatgccaaaattgatgcccctttgactgaattactcaagaaagatggttatttatggactgaggaaactgaaacaacattccttagactcaaagaagctatgatgacaacacctgttctggggttacctaatttccaacaaccctttatcttagaaacggatgcatcagggattggggattacacgagtaggtctgtagctgagttattcatgacttatgtggtcatgcctaagtcaatagtgtctgacagggataaggtttttactagcaatttctggaagaacttatttcaattgcagggtaccacattggccatgtcctcagcctaccatcctcaatccgatggcctatcagaagtagtgaacaagtgcttggagatgtttctcaggtgtttcacttttcacaatccaaaagcttggtacaaggctttaaactgggcagagttttggtacaacacatcatttcacaccagcattggtatggcaccatttaaagcattatatgggagagatccacctactctgactcgatacaatccacaggcatcagaccctgttactctacaggaacaattgatcaacatggatagcattttacagcaattgaaacaacaattggaaagagctcaagtatacatgaagaaccaagctgataagaagagaactgatgtgtccttctga

SEQ ID NO: 29596 - DNA, 1176 bp, Glycine max
  Peptide Sequence Number=SeqID_146374
atggagtcccacggcggaggacccctccgttcccgcagctcccagtccccttctccctcccactccgcctccgcctccgccacctcctccatccacaagcgcaagctcgcgtctgaggaccacgcgcctcccttccctccgtcctccttctccgccgacacccgcgacggcgccctcacctccaacgacgacctcgagagcatctccgcccgcggcgccgactccgactccgacgatgactccgaggacgccgtcgtcgacgacgacgaggacgactacggcaacgacaacgactcctccattcggaccttcaccgcctccaggctcagcaaccctccctccgctccccgcaacaccaagctcaagaccgaaatctccaccgtcaaaattgagaattctgacggcgccaaagacgccgtagtcggagcttgtgccgccgcttccgcgggatcggtccccgggattgtggttaaggaggacccgactaagatttttactgataatttgcaaacgagtggggcttacactgccagggaagagagtctcaagaaagaggaggaagcaggaaggctcaaatttgtatgcctatcaaacgatggtgttgatgagcatatggtttggttgattggattgaagaatatatttgctaggcagcttcccaatatgcccaaggagtacattgtccgacttgttatggataggagccataagtctgtaatggttataaggcgtaatcatgttgttggaggcattacatatcgcccatatgctagtcagaagtttggtgagatagccttttgtgcaattacagctgatgagcaagtaaagggttatggtaccagattgatgaatcacttaaaacaatatgcacgggatatggatgggctgacacattttctcacatacgctgacaataatgctgttggctattttatcaagcagggatttacaaaagagattcacttggagaaagatcgatggcaaggttatataaaggattatgatggaggaattctcatggaatgcaagattgatccaaaactcccgtacactgatttgtcaactatgatccgtcgtcaaaggcaggcaattgatgaaaaaatcagagagctatcaaactgtcacatcgtttatgctggaattgattttcagaagctcaattcagattgcatttaa

SEQ ID NO: 29597 - DNA, 153 bp, Glycine max
  Peptide Sequence Number=SeqID_146375
atgttgatgctcataggacaggttctgctcagtgatggtggctgcaacaatgaagaggaagataaagagaataagagagtgagtgagatgaaaaggctaaatggcagggaggaccatcattttcttacatatgctggtcctcgggatggttga

SEQ ID NO: 29598 - DNA, 336 bp, Glycine max
  Peptide Sequence Number=SeqID_146376
atgacaggagaggctggatggactcctgatcagtggggtcattcacgattcagaactttaaattcaatgttcgatcatgctgatgcttggccattcaaggagccagttgatgctcgggatgtccctgattattatgacatcatcaaagatccaatggatttgaagacaatgtctaagagggtggattcagagcaatattatgtaacatttgagatgtttgttgcggatgccagaagaatgtttgcgaatgcacgcacctataattctccagaaaccatttattacaaatgttctacaaggcatgtgctcgtgcttccacctcctggatggatgtga

SEQ ID NO: 29599 - DNA, 198 bp, Glycine max
  Peptide Sequence Number=SeqID_146377
atggatgactcatcaaccattgaagaaactgaggactcacccatacaaccttatttttcaaaaagtgatggaggatcgtgtacaagtggcaaacatggagaagtgatgttgatgccaaggagcgaaatgaagagaaagatgccattgaaggaaccaaagaatcttacttgggttttgggagttcatagtcttaattga

SEQ ID NO: 29600 - DNA, 973 bp, Glycine max
  Peptide Sequence Number=SeqID_146378
atggctcagaatcagagtaattgggaagctgataaaatgcttgatgtttatatttatgattatttgatgaaaagaaaattacatgctgctgcaaaagcttttgttacagaaggaaaagtttccacggatccagtagcaattgatgcacctggaggatttctctatgagtggtggtctgtgttttgggacatattcatctcaaggacaaatgagaaacattctgaggctgctgcagcttacattgagacccagcaaacaaaagctagagaacaacaacttcaaatgcagcaattgcaactaatgcagcaacgcagtgcacaattacagcgaagagatcctaatcatccatcccttggtggttccataaatgccatgaactctgaaggaatgttggggcagccacctgcaagtgtgttggcaatgaaaatgtatgaagagcgaatgaaacaccctcattcaatggattcagaggcatctccaactcttattgatcccaatagaatggccttactcaaatctgcagctagtcatcaaggccaattggttcatggaaattcagggaatatgtccactgcattgcagcaagggcgggctcctttaaccactgacatcaaaggagaagttaatttaggcgccactccaaagagtttgcctatggatacatcggtttatcgacaagcaattttacattcaaaatctggacttggcagtgcaggattaaatcaaggagttacaggtcttccgttgaagggttggcctctagcatctggaattgatcaactaagacctaatttgggtgtccaaattccgaagcccaatttgacagcccagaatcaatttgttttggcatcacaacagcaacaggtcttggcacaggctcaggcacaaaataaccttggaaattctaattatggtgacatggatcctcgtagactttctggtcttccacgaggtagcttaagtgcaaaggatg

SEQ ID NO: 29601 - DNA, 327 bp, Glycine max
  Peptide Sequence Number=SeqID_146379
atgggtttcattctctaccgaaaccgcgaggcaagttggaagattccgcttcggttgaagggttcctctcggtgtggggtttcaacggagaacaacggcaatttgtggtggctaatggtggctgtgggtgatggagaaagagcttggaacattggaaatggttttggaagaaagaaaggagaagaaatgacgtttttcctaagttacttggactacaagactcaaaacgcacaagtgagcaatgctctcgggaacggaaacgtcatgcacactccagacatcttctcaaagatcacaacagtcagatcatggacaagtgtcttgtga

SEQ ID NO: 29602 - DNA, 681 bp, Glycine max
  Peptide Sequence Number=SeqID_146380
atgacatcattagtctttcaaggtggtttcaacttcagctcaaaacttcaaaatcttcatttgcaacattgtagtcttacggatagaagttttcttatgccatctacttccagtatgagttcttcatcttctcttgtttcccttgatctctcctcaaatctgttgaaatcatcaactatattttactggctctttaactccaccaccaatcttcataagctttccctttatcataacatgttggaaggtcccattccagatggatttgggaaagtaatgaactctcttgaagttcttgacctctccggtaacaaactgcaaggccagattccatctttctttggtaacgtgtgcgcattgcggagtttagacctctcaaataacaagttgaacggggaattttctagcttcttccgaaattcttcatggtgcaacagagacatatttacgaacttggatttatctgataaccggttgactggcatgttacctaaaagcattggattgctatcagagctggaggatcttaacttggttaggaattctttggagggtgaggtcactgaatcccatctttctaatttttccaaattaaaatacttgcggctatcagagaactcattgtctctgaaattcgtcccgagttgggttcctccattccaattagaatacttggaatcg

SEQ ID NO: 29603 - DNA, 449 bp, Glycine max
  Peptide Sequence Number=SeqID_146381
atgccaatattcatccctgccatgactgagcacaaggccctacctccgaataacacatataagcatgtgtttatcccgcccgtgcctgggtacaggcacctacctccgaatataatcgtcaccgaaaatcaaataagggaaatattgagaaaagcagatagtaatggagacggtcgtttgagcaaagaagaacttaagaaagctttcatagaatttggatccaagatgcccggatggagagcatgtcgtcttctaaggaaagctgacaccaaccacgacggagtactcaccatggaagaacttgacaccattgttgattttgctcttgctagtgcacttgtcaatccatcaataagagcatgtcgtcttctaaggagagcagacgccaaccacgatggagtactcaccatcgaagaacttgacaccattgttgattttgctcttgctag

SEQ ID NO: 29604 - DNA, 4172 bp, Glycine max
  Peptide Sequence Number=SeqID_146382
atggcggagaacacacacatgaagaaactcacggcagaggtagctcgcctcaaagatcttctggtggacatcaagaaacttgcagagatgatggaatcgcgtgaccaagagttgaaatcactccttgagcatttaacaatgagagaaaatgatcaggatactagatttgaaacaattgaatcacacatcacctccttgcttaggaacaattcaggaccttcgaatccaccacttcaggttcaaaatgtcaaactagattttcctagatttgatggatctgatgttttacaatggatattcaaggctgagcaattttttaattactaccatactccggatgagcaacgtttgattattgttgctgttcatcttgataaggaagttgttccttgttttcaaatgcaatcccgcgataatgcttttccttcttggactacattcactagagttctgaaattggaatatggcccttcaccatatgaatgtgctagatctgacttgttcaaattacagcaagaaactatggttcaagattattatgtgaaatttacagcattggctaatcgggttcaaggtgttacgatggaagccttgctggattgttttgttggaggactcaaacctaacattaaaagagatgtgattgctcaaaattctgttatattgctgagatgtgtgtcattagcaaaattgcgcgagaaaggactctatttcacttgtgatgacaagtttactcctgctcaccgatgtcctaacaaacaatatctcctcttacaagtagaagatgatgaagtttttgatgaaagtgccattgagaaattggatgaggttactctggagcggcctcaacaaactgaaccgcacttatcctttaatttaaaaggatcatcaggtttgggaacaatgcgattcactggattgattaatggaatgcaggtacagatcttgctggatagtggaagttcagataactccttacaacccataattgcacattgtctgaaattaccaattgaacctatccctgagttcaaggtgttggtggggaatggcaatgctcttactgtggaaggacttataagagaattggaggttaagattcaaggccattccgtggttttacctgcttacttattgccagtagctggagcagatgtggtactgggtgcatcatggctgtctacattgggtccacacatctcagactatagcaaattaactctaaaattcttcagtaacaaccacttcattacgttgcaaggagatcaattacagttaccaagcgtagctcaatgccatcaattgaggagattgcagcatacacattcaattgcagaactatactccctttgctttacacgatttcatggtcctcaggatcacttactggagcttccaccaaatatggaccctgcactaaccactctgttacacacttacaaagatgtttttgttgttcctgttggattaccacctcctagaattcaaaatcactctattcccttgatgcaaggatcccaacctgtcaaagtcaaaccatacagatacccccatagtcagaaggaacaaattgaaaagatggttcaggacatgctcaatgaaggtattatttcacccagcacaagccctttttcctcacctatcattttagtgaaaaagaaagatgggacatggaggttttgcactgattataggactttaaatgctatcatcatcaaagatagttttcctatacctactgtagatgaattgatagatgagttgtatggagctagatttttctccaaattggatcttagatctggctttcatcagattttgatgaacaaagaggacagatacaagactgcttttaggactcatcaaggccattatgagtggctcgtgatgccctttgggctcactaattcccctgcaacttttcaaagtttgatgaatgatgtgttccggggtttattgaggaaatatgttcttgtcttctttaatgacatactagtatacaaccctacttggaattctcatctgcaacatctagaatcagttttacaggtgctgcagtataaccaattatttgctaagctgtctaaatgtgcatttggtttaactgaagttgaatatctaggccatactgtttctggtgaaggtgtggctatggataaagacaaagtgcaagctgtaattgattggccagttcctcagaatctaaaacaattaagaggcttcttgggacttactggttattatagaaggttcataaagggttatgcatccacagcttctgtactcacaaatcttcttaagaaagacagttttacatgggaccccactgctactgtagcttttacagcattaaaacaggcaattactaaggctcctaaacaatctgcttattctagagaatcttttgctatcactgaggctatctccaaatttagacattacttgctgggccataaattcattattcaaactgatcaaaagagcctgaaaacactcactgaacaagccttgcaaactcctgaacaacagtcatggctacctaagctccttggatatgattttactattgaatacaaaccagggaaagagaatatccctgctgatgcactatccaggtcatttttcatggcttggtcagctacaaaaatacactttatagaggtcttgcggaaagcacaagctgcagaccctgacctagcaggtaaacttgttgttcccaaaaaccatgatatgatccaacaaatactaaaggaatttcatagttctactatgggtggacacgctggttataccagaactttggctagaattgcctcccaattttattggtctggaatgcatggtgacatcaaggactttgttcaacaatgtttggtctgccaacaagccaaaacagctattgttcttccctcaggactcctacagccgttgccaatacccaaccaaatctgggaggatttggctatggacttcattacagggttacctccatctcatggctatacagtgatctatgtagttgtggacagattatctaaatatgctcactttgcaacactaaaaagtgactataacagtaagcaagttgcagaaaccttcatgaacatggtagtcaaactacatggtatccctaagactatagtttctaatagggataaggtatttacaagtcaattttggcaacatcttctgaaattaagtggtacaactttgaccatgtccacagcttaccacccacaaacagatggtcactctgaggcactcaacaaatgccttgaaatgtatcccagatgtttcacttttgacaaccccaaggaatgggtcaagctattaccctgggctgagtattggtataacactgcttaccatactagcactggtatgtctccctttaaagctgtctatggaagggacccaccaaaattgcttcggtatgcacctattaatgatgaaccagtctctgtacaagaacaactgctgcttagagatcaaattttggctcagcttaagactcatttactcagggcacaacaaattcaaaagaagaatgctgatttgaaaagaaaacatgttgaatttcagattggtgacaaggctctagtgaagcttcaaccatataggcaacattcccttgctctgaggaagaataaaaaacttagcctccattactttggtccttttacaattgttaaaaagattgggaaagtggcctacaagttagacttaccagagaacaccaaaattcatcctgtttttcacatttcacaactgaaactttgccatggtaaccatgctcaaccatacataccattgcctatgacaactactgattccagaccaatgatccaaccagtttccatattgcaaacaagaaccattatcaggggaaatcaacaggtcaaacaacatctcatcttgtgggagggattggattcttctaatgccacatgggaagatcagtcaattctaagtgaggcttttccagattttaaccttgaggacaaggttaattttgatggagggggaattgtaacaagtgctagcagcaaggataaagttgaagggacaaaagagggaaataatttgacacaaaatgaattagttacatggttgggaaagaggggcccacaacaaaagggaaaacacacgtctgaagggatattgggtgtgag

SEQ ID NO: 29605 - DNA, 483 bp, Glycine max
  Peptide Sequence Number=SeqID_146383
atggttggtgatgaatgcaatgaacatgtacctctaacaactaataaacttgatggtaacaagaatacaaatcaagaaggagaggagaatgttattaagaaaaaaaggaagaaaacatcaagtgtgtggaaggattttgatgaagttgaaatagttggagtaggaaagaaggcaatatgtaagcatttcaaagttagattatctactagtgggccatggggtagcacaagtcatctaagaaggcattcaaaaaaatgcaatgaaaagaagttgcacatggctaaagaaaagaaccaatctgtcattccttttaagtcttttaatccatcaaacccattcctaattcctggggataaatactccaatgagaggatgagagaaataattgctactactgtgatggttaatgaatacccttttagcattgttgagaatgaagtttggatgtgggctttccaatatgaaaatcttgactttcaaaaa

SEQ ID NO: 29606 - DNA, 1779 bp, Glycine max
  Peptide Sequence Number=SeqID_146384
atggatgtttggagtcttcaaaagttggtgaagacagcaccatctaaagcattggtcatcagaatcaacttggtctgtcttgccatctttctggtcgtctatgcaacctttcttctccgtccatcttcatccgtctatttcgagaatgcagcctcccttgtccggtgctccttgcgtgagtgccatcacaagggagaaaaaagcataaagatgaaagcagtgttggagaggaatgaagataggagggcaaagcagaacgcgagtaagatagaagtgcctagtttctttggcgaaatggggaaaggaatgaagataggaatggtgaacatgcaagaagatgatgtgagtgaatggagcacccttggagaaacaagccacgtttatttcgagaaagtgtcacagtttttcaattggacagatttatttcccgaatggatagatgaagaggaagagaccgatgttccatcgtgccccgagataccaatgccggaattcacagcatatgaaggcatggacgtgatcgtggccaagttgccttgcaattacccaaaggaagggtggggaagaaacgttttcaggttacaagttcatcttattgtggcaaatttggcagtgaagaaggggaagagggattggaattggaagacgaaagtggttttgtggagcaagtgtaggccaatgctggagctgtttcgatgcaacgatttggttaagcaggaaaatgagtggtggtattatgaggttgatgcaatgaggttggagcagaaagtttctttgcctgttgggtcctgcaatttggctctgcctctatgggaacaaggaatcgacaaggtgtacgacacgtggaacctggaacaaagcgttaaaagcgaagcgcgatcaaaacgtgaggcctatgcaacagtgctccactcctcagaaggctacgtgtgcggcgcaataacgctagcacaaaccctgctccaaaccggaaccaagcgtgacctaatcctcctcctggacacctccatctccgtcgcgaaacgccgctccctcgaactctccggctggaagatccgactcataacccggatccgaaatccgcgggccgagaatggcacctacaacgagtacaactacagcaagttccgactctggcagctcacggattatgagagagtgatcttcattgatgctgacatcatcgtcctccgcaaccttgatattctcttccacttcccacagatgtccgctactggtaacgaccagtccatcttcaactccggcatcatggtactcgagccctccaactgcacattccacgttctcatgtcgcgccgccacgatgtcatctcctacaacggtggcgaccagggtttcctgaatgagatcttcatgtggtggcacaggcttccgcgacgggtgaactacttaaagaacttttgggccaacacgacaatagaggcaggtaggaaaaatgcaatgttcggggcggagccgccgaagctctacgcgattcactatctagggctaaagccatggcattgttatagggactacgactgcaactgggatgtggaggatcagagagtgtacgcgagcgacgtggcacatcgacggtggtggaaggtgcacgatgctatggacgagaacttgcaaaagctgtgtaggttaacgaggcaacgaagaatggagttgaactgggaaaggagaaaggctgggaaattagggttgccagatatgcattggaagatcaatgtcacggatcccagaagagctggctcgatgttgattggctag

SEQ ID NO: 29607 - DNA, 183 bp, Glycine max
  Peptide Sequence Number=SeqID_146385
atgtattcattagagagctctgagtctcagtgtatcgatgtttctcctatgcttcctactccttttataggcctaagcgagtatgacgctgatcacatgcttagtacaaagttcgcgctgagtgcgcctttaggcttcttcattgacattcttcgtgctaagcctgagctgactcctgagtga

SEQ ID NO: 29608 - DNA, 766 bp, Glycine max
  Peptide Sequence Number=SeqID_146386
aggactacacgtcctcaccttaagagggctgcacgccctcgccttcagagggctacacgccctcgccttcagaggactagatgtcctcaccttcagagggctacacgccctcaccttcagaggactatacgtcctccccttgagagggctacacgccctcacctttagaggactatacatcctccccttgagaggactacacgccctccccttgagaggaccacacgtcctcgccttcggagggctacatgcccttacctttagaggactacacgtcctccctttcagagggctacatgccatcgcctttagaggactacgcgtcctcgacttcaggggactacacgtcctccctttcagagggctacacgccctcacctttagaggactacgcgtcctcgccttcaaagggatgcacgtcctcaccttcagaggactgcacgtcctcaccttcaaagggctgcacgtcctcgccttcaaagggcgacacgtcctcaacttcaatgggttgcacgccctcgtctttagagggctacgcgtcctcattttctgggccagtagtttccttttattagtttctgggccaccccctgatattggaggggatcgtgcccacaagacaaccagtggacccggagaagtccaacagggccctggggtttccagatctaattacgagcctttgtcagtcctacaggatgcccgttccccccagcaagggatcgcgcccacaagacacccagtggacccggagaagtccaacagg

SEQ ID NO: 29609 - DNA, 282 bp, Glycine max
  Peptide Sequence Number=SeqID_146387
atgttcgttaacttatcatgttcgttaactatccgatgtgagactctaacaaatacaggggaagacttgactaaaggaggcattggaaacaatgaattggattcatcatcctcttgggtggaggagtactacaatctgagcaaagaagcagagcaagcgaacacaagggttgaagctgctaattgtgaaattgagatagctaaggagtgtgaattgaaaaccttggagaagctgaatgatgtgaatagagagaagggaatctctgaagatggcaatggatag

SEQ ID NO: 29610 - DNA, 345 bp, Glycine max
  Peptide Sequence Number=SeqID_146388
atgaagagggcatcctcgttgttgcagcgtcatggagtcattgggcgatctgcagaagaagaagaagaagagaagggacaacgaccaaaaagacgttgctttggtggagtggaatcttggttggtgctgagcaggcagtggcatccagctaaggagccagatatgggaattcttaagatctccgaggctctacttcactacgttcttccattgcccttgcatgcgggcccacctatgatcctcttgggaccaactctgtcgttgactgaaaccagacaaaaactcattttaaacttctctgcctgctgggtccatcataaaccttctatgtttgatgtaatttaa

SEQ ID NO: 29611 - DNA, 762 bp, Glycine max
  Peptide Sequence Number=SeqID_146389
atgaggagtggaatgatcttcaatgtcttgaaaagaaaaatccaacgtaagatgagtctaaaccgaggtcaaaccataaccgctgtcatttatcgataccccatttctgttgggtctggcatgttcatttaccaggttgttaccatcagtgatgatgaggatattgatggcatgttcgatttgctcgtacaatacgaacaacaaccttcttctattgccaatgtcgaaacaaccgttcaatcaccaaaaattcataaaacatcatacattaactaccatactcaaacctaccataaaggcccatcctcttacacaccaatcccatacacgaccacaaatgattattacatccctcattttgaacccaccgaattcgatacccacattacttcatacacacaactacttggtggatcatcaaactactgtgagacgactccccaactaaatgagctcttccaactaaatgttgacccaattactgatatccatgttgctcagtctgaaagcaacaaaatgtcacatgaataccatgctcaaaatgggttgccggatgaagtagttggtgacttcagtgacgatgaagacaaaattttggcaaacaataacaacaacgacaacgatgataatgacatacagttccttttccagcaaacatcaactgaaaatgtctatcatccatatccaaatagcgctaatgttggtgacaaccaagtgcctaacaaccccgactataggcattttttggaccaacaacaataa

SEQ ID NO: 29612 - DNA, 180 bp, Glycine max
  Peptide Sequence Number=SeqID_146390
atggctgatggaaaactgatagagatgaagggtagagttaacctaggaattttgctatcaaatatgtgcagcagaattttggctttgtgcaaaaaatgttgtgtatttgctggttgtggaaagagtagtacagattgggttctggacgttttcaagcagatcccaacggtcacaatgtag

SEQ ID NO: 29613 - DNA, 165 bp, Glycine max
  Peptide Sequence Number=SeqID_146391
atggtttctggggcttccctggcttccataaaatttctgaaaaccttggaaaaaatcgagtcgaagtgcttccgtaacgcttctgtaagcgattctgtggaaattcttcatcattcttcatcgttcttcaccattcttcgtcgttcttcggtcttcaaccggtaa

SEQ ID NO: 29614 - DNA, 1035 bp, Glycine max
  Peptide Sequence Number=SeqID_146392
atggccgagaacgcggccaacgtgatcggcatcgaactgctggccgcggcgcagggctgcgacttccatgcgccgctgcgctccagtgccgcgctggaaaccgtgcgcgccacgctgcgtgcgcagtggtgcgctggcgcagggcctggccgacctgctgccaaccgtggaaccgcaggcatgaatacccatcccgactggctgacggtgcacgagggcgacgcccccctcatcgtcagcttcccgcataccggcagcgagctgccgcacgacctgatcggcgactaccactcgccgtggctggcacgccgcgatgccgactggtgggtgcacgagctgtacgacttcgtgcgcggcatgggcgcgaccacggttcgctcggcgatctcacgttcggtgatcgacctcaaccgcgatcccagcggtgtgtcgctgtacccgggccagaacaccaccggcctgtgcccgctgaccaccttcgacaaccagccgctgtaccacgcgggccgcgagccggatgacgccgagatcgcgcggcgccgcgacacgtatttcctgccctaccacgatgcgctggccgcacagatcacccgcctgcgcgcgcagcacggtacggtggtggtgtacgacgcgcattcgatccgctcgcatattccgcacctgttcgatggcgagctgccgcagttcaacctcgatactgccgggccgtccggcgcacctgacacgtcatgcgacaacgccttgagcgatgtggtggaaaacctgctgaagatcagtggcatgagccaggtgcgcaacggccgcttcaagggcggctggatcacccgccactacagcaacatcgccggcggcgtgcacagcctgcagatggagctggcctgccgtggctacatgcacgaacccctgccggaccaggtggacgaacacagctggcccaccccgctcgaccccgaccacgccgcaccaatgcgccacaccctggcgcaggtgctcaatgcctgccttgaattcgctacgaaccggagcgccgcatga

SEQ ID NO: 29615 - DNA, 306 bp, Glycine max
  Peptide Sequence Number=SeqID_146393
atgattgcctccaaacaagtgtacacacttattgtagccaaattcatcactgaagaagaaactaagtccaacactcacttcgttcaacaatttgaccgccaaagatttcaatttcaagttgagaaaatagtgaatacgagagagaggcatcgaatggggaaattcattgttaggctggatcaaagaacatgtgattatgggaaacctcagaagctacacatgccatgtggacatgtcattgttgcatattacgtgttaagtgtctacaaagtcctgttagcaggcatgcgtcatcatgattactag

SEQ ID NO: 29616 - DNA, 318 bp, Glycine max
  Peptide Sequence Number=SeqID_146394
atggcttctagtgatataattccctttgatatcaatgttgtggcggtagggactaccagtgacaacatatcatcaaagagaaaaactctagatgaggtttcactgtcatcaagagggcaacacgaggctcacaggtgcatcttccaaggtagggaaatgcgtagagttgccaccaacgtttatttgaggcaaacatcagaaaaaccaaaatgtgtgtctataaactttaagaataaaaggtttgggagttatttttacgcacaaggaagggtcgacaaaagcaaggcttttgctcctacatatcctcaattgcgatga

SEQ ID NO: 29617 - DNA, 267 bp, Glycine max
  Peptide Sequence Number=SeqID_146395
atggtgatgctgatacagtggggtgaatggttacccaaggctcaacgtgacagggtaatctatggagatactgaggtatcaattacaaggggcacctgtctcattctcgcatctcctgatgaacgcgtggtgacaatccaccttgcacgtactgccactaatttggctatggtgcccagtgctctcgttatggtatgtttcatcgaatttgatgtgttcaaaagaagaaaaagtgttccatcacttgcatgcacatacttcaactaa

SEQ ID NO: 29618 - DNA, 783 bp, Glycine max
  Peptide Sequence Number=SeqID_146396
atggagcaccctcagaccaacgaacaagtcgaggcagctaacaaagtcattttaggaaaattgaaaaatctactagatggagccaatgagagatgggccaaagagctagcagagacgactatagaagtagtgcaagaagagtttgtgcgtcactggcatatagttatacaagcaaagtgcgcggaacgcttgcatggctgcctatccattcgggtgaagttatgtcggagcaacatcgagtatgtggagcacacccatggtagaatcgtcaaacaagacccttacatgaagatcacgaaacaagaaatcgtacatgtaaaagaaatccatgttcatcccctcttggttcatgaacacgaactccgtgggcagtgtggcatccgaccggaccatgcgaagagtgaccgagcacgtatccagatctgttatggtacaaatcgacagccagctaatgaggtgtttacctctacgtcaacccacgggtactctggaagcgtaatcgggggaggtggacacctctcttttagcattggacacttcttaggtcaagaagtagccttctcgaacgtcctcgccttggcaataacggccaatactgggcccgcaacgctttcaccaaccttttcagttgtagtggatggtagctggctcaaaaaagctgaaaggtccctagacccctcggttgtcgagaggtcagtcaaactagaaaaaactgatcccaaggagtgggagttggacaacacttctaaaactacgttttcgtaccctcgaacctcagactag

SEQ ID NO: 29619 - DNA, 597 bp, Glycine max
  Peptide Sequence Number=SeqID_146397
atggctccagagtggacagacgagaaacacagcatgtatatcaagtctatagaagcatctttcgttaatcagttatatgattctaagcaaatgaaaacttcatatgaccctgctaccacttccggccagttcaaggtactacgtggtggctgttggcaaaaaatcaattttgagagagtgaatccgcaaacgagtaggattaaccagtgtcatgacttgacggaaaatccatggattcagcactaccgatcttcaagcaaacagagaagcatagcagtttcatcccttcaagaaagtgttactaccacaagtaaagttgttgatttaggccaaaggaaaggagttccctctggatcaggacatcttcatttgtgtgaatctcgagtctgccataaagatatgctttatagtgatacagagatgtcagaccagaactttgttgatgaagaagtgaaaggcaaaaagcaaaataaaaagagcaaggtgaaacgacagagatctttgataagtgatgctcaagacaatgatcagatggtccccaacagaaaatcatcttctggtggagattttaccaagaattttgtttctgctgcttag

SEQ ID NO: 29620 - DNA, 165 bp, Glycine max
  Peptide Sequence Number=SeqID_146398
atgggtgttgcgcttagcggacgctcgctaagccagcagattggcttagcgagaagttttgcttgtcctcaagcaaaaagagaacagctcccttgtcctcaagtgacaataagatgcagtgatcatgtacaaaggtgtatgcagcaaaaattacagattgcatga

SEQ ID NO: 29621 - DNA, 744 bp, Glycine max
  Peptide Sequence Number=SeqID_146399
atggacggttacgacggcaccgtcaggctcggtgccatcaacctcaagcacgatcgcgccgccgatttcgactccgccaccgccgcccccgacgtctccgtctcctctccggtcacgcgccagaaagccgctgccgccaaacaattcatcgagaatcactataaaaactatctccaaggattgcaggatcgcaaagacagacgcagagcacttcagaggaaagtgcaagaatctcaggtatcggctgaggagcaggaggaaatgatgaggaacttggagcgccgagaaactgagtacatgaggcttcagagacgtaaaattggaatcgatgactttgagcagttaactgtaattgggaaaggtgctttcggtgaggtgaggttatgtcgtgcaaaagatacaggagagatttttgccatgaagaaattgaagaagtcggagatgcttagtcgcggacaggtggaacatgttcgatctgagaggaacttgctggcagaggttgatagcagatgcatagtcaaacttcattattcattccaagattctgatttcctctatctcatcatggaatatttacctggtggtgacattatgacattgttaatgagggaagatattctttctgaagatgttgctcgcttctacattgctgaaagcattcttgctattcactcaatacatcaacacaactatgtacataggtatggctattatcacactgttccgtttttgttctattggtag

SEQ ID NO: 29622 - DNA, 1554 bp, Glycine max
  Peptide Sequence Number=SeqID_146400
atgtcacccttcacatgcacttcatccatcatacacgaattcaattggagaaaagtcacagcaatttacgaacacagcaacttctttgcctctcattcagaaatattaacaagactctcatattctctcagtctagttaatgctgaaatagaccactatgttgcttttccttcaataataatcactctttcaaacccaatagaaaactacatagaacaagaacttgtaaggctcaagaacaagagcaatagggtgttcttgcttattcaatcttccttagagttttccacattgctatttgagaaggtaaggcaaatgggaatgatggaagaagggtcggagtggatcatcactgatgatgtagctactcatcttgattcattggattcttctatcatgtttaacatgcaaggtattatggggtgcaaaaccaccttcatggaaacgagtgaaacgttcaaacgtttcaaatttgtgtttgggaggaagttcggattggaataccctgaagaggaaaactcccagttaccaagaaatattttacgtagtgatcatgagggtcttggtgggaagataagcttcaaggacagaatgttattggaaccaccaacctttaagactgtcaaatgttattggaaaagtgagaaccttgttgagcatgtggtggtgaacacaacaacaacaattagtgttggttctgctagagtgcttttaggttctgtggattggcctggtgggttgaaaacagttccaaaaggttgggcttacaatagcactgaaggaaggcctttgaaaattggggttccagcaattgatccatgccctcagtttgtgaatgtgagtcatgataagagactgaatgaaacccaattcacaggtttctctatcaatgtctttgaatcagttgttaagcgccggccttatcacctgccttttgtttttgttccattctatggctcttatgatcaaatagttgaacaagtgaacaataaggaccttgatgctgctgttggagatattcaagtggtggaacatagatatgcatttgcggaattctctcatccgtatgttgaatctggtatagccatggtggtgaaagtaaaggcagatagatccaaagaaacctggatgttcatggacgcttttacaaaagaaatgtggatgttgatggcagtgatgcacctgttcatagcatttgtaatatggttcattgaaggtgaaaacaattcagagttgaagagtcttggggccattctctggttttctgtcaccacattattctttgtacacagagaacctgtgaagagcaacttggctcgagctgtgctagcaccttggttatttgctattctcatagtgacttcaagttttactgcgagtctttcatccatgatgacagtgtcccatcttgaaccatctgtgccagatatacaaacactgctggggacaaacgcaatcataggctgcaacaagaacacttttttgataccaaaagaattacaacacctcaatgaagtagaaccccttagtgaaagcaaagaattatgttactga

SEQ ID NO: 29623 - DNA, 909 bp, Glycine max
  Peptide Sequence Number=SeqID_146401
atgatcaatacattgctctttgttttgtgtctagtaactagtggtgctagacataaagttcatggtactcaaaatgcactacaagaagatttggagttggaaagacaactagagctccttaacaaacctcctatcaagagtattcatacaaattttgggtacattgttgattgcattgatattaacaagcaacctgcatttgaccatcctttattgaagtaccacaagctgcagaaggaccaatgtccaataggaactgtacctattcggagaacaacaaaagatgatctcattcgtgaaaaatcattcttaaattatcacataatgagtcaggacatccccgatgttcatattgcagaagtgactcttccatcatcatatggtccttattatggagttattggaataaataacgtatttaatccaagagttagtaggaaggatcaaatcagttcttctcatttatgggttcagaatggaccagtggaagctactaacaaaattgttgcgggatggcatgtggctccacaattatatggtgataatgaaacccatgtttacttggcatggacgtcagataatttcaagcagacagggtgctacaatattcgatgttcaggttttgttcatataagcaaacgagtttacattggtgcccatgtgaacaattattctatctatggaggaacgcagcgtgaacttgtcgtttctattactcagttcaatactttggatatttttcagatgacattggatattctgtccaatttggaggacccggagattcttcctccagaaggcggttgcttctggaggaaacaacctggctcccctgggcaagctgagctctcctggggaggagtgaagaaggaaggggttcagccttcttggcatctcgtaatcacttga

SEQ ID NO: 29624 - DNA, 306 bp, Glycine max
  misc_feature (41)..(41): n is a, c, g, or t
  Peptide Sequence Number=SeqID_146402
atggtgaagaatttgcaaggacacgggacattgttcattgnatcacccaaactttacggattgtgcaacgatgctcttttcgactttcagaatgttgcgaaactttacggattacgcaacaatgctcttttcgacttccagaatgttgcgaaactttacggattacacaacaatgctcttttcgacttccagaatgttgcggaactttacggattacacaacaatgctcgttttgggggtcccgaaggcagcaaacaaagttcgagaaccgaccgcaagcaccgcccgaacaaaattagggtatga

SEQ ID NO: 29625 - DNA, 682 bp, Glycine max
  Peptide Sequence Number=SeqID_146403
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtcagcccctcgaagtcgccgatcccgtcattgttcgagtcgaagaacgacttgacgtggatctggtagatgatggcgtcccggtaccattgcggatcgctgcgatcgatcatcgcgtcgctgcctcatcgatgaagtcgaaggagccggccgtccaaacgaccggcggccgggcggccgtggaaaccgccgcaggtgccacgggcggcctcagcccgcaacccggcgtggtgggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 29626 - DNA, 1602 bp, Glycine max
  Peptide Sequence Number=SeqID_146404
atggaagacggcgatacgacggaggaggcggttgtcgttccggtctcaaacggcgacgagcaatcgttttctcattcttcctcacggcaacgcgattcggaggaggaatctccgcacgaaacgttgcgtaacacaaaagcttcaatagagaacatcgtagccgagattctctctctgaagaaccaggcaaaacccaaaccactcctcactctccgactccgagagctcctcactcaaacgttcctccacttcgtcactctccgccaggcaaatcgctcgatcttgctggaggaggagcgcgcaagaacggaaacggagcgtgcgaaggtgcctctggaactcaccacacagaagcttcagaacctgagttatgagaagagtcaattcgtgaaagcgataaaggtgtgtaacgatttcaagtcgaagtatcctgatattgaagtggtgtcggaggaagagttttttcgcggcgcgccgcaggatatgaaggattccgttttgtccaatcacagtgagcataatctcgtgcttaagaggctcaatttcgagctctttcaggtgtttgtaaatgttaaattgtactattgtggtcatggatgcttctgcttctggctcaagttttgtattgataaactagttgtttttcaaaagaaggatttgaggcgcaaagagctttgcaaacttcatgacaaactggaacagaaaaggaaaacccttctggatacaattgcaaaccgaaagaagttcttatctagcctcccttcacatctcaagtctcttaagaaagcatcgttgccggtgcaaaatcaactaggagttcagcatactaagaaactaaagcggcatcatacagcagagttgcttccaccacctctttatgtgatttactcacagttgttggctcaaaaggaggcgtttggagaatctattgatgtggagattataggaagtgtcaaagatgctcaagctttttcccaccatctagctcacaaggacactggcatttccaccactgtggagagtcctaaattggaaaacaatgaacctgatgaagatggtcagagacagagtaaaaggccaaggaggtttcaaggcaaggagagccttgaccaggcaggaatatttcaaattcacccacttactgtcaatctccatgtgtatgatgatgaggttactgatcttgagtctgcaaaactcatttctctaaagtttgagtacttgatgcagttgaatattatatgtgttggaaacgaagcatctaatagtggttctgagaatgacatcttaagcgatttattcccagatgacaccggtctcgagcttcctcaccagtcagctaagctctgtgtcgggaatgctataatgttcaatggtgatagaactgcacgtccttacaaatgggcacagcacctggcgggtattgatttcttgcctgaggtggctcccttgctgcttgctagccgtgaaacttcagacagtggtgaagctgccaaaggtgaagacttcataactagtctttcacaatatcgccaacaaaaccgattacagacagttctgcaaaaaattcgatcaaggataaaagctcagttggctcttcaataa

SEQ ID NO: 29627 - DNA, 378 bp, Glycine max
  Peptide Sequence Number=SeqID_146405
atggagttgttcgcattgttggttgtggccaaggaaatgaaggggaatcatgcagtgactctattcttcttcttctcttacaaaatggtcatcgccgattccgattacaatggtcctctcttcaaggtctcccaagtcttcctctgggatgatgaccttaagttttcatcctcagctgaacgctgggtaaatttgattgaccttgttacacctgaggatttggagcttaccaaacagctgaatgatttggggctccctctttccttccagacaaacaaagaggtaggttgcagttcgagcattcactcatctctttgggatgaggtaaattgtacctctcactttacgggagtgaaatccacagtgctcaagctctga

SEQ ID NO: 29628 - DNA, 600 bp, Glycine max
  Peptide Sequence Number=SeqID_146406
atgtacctcatcatcgtcgtcttctcctacccttccattgaccccgtcaacttcgatctcatcatcgtcggcactgccctatcggaatgcgtcatcgcagtcgccgcctctgtcgtcggcaaaaccatcctccaccttgaccccaactccttctacgatagccacttcgcttccctctccttccacaatctcacttcctacctcacttccccgcactccctcccctctgctgcaactgtcgtcgcatcttccaactctgacgatatcgttgtcgtcgaccttgtccaccaacccttctacaccgacgcggaaaccgcaacctacgatgaatccgtgtttcttagcgaaaatttacgaaaattcaacattgatttgggaggtccgagggcgttgttctgcgcggacaagacgatcgatctgttgatgaaatcaggcgcggcacagtatttggagttcaaaggaatcgacgagagcttcgtctatgaagcgaatgcgggtttggtgaacgtgctggattctcgaggaatgattttcagagacaaaaagctttcgctggaagagaagaaccagttgataaggttcttcaagctggttcagtag

SEQ ID NO: 29629 - DNA, 726 bp, Glycine max
  Peptide Sequence Number=SeqID_146407
atggtaattgatatgtttggattggatactaaatctgatccttttgagtcaaaacagggaaagaaagtaaaaagaagacaaaggcagaggaaattatataatgaagctgaggatcttcactttcaagaaatgcctgaagtgtattctgttgcagttggaaaatattggtgtcagaggcatagtttgttctctagatttgatgatggtgtaaaaatggatgaggaaggatggttttctgtcactccagaggttcttgctcggcatcgagcaatacgttgtgctagtggcgtgataattgacggtttcactggtgttggcgggaatgctatccaatttgcacgacaattaatcttccatacccatccctcgctgtggacagagactgctgacagcaacactaaaccctacctggctctatggtaccatgctgatacagttttcttatctcctccatgggggggacctgattatgtcaaggctactacttttgacttgaagacaatgcttagaccacatgatggatatacactgtttaatgttgcaaaggagattgcttccggagttatgttccttccaagaaatatcaatttcaaccaattggcagagttatctctgtcatcctgtccatcatggtcactagaggtggagaaagtttatttaaataataaattgaaggcgatcactgcttatttcagtgatacagcagttgggaatgtgcgaagttaa

SEQ ID NO: 29630 - DNA, 1830 bp, Glycine max
  Peptide Sequence Number=SeqID_146408
atgccagagttagggtttcaggaacgaaggtcgtggaggcggagaggcggcgacaccagccccgactccgtcatcttcactctcgaatccaacttgagcctcttctcctccgcctccgccagcgtcgaccgctgctccttcgcctccgacgcccacgaccacgactccttagcctctgaaatctcactccatttggcagtgcaggatcacgacggcgatttcgctcgtagcgaaagctggagcggtcaagatccggatccggatctgaataaacgacaacaacaacaacaacaacgacacgcagatacagattcagatgcagtacatgggaagcatcgccgaaatcgtttctctggaaaaagagagaaagcgaaagttcaaaaggaagaggacagtgatggtggtgacactgaggacggaaatcaacacttagaatttgattcggccagaaactctttctctctggctctcaaagaatgtcaggatcggagatcaagatctgagacgttatacaagaagcacgatcggcgaaggcctgcttcgttagatctgaacaatgccattggcaatggcaatgtttcttcgcctcgtttggaattaggagctatgaagaagagcacgctttgcactcgaaggtctggctctggctctggcaatggcaattttccgagtcctggaacgcctaattatcttcacgccagtgttgctatgcaaaagggttggagttcggagcgagttcctttgcataccagtgctgcacgcaagcaggttggtgcggctctgtttcctttcaacaacggccgaacgttgccgtccaaatgggaagacgccgagaggtggattcttagtcctgtttccggtgatggtggcaccgggagggcctcgcttccggcaccgcagaggaggccaaagtcgaagagtgggcctcttggcccccctggagctgctgccgttgcgtattattccatgtattcccctgcggtgcctttgtttgaaagtgggaattcggggagtttcatggcagcttctccgttttctgctgctgttagtgtctcagctgctgccgctgatgggttaactgccagttccggtggcagtactgatccttgcatggctcgctcggttagtgtccatggttgctctcagatgcagagtcagtcatcattgccggcccaaggggagaagtttgatggtttcaaagatgcaggcaccaatgtatctcctgctctttcaaggagggacatggccacccagatgagcccagagggtagctcatgctcctctcccagtttgaggccttctttatctgcctccactccatcttcctttcctctctcagagttcaagagtttgcctttctctaaaatggatatcagggatgtgccggtagatgaacgtgtaaccatgacaaggtggtccaagaaacacagggcccttttttctggcagaggctcagaaaatggtgacaactggaaaattaaggaatcaagctgtcgatcttcattttgggacatttctggagggtcaaagactgtttcaaagtccaaaagggaggaagccaagatcaattcatgggagaacttacaaaaggccaaagctgaggccgcaatacgaaaactagagatgaagttggaaaagaagcgagcatcatctatggataagattatgaccaaactgagattggctcagaaaaaagctcaggaaatgagaagttcaactttagccaaccagccccatcaagttcccagaactccgcacaaggctatattatttagtagagccagtcagatgggttctttaagtggttgtttcacctgtcatgccttttaa

SEQ ID NO: 29631 - DNA, 1872 bp, Glycine max
  Peptide Sequence Number=SeqID_146409
atgggatcaaccaatggtaacttccctacaaaccttcccattcttgacggcaaaaactggaacaagtggagtgtccagatgaaggtgatattcgcatatcaagaagtccaagaagtggttgatgaaggctatccttcacttgtagaaggtgcaacagaagcacaaagggctgtgcatcgggaaaacaagaagaaagataataaggctttgtttttcattcatcaatgcatagataatgcacactttgagaaaattgcttcagcaaagacctcacatgaagcctggaagattcttgagaagtgtaatgagggtgccgatcagttgaagaaagtgcgattacaaactctgagacgccaatatgagctgatgcagatgaacgtgactgaaaaggtagcagagttttttaatggtgtaatcgccttgacaaactcaatgaaagttgctggtgaaacggttacaaatcaaatgattgttgaaaagattcttcgcactctgattcctaagtttgatcatgttgttgtggcgatagaggaatcaaagaatcttgcaactctaaaagtagaagaattgcagggttcattagaagcatataaacagcgtatgctggaaaggcaaagtgacagatctcaggaccaggctcttcaagctcaaacttggaagagaggtggtctttctggaaaaaaaggcaatcgaggcagaggaagatccagagagtatagaagcaatcatggaagttctggaaaacaatctcagaacaatgaggaaaatgatcaatctgaatcttcttcaagaagaggaggatcacaaaattggcaaggaggtaagaagaaagtttatcgaagatttcttaggtgctataattgtaacaagttggggcacttctcaagtgagtgcaaggcacctgctgattcaagaggaaaattcagtaatgaagccaatcttgtgagtgaaaagcttgatcaagatgaagaaccagtcactcttatgatgatgacaaaagaaaggagtagcaattcaggaatttggtacattgattcaggatgtaccaatcacatgactggccatgaagaatggcttgtcaatcttgatcttagcaaaaagagcagagttcgatttgctgatgatagacacattacagcagaaggaattggtgatgtctatgtcaaaaaagaagatgggaaggatgttgtgattacagaggtgctctatgttcctgggttaaagagcaatcttatcagcatgggtcagctgcttgaaaaagggttttcactgtacatgataagtggtcatcttggagtatatgatactcatcaaagaaggattttgaagatttggtcacctaaacttcaagagtttgagtcttctgaattcaaaaggaatggtgttaggaatgactccaataaagcttccctcaaagatgtgtgtggtccaattgatactgtctcattgggtggaaacaaatactttgtatccttcattgatgaatttagtagaaaaatatgggtgtatttgcttaaggccaagagtgaagttttctctgtgttcaaagtgtttaaatcaatggctgaaaaacaatctggaaaatacatcaaggtgttgagaactgatggaggtggtgagttctgttcacatgaaatggaaaatttttgcacagaaaatggaatattgcatgaaattgtagctccatatacaccacaacacaatgggatagctgaaaggaggaataggactatactcaatatggtgagaagcatgttgaaaggcaagaacatgtctcatacattttggggagaagctgttatgacagcagcttatgtactgaatttgtgtcctacaaagaagcttggatcaaaagtaccagaagaaatctag

SEQ ID NO: 29632 - DNA, 924 bp, Glycine max
  Peptide Sequence Number=SeqID_146410
atgtttagtatattaaattaccaagagctctggtccacacgagcaatcatagtgcaagacaccaagtccgaacccaacttgattgtggttgcattcagaggcacagagccatttgatgcggaccaatggagaacagacgtggacatctcctggtatgagttgcccaacgtgggtaggattcatggtgggttcatgaaagccttaggtcttcaaaagaacactggatggcccaaagagataattgatcaaagcagcacaagtggtgagcctcatcatctttatgcatactatacaatcagagagaaactgagagtcatgttggaggcaaaagaagatgcaaaattcatattgacagggcacagcttaggaggagccttggcaattttgtttgctgcagtgctcacactgcatgaggaggaatggttgttgaacaagttagaaggggtttatacatttgggcagccacgagttggggactctcggtttggggagttcataaaggacaagttgagaaagtatgatgtgaggtatatgaggtatgtttactgcaatgatgtggtgcctagggtcccttatgatgacaaaactctcttctttaagcactttggtgcttgcctctacttcaacagcttgtaccatgggcaggttctagaagaagagccaaacaagaattatttctctttgttctgggtcatacccaagatcctaaacgcagtttgggagcttattagaggatttcttatcccattcatagaaggtagaggctatatacagaattggttcatgacgatgttcagacttgttggattgataattccaggactaccagctcaccttcctacagattacgtcaatgttactagattaggatccttaaacgattctcaggagcttcaaaactcacaagattccaaggctgactga

SEQ ID NO: 29633 - DNA, 1331 bp, Glycine max
  Peptide Sequence Number=SeqID_146411
atggttttcataggatatagctctactagtgcatacaagctatataatcctagaaccaagaaagtagaattcagcagagatgtattgtttgaagaatatactgcttggaaatccgataattgttgttcaggtcaagatcaaacagtggctgagatagatctggatctagatcagactgcacctgatttagataatggagaagaacttggagaggaactcaatttaccacttgcaccacctgtggaatcaaatgcacctcagaatgaaaggccaaaaagacatgctgaagtgcctgcaagattacatgactatgaattgttccaggattctgaaattgggaatgatggtgagctaatccatatggcattacttgctgatgttagtccagttagttttgatgaagctatagttaataaaaattggaggaaagctatgaaagaggagctggtttccattgagaaaaatgaaacttgggaattggtagagcttccagcaaataaaagacctatttcagtgaagtgggtattcaaagtgaaactgaatccaaatggttctatctcaagacacaaggccagacttgttgttagaggcttcatgcagaaagagggactggattactcagaagtgtttgctcctgtagcaagaatggagacaataaggctattggtggctttggctagttggagaggatggaaactttggcggcttgatgttaagtctgcatttttgaatgggcctttggaagaagaggtttacattacacaacctcctgggtttgagcttaaagggagtgaggacaaggttcttaagctcaagaaagcactttatggtttgaagcaggctcctagagcttggaacaaaagaattgatgcattcttaagcaaaattggtttcagaaaatgttctgttgagcatggcttgtatgtgaagaaaagtgattctggtggaatattgcttatatgcttatatgtggatgatttactcatcactggaagtagtagcactgaaatagcagaaattaaaagatgtttgagcagtgagtttgaaatgactgatctaggcaagttgtcatacttcctaggtatcgagtttgagcaaaacaacaagggaattctgatgcatcagagaaagtatattctggaaattctagaaaggtttaatatgcttcagtgtaatcctgttgatacaccagtggaagcaaatttgaagcttggaagttgtgagcaggagacaaaggttgacagcactatgtttaggcagctggttggatgtttgaggttcttatgccatagcagacctgaaatatcctttggtgtaggacttgttagcag

SEQ ID NO: 29634 - DNA, 237 bp, Glycine max
  Peptide Sequence Number=SeqID_146412
atggtggacaacaagtctgctattaatcttgctaaaaatccagtttctcatggtagatcgaagcatatagaaactaagtatcatttcttaagaaatcaagtcagtaaagagaagataaagctgcaacattgtggtactgatttgcaagttgctgatatattgactaaacctttgaagattgaaaggttcaagtcattaagagataagatgaatgtagagatgtgttgtgttctataa

SEQ ID NO: 29635 - DNA, 153 bp, Glycine max
  Peptide Sequence Number=SeqID_146413
atggaaatgaagaggagccatctttgtcgaaattctctggcctcaatctcttctgggcattcgatgaatcttctgtttttcaagttggaagagaacaagaggcgtccaagatcaacagcacttgcctcttgtggcttcagcagcagcccttaa

SEQ ID NO: 29636 - DNA, 297 bp, Glycine max
  Peptide Sequence Number=SeqID_146414
atggcgcagaagacgacagttagtctctacgtgctatcaggcttttcgtcttacagacagcaaaaagtttatacggataaccactcgggtatttccgcccgtcagcgtgactcaaaagtcagtatgacagatctacagcagaaagtttatacggataaccacttgggtatttccgcccgtcagcgtgactcaaaagtcagtatgacagatcttgtgagcgcggaagatgacgtaaatctccgcatgtcaacgggcctgtcggacgcgattgacgaaggtcgcagaagacgaagttag

SEQ ID NO: 29637 - DNA, 222 bp, Glycine max
  Peptide Sequence Number=SeqID_146415
atggggaccaccacggcaatttcaagtgaatacgaagtgccaagaaggctgacccctttcctcttcactcctccccctatttatagccaaatagaggaggagcttgccacccagctcgcccaggcgagccaggttgcttcctctagaagcaaccgccttctgggggaagaatctggaaggcccaagtgggtctggttgctatttgcacccctattttactaa

SEQ ID NO: 29638 - DNA, 363 bp, Glycine max
  Peptide Sequence Number=SeqID_146416
atggaagggttgtccctgtgtggttcagactttgtaaaaggagttttacaaagagagtggaaaatctcaactgtggtttatggcataaacttaaaaatcctgatgagtcataataacagcttccagaattgccccatgtatggtgttgcttgtcaatgttatgattcaacaagcgattctcctcaaatttcagccagcccgtatcaattagacttcacactttatgcttcggggtcatacaatgctcaatggaatgcccctgggctcctccatgataagcacacgttgcgttcgagtcgtatcctcagaaaaatggaggttgaggaaccttggttggggttatggctaccattgaattattga

SEQ ID NO: 29639 - DNA, 252 bp, Glycine max
  Peptide Sequence Number=SeqID_146417
ggggaacgggcaccctgtaggactacagaggcccgtaaccagagctggaaaccccagggccctgttagggtggtcatgttggtgcgcatggtccgcactcgtctttttgtagcggaacgggggaaatcttgccccggtatgcatagtagatgcgtgatagcctccctctctggatgtgctcacacagttggtcgccctccaatatcagggggtggcccaggaactgataaaaggaaactattggccccttaa

SEQ ID NO: 29640 - DNA, 207 bp, Glycine max
  Peptide Sequence Number=SeqID_146418
atgaggacgcgtagccctctaaaggtgagggcgtgcaaccctctgcaggcgaggatgtgcagtcctctgatggtgaggacatatagtcctctaaagattgactgtccttttgaaaaaggtgataattcatgcaaccttatcctatcttttgcaaatctctccgggaactccctcagagtgtatgttctgtttgatttagtcacttga

SEQ ID NO: 29641 - DNA, 306 bp, Glycine max
  Peptide Sequence Number=SeqID_146419
atgaccataatttgtctctgcgtgccatcggacacgactgtgtctgaatggcaaaaaggtgctggaatgaccataatttgtctccgcgtgtcatcgggcccaccgcctctggatggcaaaagacgcagaatgaccataatttgtctctgcgtgccatcggacacgactgtgtctgaatggcggaaaggtgagcagaatgaccataatttgtctccgcgtgtcatcgggcccgccgcctctggatggcaaaagatgcagaatggccataatttgtctctgcgtgccatcggacacgactgtgtctga

SEQ ID NO: 29642 - DNA, 288 bp, Glycine max
  Peptide Sequence Number=SeqID_146420
atggagaattggcgaacaacgctacctaataacttcgcggggctccagactccgctaggcaatgacattcttggggctacgaaaaaaactggagaatggagaattggcgaacaacgctacataataacttcgcggggctccagactcgtaggtggaggacacacgaatagcactaggcaaggacattcatggggctccgaaaaaaagtggagaatggagaattggcaaacagcgctacgcaataacttcgcggggctccagactcgtaggtggaggacacataaatag

SEQ ID NO: 29643 - DNA, 258 bp, Glycine max
  Peptide Sequence Number=SeqID_146421
gcctgccagaccctaactaaagggggattagcctttcattgtcatgagagacttttacactttagggggttgatgtggatggaagaagatggatggatagaggaggaaaagaggataatggacatagaaagagggtttcccaagttggagatactcaggcttaggatgtattcattagagaactctaagtcttcgggcgtggtgttatctcggtgtatgggttatggccttcccttctacttcctaatctttttatag

SEQ ID NO: 29644 - DNA, 352 bp, Glycine max
  Peptide Sequence Number=SeqID_146422
atgactagaggcaatccatttgacttacaacactttgatcctgagatagataggacatttcatagattagttagacatcattttataccttttgagcatcatgagcattttgttactggagagtctgtgcattttgttattggtgattttgaacatcctgattttgagcattataattttgaacattctgagaacatggcacaacctccaccccgtgagagaactctaagggaaatggttgcacttgatttcacctacgaaagcttgtgcatccaataccctgatgaggatgtccaatatgttcttaaaaccggactgatccatttgcttccaaagtttcatggccttgcag

SEQ ID NO: 29645 - DNA, 688 bp, Glycine max
  Peptide Sequence Number=SeqID_146423
aggactacacatcctcgccttcagaggactacacatcctcgccatcagagggctgcacgccctcaccttcagaggactacacgtcctcgccttcagagggtcatctaccttcatcttcagagaactacacgtcctcgccttcagagagctgcacgccctcaccttcagaggactacacgtcctcgccttcagagaactacacgtcctcaccatcaaagggctgcacgccctcaccttcagaggactacacgtcctcgccttcagagggtcatgtaccttcaccttcagaggactacacgtcctcgccttcaaagggctgcatgccctcaccttcagaggctggacgccctcaccttcaaaggttcttgggccaccccctgatattggagggcgaccaactatgcgagcacaaccaaaggaaggctatcacgcagctactgtgcataccggggcaaggggtcgcgcccacaagacacccagtggacccggagaagtccaacagggccctggggtttccagctctgattacgggcctctgtcagttctacggagtgcccatcgccccctgcaagggatcgcgcccgcaagacacccagtcgacccggagaagtccaacagggccttggggtttctagctctgattatgggcctttgtcagttctacgaagcgcccttcgcccccaacaag

SEQ ID NO: 29646 - DNA, 411 bp, Glycine max
  Peptide Sequence Number=SeqID_146424
atgagtcatcattcatctagtgttaatggcgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaagaagagaggaagaaagaagaaaaataatgaaagaaatgaaaagagaaaaacatgcctcatatagtagtcataactcttgcaagagcctaagtgaagaacttcgtgactattacgaaggaaggcataggtcacatcttagacctcactcccatagaagagacaaggaaagacagcctcaagaggctaacattaacctctcatacttccatgggaaggacaatgtagaggctaacttagattga

SEQ ID NO: 29647 - DNA, 276 bp, Glycine max
  Peptide Sequence Number=SeqID_146425
atgacccttcgctcagtgaatatgcacagttcatcctccttccagattctttctcgcgctcagccgagaagtgttgcgctctgtagatggctcgctaagcccgaagattggcttagcgagaagagagagaatgcagagaaagagtttgtgaaatttggcaattatgagtgtaactaccgttacacttacttaagcagttttcaaccttctcgcttagcggaccgctacgctaagcgagccagagagacgtttggtttctcaatgaggctcgcttag

SEQ ID NO: 29648 - DNA, 174 bp, Glycine max
  Peptide Sequence Number=SeqID_146426
atgactaatgcaagctgtctgcaagagtcattgcattcagtctcaaacaggaatctaaggtttgacactgcacaaactcttgtgtcaaggttccttcaagtttcttcttttttcgaggacgagggtgagagccccgtcgagtctgatgaaacaaaagtccaaacttggagctgt

SEQ ID NO: 29649 - DNA, 345 bp, Glycine max
  Peptide Sequence Number=SeqID_146427
gaaaggaatattaggattggtcaagctgaatttgatgagtttaaggcagagttggaaaggcgtgaccttcacaaacgcctcgccaaccttcaggtgggaagcatagacgtggcgatggttatcctgtgcattcctggcaagggctttgttctaaacgttgagggccaaccatggaagctcctcagaaaggatcttactactttggcccagacatggaatgtcttctcttactccaacctagctcctacctcccacacctcagacttgaatatggacagagctaggttggtttatggcttagtcacagggatggacatgaacattggcggcttgatctctggatag

SEQ ID NO: 29650 - DNA, 404 bp, Glycine max
  Peptide Sequence Number=SeqID_146428
gaattgctcttaaagtttcatcatctactcaagaaggaagtgataaggaggacttaattgaaatagatgaagatgatgatcttagtctatttgtaaaaagattcaacaaattcttgagaataagaggaaatctaagaagatcaaattttaaatcaaagaaaagagcagaagattcatcctctactccaagatgttatgaatgcaatcaatctggacatctgagggttgattgtccaatgttcaagaaaagaatagagaaatatgaaaagaaaagcttcaatgaaaagaaggctaagaagacctacattacatgggatgacaattatatggactcctcagaggaatcagagaacgaagttataaacctgagtctaatggataagaactatgaaagtgatgaagag

SEQ ID NO: 29651 - DNA, 210 bp, Glycine max
  Peptide Sequence Number=SeqID_146429
atggacatggagctagagcaacttgatgtgaaaacaaattttctacatggaaagttggaggaagaaattctaggaaacaaccaaaaggttttgaggcgcaaggaaaggaagattttgtctataggcataatatatggctcaagcagaagcagtgaaggaaggaatctggttaaagggtcttatgaacaatcttgggtttccataggataa

SEQ ID NO: 29652 - DNA, 291 bp, Glycine max
  Peptide Sequence Number=SeqID_146430
atgttgaaagtgtttaaatgtccaacatactatcatgtacatgaaggaaagctagagcccagagctaagaaagtggatgagtttgactacacgagtcaaaaccttatgaggaagcctaatactactgctcttaggaagtctcaaaggcaaatcaaagcacctaaaagatatggctttgatgatatcgtctcctatgcactccaagtagcagaagaattgactcatttgaaccaaccacttatcatgaagcaattacttgttttgaagttgataagtggacaatggctatga

SEQ ID NO: 29653 - DNA, 333 bp, Glycine max
  Peptide Sequence Number=SeqID_146431
atgcgattaagcgcgtcatcggtcaccaaaatcgtctcgtccgccgcggcggacgcgtgtggcgcgaagggcagtaaggccagcgccgagcccagcaacaaccgcttggcggccgtcgcttccgcattcgaattgtctatccctttgtttttaatcttcattctctctcttgcatacctgcgttgtgtgtcatgcaaccctgataaaccccgaaatatcggcgagcggtctttacccgtcgatacggaaacgccgtgtgcgcacgacggtaaaaatccgacaaatagtattgaaaacgataatgagtatcaatacgattgtcaggttttgtaa

SEQ ID NO: 29654 - DNA, 111 bp, Glycine max
  Peptide Sequence Number=SeqID_146432
atgggttttcaagataaagattctactcctgaagatgaatccaaagttgaaaaactggagcaaagcattgaaatcactgccacacctcctaaagacctccctagagaatga

SEQ ID NO: 29655 - DNA, 744 bp, Glycine max
  Peptide Sequence Number=SeqID_146433
atggctaagttcgacccagatgtagtcctagagtttaacgccaatgcttggcccacggaggagggcgtgcgggacatgcggtcatgggtaaggggccagtggattccttttgatgcagacgccctcagccagttcctgggagacccgctagtgttagaggagggccaagagtgcgagtatagtcagagaaggaatcgggccaatggatttgacgaggaggccattgcccaactgttaagcatatcgggtcaggattttgcccgaaccactgccaggagacaggtgcggatcatgcgcaccagcatgaccaccttgactcagatgtggatgacgttgctgctcagcaacgtcctgcctagcgatcataactccgacctccctctaccaaagtgtcagctggtgtatgccatcctgacacggatgagcgtccatgtggctcagttgatcgctgacgccatttatttatttgtaggtatgccacctaccaggcaccctctagacccatataagtctaacagggccctggggtttccagcgttgatcacgggcctctgccagtcaaacggggttcccgtcacacctagtaaggtgattcgaccgccgatcacccgggccttcattgagaagtattgcacacctagacaggcgcagggtgatgcaccacaggccgcagatgcaccgccaccacctcgtatggctgatgcaactgggtcatttggcatggagcagtatttacagaacttg

SEQ ID NO: 29656 - DNA, 360 bp, Glycine max
  Peptide Sequence Number=SeqID_146434
atgtcatttgggttatgtaatgctcctgccaccttccagagatgtatgctagctatttttgctaatttggtcgaaaaatgcattgaggtgttcatggatgatttatcagtatctgactcctccattgaatcttgtttatccaatatggaattggtgctaaagcggtgtgtggaaactaacttggtgttgaattgggagaaatgccatttcatggtccaaaaggggcttgtcttaggccacaagatctcgtcccaagagattgaagtggataagacaaaaattgatgttattgagaagttacctcctccatcggttcctaacacatgtcctcacggtttgatcgttgggattatagaatag

SEQ ID NO: 29657 - DNA, 483 bp, Glycine max
  Peptide Sequence Number=SeqID_146435
atggccaagcacaattttaaagaagaaaaaacagaagagcaagcttccatagaggctaattggatgaacttctgtctggcactattgtcttccgcatgccgctttggcacttggcctgttgccatgcttgcgccaagcaaaaacaaggccattttggagggtcctgtatgcaatgcaagccaagtgattggatggcatacaaatgagaaaagtaaaagacttcgtagattccatgttgatatgtctggatttgcattcaacagcacaatcttgtgggatccaaaacgatggcgacgcccttcttcaaatcccgagaccacctttatagaacaattggtggaagatgaaagtcaaatggaaggttcacctcctggttgttcaaaaatattgaattggcatctccatttggctgctaataatatagtttacccaaaaggttgggtgcttcagaaaaacctagatgctgtcatacctgtcaagtaa

SEQ ID NO: 29658 - DNA, 525 bp, Glycine max
  Peptide Sequence Number=SeqID_146436
atgcacaatgggaaaagatcaattgccaattacgcagtgttatcaggtccactctccacccctctcataccaatttttaggcctcgcaacacttgtgaattggtttggagtgaggcacgtgctctctacacgaatgatgctcaacgagtgcatacggctctccatgattttaatgaacttttacccccccccactgcctctatcgccaccgaggctaagacggaactcaagaactgtaccaaattatttatgactctggccctttatggtctgcctcaggaatattctgccacacgagaccaaatacttgggtcacctatggcaccaacgatgcaatcagcatctgctacattacttcggatttcgttagagcccacagttgacgttcctgaatctaccataggtgattcatctgctcttgtttcccagagcaataagtttggacgctctggcacaaggccatcgaaacccaaagatcgtttttggtgcacccattgtcaccaagataaccatagtactgattga

SEQ ID NO: 29659 - DNA, 495 bp, Glycine max
  Peptide Sequence Number=SeqID_146437
atgtggtatgatactgacaaagtggtagtaatttggaaaaccaaacagtttcaacaatatggtaaagttgagaggtggctagaagatatttggatgtggatgcttaggttcaaggatgctgtttttgggattgctgtggagtcatctgctgagattttaggttgcacattactgataatgcgtataactaatcaagttctaagttcctatcaatccatgcctgcttctgttggaataaagttgctggccctgaagttcttggaaacgtttgtattactcttttcatctgacatcggtgatactgagaaattagccacaaaaggaattaggcaagctgttaatgtcgaatggttggttggtggtcaccctcaccctgttcttgatccagtggtgctcatatcagatgcaaataggactattggcattctattaaatttattgctgtcggttggcagtcttcctggttgcttgactattactgttgtaaattggtga

SEQ ID NO: 29660 - DNA, 372 bp, Glycine max
  Peptide Sequence Number=SeqID_146438
atgtccagcagttccagcagggaagcttgtcaaagatgcgtgatctctagaaatccaccactatcgatgaccatctcccaccctggaaaattcaaagtacagtaccctatcaatgataatgggctgatcatttcatctggctcattacgaagccacccacaaggaatgttttcccttccattcttgtcaccactattggctgcccatcagcctcttcagttccctttgttccttcagatcatttcctaccatccttcaaaagtttgtttttgcttcggttccgtttcttggacccaaagagcagatcaaggtcaaactgaggctgggaatgctagagaaaagccctctacaaacttccacatgaggacttag

SEQ ID NO: 29661 - DNA, 3012 bp, Glycine max
  Peptide Sequence Number=SeqID_146439
atgtcggctagtttagcagccatcgcaaggaaaaggccacaacactatgatactattctttcagcattgcttgattttgatccagattttcaaagagtgaaaggatgtcatgttactagtattcagtactccttcagaacagcttttttaggatttcttaggtgcacttattcaccaatactagagtctagagaaagactaataaggagcctgcgagctatgaatgcgggggatgctgctgatcaggtcattcggcaagttgataaaatgattaaaaatggtgatcgttctacccgcgatgcacgggtgagcaaggatgatcaaccatcaactcagtcacctgtttcaggggaattatctagaaaaagacctgttcctctagataatgaacaattggccaatggtcatgataccatctctaagcgaattcgttctggttctgattctcactctactttaccagctcaaataaatgattctaggcaggatcttagctctgttaatggagtatcagctaatgttcctgtgctggatagcgaactaactgctgtggagcaaatgattgctgtaattggtgctttacttgctgaaggagagagaggtgctgaatctcttgaaattctcatttcaaagattcatcctgatctgttggctgatattgtcataactaatatgaagcacttaccaaagacccccccaccactagcaaggattgcaaatttaccagtaacacgtcaattaagctcccaagtcagtcaatctcaggttatagcagcttctgttccaataaattctgtccaatccttgtctggtactgcccaagcttcattcccttcacctacgcccactgtcactgttactgttaccacttcattgccatctgacacctctaacttcagtaaccagcctgctgattctaaacgtgatccacgacgggatccccgtcgcctggatccccggcgtgtagtggtaactcctggaggagcaactgtatcaattgcagatgatactggggccacaaaagagtttgatgaacctgtgtcttccattaagcctgtttcacttcctgtcatgactgctgatgacaatactctgtcagatctgacggtcaaaataaaaaatgatgatattatctctgaaggttccccagtttcgggacccgatcaagtaactccgaaaacagaggttctggaaatgcctggagatattcatcagattacagaagcagatacttccttggatccctcactctcttctactgatttaagagatgaggatctgagtaaagcgaagctgtcagaagatactgaaacaattgggacagattcatcaattttcgagattgatcagtcttctattgatgttcaagttgaatctacattggaagacacctgtctggagttaccacagcttccgccttatattgaactatccgaagaacagggaagtaaggtgaaaaacatggctgttaggcgtataattgattcatacaaacatttgcatgggacagattgtcagcagttttgcatgccactacttgctcgactagttgcacagccaatactaaccttcaccattagaaatttagaggtacaactaagaaaatttagattatatatcatagattataaaaaagggtggcacagtgcacaagggtcccccatagtggggtttggggagagggtagatttgtgcattacccctgggcatgaacttgtactgcatgttttgtatcatctgcactccctcatgatattggattcagttggaaatgcttcatcttctgctgttttatatgaaaaatttctcctgggtctggccaagacgttgttggattcttttccagcttcagacaagtcttttagtagacttcttggtgaagttccacttttgcctgagtcatccttgaagattttaaacgacctctgctattctgatgttattggtcatgatggaaaaatcattcgtgacattgaacgtgtgactcaaggccttggtgctatctggagtttaattttggggcgtccacaaaatcgtcaagcctgcttaggaatagcattgaagtgtgctgttcacccacaggatgagattcgagcaaaagctattcggctggtgacaaacaagctctttcagcttagttacatatcaggagatgttgaaaagtttgcaacaaaaatgctgctttctgctgtagaccatgaagtttcagatacaggtcttttgcaatctggacatactgaacaaatagctgaggcagagcttccccagttaacgggatgtggcttagtcattgtcgtgcctgataaactgattattgatagtgcatacttaattttacaggttgaaagtcatgaaataagttgtacttcacaggtttcagagtccacaatttctgaaaatgacactgctatatttgctaaaccatcgattcaaagtgttccatctatattgttttctgaagctcaacgcctcatttctttgttttttgctttatgcacaaagaaacccagtcttcttcagatagtatttaatgtgtatggacaagccccgaaaattgtaaaacaggcttttcatcgccacgttcctgttgttgtgagggcgttagggcaatcttattctgaattgctccatatcatatctgatccaccacaaggaagtgaaaatcttctgacactggtactgcaaatattgactcaagacacgacgccatcttctgatttgatatctaccgttaaacatttgtatgaaactaaatttagggatgttacgattcttgtcccgttactgtcttcgctttccaaacaagaggttttaccaatattccctcggcttgttgatcttccattggaaaagtttcaaagagcacttgctcacatactacagggttcagctcatacgggtccagctttaacacctgtagaagtgttggttgcaatccatggaattgttcctgagaaggatggccttgcacttaagaaggcatgtcttctatcatctacacttatgctttga

SEQ ID NO: 29662 - DNA, 423 bp, Glycine max
  Peptide Sequence Number=SeqID_146440
atggccgctcctaccagggaccaagtcctctctctcctcgccgccgccaacaaccacggcgacctcgccgttaaaacctcatcgttgaaacaggccaaggaccttcttctctccattgacccctctctcgccgccgacctcttcccttacttgattgagcttcagtcttctcccgagagcctcgttcgcaaattgctcattcagataattgaggagattggttttaaagcagttgagcactctcctacgatgatatctttactattaacatttttacgagatggcgatgcaattgttgtaaagcagtctattgttagtggcacaaatatcttctgtagtgtttttgaggagttgattgtgcagattaagttatctttaagaatgcatcgtgctgattatctcattgctctgtgtacacgatga

SEQ ID NO: 29663 - DNA, 947 bp, Glycine max
  Peptide Sequence Number=SeqID_146441
atctgccgcctctgcagatccgttgttgctgcaacgctacctccatcacggcttcatccttatcccggaatctttggtgcaagtcgcgtgcacaaacgctggcggacccgaacttgcagggtgacatgacattgtatttggcttgcttgtcaacgacaaggatgatcttcgcagatgctgcaatattctgggtggtggttgctatagaccccaatactttgttgatcctagagctttctcgaatgccattgttcctagatgatgaatttgttttggtggtggaactagtcattgaaggtgccaggctgccgtcaaaaggggtggaagcgttccccaaaggtgtcactggagttgttgtcaaaggtggtgaatgtgttgttgcaagcaacaagggaggaggagagttatgtgagagagagatggaaggttgggacccgaatacgaagtcgacgctgacacagatccctctgctggggacgaaggctggtccacgagacggggcggcatggacgcagaggctgaaggaagagtacaaggctctgatagcgtacacgcaaatgaacaagtccaacgacaacgattggttccgcatctccgccgccaatccggaaggcactcgctggaccggtaaatgctggtacgtctacaacctcctcaagtacgaattcgacctccaattcgatgtccccgtcacttacccttccaccgcccccgaactcgaactccctcaattggatggcaaaacccaaaagatgtataggggtggaaagatctgcttgactgtgcacttcaagcctctctgggccaaaaattgccccagatttggaattgcacatgcactttgcctaggccttgcaccgtggcttgcagcagaggttcccatcctcgtggattctggtatgatcaagcacaaagatgataccgcaaccacatcaactgaatcttag

SEQ ID NO: 29664 - DNA, 1520 bp, Glycine max
  Peptide Sequence Number=SeqID_146442
atggagacaataacagagaacggatcagatggtgtgagtttggcaagaaatacatccaacaacgcccgtcgagggttgccaatgatccaaacaaacatgaagccaacggattcggaattccaagtgtgccacgacgacagcaccccgccggtcagagcccaaaccattcacgagctccattctctgcagaagaaaaagtcaaccccttccactcccctctcagcaacgcaaggccccttcgccactgtttccgatgaggaacgccagaaacagcaactccaatcaatcagtgcgtcgttggcgtcgttgacgagggagtcagggcctaaggtggtgaaaggagacccagccactaaggcagagaaggggacacatgttcatcaccatccgcaaccacattactttgcttcaacggcgtttgatgtcagtgacagtgcgctcaaattcacccacgtcctctacaatctctcccccgctgagctgtatgagcaagcgattaagcacgagaaaggatcattcataacggcaacgggagcgttagctacactttctggagcaaaaacgggacgctctccccgagacaaacgggttgtcagggacgacaccaccgagcatgacctctggtggggaaagtgcatccgacccactcctgaagagctagaggaatttggaactccagacttcactatatacaatgcaggacagttcccttgtaatcgttacacacactacatgacttcatcaactagtattgacatcaacattgcaaggaaagaaatggtcatccttggcacacaatatgctggggaaatgaagaaaggtctctttggtttaatgcactacctcatgcccaagcgcaatattctctccctacattctgggtgcaatatgggcaaagatggcgatgttgcactcttttttggattatcaggtactggaaagacaactctgtctaccgatcataaccggtacttaattggagatgatgagcattgctggagtgaaaatggagtggcaaatattgaaggaggttgctatgcaaagtgtgtcgatctttcaaaggataaagaaccagacatctggaatgccatcaaatttgggacagtactcgaaaatgttgtttttgatgagcatactcgagaggtagatttctctgacaaatctgtgaccgagaacactcgtgcagcatatcctattgagtacatacccaatgctaagataccgtgtgttgctccccatgcaaagaatgtcatccttctagcttgtgatgcatttggggtgctccccccagtaagcaagctgagcttggcccaaacaatgtaccatttcatcagtggctacacagccctggttgctgggacagaggatggtataaaagaaccacaggctacattctctgcttgtttcggggcagcgtttataatgatgcaccctaccaaatatgcagcaatgctagccgaaaagatgcagaagcatggggctactggatggcttgtcaatactggctggtcaggaggaag

SEQ ID NO: 29665 - DNA, 1014 bp, Glycine max
  Peptide Sequence Number=SeqID_146443
atgaaaacatactccgtagccttgttagctcacagccattcccctatgggaaaaggaaaaacatacttagttgttccaaaggatgacacttcaaatctccgtagccttacaaagcacggtgtagaagggaaaagctcccttgtagagctctgcatttcccttaaaactatgtttgatgaatctcctagcagttcaaagaaggtcacctctcactcggatgatccttctcttaacccgtcaagtccgttttttattcatcctagcgaaggaccaacctctgtctcagtcactcctgctctagatggaaccaattatcactcctggtgtaacactcttattatgtcatggctattgaattccatctctccatctatagctcaaagtgtcatcttccttgaatctgctgttgacatctggaccgatcttcatgaacgtttctcccaaggtgaccttcttcgcattgcagagctccaggaagagatctacggactctctcaggccaatcgctccgtctctgagttctacactgctttaaaagccctctgggaagagctagacaactatcgtcctcctgctgcatgctcttgcgatgcaaaaatttatcatcaacaagacttcattattcacttcttgaaaaggcttgatgagcgtttctctgttgttcgttctcagatcctactcatggaccctcttccagcggtcaaccgtattttctccatggtgattcagcacgaacgacaacttcatattccccccaccaccgcagatgatcccaactcgtttgtcaacgcagctggtggtccttcttccgtgaaatctcgtggtggctctcgttcgcaacctaacaaaacttcttccaacaaaaggtgtgcctattgtcatcggtctggacataccatcaacgagtgttgggggaaacatggatatccaccgggtcaccctcgctaccctggacacccgcaattcaccaacattctcagcatgatacatctctcaaccctaatctatctctga

SEQ ID NO: 29666 - DNA, 261 bp, Glycine max
  Peptide Sequence Number=SeqID_146444
atgccaacatttcaagtgggtgaaacaccatacaacaaaatcaggctatgcccaatgaaccacgacgttcccaactcatcacctatattcataatcacagtcgtgcatagttggcatacggagaagaacaatgagagcttgagaagtaggctgaaagctgaacataaatggaaagaagcacagagcattagtcaggttctcataaagacatgtgttgaggcatatctcatcagcttgtgtaaagcagacataaatgcttaa

SEQ ID NO: 29667 - DNA, 360 bp, Glycine max
  Peptide Sequence Number=SeqID_146445
atgtgtgtcgtctctgaagtcggacatgttgagaatcctcgaggtgctgaggcgcgtggagtgcacgatctcatcttggaaggcggagtaggcgtcgagcaagagcctgtgaacgagcaagagggctttgatggcaacgatccaatcgcgagtcttgttgagcctcttggatatggtgatgagagaagcgttgagggaatcaagagtgaagaggaagacaaagcggagattgtgaaaccgcataatggacgacctaaacgattttcatgccctatatcacttgtttccgtaccaacctctacgaggctgacttctttgcctaggtttcctagctttaagaaatctactcctagtggttga

SEQ ID NO: 29668 - DNA, 2274 bp, Glycine max
  Peptide Sequence Number=SeqID_146446
atgggtactggttggagaagagccttctgcacccgcgaccctgcatctaccatatcggataaacatcccggaagcccaagcccgagcccaagaacctgcactcgattgggttttctctctggtggtagcaacccttccaccccacgcttgcgttgcacaacaaaagcggaaactgcttctcaaacagttacattaagtgatagtcccagagttcaaagcaagaacacccccagagcaacgaaatcaccatcagtctcaaatccaacttctccacgctcccctctcaagctctccctcttcaagaacagcttcaaattcaggagtagctgtggaatttgcttgaacagcgtgaagacaggacagggtacggcgatatacacagcggaatgcggtcacgcgtttcatttcccgtgcatcgcagcgcatgtacgcaagcatggaagcttggtgtgccctgtttgcaaggccacgtggaaagacgtgcctctactcgcggcgcacaagaacctcgcgccagaatccgccgcaaaagacgacgtcgtcgccgtccagagggtcacagaaagtccttaccccaatgccaacgacaaaaagccaacagagaataataatgcctcccccgttttcaaaacctacaacaaccacgtggagcaaccatcgaagcattccgattcaaccaggtcctacgacgatgacgagccactcctctctcccacctccggcggccggattattccaattcccgaagccgacgagaatgccgaagacgacgaggatgaagaccccggcgagttccagggcttcttcgtcaatcccaaaaactcatcctcgtccaaatcctactccgattcgttgcaaaccagtgacggtgattccagaaccgttcaggtgaaactgatgccggagtgcgctgtcatctcagcttcccgaacacacgagacctacgcgttggtcttaaaagtgaaggctccaccgccgccacctccttctcggagcagcggcgggccgtcacagcgagcgccaatagatctggtcaccgttctggacgttggcggaagcatgatcggcgcgaagcttcacatgctaaagcgcgcgatgcgtttggttatctcatcccttggccccgccgacaggctttccatcgtggctttctcagccacctccaaacggctcttacctttaagaagaatgacacgtcaaggtcagcgcgtggctcgtcgcatcgttgaccggctcatgatcggtcaaggctccagcatgggcgatgcattgaggaaagccaccagagtgttggaagatcgcagagaaagaaacccggtggccagcgtcatgctcttatcagacggtcaagaagagagggttcaaaatcaaaggggtaataataataataatcagaggaaggcatcgagccacgtgtcatcgacgcggttcgcgcatatcgagattccggttcacgcgtttgggtttggggcgaagagtggttacagccaggaaccgggggaagacgcatttgccaagtgcgtggggggacttttgagcgtggtggttcaagacttgaggattcaagtagggtttgaatcagagtcttcagttgagatcagcgcgatttactcgtgcagtggaaggcccacgctcatgagctcaggggcggtgcggctcggcgatttgtacgcggaggaagagagggagctcttggtggagttgagaattccggcgtggtctggaactggggcccaccaccacgtgatgacggtacggtgcctgtataaagaccctgccacgcaggagatcgtatacggtagggagcaggggcttctggtgccgccgcctcagagcgtgcgttgctccggtacaaggattcagaggctcaggaatctcttcataaccaccagagccattgcagagtctaggaggctcgttgagcatagcgctgacttcaccagcgctcatcatttgcttgcctcggcgcgtgtgcttctcatgcagtctaattcggcttcggctgaggagtatgtgcgcggcttggaggctgagctggcagagcttcattggaggagacagcatgagcagatgcagattcagcagcagcaaatgatgcaacagcggagaagagggagcgagagagaggtgatggcgctggtggacgagaatggcgagccgcttacgcccacgtcggcttggagagccgctgagaagctggctaagatggcaatgatgaagaagtctttgaatagagtcagcgacttgcacggcttcgaaaacgctaggttttaa

SEQ ID NO: 29669 - DNA, 282 bp, Glycine max
  Peptide Sequence Number=SeqID_146447
atggaagattttcaacgagagagaggaggggcagtgcaaaagggaaggggaaattgtcaaattgagttgtgcaatgttgaccctcctctctctcagactcggtttggggcgtgtggcgttgtttcgaaaaagggtgcacccaacaacattgttggtgtatccaacaattatgtaaatggacaaaattattcttgtttaaaaaacatgaatatcttttcacggaagaggatcttcttccgtgtcttctttcgcatgcagccaaagaagaatattcttctgtga

SEQ ID NO: 29670 - DNA, 1164 bp, Glycine max
  Peptide Sequence Number=SeqID_146448
ggtgacctccgtcaccctgagaatcacaggagaaacgggatgaaactttacatctacgatcactgccctttctgcgtcaaagcacgcatgatttttggcctgaaaaacctgccggttgagctgattgtgatgctcaatgatgatgaagcaacgccgaaaaagctgattggccagaaaatggcgccgattctgcaaaaagccgatggcagtgcgatgccggagagcatggatattgtgcgctttgtcgataatcaggatcgccagccgctgctgaccggcaagcaaaatcccgccatcgccgactggctgcgacgggtcaatggctacatcaacaagctgctgctgccgcgcatcgccgaggccgcgtttgctgaattcgccacccccgaagcacgtgattacttccgcgaaaagaaacaggccagcctcggtgactttgccgaactgcgtaagcatgccccgggtttcatcaaaaatatcagtgatgatctgcgccagctggataaattgatcgtcaaacccaacgcggtgaacggcgagttgtctgaggatgacattcatctgtttccgctgctgcgctcgctgacgctggtttccggtatcgaatggccgagccgcgtcgccgactaccgcgataatatggcgaaacagacgcaggcaggcttaaggctgtttggccgtatcaaccaggaagaagaaatgatgaagaaggcgtttcccgggctgtttgccctgttttttgccgtgctgctcagcggctgtaaccaattgacgcaatacaccatcagcgagcaggaagtgaatcaggcgctgcaaaagcgcaactactacgagaaagacatcggcgtgtccgggctggtgaatgcccatattgtactgaccgacctgagcagccagattggtcgtgaagaacccggcaaagtgacgctgtctggtaaagccaacatcaacgtcagctcgctgtttggtccgcagcaggccgaaatgcagctgaagatgaaagcgcaaccggtgtataacgcgcagcagggcgccatttatctgcaggacctcgaaatcgtcgacgcacaggtgcaacctgagaagatggcgtcgatcatgaaaacccttacgccgtatctgaacgaatccctcaagcgctatttcaatgaaaaacccgcctac

SEQ ID NO: 29671 - DNA, 384 bp, Glycine max
  Peptide Sequence Number=SeqID_146449
atgccggtggtaaccagctcagcgtgtttggcggctgtaaagaatcacgcgaccgcatcagcgatattttgcaggaaacctgggaaagcgctgacgactggaggtgtgttgcacatgactactgaaaaaccagaagaggcgatgacgtttggagaattactggccttcattgctgaacagcaacgccgtttgaccgtgctggaaaatgcctttgctacgctgaccttctgtctggacgatcgcgccagccagctgctggctcacaatctgacgctcgaagcgcaaaaccagaatcatgacgctcagttacagcagcattttgcccggctggcggacgagatccatcgacgcaaagggcagttgcctgccgagtcgcagggataa

SEQ ID NO: 29672 - DNA, 294 bp, Glycine max
  Peptide Sequence Number=SeqID_146450
atgaattcattgcctagcgttgttcatgcatcatccacccaagagtccggagccccgcgaatttattgcctagcgctgttcgccaattctccattctccacttttatccggagccccgtgaattcattgccttgcgctgttcatgtgtcctccaccgacgagtctggagccccgcgaatttattgcgtagcgctgttcgccaattctccattctccacttttatccggagccccatgaatttattgcctagcgctgttcatgcatcctccaccaacgagtctggagccccgtga

SEQ ID NO: 29673 - DNA, 537 bp, Glycine max
  Peptide Sequence Number=SeqID_146451
atggctccgaaacacatggagcagttgacgcaaaaaatcagggaccagctggaggagtcgatcacagaaaaagtgactcgacaagtactcacactacctcctgagcctgtagatggtcgttcagctactcatgtcagcacaaaggaaaatgttgttatctggttttgttcgttgcataataggctagacttcctgaaaggaattattatcaggtcagatatatttttcaatacatttacattagcattatttgggaacatcaatattttaattgtgcaattcacatccatgtttgtattgaacaatgctttgaaaggatttgacgatactccacaaagtaaatccaaggctactgctaggtggattgttgttaaatgtaatagacaaaaaggaagtactgcgtgcgagtattacgtcatgcaccggatgtcaactataatcttaggaagtttcaagaataattggaaaatgaccattgaaaccaaagagattggaagcgcttcgcatccaacagacaagctactatttgaaagttaa

SEQ ID NO: 29674 - DNA, 656 bp, Glycine max
  Peptide Sequence Number=SeqID_146452
atggcagagaacacgcgcaatcaagcttcccttcgtgaaatggaagaacgtctcagcagcaaaatggaatcgagatttgtcgagctcgctgcttccatgcaacaaacaatacatggaatgtttcaacagagacaacaagattctccaacaacaagcaatccacctagaggtgagagatctagcccttattcttgtagcactcgattggctaggttggactttccaagattcaatggtgaaggaataaaacagtggctgatccaatgtgaaacttttttttctgttgataatacacctgatgaattcaaagtacgtttaacagtttttcattttgaagggaaagcacttcagtggcatagtgcttacataaaatctgtaggattggagaatttaccctcttggaatgaatatcagatcttgttacttgatcgttttggagatgtttgtgaagatcctatggtggatttaatgaaacttaggcagacaggatccatcatagagtatcatgaggagtttgactcaattatatcaagagtagatctttctgatgagcatcaacttagctgctttttaggaggattaaaacaagaggttcagatgattgttcgaatgtttcatccaaattatgttcgaagggcttattcccttgcaaatat

SEQ ID NO: 29675 - DNA, 461 bp, Glycine max
  Peptide Sequence Number=SeqID_146453
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 29676 - DNA, 342 bp, Glycine max
  Peptide Sequence Number=SeqID_146454
atgcgaacatgctttagtaaagagacaaaacttccaactgatcagagcaacatatgctttttggatgaaaaacaatgtgtctatcggggaaggaaacattttgtttctaaacgaccatttagaggaaacactgggtccaacaaagataggagagaatcactcaaagtgtatcaatctcacacaggattgacattctcaccctgggtcaaggtttatgataagttggaattttggctcaaggcttgtagaacagttggtcatgatatatgtcagggtttgaccagcggttcggggataaaggggatgtcctacattatttccatgatacacatgcaacaatga

SEQ ID NO: 29677 - DNA, 342 bp, Glycine max
  Peptide Sequence Number=SeqID_146455
atgacttcaaaagaattgaacgaggagccatatgaagtgaaaatctcatgtacgtttcgtaagggaactggagcaggctaccatgagacaaaagattttctttctaaagaaattcgattcggaactacgatatgtccaaggatttccaatcctagcaggaaaagggggggaacggatactcaatttcaagtgagtaaacagaattccatactagatatcatagatacatatagaattctgtggaaagccgtattcgatgaaagtcgtatgtacggcttggagggagatctttcatatctttcgagatccaccctacaatatggggccaaaaagccaaaataa

SEQ ID NO: 29678 - DNA, 339 bp, Glycine max
  Peptide Sequence Number=SeqID_146456
ctttaccaactaacacaagttccccgagagtttgatactcggttcttaccattttatactacttgtgcgatccggtgcacttgccggaagcgaacagttacctgtatctgtgaattgctgccgatagtaaatttcatccaaatattgttcgtcgctccattggagcttgtaggcctaggatctacttcatcaatggattcctttgcttcttggaagatgaatggcagcggaatagagaaggaagggagagaggagacgccacttcaaggagaagatgagtctagaagaagctcaccaccatatgaggtcatggataagagttttggaggaagaagataa

SEQ ID NO: 29679 - DNA, 303 bp, Glycine max
  Peptide Sequence Number=SeqID_146457
atgaggcttgtgtggaatcgacaagcaaggactaaaaggaaacttcaagtgacgcgacgaggaatccgtggggatttgttcattgatgttggaaatgcattgtcatgtgcatgttatgtatgttcgtggggggcattgtgcattgacctttcagggtctttggcactagcttttggccacgttcatacgttggatgttgtgtatgatcgtgggggggcactatgcactgaccttccagggtctttggcactagcttttggccacgatcatacgtcgtatgaagtgtatgtcatgggggggtag

SEQ ID NO: 29680 - DNA, 933 bp, Glycine max
  Peptide Sequence Number=SeqID_146458
atgtcactcccaataattcacacaaatcgccactcgtcgaagcatgcgattattccagaggccgctgggtgtgggatgaaacctaccatcgtcaattgtatgatgaaaactgcccctttctggatcccggattccggtgtcgccaaaacggacggaaaaatgaaaggtttcgtaaatggagatggcaacctgatggctgtgacattccccgtactttttaaaagtcatgagtatctgatagcaacttatcttgattgcattgtgataaaccaatgggagtctttgctatgcatgctgacacaaggggtttctaacctctccaaaatatatgaagtgaatggaaatcccataagcaaacacaacggttttctggtaatgaggtttcaggaatacaacatgacagtagagtactacaggacacccttcttgtgtgttataggtcgcccaccacttaactcatctagtaatgtccgaagtactatcaggcttgacgagttgcactggtatttcaataaatgggtagcagcagatgttcttgttttcaattccgggcattggtggaacccagacaaaaccatcaagtcgaatggcacatggaatgatggaggagagtgtgacatgcaaacagagccagaaaatgaccctacaaaacttgaaattgaaccatattataacatatttgtatctggtgttgtcaaacagacgcaatacgagagacggaaggcccactttttgaacatcacatatctttcagaattgaggaaagacggtcacccttccaagtatcgggaaccgggtactccacctgatgccccacaggattgcagccactggtgcttaccaggggtgccagacacgtggaatgaacttctctatgctcaactcctatctgagaaatttggcatcaacaaaatttttccagaaagagggtaa

SEQ ID NO: 29681 - DNA, 309 bp, Glycine max
  Peptide Sequence Number=SeqID_146459
atgtcagctattgcgggaagaatggacatgttgttgaagattgttggaaaaagaatggctatccaagtaatttttcatcgcatagaggaagaggaggtcgaacttttcatggtaatggtagaggctggaatactgacagaagcggtaaagtgtgcaattactgtggtatcattggctacactgagacagagtgcttcaagaaacaaggatatccaccaggacattgtttgcacaaggcacccgatgctaatatcaatgacacagctacagaaccaacgaataatgagaattcagcagcagcaactataa

SEQ ID NO: 29682 - DNA, 285 bp, Glycine max
  Peptide Sequence Number=SeqID_146460
atggaacaccaattcaaatttaccagagaaaaaagtctcagaatcacccaacaggcaccaaacagcttgtctttcggaaaaagaaaaacaatgaaaacaagaatatccgaaagtgaaactggttccgtggcactaaccggtcaaagagctaagccgatttccgccgaagcacgagaagaagagaaaaaacggagtggcagggtttacacggagattgaagtggatttgactaaaatacccggcccggtccataatccaaaggcttgtggtcattttggagtttga

SEQ ID NO: 29683 - DNA, 411 bp, Glycine max
  Peptide Sequence Number=SeqID_146461
atgagttcagttgagtataatagagctaatcctcttccattcatatatcttattggaggcagtattttatactaccctcagctctcatccattagttcatatcaattgtacgtggaggtagtttgtgaagagttggattggcttccattttatccgggaatcaccagcgttacaaaacaatctcatatgcatagaagtaaacaagaaggccctcccaatgctgaagcagtgcgccaggcttttgatgtttgctctcattggatgcagagctttattaaatacagtacatggctggagagcccttcaaatgtgaaagcagctgagtttctgtcgacggggcacaagaagttgatggaatgcatggaagaacttgggatgattaggcatcaaaaccataaatttttggagtaa

SEQ ID NO: 29684 - DNA, 807 bp, Glycine max
  Peptide Sequence Number=SeqID_146462
atggcagactcaacccgttcgaaaaccaccttggatcggctggaggaagctcttgccaagcttacttcaagtcacctgcacatcaccggcaaactcgatgacctcctcaatcgcgtggcggttctggagaatacccctcaccacactccttcaccttcatcttcttcgacgaaccctgcaatacaaacccacccaattcagccccacagactcaagttggacgtacctcggtttgatggcacggacccatccggctgggtattcaagatttcccagttctttgaataccactccattcctgattccgaacgtctcacgatcgcgtctttttatatggacggacccgcgcttgcctggttccagtggatggcaagaaaccaccagctacccacatggaccggcttcctgcaagcaattgaagctaggtttgctcagtccccttacgaggatcccacaggccagttattcaaattaacacaaaaaggatcagtaagcgattaccttacgcagtttgaagccttggcgaatcgaatcacaggtctatccccttcctcgctcctcagctgtttcatttccaggcttgaccctgctattcgccgtgaagtccaagcattgcaacctctgacaatggtgcacgccgccggcttggcccgtctccaggaggaaaagtttcaggacttttcccatcccacttgcatccgcccctcctttccttcttccccacccactctgctttccctctcgaccccctcacctccctcacccttgccgttacttccttcccccgcaaagccacctcctctacct

SEQ ID NO: 29685 - DNA, 582 bp, Glycine max
  Peptide Sequence Number=SeqID_146463
atggaggtcattttagggaacgtgacaagctattttgattcagctaagcagcttgtgaatgggattcccctgccactagatcttggatccaacattgatgatgtaaaagtgaaagtcaccacagttgctgattctctctccaagaaggctaaagaaaattcaaggatgatacacaaagtcatagatggagtgagactggctcttgttactgttgctgctgttatgatctttgttgcatttctcggattgtcattttctttacttgctttgccgtgtcctgtatactccttggtggttattggatggattcttgttacaggcaccttgttactttgtgctgcatttctatttgtccctaagtttatcagcagagaacctttagtttccattgctgatcttacccttttcatatatgaagaattggctgtaaatgtccattacatggaatgctttggttcctttgctcccataagaggtttgactgaagatgggagccaagcccaatggtttgtagatggacaggcaacatttgaagcaattgctacttcaattcaagatgcaaagtcaattgttcaccaataa

SEQ ID NO: 29686 - DNA, 624 bp, Glycine max
  Peptide Sequence Number=SeqID_146464
atgtcaaccaccattgatgtccctgcagaatcaagcaagattaatagtattgcgaatggaattagaaaagttccaggtgcacccccaaggccagaaggagggtggaagaaaggggtagccatactagactttattctaaggttgggtgctattgcatctgctcttggtgctgctgccaccatggcaacaagtgatgagacgctccctttcttcactcagttcttccagtttgaggctagctatgatagtttttctactttccagttttttgtgattgctatggcatttgttggtggctacctagtcctatctctacctttctctatagtcactattatacgtccccatgccgctggaccaagacttttcctcattatcctagacacttatagctatgggatacaaaaggtgttcctgactctagcaacttctagtgctgccgctgctactgccatagtgtacttagcacacaatggcaatcaggattcgaattggcttgccatctgcaaccaatttggtgatttctgccaagagattagtggagcagtggtggcatcgttcgttgccgtggttctcttcgttttgctcattgttatgtgtgcagtggctctacgaaatcattag

SEQ ID NO: 29687 - DNA, 321 bp, Glycine max
  Peptide Sequence Number=SeqID_146465
atgattgtcaaggccgatcaaaagcaagcacgacagtgctgcgcagaaagcctgaaggtggcaccttatcctcccactagggagcctgtcaagcctcaccccacaacggatgatactactcaggtcatgagcgtggacaaggtctctaatctgcatgatgacacttatgacagaggcccaaagcctattgaagagcttgtcaagctacaacttagacccaaacccgagcagtgtacgcagctcaacaaggacctcaccaaccatgaacataggtgcatcgctgatgtcctacataggaatgtagacctgttcgcttggtag

SEQ ID NO: 29688 - DNA, 283 bp, Glycine max
  Peptide Sequence Number=SeqID_146466
atgactgttgggaggatgaaatgcggatgtggaagagctcactcgcactctgggtttgaagtaaacttcgtaattggggagggcttacagccaatgagtgtcaaccgtgaaggtacgatcctgagtaatgactgggacgaccatgcaaatctgagagcactccacttcacttccattgctgacgaggacccgcaatgtgggtcaatccggccagccaaacggagtgtctccggcacggtctggcccgctaacgcatggaggctaatatgggcttggggaggag

SEQ ID NO: 29689 - DNA, 1257 bp, Glycine max
  Peptide Sequence Number=SeqID_146467
atgaccaccatgctccgacaggggatcatacatccgagcaccagtcccttctcctcacctgtgctcttggtgaagaagagtgatgcagttcctggcgcttttgcgtggactaccttggacccccttcaaggctatcaccagatattaatggcaccagaggacattagcaagaccgcattccgaactcatcacggccactatgagttcgtggtggagtacttgggccatttggtttctgcgaagggagttgagccggtaccgaagaaggtcatagctgtgcaacaatggccgactcttaattccactcgtaccatgaggggattgttaggcttatcaggcttctaccggcgtttcatcaagggctacgccacccttgcagctcccctcacggctcttttggctaaagataaattcaattggaatcctgatgctgatcgtgcattccatctcctcaaagatgctctgtgtcaagctcctgttctgcgattacctgactttaattatgagtttgtaattgagactgatgcctcgggaattgaccataggagcttgaaggagctcatggcacaagcggtgcaaaccccagagcagcaagtttacctcgctcgcttaatggggtttgattacaccattcagtatcgagccggcaaggctaatggggcggctgatgccctctcgcgactaccggaaccaccatcgggtcagctttatgtgctaacgatacccaattgcttatttttgcaggaattaaatgctgagctcacatctaatcaggaattcattgatcgccggcaacaaatcctcgacgaacccaatcaattccaagaatgggttgttcgagacacatggctccttcaccggggacgcagttggctcccaccacgacttaaactaattcccaccatcattgccgagtttcattcaacccctaccggcggacatatgggagtaatgaagacgttagcccgtattcgagagaattttgtctggccctctatgaaacgaggcatccatcaattcgtcacgagctgtgccacttgtcttcatctgggatcacttccacagcaccacaccgccgccggtgtagctcagttattcatggaaatctctggcaagcttcatggcatgcccaagagcctggtttctgacagggacccgttatgtgtcagccatttctggcaagaatctttcaagcttagcggaactaagctccggatgagctctgcctatcacccagaatcggatggccaaactgag

SEQ ID NO: 29690 - DNA, 354 bp, Glycine max
  Peptide Sequence Number=SeqID_146468
atggcaaaaatacccttcaacctttttgcgaactttcttccgctgatactcgtagaagaaatgtttcgcgggcatctgcagaagaactttcttccacaattgacggaagatggttcttccgtggatgcccgcagaacatttcttccgcgagtttcagcggaagaagaactgcggaagaaccatcttccatggaacaacgcgaaagaacttcttccgccagagtcaacggaagaagaaatgacgaacaaggccaaaggaaaaggcaaggaggtcgctggaaaaggcgctatcgacaagcgcaaggtggccttcggcatcgacaagcccggtggcggccaaaagagaaacaagtga

SEQ ID NO: 29691 - DNA, 378 bp, Glycine max
  Peptide Sequence Number=SeqID_146469
atgggaactgtctttgttgttaagaagtattctaagaaaggaatctgcaagtgtacccactacaatggggataatcgtgtcatggagacatgttttaaactccatggctatccgaattggcatccaaaaggcaaaactacttcaaataccaaggtagacgctacttccaagagccatatttctactgctgctagatttgtgaccaagtcaagggtaaccatccattccaaggagaagattggtagtggtagagagagtgaaggactgtattatctggaaaatgtctcacaacaaacccataaaggagcattggcttgtcttgcaaatgaacacatacaagataaaaacaaaaagggaatatggctatggaatagatga

SEQ ID NO: 29692 - DNA, 600 bp, Glycine max
  Peptide Sequence Number=SeqID_146470
atgcactctgtggcttggagtaaattctgtaaacccaagcttagaggtggtatggggtttaggtaccttcgtttgttcaacaaatccctaataatgaaactaggttggggtctcatctccagccctaactcgcttggggttaaagttttccgggacaattatggtcgcaaccagggatttattcttgatgttaaaaagacctccaactgctatgatgtttggaaaggcattcaaggtgtttggaataatgttctaaagggtggctggtggattcttcgaaatggtagaactatcttgttttggaagcaccactggttgaaatctggtatggtcctcctattaacctgtccttctcccccacctttgagtatgttgaactttacagcgaatataatggttgataacagtggaaattggaagatgaaacatggttatggaaggttcttcgggaaggtttggttactaatctttatagatgggagagaaacatggtgtattgagaaacgggataggtggctgggtttcttgcttcatgcatgcgtaatattggatcaaccgatgtaccagctgttgaattatggggagttctatcgaccttag

SEQ ID NO: 29693 - DNA, 855 bp, Glycine max
  Peptide Sequence Number=SeqID_146471
atgaatcgaattgtagaacaatatcttcgcgcatttgtacaccaccaaccttccacttggggacgtttattaacttgggccgaatggtcatacaatacttcagttcattcggctaccggcatgtcaccttatgagattacatttgggaagaaaccaccctgttttccgcagtacatcgaaggcacatccaagattaaggcaattgatgagtggttcactcaacgtgacaggatgattggcagtttggtaaagaaattaactaaggctcaacagaggatgaaagaagttgcagaccgccggcgccgggaagtgcaatatgcagagggagatcaggtattggttcgcctacgtcctcacaggcaaacctcagcttcaggaactgctcactccaaacttgccaagaggttctatggtccttttcagatcatcaaaaggattggtagtgttgcctatcaattgcaacttcctccagattcccgcatccacccagtatttcattgttccctcttaaaaccatacattccttcgaatgactcagtgcctctctttctccctcctaagtttattgataatcaaccctgtgtttctccacttgctattctagacacaaaatgggaggagactgcctcaggaaaacaattgatggttcttgttcagtgggcaggactatttccaaaggatacatcgtgggagctgtggggtacacttaaacaagacaacaaccttgaggacaaggtttttttggaagcctgcaaggatgatatgaacaaagaaacagggcacaacgcagaaattacaaaaggaaagagaagaagcattaaaccaaaatacttggaggattatgtggcaaaataa

SEQ ID NO: 29694 - DNA, 516 bp, Glycine max
  Peptide Sequence Number=SeqID_146472
atgcagaaaagtgaaatgcttcatcactttgacaacctccaccgcccaatcatgtgtttttccagccgcgtttctcttgccgacgacatctccggccactgctccgtcgcttcaacaacctcctccgcctcggggctccgattcttaagatccaaatgctccagatctgagtttgaactcaatgaaacaaatccatgcgccggaagaaagtcgtcgtcgtgtgcagggacggtgacatctgggaatgggaggttaagtttgaacagttttgacaattctttgggttctaaatttggcatagtagtgggaggtagtagcattacaagtggttctagcttgcctgttacttcatgggcttctgttgtatccttcctcctatcatttcctgacccatcaaaaacactttatcctcaagagccatttgacaacgatgagaatggcgtagacagtgaggaggaagggttggtcgagctccatgttcctgaccttggcggcaaacacgacgaaaaaggataa

SEQ ID NO: 29695 - DNA, 549 bp, Glycine max
  Peptide Sequence Number=SeqID_146473
atggtgtgggaaggttccttttttgcaacgtgtgaactgggtctctggtgtagagcgtggcctctcaaggtagcagacgcgagtaaaggtgttttccggaaggaaggtgagagtgtggtgtatgtcaatggaatcaaacacactcacaaagttactgattttgacaagtggtgtttctttgaagctgttggagttgtgaaggggaacttacgtacctatggtgaagaaagtccgaactctattggtgaatacaaagccttaaaggtcaatgaagaccaggaaccaattagaaatggtgatgggagtgaggaggatcatgatagtgatgaagcaagtgatgtatactttggaggcagtgaggaggagagggctttgggtttggatgatgattttggtgatgtagttcatcctgtgtatattgttatggatgaagaacatgatcctactttcgctgtagagatggaacaagattacgaaagtgaagaattagacagttttgatggttcggacattgaagaggaaagaggcaatatgagttttcaagactga

SEQ ID NO: 29696 - DNA, 306 bp, Glycine max
  Peptide Sequence Number=SeqID_146474
atgacactagtgaaccggagtccatatccccaaatctattctcatgcaccaaataatacagaatactcttcggtatcaggtatagttagtgtgctactatggctaaaaggaagaggagatgagtatggaaacattctgggtttggtaacaagtattgatctgtcaagtaacaaattattaggagaaattcctagagaaatcacagatctaaatggattgtactttttgaacttgtcccacaaccaattgattggtcctattccagaagggaaaaattccaacaggaactcaattgcaaacctttga

SEQ ID NO: 29697 - DNA, 588 bp, Glycine max
  Peptide Sequence Number=SeqID_146475
atgatgataacaaaagatgatgacaaaggtgatgacaaaaagctcaaagatcaatcaaagaataactcaagtgactcaaaatcaatcaaagaacaactcaaagggtacatctacttgggtttgactgagaacaagagagggtacatctcttgtggattagttctagcggagggtacatccactaggttcaaagagaacaagggagggtacatcccttgtggatctttgcttacttatcaaggtaatccttgtggcgtctaccctgacttatcttccttcactggaagtggcgtcattcaaaactccgtagactgtatcaaacgattcgctcctagtcaggggcttgtggggatagttggaagtgtatcagagaagtattgggatcatcatttgggggatatcagcctggcaacaatggccggtgtgaaaattttcatcacaataataatagaatcccttagcatgtctctcattgtattgacaagatgtcaagtgtttaaaaggaagattaggggatcaaggagtggggttagggtttggagtgggtgtgggaggtgtgaaagaatgggtaaaaaggcttgggtttga

SEQ ID NO: 29698 - DNA, 360 bp, Glycine max
  Peptide Sequence Number=SeqID_146476
atgtctcctcttctcctcattttcgttttttccccttctcttcccaaaaccctctttttttcccgcagacaatcaaatatgtctaagaaaaatgatcatctcggactcattcaccgttggattgtcgcgaaattgaagaactgggttaaaagctcaattctgaggcatttcaccgttgggaattacgagaaaatatcgggaatgagagaatacacttcgtattgtagccttttttttctcgtagaaactcaaaactgtatcgagaaatcagaggaaaaaattaaggaatatcaggaaattgctagagatgccgctatcgctgtcggaagacacgtaagcccgcttagaggtaagggataa

SEQ ID NO: 29699 - DNA, 228 bp, Glycine max
  Peptide Sequence Number=SeqID_146477
atgacattgcaggtgtttctgactttggccactgctagtggtgcttcagctgctgccatagtttacttggcacacaatgggaaccaagactcgaactggcttgccatatgcaaccaatttggagacttctgtgcacagaccagttcagcagtggtgtcatccttcgttgctgtggttgtcttggtgttgttggttgttatgtctgctttgtctcttgggaagcgttga

SEQ ID NO: 29700 - DNA, 468 bp, Glycine max
  Peptide Sequence Number=SeqID_146478
atgtcaaccaccattgaaatcccagagtcaagcaaagttgctaagggaaaagctgttgcagtagttgcaccagcaaggccaggagggtggaagaaaggggtggcaataatggactttattctaaggttaggtgctattgctgcggctcttggtgctgctgccactatgggaacaagtgatcaaacacttcctttcttcactcagttctttcagtttgaggctagttatgatagcttcactacttttcagtatgcgtttcttactctagccactgctggtggtgcttcagctgcagccatagtttacttggcacacaacggggatcaggacacgaactggttagccatatgcaaccaatttggagacttctgtgcgcagaccagtgcggcagtcgtctcatccttcgttgctgtggttgtcttagtcttgttgattatcatgtctgctttggctattgggaagccttga

SEQ ID NO: 29701 - DNA, 249 bp, Glycine max
  Peptide Sequence Number=SeqID_146479
atgacagaagaatctgacagggcattaatatcaaggctgcgcgctaagtgcgagatcagtgcgctaaacacagtaggtgtcttcagccaagctcaacgcacgactggtgaatttgggtacacttttacacagctttacacacacttgagacaaggccagggcacagaattccacaatagccatagtgcccattttgggaaaagaggcctagaagcagcaaagaggagcaatttttgtagagatatatag

SEQ ID NO: 29702 - DNA, 393 bp, Glycine max
  Peptide Sequence Number=SeqID_146480
atgtcaaccaccattgatgttcctgaatcaagcaatgttgctaaaggcaaagcagttttagctgccccaccaaggccaggagggtggaagaaaggggtagcaataatggactttattctaaggttaggtgccatagcagctgctcttggtgctgcagccactatgggaaccagtgatcaaacactccctttcttcactcagttctttcagtttgaggctagttatgatagcttcacttctttccagtttttcgttattacaatggctttagtgggtggctacttggtgctatccctacctttctctttcgtagccatcattcgcccccatgcagctggaccaaggcttttcttgattatcttagacactgtaagctctttcacacttaattag

SEQ ID NO: 29703 - DNA, 1215 bp, Glycine max
  Peptide Sequence Number=SeqID_146481
atggtgacttggattggttatcccaatacaacaggattgcctacaattgattatagaataactgattctcaggcagaccctcccgaaacaaagcagaagcatgttgaagagttagttcgattaccggattgcttcctttgttacactccttcccctgaggctggtcctgtttgtccaactcctgctctttccaatggcttcgttacatttggtagttttaacaatcttgccaagattacacccaaggtactgcaggtctgggcaaagatactatgtgcaattccaaattctcgtcttgtggtgaaatgtaaaccgttttgctgtgatagtgtgagacagaggtttctttcaacactagagaagttaggtcttgaaccactacgagttgatcttctgccccttattcttcttaaccatgatcatatgcaagcttattctctaatggacatcagcttgtcttatgcccatgataatctttcttttctgtcttttgtattaagtttggacacatttccatatgctggaacaaccacgacttgtgaatctttatacatgggagttccatgtgttacaatggctggttcagtgcatgcacacaatgttggtgttagtctccttagcaaagttgaattcaatgatcctaaacacagaggtatgaaaacttgggtgcctaattggctaattctcaaacaattatacatgtttgagattaacatagctatatggatgagtataaaagaaagctatgttcagctaggtggatggttgcaacttgcaagtctgggcaatttgattgccaaaaatgaagatgaatatgtaaaattggctgtgaagttggcctctgatatttcggcactacaaaatttgagaatgagtcttcgagagctcatgtctaagtcccctctctgcaatggagcaaaatttacccttggtctagagtcaacatataggaaaatgtggcgcagatattgtaaaggagatgttccggctttgaaacgcatggagctgttgcaacaacctgtttcttcaaatgacccatccaataagaactctgagccaacaagggccacaaactcaagtgagggcagccccggatctgtcaaggccaatggattcagttcaacacaaccaccgaagcttaattttgtcaattgtgaagaaaatggtgggtcgctgaatcacagtagtaagcaaggtatggtgggttcaagttga

SEQ ID NO: 29704 - DNA, 444 bp, Glycine max
  Peptide Sequence Number=SeqID_146482
atgtataatcttggggttgcttatggtgagatgcttaagtttgatatggctattgtgttctatgaacttgccttccacttcaatccgcattgtgcggaagcttgtaacaatctaggtgttatatataaagatcgtgacaaccttgacaaagcagtggaatgttaccagcttgctttgggaatcaaacctaacttttcacagtcattaaacaaccttggcgttgtatacactgtccagggtaaaatggatgctgcggcgagtatgattgagaaagctataatcgcaaatccaacatatgcagaagcatacaataacctaggagttctttacagggatgctggtgatatcgctctagcaattaatgcttatgagcaatgtcttaagattgatcctgattctcgaaatgctggccagctgaaagttttcattgctggtgctatgtaa

SEQ ID NO: 29705 - DNA, 207 bp, Glycine max
  Peptide Sequence Number=SeqID_146483
atggggtggaatagtggcaatgacgaaggtggtgaaatcatggcgatggaatggtggtggcgacagcgatgctcgcaatgtgacggcggtgtggtgatggtggaggcggcaaaggcaacatgtgatagtgatggtgaaatgatggaggtgataatggtggaggtgacagtgacggtatggtgctggtggttggaatgtggtttttaa

SEQ ID NO: 29706 - DNA, 873 bp, Glycine max
  Peptide Sequence Number=SeqID_146484
atggcgtggacggaagatagtgatgggaataatgggagggaaaagttggttggggaaaatgggtttttgaaagtgtctgagccttcttctgatggttctgttggggatgggggttcggtgagtaagagatgtgaagggaaggacgatgtttcgtatgccaacatcctgcgttcaaggaacaagtttgtggatgctcttgcgctgtatgagcgcgtgctggagagtgatggcgggaatgttgaggctcttattgggaaagggatatgtttgcagatgcagaatatgggtaggcttgcttttgagagttttgccgaggctatcaggttggaccctcagaatgcttgtgctctcacacattgcggtattctgtacaaagacgaaggtcgcctcgtggaggcagccgagtcatatcaaaaggctttacaagtggatccttcttacaaagcagctgctgagtgcctagccattgttttaacggatattggtaccaacataaagcttgcaggaaacactcaggaaggaattcaaaaatattttgaagctctcaaaatagatccacactatgctccagcatattataaccttggtgtggtctattctgaaatgatgcaatatgacatggccctcactttctatgaaaaggctgcatctgagaggcctatgtatgctgaagcatactgtaatatgggtgtaatatataaaaatcgtggtgatttggaagcagctattacttgttatgagaggtgtttagctgtttcacctaactttgagattgcaaagaataatatggctatagctttgacagatttgggaacaaaggtgatgcatatgccttcctacatatttccaattgtttttgagcaactctattga

SEQ ID NO: 29707 - DNA, 1291 bp, Glycine max
  Peptide Sequence Number=SeqID_146485
atggagatgggcctgagccacgaagaaggtctttcgaataaagatgaaaaggctggagctttaatgggagccaattatgaggggaaaatagggagatgggatatacaatctttcaattcctttgccactaaaagctatgcagggatcaagcggggatcttttttctcaaatcagcgaatcggtcaccaattttccgcttctcaacgcgcttttatacaatatcagaattcgcaggtagaacctgagttcctaagtttccaaagtgagccaatccaaccggggaataccgctaatttgcgctattatttcaacagtacagaagctttggggttaggctatcagttttccttaaagaagtggaattttctactttctccaaaggttgaaaaccagaaaacagctaatttttatacatcacaggagcttttttcatacaagttggaagccaatataagcacgacattaggtgctcatggattcaacctaacggcggaatattcttattcaaaagagaacaataaacaggactggttcaatagtctgaaaacaactttatcttacagatataaatcattttcccttaacggaactgcccaatggaatgctaccagtgtctttgatttaacttcttattacaatgcagaccgtaattttgccaactacaatgtatacgcctcgtataatttccagatgctcaatcataatctgaccggatctttttctgccggagccttctattcggaactttataaaaatttaaacagcaatattaccggtaatctggaatataagatttcgccttcctggtccaccacaggttattttaatctttccggttataaatctacggctgaatatgcaagcagcggcagttattaccagttcagggtgggaattaaaaaatattttaccaccgctacggctctaggaaatcataaagtggcattccagttctttgaagataaaaactataatggacttctggagtccggtgaatcggtacttgctaatgaaattgtaaaactggacaattatgtagcgatgacggataagaatggaaaagtagtttttcagaatgttcctgaaggtacttatacactgaaggtgaacgaaagtgcgggctcccggttgatgacggatcctgtcattatggtgcacaataatatcaaccgcaaagtgggcttggtaaaaaacatcagagtaactgggaaattaacggagattaaacaagcttacgatactgtagaaacagatgtaacagggattgtagtatatgcaaaaggggaagatg

SEQ ID NO: 29708 - DNA, 1293 bp, Glycine max
  Peptide Sequence Number=SeqID_146486
atggaagataaaaaacttaaactatttgattcaggtggtaaaaacggtttgatatttgatgtttctatgtctagaaacaggacatttagagccaatctggaagcactttgccataaatgcctagctgcagtagtgagtgaagatgattgggtgtggcatcacagatatggtcacttgaattttagagacttgcatgacttgaatactcacaacatggttagagggctgccattgataaacgtaccaaaagaattatgtaaaaattgtgttgagtctaaacatcacaaagagtcttttaagaaatttgttgaaactaaggcaagagaaaagcttgaagtgatatactctgatgtgtgtggcccaatgcagtgtgaatctcttggtgagagtagatactttgtatcattcctagatgatttcactaggaagatgtgggtgtatatcttgaagagaaagagtgaagtgctaggagtattcaagaagttcaagagaatggttgagagacaaactggtttcttgataaaaactataatcactgatggaagaggagagtatactagcaatgaatttgatgaattctatgaactggaaggtattgtgcatgatgtggcacctccctacactccccaacataacggtgcagcagaaagaagaaatcgaacaatggtgaatatggtcagatgcatgcttaatggaaagaagctaccaaaatttctttgggcaaaggctatctccactgcagtgtatgtgctaaaccgaagcccaacaaaaagtctcaataaaaccacacctgaaaaagcatggtctggacgcaaaccagtgttgagaaagaagttagatagcaaaagtgagataatgatattgctgggttatcatgccactagtgattacaaattgtttaatccagtaaccaaagaagtgctcgtgagtagaggtgtgatagttgatgaatccaaggaatgtaattgggataaagagatggtagaggagcctacaaaagttatgattgaagcttctattgatgagccaagtgattcttctgttgtagtaattgatgacagtgaccaaggaggagtaaggaaatcacagagagctagacaagtctctagcaggttacaggattatgaattgatacatgattcagcaataggggaggaaggtgagctagtacacttagctttatttgctgaatctgaatcaatgagcttgaaggaagcaatgaatgacacaaagtggattgatgctatgaaagaagagctgaaagctattgaaaagaataatacatggcaactt

SEQ ID NO: 29709 - DNA, 330 bp, Glycine max
  Peptide Sequence Number=SeqID_146487
atgaccactttttctttcttctctcattttctttcctccactattcctccttctccctcaccctcctccaagaactctattttctatgccctcttcaaaggaaacaccaagcaattcactttttccaaagccacgaacctcttgcagttgcagccacgcataactgttttctcttctttaaaggatgcaggctccagtgacaacacaccaagcaacttttgcattattgaggggccagagacgattgaggattttgtgcagatgcagctgcaggaaattcaagacaacataaagagcaggcgcaataagatctttcttctcatggaagag

SEQ ID NO: 29710 - DNA, 795 bp, Glycine max
  Peptide Sequence Number=SeqID_146488
atggaacgattaaggtcacacgagactggcatattcaagaagaaaccagctgatctaatgcagatttttaaggatgtgcaatctaaagtcagtgatgttgtccttgggaaagagaagccagtagaagaatcaaatcctgagtatgaaaaaatgaaacattacatctttgagcttgaaaaccacttggctgaagctcaaaagcatgcataccgtcttgtgaagaggcacagagagttggggcaatcactgtctgattttggaaaagcagtaaaacttctaggtgcttctgaaggaaatgctcttggaaaagcattctctgaacttgggatgaagtcagagattttatcagccaagttgcaaaaggaggctcatcagctcttgatgaattttgaagaacctttgaaagattatgtccgtgcggtacaatctattaaggcaacaatagcagagagggccaatgccttcagaagacaatgtgaactggctgaaacaatgaagctaaaggagattaatctgtatactcctggttctctgtttttattatttgccaaatttaatttctctgtcagaataattccttttcatttgaaggcagagagtgaacaggcgacgaagacatttgagatgattgtgaaactaatgaatgaagagatgggtcgttttcaggaacagaaaacattagatatggggattgctttccatgaatttgccaaaggtcaggcacgtctagcaaatggtattgcagacgcatggcgaagtttgcttcctaaactggaagcatgttccacctcatag

SEQ ID NO: 29711 - DNA, 369 bp, Glycine max
  Peptide Sequence Number=SeqID_146489
atggtgatgatggcaagtagtagtagtacaatgcagagtgtgtacccgagggtgagtggagcgaatttccacgttccgctatctccccactctctcgttcctgtttacagcaacagccactccttttcaaaacttcgcaattcaattcatctggcggcggcgccgttacccaaagcttcggcggggaacggtggcctcaccgacgacggagtgtcattaggcacgatgaagctgcctttggacaccgaccttcagagattcgattccttgctctttcagtgggcaaacagcctttgccagggagccaatctgccccttcctgtgcctctcaaggtgtgtgtatgttctttatcacaaggagaggcctag

SEQ ID NO: 29712 - DNA, 2157 bp, Glycine max
  Peptide Sequence Number=SeqID_146490
atgtgtcctataaaggatttctttgagaccttagaactaaaagaaggaggagtagtactccttaggaacaacaaatcatacagagtacatgacatgggtactgtcagactgaagatgtttgatgaccaggagatgttgttgcaagatgtgaagtatgttcttgagcttaaaaggaatcttttgtcaataagcatgtttgataatttgggatactctaccaaaatagaacatggtctgattaagatttcgaatggagccttaattgttgctgagggtgttaaaaggaaagggcatattagtgaaagaggtttggttgaactggaaaaacagaatctgctaagcggtgataaattggataaactagaattttgtgagcattgtatattggaacagtttaatgagttttgcaggaaacaggaaattaagaggcataagactgtagcaggaactcctcaacaaaatggtctggctgagagaatgaacaagactattttgaaacgagtggggtgcatgcttttagaatcagacaaactggaggctcggcctgtgaagtgtatctttattggatacgcaaacggagtcaagggttataagttgtggaagctggatcctagagactcaagatgctttatcagcagggatgtcacatttgatgaaactggaatgagaatgagtgtggctgaagaaattcaagactcagaaccgaggaacttcaaggaggctatagaaggcaaagaaagtcagtactggttacaagtcatgaatgaagaaatgcagtcctttgtgaatctacctaaaaatcagagagtagttggatgcaagtgggtcttcaagatcttgatgacaattgtaaatcagtatgatctggagttgcaacaattggatgtcaagacaactttcttacatggagactcgaggagaccatctatatgctgtatgcaacaacctaaggggtttgcagaagatcagacgaaggtatgtctcttgaagaaatcattgtatggcttgaaacagagcctgtgtcagttgtataaaaagtttaatgactttcttctgaggataggttttctaaggagtagttatgatagttgtgtcgacatcttgagaagagaagaacaatgtatcattttcttgctcctgtatgtagattatattcttatagctagctcaaacaaggatgagattagtatgctcaaggagagattaagttcagaatttgagatgaaggaccttggtactacaaggaggattaaaaaaaacttcgtaccccattgcccggaggctcttcgctatgcgaaggctgtttccggattcgaacccatgaccaacaagtcaccaaggcacaactttaccgctgcaccagggctcgccctcactacaaggaggattcttgggatgaatattgttagagatcaaatgaagggagaattgttcttatctcagcaaggctatttgaagaagatagtgaaaaggtttaggatgcatcaatctaaacctgtaagcacacctttaggacatcacactaagctctcaattactcaagctcctaatactgaagaggaaaggaggaagatggatattattccaaatgctagtggagtaggaagcatcatgtattgcatggtctgtagtaggctagacttggcccatgttgttagcattgtatgtgaatggatctctggaatctctggtctgaagtacaagaaggcagctcaagatggagatgctattatggggtatgttgatgcagactatgtagggaatgtggatattgggaagcccttatctggatatgtatttacaatgtttgggactgctatttgctggaaagcaaacttacagcctgtggtagctctatctacaactaaatcaaagtatattgctcttgcaaaaggagtgaaggaagctctatggttaaaaggaatgattggtgaactgggaattgtacaaaactgtgtgacaattcactatgacagccaaagtgttatacaccttgcaaatcatcatatttaccatgagaggacgaagcatattgatgtaaggcttcacttcataagagatgtggttgaatctgaagacaatcccactgatgtgttcacaaagtctctaccaaggtcaaagttcaagcattgcttggacttgattaatttctcttga

SEQ ID NO: 29713 - DNA, 345 bp, Glycine max
  Peptide Sequence Number=SeqID_146491
atggcagatcttgagcaaagatcttgtgctcaagatctagtcttgcaaagatcttgcaataaagataatgttgagatctctggggtgggagaatggaaccaattaaccaacaaccaacccctgggaacaacaaaaaaacaatggaaaattaaaaagaaaaaacaagaacgaaggtcgcgggaggaggaggttgcgggaaggggaggaggagggaggtcgcgtctatggcagagggaaaggaagaagaagaaggccacaacgacgaggaaggaggccacggtggaggaagaagaaagaaagaaacagcatatgaggagagagggagagggaggtagcgtgaagtag

SEQ ID NO: 29714 - DNA, 610 bp, Glycine max
  Peptide Sequence Number=SeqID_146492
tctgatgctggaggttctttcactgtcaccagggataacactggtgaggttcttggaaggggtactaagatcactctctacctcaaggaagatcagcttgagtaccttgaggagcgtcgcttgaaggatttgatcaagaagcattctgagttcattagctacccaatttttctttggattgagaaaactaccgagaaggagatctctgatgatgaggagggtaaggtggaggatgttgacgaagagaaggagaaggaagaaaaaaagaaaaagaagattaaggaagtgtcacatgaatgctccttggtgaacaagcacaagcccatttggatgagaaagcatgaggagatcacaaaggaggagtattctgctttctacaagagtctcaccaatgactgggaagagcatttggctgtcaagcccttctcaggtgagggacagttggagtttaaggctatcgtctttgttcctaagagggcaccttttgacctctttgacacaaggaagaagcctaacaatattaagctttatgtccgccgtgtctttatgatggacaattgtgaggagttgattcctgagtatttgggctttgtcaagtgctttgtcaagg

SEQ ID NO: 29715 - DNA, 465 bp, Glycine max
  Peptide Sequence Number=SeqID_146493
atggacgacattctacgtcggttaatgaccgtcatcgtctctgacatcgtcaaaagtaatgacgatatcaacgacgtctacgacggtcatggggacaacaccgtcgtcaacttcgttggattctacgacgggcttgtccagatgcccgtcttagactttgctgcattctacggcggtcttgttcccatgatcgtcgtagacttctttgcattctacgagtatctcgtccccatgaccgtcgtagactatgttgcattctacgacggtctcgtccccatgaccgtcgtagactatgttgcgttctacgacggaatgctccttttcggcaaggaaccaagcacctggttggccgattcctccgaggttgaagtggttgagttgaagacatgtcctccgatgatatttgaagtaccaacatgtagaggatcatcagtgggcatcactgggaaattagacctgttgtaa

SEQ ID NO: 29716 - DNA, 252 bp, Glycine max
  Peptide Sequence Number=SeqID_146494
atggaagaagaatacattgaggagctctgcatgcagatattgaagtttaaaccagatttggtgattacagagaaaggacttagtgaattcgcatggcattttctcagcaaccatggacttactgcaatcagaaggctgagaaaaactgataataatagaattgccaaagcatgtggtgctgttattgtgaacaaagcggatgaattacaggagtctgatgttggtactggtgctgggttatttgaagtttag

SEQ ID NO: 29717 - DNA, 255 bp, Glycine max
  Peptide Sequence Number=SeqID_146495
atgccattttgtggttgctccataggagttgttgatggttgcatctatgcattagaaggattttcaagatcttcaacaattaaatatgtttggcagtatgatcccattaaaaactcttgggctgaggctagtccaatgtcagttggcagagcctattgcaagacaggggttactaggggtcgtggtggactaatccctctgcaatctgcagaagtatatgaccctccatacatgcatgtggtccctgttacctag

SEQ ID NO: 29718 - DNA, 162 bp, Glycine max
  Peptide Sequence Number=SeqID_146496
atggaggataggatcgcgaccgaccgattgttgccccttcccggcgattcaagtgggcaaacgctaactcataaggaaggaggagacatggttaatgttccccttaaaagaaaatggcaggttagctctcctgggcgagcaacccctgcacccaaattataa

SEQ ID NO: 29719 - DNA, 1048 bp, Glycine max
  Peptide Sequence Number=SeqID_146497
tttttccatttttatcggtcggcgggtgcgtaacggcggacaaaggccttcggctcctgcatcaggatgccgggccgtgcgtcagccagggcccgacaccgcgagtcgttcatcccataccgatgccgtcaagctcggccaccgcctgcggcgacaacaccaggttcgccgcggcggcgttctgccgcaggtgttcgaccgacgaggtgcccgggatcagcaggatgttgggcgagcgttgcagcagccaggccagcgcggtctgcatcggcgtggcctggcactcggcggccacgcgctccagcgtggccgattgcagcggcgagaagccacccagcgggaagaacggcacataggcgatgccgtcttgcgccagttgcccgatcagcgcatcgtcggcgcggtgcgcgatgttgtactggttctgcacgcagacgatgtcggcgatgccgcgcgcctgcgccacctggcgcgcggtggcgttgctcaggcccaggtggcgtatcaggcccttgcgctgcaattcggcgagggtggtgaaggacggttcgatgtcgccttcggcggggccggccacgtcgaacatgaggcgcaggttgaccacgtccagcacgtccaggcccaggttgcgcaggttgtcgtgcacggccgattcgagttcggcgggggaattggccagcagccacgaggcatcgtcgccccggcgcgcgccgaccttggtgacgatgaccagatcgtcgcggtaggggtgcagcgcttcgcggatcagctggttggtgatgtgcgggccgtagaagtcgctggtgtcgatgtggttgatgccgagttcgagcgcttcgcgcaggaccgccagggcttgcgccttgtccttgggcggtccgaacacgtgggggccggccagttgcatggcgccgtagcccaggcggttgacggtcaggtcgcccagcgcataggcgccggcttgttgaatcgaggtcatgacttgctccgaggcagggggaatgaagcgagtctagggcggcgcgctgcgtgcgacaatccctggtaa

SEQ ID NO: 29720 - DNA, 1839 bp, Glycine max
  Peptide Sequence Number=SeqID_146498
atggaccgtactactgacaagcagcagcagttatccttggccaagggtacaaggcagagatacaatgaatggatttttcgtgatgtaccaagtgatataactatagaagtaaatggaggaacattttcattgcacaagtttcctctcgtctccagaagtgggagaataaggaggttagttgcagaacacagggattctgatatctcaagagttgagcttctaaatctaccaggaggtgctgaatgctttgagttggcagccaaattttgttatggcattaactttgagatcacatccacaaatgttgctcagctatgttgtgtctctgattaccttgaaatgactgaagacttttcaaaagataatcttggatcacgtgccgaggaatatcttgatagtatagtttgcaagaatcttgaaatgtgtgttgaagtcttgcaacaatgtgagagcctgcttcctcttgctgatgcgctaaaagtagttagccgctgcattgatgcaatagcttcaaaagcatgtgcagagcaaatagcttctagtttttcaagattagagtatagcagctcaggaaggttacacatgagtaggcaagccaaatgtgatggtgactggtggatagaagatctttctgttctgagaattgatatgtatcaaagagtcataacagccatgaaatgtcgtggggttcggcctgagagcattggtgcatccctggtgaactatgcacaaaaagaattaacaaagaaatccagcttgtggaatccatctagccagactaatgttgattcaaattccacattgcatgaaaagcttgtggttgagaccattgttagccttttgcctgttgagaaattagctgttccaatcaatttcctttttggacttctgcgaagtgcaatgatgcttgattgtacaattgcttctaggcttgacatggaaagaaggattggatcacagctagatgttgccactcttgatgacattttgataccatctttcaggcatgcaggtgataccttatttgatgttgacacagttcatagaattttggtaaacttctgtcagcaggatgatagtgaagaagaaccagaagatgcttctgtttttgaatccgacagccctatttcaccctctcaaactgcactagttaaagtgtcaaaactaatggacaactaccttgctgaaattgcccctgatgcaaatctaaaactttccaagtttatggtcattgcagaaaccctacccgcacatgcacgcacgattcatgatgggttatatcgagcaattgatatttacttaaaggctcatcaaggattgacagatttggacaagaagaaactatgcaaattgattgattttcaaaagctttctcaagaagctggagcacatgctgcacaaaatgagcgccttcctgtccaatcaatagtgcaagttctatattttgaacaactaagacttagaaattctttgtcatgctcctacggggaagatgaccccaagccaatacaccagtcatggcgcataagtagcggtgcactaagtgcagcaatgtctccacgagacaactatgcatcattgagacgcgaaaaccgtgagcttaaacttgaattggctcgactaagaatgagactaaatgatctggagagggagcatgtttgcatgaagagggatatggccaagtctggatcacgtaaatttatgagttctttctccaaaaaaattggtaaacttagtctttttggacataattcttcaagaggatcaagttctccatccaggaactctcaaagaacagattcaaaggtgattgagagaacctgtgctagcacagagtag

SEQ ID NO: 29721 - DNA, 198 bp, Glycine max
  Peptide Sequence Number=SeqID_146499
atgcaatcaacattggaagaagaagaggaagccaaggctggtcttatgagtaggatccaaaggctaaccaaactcattatggtttcatcaaacaatgcaccccgtatgaaggcaacccctaaggaaatatctagctttacaagacctgggtacaacaggttacatattgtcgaacaatattcaaatatcatcaactaa

SEQ ID NO: 29722 - DNA, 561 bp, Glycine max
  Peptide Sequence Number=SeqID_146500
atgcagtatcaaaggacctcatcaattgaaaagaacttgaacctgctctatacccatcaaaaccctttgacaaatgcgggtgttggtctgggtgagccactgtactcccaggtccaattgtatgccatacctgaaaacaaatccgtagttaggagtagtattaagcatgttctcaagaatagccttgactttactaggtatgagtactatacggttggaacatacttcaaaaataagggtaagtatatcccagataacaacacttcagaggatggttggggtggacttagatatgattatgtcaattccgagaacagtagcttgattctggtgggagacagttgcactactacaaaacgtgctttctacatcgctgattcaatgacggctgtagacaaccttcttagaagaggaactccgtgccctagagcatcgtctctgacaaagagctccgcgttgcttcttcttccgtttgcagtcgccaccgacaaagttcaggccgcatttaggttgttagttcttgttggtggtctactacgtctcggccacacattgttgtga

SEQ ID NO: 29723 - DNA, 952 bp, Glycine max
  Peptide Sequence Number=SeqID_146501
ggtagcattcggtggcatatacaaggagcaagatgagtttgttgtgtctttgatccgaaaaatcgtagaatccgggggaggattcgaccttgctgatgtctttccttcaattccattcttatatttcctaactggaaagatgaccagattgaagaagttgcacaagcaggttgacaaggtcctggaaaacatcatcagagagcatcaagaaaagaacaaaattgcaaaagaagatggagctgaattagaggaccaagattttattgatcttcttctcagaatccaacaagatgacactctcgacatccaaatgacgactaacaacatcaaagctttgatattggacatatttgctgctggaactgatacttcagcatcaacactagagtgggctatggcagaaatgatgagaaatccaagagtgagggagaaagcacaagctgaattgagacaagcttttcgagaaaaggaaataattcatgaaagtgatctagagcaacttacttatttgaagttggtgatcaaagagacattcagggtacacccacctactcctttattgctccctagagaatgctctcaaccaaccatcattgatggctatgaaatacctgccaaaactaaagtcatggtaaatgcatacgcaatttgtaaggattcccaatattggattgatgctgataggtttgtccctgaaaggttcgagggtagttctatcgatttcaaagggaataactttaactatctcccttttgggggaggacgaagaatatgcccaggcatgacattgggtttagctagcattatgcttccactagctctactactgtatcacttcaactgggaactcccaaacaagatgaaacctgaggaaatgaatatggatgaacacttcggattggctattgggaggaaaaatgaattgcatttgattcccaatgttaatttatga

SEQ ID NO: 29724 - DNA, 231 bp, Glycine max
  Peptide Sequence Number=SeqID_146502
atggttaggcacaacaggtctggaattcaacgacggtcaacaaaagacccgtcgttatctactgagttgaccaatacaacgacgatcacaagtacagccgtcgtgaacgcattacaacgacggtctaggcaacccgacgttgacaccaacaaactcaacgacggtgggacgtacacaacgtcgttgaaaatgatgaaaacaacgacagcctatgttaatggccgacgttga

SEQ ID NO: 29725 - DNA, 246 bp, Glycine max
  Peptide Sequence Number=SeqID_146503
atggcttctatggacacctctgctatggtcaactctaagatctttccatgcaatctaggaatgcgggggtccggggaatttgtccccttcttagatacgacgtctaggggtagcaaaatgccccaacacacgtttttaagaaggcgacacggaccctccgtttggttcgtttacagtagggatcaagacagaacccatatgcaatgcctatgcaaaagacacaatgcgggaatgtacacagtatga

SEQ ID NO: 29726 - DNA, 186 bp, Glycine max
  Peptide Sequence Number=SeqID_146504
atgcaggaagcccaagtctgtgtgtcatctcaaaatatatctgagagtgggctacagcaagctagcctcccaccaagaggttggaattcctatgattccttttgctggacaatttctgaagaagaattcttagaaagtgctgaaatggtttctcaacgtctcaaggctcacggatatcaggaataa

SEQ ID NO: 29727 - DNA, 705 bp, Glycine max
  Peptide Sequence Number=SeqID_146505
atgaagggcttggactttctggatactttctcaccagtggcaaagctcaccattgttcgcttattgctagccctagcagctcttaatggttggcatttgaaacaactagacatcaacaatgcatttcttcatggtgagcttaaagaggagggaataacattgatgaaatccgtcatatcacgactcttcttgtcaaaccttcaaaataaaagatcttggcaatttgaagtttttcttggccatgaagttgctcgatcccacaaaggcattcatttgtgtcaatggaaatacacattagatatcctctctgactctggtatgcttggttgtcgccccacttccactcctatggattattctacccgtttgcatgccaccttgggtaccctgctatctgcttcatcttcatcttcttatcgtcgtttagttggacgactcatttatctaacaaacacgcgaccagacatcacacatgttgttcagcaactaagccagtacatggccaatcccaccattgctcattctcaagctacattccccgttctacattatcttaagggtaccccaggttcgggtatttttctttctgccactggtactcttcaacacaaagctttcagtgactctaactgggccggatgtcgtgattctagacactccatcacaggcttttccatttaccttggccattcgctcatttcttag

SEQ ID NO: 29728 - DNA, 1260 bp, Glycine max
  Peptide Sequence Number=SeqID_146506
atgaagcatgactatgagcatactccatctgaggcctttaaggctctaccaacaaatgcaatagttcatcttccaattccacaatggacttgtccagtgctacccaatgttatcaagatgcctcctcactggcttgtacctgacaaaagatctcccaaaacaacatctagggatctatttgaaaaacacaaaagggaccctttgctagaagtggaactcccaaaaagggagtttcaaaagatggaagacctttcatctcttagtaaactgcatgaacaaatctacttaagagatcaagccactgcctaccttcctggtttgcacatctcaagggccactgatataaagatggttgctgacaaagtgagttcatgcctactggtttggggttctgccaaaaagaaagggctcaagctatactacaacaaagagatgccctcaagaaagagaaaggtggaaaaggacaacttccctcgcagctggagctcattgtttagttggaagaagctggttcacattcctgatgcttatgatgctaggaccttctggaatcaaactgtgtggatggactctcaaaaagcctacacttttggatatgatggaagtgacaatgttgagcatcgggacgtcgttcaaggcacttataatctgaaaaggatgaccgaagaccagattctagttcatgtgactcaactccatgacactcggcaaaaaaggaaggctaaagaagaagaagttgttgttgctatgaaaaaagatgttggctcagtccaagctaaagcatttgctaaagttgtggacaacaccattataagtggggtcatcattgatcttaccaacactggcgtcacggacaaaactctcaaggcatctaatgtagccatagctgatgaacttgaacacaacaatatagaacctacgtccaagcaatcaacaacttcaaatgaggctacttctagaaacaagggccaaccagatattttcatcggattaagtgcaagatatgataggggaagtgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 29729 - DNA, 144 bp, Glycine max
  Peptide Sequence Number=SeqID_146507
atggagagagatgagaataagacaagactgaatggagaggatactgaatattcgtcgaggtggaatggaaaagatggtgatatacctgaggttggtgctggattagtggaacatgaagaaatagaagcaatttgtttgacatga

SEQ ID NO: 29730 - DNA, 1593 bp, Glycine max
  Peptide Sequence Number=SeqID_146508
atgggagcggagtcttgtattgatctgttgttgagatgcagaaacgttttccatattagacaagttcatgcccatgttgtagccaatggaactctccaagacttggttattgcaaacaagctcctttacacctatgcccaacacaaggccattgatgatgcatattccctgtttgatggattgacaatgagagactccaaaacttggagtgtcatggttggtgggtttgccaaggctggagaccatgcaggttgctatgccaccttcagggagcttctgaggtgtggtgtaacgcctgataactacactttgccttttgtaataagaacttgcagagacagaacggaccttcaaattggtcgcgtgatccacgacgtggttttgaaacatgggttgctttcggatcattttgtttgtgcctcccttgtggacatgtatgccaagtgcatagtggttgaggatgctcagcggttgtttgagagaatgctcagtaaggaccttgtgacttggacagtgatgattggtgcttatgcagattgcaatgcgtacgagtcattggtcttgtttgatcggatgagggaagaaggtgttgttccggacaaggttgctatggtgactgttgtcaatgcctgtgctaaactgggggctatgcacagagctaggtttgctaatgattacattgtgagaaatggtttctcgttggatgtgatattggggactgcaatgattgatatgtatgcaaagtgtgggagtgttgagtctgcaagagaggtttttgatagaatgaaggaaaaaaatgttatttcatggagtgccatgattgctgcatatgggtatcatgggagggggaaggatgccattgatttgtttcatatgatgttgagctgtgcaatattgccaaatagggtcacttttgtgtccctcttatatgcatgtagtcatgcaggacttattgaagaggggcttcggtttttcaattcgatgtgggaagaacatgccgttagacctgatgtcaaacattatacctgtatggttgatcttctgggccgtgctgggaggctagatgaggctttaagattgattgaggccatgactgttgaaaaagatgaaaggctgtggagtgctttgcttggggcatgtagaattcatagcaagatggagttggcagaaaaggctgctaattctctacttgaactacagccgcaaaatccgggacactatgtgctactatctaatatttatgcaaaagctggtaagtgggaaaaggttgcaaaatttagggatatgatgacccaaagaaagctgaaaaaaattcctggatggacatggattgaagtggataataaaacctatcagtttagtgttggagacagatcccatcctcaatccaaggagatctatgagatgttgatgagtttgattaagaagttggagatggctggatatgtacctgatacagattttgttttgcaagatgttgaggaggaagttaagcaagaaatgttgtacacacatagtgaaaagttagctattgcatttggcctaattgctatccctgagggtgaacccattaggatctccaaaaatttgagg

SEQ ID NO: 29731 - DNA, 369 bp, Glycine max
  Peptide Sequence Number=SeqID_146509
atgtactggagacagcgggctaaagcatattggttaaaggatggcaacatgaattctaagttcttccacacttttgcttcaacaaggaagaaaaggaatcaaattgatgcattgatgaatgttgaaggtcaatggattgatgatcaagaggggatttgtgagctggctcggtcttattttgaggatcttttccatcttgatgagggttcctatgacccggtggtggatttggttcatccctacttgagtgaggaggataatcatcccttgctagccctattcatgaaggaggaggtcaaagcagttctttttgacatgcacccagataaatctccgagctcagatggcctcaatccaacctttttttaa

SEQ ID NO: 29732 - DNA, 429 bp, Glycine max
  Peptide Sequence Number=SeqID_146510
atgacctggagattagagtgccatatggaagattcgaattccaccccgagtccgattgtttctatggcggtctttggaagaccagaaacaaacaaacagtggaatgatacaggtcctaacatatatttgactgtttcaagagccattcaggtgttgcatgagtggatcaatgctaggaatttgcaacaaccagaaagcactagtctaaacaatgaggactttgcttggtgggaacctcctccaagtggttttctaaagtgcaatgtagatgctagcttcaatacacaggaaaaaactacaagggaggctctcagcctgctccatgttatgaaatgggcaattaagttgggttatacacgagtgtattttgaagtggattgcaaaggagttcaagacatgattcatagcagcaaatgcaatacaacatag

SEQ ID NO: 29733 - DNA, 207 bp, Glycine max
  Peptide Sequence Number=SeqID_146511
atggatgaaggtggtgacgttcgcaacaacattcacagccacggcgtttgcagtagtgacatttgcgacggtggcaaggtagggtgtgaggaccggaggaagtggaagaaagtgacaaatgtgttaagagaactagaggacgggtgcaacattaggattgggaagttagggcaaatgatggatgtcatagatgtggggaacacactg

SEQ ID NO: 29734 - DNA, 207 bp, Glycine max
  Peptide Sequence Number=SeqID_146512
atgagccaagaggttccagacgaacttgctcaggcgagttggttacttaaggctgaagaaattccactagcccaagcgagctggttcatagccttggcgagtggtaatcctatcttactagatgagtgcttttttcatctatatggctttaatttagtcatgctagggaagttgggaactccttttctgaccaagatgctattgtaa

SEQ ID NO: 29735 - DNA, 261 bp, Glycine max
  Peptide Sequence Number=SeqID_146513
atgcaaaccatcaacaacaaagaatgcagtgcaaaacagaaggagaagactcacaaagtgccaaagcagaaaaattcagaagctctccctctctctcatgcagccttcttcttctcttcttcctccaccattgttgcccaacaaagctccaacctttggccatcatttctgctccaaatcgcgaaaggagggcattttcaggaggctaagatggtctctggtaatcgattacaacggggtgtaatcgattaccaggcttga

SEQ ID NO: 29736 - DNA, 900 bp, Glycine max
  Peptide Sequence Number=SeqID_146514
atgaagggagaattgttcttatctcaacaaggctatttgaagaatatagtgaaaaggtttaggatgcatcaatataaacctgtaagcacacatttaggacatcacactaagctctcaattactcaagctcctaatactgaagaggaaatgaggaagatggatattattccaaatgctagtggagtaggaagcatcatgtattgcatgctttatggaagattcaagtcaagctcattaggaggctttgaagtgggtattgagtacaagaaggcagctcaagatggagatgctattatggggtatgttgatgcagactatgcagggaatgtggatattgggaaacccttatttggatatgtatttacactatttgggactactatttgctggaaagaaaacttacagcctatggtagctctatctacaactaaatcaaagtatattgctcttgtaaaaggagtgaaggaagctctatggttaaaaggaatgattggtgaactgggaattgtgcaaaactgtgtgacaattcactatgacagccgaagttttatacaccttgcaaatcatcatatttaccatgagaggatgaagcatattactgtaaggcttcacttcataagagatgtggttgaatctaaagaagttaggattgtgaagattgcttctaaagacaatgtcactgatgtgttcacaaagtctctaccaaggtcaaagttcaagcattgcttggacttgattaatttctctagaagcatagtttcagaagcaagagagcaacactatggtggaaggaatcgtttgtctaacatttggagtcagggtggagaatttttgtatgtgactcaaactctattgtttagtcttatggacgtttggtttgatgaggattgtttgttgtga

SEQ ID NO: 29737 - DNA, 222 bp, Glycine max
  Peptide Sequence Number=SeqID_146515
atgagaaaccaaccttgcatgaagagagtgtgcaatctgaatcaagagagaacgaaggtcatagccaccatgagagtgtgcgatctgaataagagtgagaacgagggtctcgaagccgcaagggagagtgtatggatggagaggaataagtgcgagcaagtgaggtgtaggttgagagtgatgaacgagaccgatcgaagacaggagttgcaaagaaattga

SEQ ID NO: 29738 - DNA, 906 bp, Glycine max
  Peptide Sequence Number=SeqID_146516
aacttctttggtgtcgttttggttgagttgcaacctaaccacttgcgaaaacctggggttttttgcgtcgacgaacttcaagttggtgagcctgaaggagttgagcgagtacgcgagcatgtcaagcccgcgcgtccacatggacttcttgcccttgccacgtggcacgagatcttcgattgccaaactcatttctttttccttaggacattgcgcggtggtgcggtcacaggcggagacgtggagcctcagtgccaccacccaggtgttggtggtggggcccgcgtagatggtggtgaagaacacgttttcttcggtggtagaatcttgccacgagttacggttgagctcgagttcgaggatctgggtcagggggtcggtgaggtgaggaaggagaatgtggttgcgttggtttggagtcgggaactgaggattgggtgggagggcgaggacggcgatgccggtgccaccgcggacggcttggcaccagcttcgctcggtgttgcccacggttcgggactttggttcgaccatggcggtagtgtaatgataggaggaggttgtcccggaggcatggtgatgatggcaagtagtagtagtacaatacagagtgtgtacccgagggtgagtggagcgaatttccacgttccgctatctcctcattctctcgttcctatttacaacaacagccactccttttcaaaacttcgcaattcaattcatctggcggctgcgccgttacccaaagcttcggcggggaacggtggcctcaccgacgacggagtgtcattaggcacgatgaagctgcctttggacaacgaccttcagagattcgcttccttgctctttcaggagataatctatacggatgaaccatgtttgattcttctattgtgccaacagtaa

SEQ ID NO: 29739 - DNA, 378 bp, Glycine max
  Peptide Sequence Number=SeqID_146517
atggaattacctcctagctatgccaccagctcgcctgggcgagctcattacttcagggctaaggttcagctcgcctgggcgagcttaaaccaccccaaggagttgaatcagagggacttggttgagggtggaaagaagaaaggcgaggaagggaaaaaggcaacaatggaatgcattcttggctctatggaggaacttgggggagataagtggtgcctcctaggggacttcaactctataaggcagcctaaagagagaagttattgtatatcagggtatgtggaagtgaatgaatttgatgattttatgatcaatatggatcaagctgaaggacatccctctcattgggaagaaattcacttggttcaaggaaaatag

SEQ ID NO: 29740 - DNA, 342 bp, Glycine max
  Peptide Sequence Number=SeqID_146518
atggcccttggaacaatggcagctcgcccaagcgagctaatgcttcatcttgaagtaactggctcacccaggaggttatggtttggtacatcgagagttgatatgcgtggcccgattggtattggtgtcaaggtaccaagtgggtgtgctgattgcataggcacatcactggttacaattgggcttaccttttcaactagagtattcgacatacttgaggccaagcagtacatggaagctcctgtcatttctgagaagtatatgtacctaattggatcacctcttgttcccaagggtgacaagtgtcatcctattgagcttgattctgaggaaagggattag

SEQ ID NO: 29741 - DNA, 246 bp, Glycine max
  Peptide Sequence Number=SeqID_146519
atggctaagtatgatccagaaatagtcatggagttctatgccaatgcatggcccacagaggaaggggtcagggataagcactcctgggtacggggccaatggatcccctttgatgaagatgccaataatcaatcctaccccgcaagcgcattggatagaagactccaagtagattgggccagagatgcaagagaaggccctagggttctcatgagccttagggtagatttcgggcccataggctaa

SEQ ID NO: 29742 - DNA, 324 bp, Glycine max
  Peptide Sequence Number=SeqID_146520
atgcacgaacagtgcttggcaatcaattcgtggggcttcggactcgatggtggaggatgtatgaatggcaatcaattcatggggctccgaataagatttgatggtggaggatgcacgaacagtgcttggcaatcaattcgtggggcttcggactcgatgatggaggatgaaatcaattcgtggggcttcggactcgatggtggaggatggatgaacgacaatcaattcatggggctccgaataagatttgatggtggaggatacacaagcagcgttaggcaatcaattcgcggggctccgaactcgatggtggaggatggatga

SEQ ID NO: 29743 - DNA, 252 bp, Glycine max
  Peptide Sequence Number=SeqID_146521
atgaacacaagattagtttccaagttgaacctcactatcattccctacccaaaaccttataaacttcaatggctcaatgagcaaggggaaatgatagttaaccaacaagtgaaggtacctttctccattgggacatataaggatgaagttaattgtgatatagttcccatggaggtaggacatatttacattggcctaactaatgagattaccctcacccatcttagcactaaatttgtgttgcatccttaa

SEQ ID NO: 29744 - DNA, 210 bp, Glycine max
  Peptide Sequence Number=SeqID_146522
atgtatactggtagaagctatcgttcaactacacctagcccctatggttggctgcctgttggtcacccaaatgtttcatgtatgcgtgcatctggagctccatcccctgtatgctccattttttgcaatcctaccccgcaagggcattggatagaaggcaccaagaagattgggccagagatgcaagagaaggccctagggtactcatga

SEQ ID NO: 29745 - DNA, 189 bp, Glycine max
  Peptide Sequence Number=SeqID_146523
atggtgggttacacaccttcaagcttcgctgatttagttttcaccgacgaaaggatcaaagcagccataaccccagccaaggttcatcaacctcaatttctccgagaatacgactcgaacgcaacgtgtgcttgtcatggagaagccccggggcgttccattgagcattgtagggccctgaagcgtaag

SEQ ID NO: 29746 - DNA, 297 bp, Glycine max
  Peptide Sequence Number=SeqID_146524
atgagtatcaaaggtggtgccggtggagctggtggaggtggtagaatctcaacctccggggaagctggtggatctaatactgggggtcgcgactcaactggtgcaggctctatccttgttggccatttggttccatggttgctgttggaggagcgaaatgggtcactcagctcagtcactgccgtaaagaacttcgcttggcacgaggatactggctcagcgcgtggctatcatgacaagttacttgggcttggcgaatcagcctcgcttagcgacaagaacttatccagaggatga

SEQ ID NO: 29747 - DNA, 186 bp, Glycine max
  Peptide Sequence Number=SeqID_146525
atgaacattggcacgatcaccctggtgaagactgctttggtgtcaaatgctacctttgccaagccactcccgaacgtgtccaagaacaaggaacatgttgatacactacttgacttgcatggggtagctttcgcccttacctccaagaagccaaactctaaaacacctaccaaagagcttgaataa

SEQ ID NO: 29748 - DNA, 426 bp, Glycine max
  Peptide Sequence Number=SeqID_146526
atgaagggaggggaaaccctatggggcttggcaaagagagcatatgaagaatttgcaaactcaaagaaatgcaacaagcacttctcggacatggctgaccttaattttctgatgtgcaaggccatagagaatccaggcttgacaccatcgtcgtcgttgagaacgtcgatcatgtcggtgttcgaggacaccgtaatcgacaacggtggcaagaatcaaagggaggttggtgtggaggactacatgggatgcgcctccgtgcatggggtgggatcctctatcgccatttttgacaccataagggatggaagcttggattgtgtgtgcgtctatccaacacctttgcattcgcgggagcagatgttagaacttgttgggaagatgaaggtcatcctcatggaaggtgcaaagacatacaagaaatga

SEQ ID NO: 29749 - DNA, 945 bp, Glycine max
  Peptide Sequence Number=SeqID_146527
atgttttctaggtctcttaggattttattgccggtttattctcggcttgcatccattacagcttatttgaccaggttgctgacgaaggaccaatttgaatggtctcctgaagcccaacaggccttcattggtctgaaggatgcatttacgatagctccaattttgtttttgcctgattttacccttcctttcactttggaaacagacatgtctagcgtcgaaatgggtgcggtcctatcactaaaagagcaccctatcgccttcttcagcaaacctttagtcccaagctacttcgagcctccacttacatctgcaagttcttcgctatcaccgccgcggcacaccgccattctagtggttgtggactgtgttttgaaaggcatccatttgggaatgcttccaactcatcatactactcacactgtcgcgctcctctttatggaaattgtcgggaaacaccacgggatgcccagaagcttgcattcgggctcaaggacttccccaaacgagatcactttcggcaagaaaccttttaacattcctttgtacatcaccataacctctaatctggaggcagttgatgaactcctgattaacacggaggttgtgatcaccgaattaaggaaaaagcttctgaaggcccaagcaactatgaagcgaattgctgataccaaacacatagatgttaacttcaaggaaggagattgggtaatgggcttatcacgtgatgaaacatcatgggaagactgggaccaattaaaggccacttatgaccttgaggacaaggtgtttttggaaggcatgggggatgataggaagaaagagttacaattgcaaccaggcttgagggaaaggtccacgagaaaggtcaccacactaggtacctcagggaatatgtttaacttaatttgggttgcactggcactagctagagatattgcgtga

SEQ ID NO: 29750 - DNA, 279 bp, Glycine max
  Peptide Sequence Number=SeqID_146528
atggagagagagaagaagaagagaatatggtcgaaagtgattttgaattcagtgttgacaagtacagaaggaatacgatgccaaaatatatataaagggagaaaagcaatgcaagaggaggcaggtgagtgtcgcaggctatttggaggggttgtggctggtagtgttatacgtccagttcaaaatagagacatcggtgaggtcgccgttggtggagatgagcgacctaacgacgacattagcaaaatagggacaacaagctcaaggtggtcgttgtag

SEQ ID NO: 29751 - DNA, 177 bp, Glycine max
  Peptide Sequence Number=SeqID_146529
atgggggaaggttttgtcaggcttgcaagaatggaggacgtgagggtgttggggataaagcttgctaacatctacattaataatatgaagcttaatgtgaacctcccgaggttcaataggaagaacagacaagggccttcagatcaagaggaaggaaaatcccaagagagaggatga

SEQ ID NO: 29752 - DNA, 240 bp, Glycine max
  Peptide Sequence Number=SeqID_146530
atgataaatgatggaacatacgaatttggggatcccacggtcatgtggctccgcatgccaccggactcttgggacacggtaacaaaaggtggggtggtcgacaaaagcagggcttttgctcctacgtatctccgcgcgggtcagtgtggcagaaattgtggggcggccgacaaaagcgaggctcttgctcctacgtatcctcaatttgtgatgaggaactcatacctacgtagttcttga

SEQ ID NO: 29753 - DNA, 192 bp, Glycine max
  Peptide Sequence Number=SeqID_146531
atgggaggttggtgccatttgggacataaatctaggaaggatgtctttggaaggatacaaacaaggcttgctatggtgaagggatatagggagagttacagaaggtccatctccactccttgtgttgtggaggtctgcaacttatgtttatccatccctatatataatacatctcagttgcccttcaaataa

SEQ ID NO: 29754 - DNA, 246 bp, Glycine max
  Peptide Sequence Number=SeqID_146532
atgacacctactgccttgaaattagccatatcagcaaaccagggtctcactgcaatcaaaaacaaagattcatcagcacaaatgcacagctcatccttcttccagattcttcctcgcgctcagctgaggagtgttgcgcttagtggatggctcgctaagccagaaggttggcttagcgagaggatgaaaatcagcacttcacaaacttgcctaattaacctgaaattgagagaaaatgattattaa

SEQ ID NO: 29755 - DNA, 141 bp, Glycine max
  Peptide Sequence Number=SeqID_146533
atgtgggagaggagactttcgttgaaacttctgcttgctgccttgaatggaaaggattttgcagtagctatgtgcagattctgcaggctcatgggtactaccactactgagctgttgttgaatcggtttaaggatacttag

SEQ ID NO: 29756 - DNA, 225 bp, Glycine max
  Peptide Sequence Number=SeqID_146534
atgttggctagcggtaagatcgttcgggcgaatccccgtgctggaaagaaagcgagaatagaaatgactgtgccattctttcacatcactcttttcagtcttagatgcaccaaaaaggctctcgaaggccggcagcaaaagaagagttatagcgggcgaagtaggaacccaccccatatgggccatcttcaaaggggcgtagcgcttgcttactcgaaagagtaa

SEQ ID NO: 29757 - DNA, 265 bp, Glycine max
  Peptide Sequence Number=SeqID_146535
cgcacccgtgagcctcgccctcgctcgcccgcgaagggcatgttgcgacagcgtgacaagggaatctagaagaacacaaggatcaaggccgcgtgctaagcacgagatcatctcgctaagcgggacgtttgtctcttgccaggctcagtgcacgactggtgccaagcccaaatccacaaactcacgcaaagcgcgacgcaagcagtacaaaattccagagcaaggacaccagagtgctaatttcgagatagaagctctggaggca

SEQ ID NO: 29758 - DNA, 117 bp, Glycine max
  Peptide Sequence Number=SeqID_146536
gatgactttggctcaaggattattctattatggtctcaaagacacttctgctacttatgctgtcaactttctcaacttggttcctatatgtactttctttacctctatcatattcag

SEQ ID NO: 29759 - DNA, 468 bp, Glycine max
  Peptide Sequence Number=SeqID_146537
atgctagcatgcgttttggcagcaattcaaggaggaatcataggtgtttgcatagattccagtaaagctgcttggaaattagagtggaatctacaactggtcactatagtgtactcgggagcactggctacagctgctacattcactatattatcttgggcaattacaatcaaaggacctagttatcccccaatgttcaatcccctggctcttatttttgtggccttttcagaagctatcatacttggggaaccattaaccgttggaacgttgctaggcatggttttgatcatggtgggattatactcctttttgtggggcaaaaacaatgagacaatgcgtagggttcaacaactagcatctacaaaaatatcaaacattactaatttgtctattcggacagaatcaatgaccacaatagtgtcaagttcttcacctatgaattcagtaggtctagctagaacttga

SEQ ID NO: 29760 - DNA, 157 bp, Glycine max
  Peptide Sequence Number=SeqID_146538
atgaaacttacgctttacgctgctcagcgcgcgcgaccggtttttctgttttactggtttctgcaaggttgcccggcaggtgacggccaatcagcgcacggtaaccgaaggcaccgaggcaggcgccgaccagcgggccaaaaattggcaccaggaa

SEQ ID NO: 29761 - DNA, 103 bp, Glycine max
  Peptide Sequence Number=SeqID_146539
ccgaggcgcttccgtaacgcttccgagacgtttccgtgagcaaatccgtgaaggttttccgtcgttcttcaccgttcttcatctgttcttcattcttcaacag

SEQ ID NO: 29762 - DNA, 1488 bp, Glycine max
  Peptide Sequence Number=SeqID_146540
atggaatttgtggtaaacaatgatgcggaagatttgtcagtggtacggaacaaggatccagagtggttcttcttctgtccgcaggaccggaagtatccaaacgggcacaggttgaaccgagctacgaatcatggctattggaaggcgacggggaaggatcgaaagattaagtctggctccaccttgattggaatgaagaagactcttgttttctataccggtcgtgctcccaaggggaagaggaccaattgggttatgcatgagtacaggcctaccttgaaggagcttgaaggaaccaatcctggacagaatccatatgtcctttgtcgattatttaagaaacaagatgagagtcttgaagcttcaaacggtgatgatgtggagcggactgcttcaactcctacaactgccaattactgtcccgacgaaatacaatctgattcagctctggttccagcatcttcctcacaggttactgaagatgataagcctctaccagttatttccgagaactccgaggaagcaatatccaacattataacccctggtgatattcatagtgacgaatgtgatgctcctgatgcacaatatcaaattgttgaaccagttgcagaggaggatcagctgttgagcgtggacatattttatgacccaacaaatcagcaattagacgacaaattgttctcccctgtccatgcacatttcccagcagatttttattatcaagctaacaatcaatcagaacttcagtatggtacaagtgagaatatttcagaattttttgactctgttgttaattgggattcattctcttatgctaccagcagtctagatctgggctcatccttccttaatcctaaggacaatggatcaggcagtgactcagatgtggaaatggccaatatgctgcatctgcaagcattacatgattatcctaaggaggcagttgaggagaagttcaatgtaggattatttcagaacaatccccagatggctttctcaaatgatggtcctatgggccaagtgcacaatgtggccaactattgtgagcaaccaagaaactttgatgcatttgttaatggtgatactggaatcagaataaggactcgtcatggaagaaatgaacagccaaacatgaacatgatgatacaatcacaaggtattgcaccaaggagaatacgattgggagttgttaggcgtccgcttggttctcaggagacagcaaaagatgggagttgtgcttgtgccccagaagaccataactcaaaaaccatcattagtgcggagaagaaagcttcagaaaaccatgctgctgatgagagttccactgtttctgatgagagttccactgttactgatgattctgatgaaccagaggaggcatctcccaagtcaactgacccgagaaagataagtcagcaacatgttgcaactgcagaatccatctcggggtcgaaagaccttctagtgagcagaaggggctgctaa

SEQ ID NO: 29763 - DNA, 960 bp, Glycine max
  Peptide Sequence Number=SeqID_146541
atgggtgaggaagcaaaacaggaacaagtacaaccggtggctgaagccaagcctgaggagaagaaagaagagatggcagaggaaaagaaggaagaaaagccagaagaagagaagaagaaagagcctaaaccaccttccccatgtgtgctgtttgtggacttgcattgtgtgggatgtgccaagaaaattgagagatacattatgaaaatgagaggagttgaaggagtggtaattgacatggctaagaatgaagtgaccataaagggtatagtggagcctcaagcaatctgcaacgcaatcaccaagaaaactaagagaagagcaagtgttatatctccgttgcctgaagcagaaggagaacctatacctgaagttgtcaattctcaggttagtggaccagttactgtggaacttaatgtaaacatgcactgtgaggcctgtgctgagcaactcaagaggaagatactacaaatgagaggagttcaaacaacaatgacagagtttagcacagggaaggttcttgtgacaggaaccatggatgcaaacaagctagtggattatgtatatagacgcaccaaaaagcaagccaagatagttccccagccagaacctgaaccagaaaagaaagaagagagcaaagaagctgaaaaacctgcagaagaagagaataaaccagaagagaagaaagaagaggagaagccaccagaggaaccaaagaaagaagagggtggtgagggtggtgaaggtggtggtgagaacaaagaagaaaagggtggtgaagaaggcaaagaagaagccaaaaaagaagacaatgtggtggtggtggctaataacattgacgacgaaggcttgaagagaatgatgtactattaccagtaccctccactttatgtcattgaaagaataccacctccacaactcttcagtgatgaaaatcctaatgcatgctgcattacatga

SEQ ID NO: 29764 - DNA, 1488 bp, Glycine max
  Peptide Sequence Number=SeqID_146542
atgacttttcactttgttggcgtacggaatcaaactagaagacaagtggacggtgggctttgcattgatgagactaaggatggcgttgggcccaataaagacgggccgttgaatcaaccaaaactgaaaccgccatccaaattaggtcacaaaatattccaacggcagtccacagagacacgcacccaaaaccgaaccataacccaggtcgacgcttcgcgagtgcgcatcctaagacccacgtcttttttctctgttgtcgccgcctcaacgcaacatcattatcactatcactatatatatgtaaaccctactctactctcttttcacttgttcactttcttccaacctctcaagtccaacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgacaagggcacagttgagcttgctggcactaatggagaaaccaccactcagggtctagatggccttggtcagcgttgcgccaagtactatgaagccggtgcacgttttgccaagtggcgtgctgtgctgaagattggtcccaacgagccatctgagctggctatccatgagaatgcctatggcttggccagatacgctgtcatatgccaggagaatggcctggttcccattgttgagcctgagatccttgttgatggatctcatgacattcacaagtgtgctgccgtcaccgagcgtgtccttgcagcatgctacaaggctttgaatgatcaccacgtccttcttgagggtaccctattgaagccaaacatggtcacccccggatccaattctgctaaggtttcccctcaggtggttgcggagcacactgttagagcccttcagagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggctaactcagaggcaactctgggaacctacaagggtaactcaaagcttgctgatggtgcctcagagagcctccatgttgaggactacaagtactga

SEQ ID NO: 29765 - DNA, 336 bp, Glycine max
  Peptide Sequence Number=SeqID_146543
atggtagctgtcttggtaatcctcatgagggccaatggatcacatgtttttatggttacattggggataaaagatatcttgtatgctgaacttattgccatgttgcaaggcctatccactgcttggaacattaactcggccaaggttgtttgtttttcagattctaaacatgctgttgactttgtcaacgatgccaattcagtgtttcatcattatgcagctgttatcagtaacatcatggacctccttaatagattgtggcaggctataatccattctctgtgtgaaagaaatcaagttgcagatttcttggccaagacgagggctaaagggtga

SEQ ID NO: 29766 - DNA, 237 bp, Glycine max
  Peptide Sequence Number=SeqID_146544
atgaccacattggtctctgcttgtcaatcggactcggggtctccgaatgatgaggtgcggataaccgtaaggtgtctccacatgctaccggactcttgggtcatgataggaaaaggtggggtggtcgaaaaaagcggggtttttgctcctacgtatcctcaatttgtgatgaggaactcagacctacgtagttctttcttttgcgagactaaaatagtctcggtgttctttcactaa

SEQ ID NO: 29767 - DNA, 204 bp, Glycine max
  Peptide Sequence Number=SeqID_146545
atgaagttaggtggcaggcggagatacccaagtggttatccgtataaacactctttcactatccgtcagactcaaagtccgagacttacatcgtcttctacacctttgtcatccagagacggcgagtccgatgagatgcggagatacccaagtggttatccgtacaaacgagttttgttaatcctgacctgtgaagtccagtga

SEQ ID NO: 29768 - DNA, 1506 bp, Glycine max
  Peptide Sequence Number=SeqID_146546
atgattgccatgccgggtatggtggattcccatcgtcacgcatgggaggggcagctgcgccgcatcaaccccaacgctacctgtctggacgactatagcaacgccactcacttctcttttgccaaatattatcgaccttctgacatctatgtgggtaacctcctgacggcactgggcgctatcgacgctggcatcacgacaatcattgataattcccacaacagccgcagcgctgcgcattctgacgccgccgttgaggcactccttgattcgggcattcgcgccatccatgcttccggcgcaccggtagctggcgaatgggataaagcgcactggccgggtaactggcagcgcctgcaggaaaaatattttaaagataacccggaaagtctcgtttccctgggcgttatggctcagctggagccagagctgtgggctgaagcacgcaggctcggactgcctattgtcactgaatttttcggtgctgagatggcctctgaacttgagtcactgcaccagaaaggcctgcttggcccggacaatatttttaatcactgcacggcactgcctgacgagggatgggaaattctgcgggaagccggtgtacgggtgaacgtctgcccgcgctctgactcgcattatggcatcgaaaacggaatgtttgctattgaggccgcacagcgtcacggcatcaatcccgggctgagcgtggataatgaaacgtcctacagcaccgacatgtttatggaaatgcgcgtggcgttttatctgcagcgtgtgatgggtatgcacaggcagcactgctgtgattcagaccgtacgctgactacgcttccggcagcacagcttcttaaatcggcaaccgtggatggggctttctgtgcaggactgcaggataagttgggcagcctgacgcctggtaaacaggctgatctggtactgattagcgcgacagatctcaacctttacccgaatggcaatgcgtttggtacggtggtgcatgcaaccgagcgcagtaatatcgatacagtcatgatcggtggacgtatcgtcaagcagaacggcaaagtgctgggtgtggacagcgagcgcctgcgcgcagccattgatgaatcacacaaccctgaacagccagcttgcaaaaggactcggaggcgactcggtcaccgccgcgttgttttccttttcggctggggcattcagcctcggaatttactcgctgctgcgcgggggattattcacctcacttgccgccattccttctcagcctgtgtggagtctggcaggcggactgataggtgcctgcgcgctgttcagctacgtggtgcttgcaccgaaaattggtttttcagccctgctcgggctggctattgtcgggcagttgctctcatctcagatgatcgaccattttggtctgctgggcgcgatcaggcggccggtttcaatactcaggctggcaggaatgctggtcatgctgaccgggctcgccgtcatgctttacggtga

SEQ ID NO: 29769 - DNA, 465 bp, Glycine max
  Peptide Sequence Number=SeqID_146547
atgcataaatgtatccaaaataacgtagaaggcaaagacatcaacgccgaacagctcgagcagcaagctgaatctcctcctgatcagtttgaggaaggcgtcgtcttaggccccattatgctgattgacggtgactatgtgcttaccccttccatttggtctatcaccaaaaggaacgactttttgtacaagtacttgttctatcaatttaagagtggcaagagtagtcaagatctcagagcgagagttagatcgagtgaagcagaagaagaatggagtggtgggtataccgaggaagtgtttggaggaaaaggcagaagctttggaaaaacaaggagaatgagcgtcgttcatggatgtattagcattactggtgtttggggtggtgttgtttctgaatctatatggacttgtggatttggctacgtgcctttcttgcttatcaccatagcaaggaaagcctga

SEQ ID NO: 29770 - DNA, 294 bp, Glycine max
  Peptide Sequence Number=SeqID_146548
atgaaatctctgtcagagaaggtagatgcactttcccagaatcttgtgagggaaacgtctgtactaaataataaagaagacactttgaggagtgaagaagccaacaaggcaaatcttgttaaaaatattgaagaattgaagcattctggaaaagagaagtcctctgctgttaaaaaggctgaagagggggcagcagatctgaaaaagaaagttgatgagctcacaaagagtctagaggagcatgataaagaataccaggtaccagagatcaatgtaaaaaaaatgcatcaataa

SEQ ID NO: 29771 - DNA, 312 bp, Glycine max
  Peptide Sequence Number=SeqID_146549
atgattagaacaattcatcaaggctttgacctcaagaatatcacccataggtattaccctgactcggggccaaagaaaaaagaaaattgcaacaaagagcttaaaaaatctagcactatcaagaataaaacgagagttatggaagtcaaagatgaggaacataagatccgcactaaatctttgagaagtgagatgatatctctgttcaagtttgtaaatgaatccgcgctgaagaaggaaaatccaatttttgaggttggcgaagaaggaggaagagatggaagatgcagaaaccctagcggagaaacgtga

SEQ ID NO: 29772 - DNA, 189 bp, Glycine max
  Peptide Sequence Number=SeqID_146550
atggctaaccaattgtcattttgttaccttggtaggaagtctttgggattgggagcaatcttgtctaaagttgtgcctgcaacgttttccacaataagttctttttctaagttgatatggcgaagtgaacagtcgtctcctaagaaatcagatcagaagcctcagccatttgctcgaggtaagcattaa

SEQ ID NO: 29773 - DNA, 579 bp, Glycine max
  Peptide Sequence Number=SeqID_146551
atggatcgaagttggatgaaagcaccacgcataagtgacgtgtatgagaacgggttgaagatttcttgcaatttacgcaacaaaatgcaccatcgcacttatacaaaatggatatggcatggtgaattgccacacgagtcaacaatccctcacactgaggcggttgatgtacaaattggagatcgtatagaagacatgatatgcgatcttgggcaagagggtttttggcaaactcatgcaccttattatgaaaaattacaaactgattctaagaagccatttgtatttgggatggacaaccttcgcacaattatcagcgatgttagcttcaccgaattgcttgtgttattgaagaatatgcttcctaaagataacatgttaccgaagaaccaggtatcccgctataaagtgaagtatgacaaatgtagtgatgatttagccacaaaaaatgatcatccatcaaagacaattgatcgcttgtattcggattttggagaggatccaagaaacctaaggcttggtcttgctttagatggaatgaaccttcttggtaacttgagcactagccatagttcatga

SEQ ID NO: 29774 - DNA, 192 bp, Glycine max
  Peptide Sequence Number=SeqID_146552
atgaagggttttggtgatgtgggtaataagggtggaggtgggtgtatcggtgggaatgaggcgacccaccgagtcagacccatcaaaatgtgtaacttcgagtttcatgtgatatggttgcacgagaagagagacgaaagaagtggggagtgtgtggaagatgagatcagagaatgtgaatggactccataa

SEQ ID NO: 29775 - DNA, 459 bp, Glycine max
  Peptide Sequence Number=SeqID_146553
atggttgacaaccatcatagaagcgtcatttccatcatcatagaatgtcatttctgcacaattgtccattggttatccatgaacgaagatcagtggatgtatggtagtataatatctgaaaaagttgatatgaatgaacagaatgaaaatgaagttgttgttaatgaagaacatgttgattgttctgatgtgttcaatacttctcaggtgtttgttacccgtgatgatgttctgcattgggctcaatctgttgcttatgaaattggttttgtggcggtgataataaggtctgacacaaataatggtattagaggaaggacctcatttgttttaattggttgtgaaaggaatggtcagcataaggccaagaagaaagatttggtaagaacagttactggtagtagaaaatgtgggtgtccctttaagttgcacgtgaaaccagcattgggaggcaaatga

SEQ ID NO: 29776 - DNA, 810 bp, Glycine max
  Peptide Sequence Number=SeqID_146554
atggccagactacaggacaacttcacttggatttctattcgacaagacattcataattttgttgcacagtgtctcgactgtcaacacaccaaatacgtgaccaggaaaccagcaggattgttatctccactacctcttcctactcggccatgggaggacttatcacttgatttcattgttggattgccgtcatataaaggaaataacacaatattggtggttgtagactggttctccaaaggtattcatttgggtcttcttccatctcaatatgctgcctaccaagttgccacccttttcctggacatagctgccaagcttcacatcatgcctcggagcttagtctccgacagagaccccttatttataacaatttttgtgtgccttcgttcatcatcgcccatcgtcatgggaaatactagtaccggcacctcctcatttgaggtcacatacagcaagaaaccatcaacaatccttcagtatatcataggctcttcttcagtggaggcagtggatagattgctcaccacacgggaggcagtttttgatagcttatgtcataaattgttaaaagcacaagctcgaatgaaacattttgcagacaataaccatcaagaagtacactatgcagaagatgacatggttatggtactatgtcttacaagctccttctttcagaggactcgcgtatccaccctatctttcattactcactcctcaagccattctgacatgatgcggcagtttaacccagcccacttccattaccttgaaaggactctgacaatcatcctctcatcacccttctaa

SEQ ID NO: 29777 - DNA, 1299 bp, Glycine max
  Peptide Sequence Number=SeqID_146555
atgggttacaaggacgagcctttcatcgtggtagaacaagccagacaagtgttttacgtccaagatccaagaagaacaagtggtattggtcaccaaaatgatgcttcaacactttatataaatgacatgcctgctttctccccacaaatgccttccataaatgttgaacatgaggatgatatacatgcaaatcgtaatgatcatgatgaaggtttatgggaaatattcctacttaagtgtggtataccaaaatgctccttcgaggctacatctagaaggagtagacaacccaccaggctgagaaggttgactgttagaagcttggatcatccacggcaaacagttaacgtcaatcctaccactgggagaggatcaggcccccataaagaaaaacaacctagaggaaaagtggaggagagaagtaaaagaggagaacaaaactctcaaagaagcgtggtagagagaaggaaaagaggaaaacaagcgcaacttggagaaagtgaaacaaaagttaaaggaggccataaaaatgaagttatcccaaatggcattgcaacactcaccccggtagaggtgccgccagatatacaattattagttgcacatgtgagcaccaaagggagttgtgttaaagttgctgctaatccatcaagggaagagggtggtgttgctatgagacctactatggggttgtacgttgaacgtgatcagtgtgcacacctagttgcattgggaaaagtatttgaaggggcttccaccatacacagtgtgccttatggagatgatgtggtgaaggtgagtgttacaaaagtttatgacggtaatgctgaagttccatttccgacgtccaagattcaatatgtgaggcagacccttgacagttttgttgcatggccaacacatcacgtgaaacttgtatcccatgaggttgaatctagtcataggtcaaatatcgttgctggagatgatccattcggtgaattgtttaagaacctgtacgagctttaccataagcttgttgagttagtgtgggatgcgacaaaagttgggattctggatgtacaagaattgttcttcataacatattctgatgtaaatgaaataatatcaggtgaaaaatgtttgaacatatctattctacagttgtggatgatgttttcatgtatctcattaaccattttcatttcaaatgttcaaaatatgtttatggatgactggagtacaaggttgggtcatggttcggtgtatggattctttgagcctcaatccatacacaatgcaaaggatatacgtgattaa

SEQ ID NO: 29778 - DNA, 570 bp, Glycine max
  Peptide Sequence Number=SeqID_146556
atgcgtagtgattgcctagtgcaattctccattctcgacttttgttcagagcccaatgaattgattgtcattcatgcatcctccacctgtgagtctggagccatgcgtagtgattgcctagtgcgattctccattctccacttttattcggagccccatgaattgattgtcattcatgcatcctccacccacgagtttggaaccatgcgtagtgatttcctagtgcaattctccattctcgccttttattcggagccccatgaattgattgtcgttcatgcatcctccacccacgagtttggaaccatgcgtagtgattgcctagtgcaattccccattccccccttttattcggagtcccttgaattgattgtcgttcatgcgtcctccaccaacgagtttggagccatgtgtattgattgcctagtgctattctccattctccacttttgttcggagccccatgaattgattgtcgttcatgcatcctccacccgtgagtctgaagccatgcgtagtgattggctagtgcaattctccattctccactttttttcggagccccattaa

SEQ ID NO: 29779 - DNA, 1329 bp, Glycine max
  Peptide Sequence Number=SeqID_146557
atgatagctcatggtaagcctcagcagaatttcaccccatatcgtcaggttgcgaatgtcgcatccactatcccaaacccatcatatcaccaacaaaggccacattacccctacccgtaccctccacaacaataccctccacaacaataccctccacaacaatatcctccacagcaataccatcagccacaataccctcaaaaacaacaaaatcgcccgcagaccccccaacaaccatatcactcacaaaaccgccaaaaaacaacctttgatccaatcccgatgaaatatgctgacttactccccgccctgctcgccaaaaaccttgtccaggtcagaacaccccctcgtacaccagatattttacctccctggtttcgtcatgatttaacctgcgctttccaccaaggggccccaggtcatgacgttgaaaactgctatgtcctgaagaatgaagtgcaaaaactagtccgggccaacttgctatccttcaaagatcagaatcccaatgttcaggcgaaccctctgccgaaccacgggcctgctgtcaacatgatacaagattgtgatgaagacggtgtcatcctgaacgtccagcacgttcgaactcccctggtcccaatacatatcaagatgtgcgaggcagctctgtttgaccatgatcatgcagcgtgtgaaatatgtcatgtgaatgtaaaaggatgcccgaaggtacaagaggacatacaaaggctgatagacaatagagaactaatcatcacgaggaaggacaaggaagtgtgcgtcatcacccctgagtttcagcggttggaaataagctataacagtggggaatcaactactactccactggtgattagcttgccaggacctatgccgtatgcttctctaaaagcggtcccttacaagtatagtgccacgatgttggaaggtgggcaggaggtgcctttgccctctctaactcctgcgatttctgtggacaacattgctagtgacggtaaagttctaaggaatggacgtgttatccccacattgtttgcaaagaaagtgaatgatccggcagttaaacaggcgacagtgaatggccccggtacaaggaaggaagtaggccaatccaatgggactagcaagaattctgatcatgacgaaattctgaaactgatccagaagagtgagtataaagtagtagaccagctgttgcaaactccctctaagatatccattttgtctctgctattgaactcagaagcacaccgtgaggctctaatgaaggtgttggaccaagcttttgtggagagggacgtgactgttaaccaattggacagtata

SEQ ID NO: 29780 - DNA, 900 bp, Glycine max
  Peptide Sequence Number=SeqID_146558
atgggttccgtgttggtggaaagcgccggtgaaaccatgggcgacatcgtcaacgccgtcacccgcgtgaccgacatcatgggcgaaatcgcctcggcgtcgagcgaacagagccgcggcatcgagcaggttggccaggcggtagcggaaatggaccgcgtgacccagcagaacgcctcgttggtggaagaatccgcctcggcggcggcggcgctggaagaacaggccagcatgctgacccagtcggtggcggtattccgcctgagggcggaaggccaggaagagtttaaagcgcctgtcaccagcaaggcgacggtaacaccgctggccagcagcggcctgtcgtattccgcgtttcgctccgataaccacaacctcgacatcatcaccctcggcagccagcagcgcgattcgctcagcctgagctgggtgtcgctgttgcaggcgcgcaatacgctgaaccgcgccggcacccgtgcggcgctgaaactgccgcaggagcaggtgaacgaattgatgagcagcgctcgcagttcgctgcagaaggccgatctttatttcaatcagttcatggcggttgagcgcagcagtgagcaacagagtcagcagacggcaaccaccaaggccagctacgagcggctgcgcggcgcgctgcgcgagctgatcggctttctggagaaaggggagctgcaggcgtttatggaccagccgacgcagaaaacccaggacttgttcgaagccgacttcgtgcagtacctgcagttggtcaacggcgacatcagcgaagccagagacgccaaccagttctccttcaagctggcgggcctgatgctggcgggggcggtcttgatgctgatcgtggtgaccggcagcgccatgtggtggttacgcaccatgctg

SEQ ID NO: 29781 - DNA, 201 bp, Glycine max
  Peptide Sequence Number=SeqID_146559
atggctgtggggtctgagctggagtggtctcctcctctgctattgctggtgatggtgctggcgctatgggctcctcagtcacaggctcctggcctgtggaggcccccaccccctctagaggaagaagactggtctcctggccaggccacctgtgcgtcaaactcctccatgctcataatggagggcaagctcaagctttga

SEQ ID NO: 29782 - DNA, 657 bp, Glycine max
  Peptide Sequence Number=SeqID_146560
gaattatatgccaacccctatgacctcgaggacaaatcacctaagcaggtgagggtgagaggtcacctgattaaatttgatgaggatacgcttaatactttcttgaagacctctgttattgtggaagagggggaatcactctgtgcttactccagatttgcactcctaaggcctgatcctcaggagttggctgctaagctctgtgtcccagggagaggattcgagcttaatgctgatgggaagcccctgaagattttgtggaagaacataaccaccttagctcaaacatggagtgttctttccttctctaacttgattcccacctcccacacttctgatgtcactcttgacaaggccatacccatttatggcattattatgaagatggatatgaatgcggggtacctcatttcccaccaaatctccctcactactcaggatgatacatctagacttgcattcccgaccttgattacaactttatgtaaggctaggagagttcagtctggctctagatccttggagagtctaagtcttactattaatttggcttacattaagaagaactgttggaatcttgatgatccaatagtcacattcagaggacccaagaaggccagagggaagagatatgaggccctttccacagcaccatga

SEQ ID NO: 29783 - DNA, 183 bp, Glycine max
  Peptide Sequence Number=SeqID_146561
atgtcaattaggacttgtaggaaagcttgggcagagcaaatgagaaaaatgagtgacaaatgtgaaagaggagagccatttctaggaaaaatgctgttgaattgtgcagccgattttttatgtgtgcagaaaaatgcttgtgcattgttggttatgggaaaggtagtacatattgggttctag

SEQ ID NO: 29784 - DNA, 474 bp, Glycine max
  Peptide Sequence Number=SeqID_146562
atgggggagacacatgaaattccccaccacaatctagcgaactttgagccttgcctcagatatgccactgaagggcaagcagttggtggtatacccctacaaaacactttggatgggccctcagtttcacccacaaccacaacctttgcattccacagcagggaaaagttggatcatctagaggaaaggctcagggccattgaaggaggcaaagattatgcctttgctaatctagaagagttgttcctagtacccaatatcatcacccctcccaagttcaaggtgccagactttgtcaagtacaaggggactacttgccccaagaaccatctaaagatgtattgtcggaagatgggggcatacacaaaagatgaggaactgctaatacatttcttccaagaaagtaccactggggtagctgttacctggtacactaacttggaccttcccgagtccattcttggaaggacctaa

SEQ ID NO: 29785 - DNA, 226 bp, Glycine max
  Peptide Sequence Number=SeqID_146563
atgcagaagacgacgttagtctctgcgtgccatcggacacgattgtgtctgaatggcaaaaaggctcgccacctctggatgacaaaaggcacagaagacgacgtcaatctctgcgtgccatcggatacgactgtgtctgaatggcgaaaagacacgactgtgtctgaatggcgaaaaggtgtgcggcatgaccataatttgtctccgcacgtcacatgtcccaagg

SEQ ID NO: 29786 - DNA, 648 bp, Glycine max
  Peptide Sequence Number=SeqID_146564
atggataccctgaaagacgggctgagtgtcgtcaagaaaacttctgacgcacaggaaatgcacgctgcactgggcaagatgcgtgccgctgcgcaggatgcaaaaaaatccacgccggaaaaactggaaggtcagggcgctgacagcgcacagatcaaggattaccacgccggtctggactcactgattgcccagatcgacgttgtcgaccagctggcgcaggctaacaagctggacgaggcgaaaaccgaagcgaagaaactggaagatatcctcgcccgtgggatttccactttgaggagtaacaaggtgaggagtgatgctgtcccgctgaaaccgagcacgccggaggcaatccaggcgctggcggataaggtgatgaatcaaatcgcggcgctgtatgccgcgcaccacattgcagccaatgcggtgcaacagcaaatgctggcctcacatgtccgcgccatggcggcacgttctctcaccggagaggcgctgccggacgtcgaagccgaactgtttgaggacatctcgcctgagaccatggcgctggcgcagaaggtggtggatctgtttggcaatttgcctgtcgaagaagcctggctgctgtcggtgcatatcgaagtggcgaaatcgaacgaagcatga

SEQ ID NO: 29787 - DNA, 1214 bp, Glycine max
  Peptide Sequence Number=SeqID_146565
ccacagcaccacttcggtgccggtcggggtatcccgccagtggcgatgtactgcggtggtgccgtcgtctgtgcggcgcgggcgtgcggcagcgcggggaattgcttgacgctgtggggctgtctcaggacaatccagcctctatattccgcagaggatagttatggaagcctggatccaacacctgtttacgcaatcgctggagtacgcgctgattgccgtggcgctgtcgctggcgtttgtcggcctgctgctgccgggaacggtcttgatggccagcctcggcgcgctggtgggcagcggacaaatcgggctctatccggcgtgggccgccgggctggccggctgtctgattggcgactggcacgcgctgcatcagcacagcatgtttaccatcctggtggggcgctttgtcggaccgacgcgtccgctgattccgctggcggccggcatgctggagctgccggcggcgcagggcgacagcttcaaatggctgctgctggcggtggcgctgctgctgtggatcggcggctggctgctgtggcgctggtggcgcagcggcaaaagcgtcgactgggccacgccttatctgccactggcgcggctgcgctggctggcaccgctgatggcgctcatcggcgtgggtgcctttattgcgctgctgttccacccgatgatgccgattttcctgcagctgctgtggaaagtgttcttcgcttaacgcggcgatacgccaaggatggcggccgccgggctttcaccgcgcagcaggctggcggtgctgccatcccatgcgcgcctcgcacaccgcgcgcaccagctgcagcatctcgctgcgcagcgccggatcgagtgccgaaaacggttcatccagcagcagtaccggctgattacgcagcaggcagcgcgccagcgccacgcgttgtcgctgaccgccggagagctggccgggcagacgcgtcagcatcgattccagcccggtttgctccgcaatctgctgtacctgctgctgctgttcgcgcgtcagcttcaggccgggatgcaggcccagccccagattttgctgcaccgtcaggtgcggaaacagattgttctcctgaaacagcatcgataccggctgccctgactcaccggcagaaagccgccgagcaggctcagcagggtacttttgcccgcgccgctcgggccgagaatggcgagacgttcaccggcct

SEQ ID NO: 29788 - DNA, 156 bp, Glycine max
  Peptide Sequence Number=SeqID_146566
atggaacatacgaatttggggatcccacggtcatgtggctccgcatgcccccggtctcttgggacacgcatttcgtttctaaatgaccatttagaggaagcaccgggtccaacaaagataggagaaaatcactcaaagtgtatcaatctcacacag

SEQ ID NO: 29789 - DNA, 159 bp, Glycine max
  Peptide Sequence Number=SeqID_146567
atgactaaagactcagatctgaaacacccccataaaaatgagaccaaccattttgtggcaaaaaaagctagaaattcctacttggtccagaaggagaaccctcttgaagggtctctagaagaaagaaaggtacctaacatgggaaagccaccattatga

SEQ ID NO: 29790 - DNA, 1968 bp, Glycine max
  Peptide Sequence Number=SeqID_146568
atggctccaagctttgatttttccaataggtggatgaaggagacccagaagggtaccccagttgtggtgacaatggagaaccccactttctcggttgtggagattaatggtgctgatgctgcattcaggccagtggagaagacccgcggcaagaatgctaagcaagtcacatggttcttgtttctcaaggcttaccatgctattggttgtgtggtggtttatttgcaaggttggcattttgggaatcccagtgtgcacattcctcgtgccgcagatttggaaggcttgatgcacttggtttatgttgcgtggctgaggtttcgtggcgagtacattgctccaccaatgcaggcactttcaaagttttgtattgttctgtttcttatacagtcagtggaccgtatggtgctttgctttgggtgcttttggataaagtacaagcggattaagcctaagattgatggggatgccctcaaggttgatgatattgaaggatctgcgtgtagccatccaatggttctggttcagattcccatgtgtaacgagagggaggtgtatgagcagtctatttctgcagtatgccaaattgattggccaagggaccgtttactcattcaagtacttgatgattctgatgatgagagcatacagtggttaattaagactgaggtcagaaaatggagccaaaagggaatcaacataatctacaggtatcgcttagtccggactggatataaagcagggaatctcaagtctgcaatgagctgtgactatgtgaaagactatgagtttgttgcaatttttgacgcagatttccaaccacatcctgattttcttaagcaaactgtgccgtatttcaaggacaatcccgaattaggtcttgtccaagctagatgggcttttgtgaacaaggatgagaacttgttgacacgtctccagaacattaacttatgcttccattttgaagtagaacagcaggtcaatggggcatttctcaacttttttggatttaatggaactgctggtgtttggagaatcaaggccctggaagagtccggtggctggcttgagaggacaaccgtagaagatatggatattgccgtccgagctcatctcaatggctggaaatttatctttgtaaatgatgtaaaggtactttgtgaagttccagagtcctatgaagcttataggaagcagcagcaccggtggcactcgggtccaatgcaacttttcagattgtgtcttccagcaattttgagatctaagtattacttaaatatacacaacaagctaaaggacctcgattctcttcaactgcagatatcaccatggaagaaagggaatttaatactgctattctttctgttgagaaaactcattcttcccttttactccttcaccttattttgcataattcttcctttaactatgtttgtcccagaggccgagcttcctctatgggtgatctgctatatacctgtatttatgtcattcctcaacattcttcctgccccgaaatattttccttttctagttccataccttctttttgaaaacaccatgtctgtcaccaaattcaatgccatgatctctggactcttccaattaggtagttcttatgaatggattgtcacaaagaaggctggcaggtcatcagagtctgatttggtggcggctgcagaaagggaagtcaagtcaataatggaacaacaaaagatccatagaggagcttctgacagtgtacttgttgagtctaaccaatgtaaggaacataaagaaacaaatggaacacctgttaagaaagctaacaaaatatataagaaagagttgactttggcattgctccttctcacagcttctgtcaggagtttgttgtctgcacaaggagttcacttttactatcttcttttccaaggagtgactttcctccttgttggtcttgatctgattgggcagcagatgagctag

SEQ ID NO: 29791 - DNA, 162 bp, Glycine max
  Peptide Sequence Number=SeqID_146569
atggagagagaaaacggaatcgcacaaagacagtacaagtgtaggcttcaatcccttctctgtctctcagatgtttgggaactctatcaaagcagaaactggaggaatctcagggaaccgctagagatgccactatcgatatcagaagacacggaaccttag

SEQ ID NO: 29792 - DNA, 168 bp, Glycine max
  Peptide Sequence Number=SeqID_146570
atggcattcaaattaaaaagtatctctgtaaggttgtttccctacaaaaatcacgcgctaatgccattgaggcatttcaccgaacacttggcgggcgcgcgtttaggcgtcaatagcaagagaacggggacaatgtggcatgtcccattgcttcaaaatgcattatag

SEQ ID NO: 29793 - DNA, 603 bp, Glycine max
  Peptide Sequence Number=SeqID_146571
atggtcaagaatgactggccctctcaatcagtcaatctcttgctttctcataaggttggacccttaaggactacatgtcctcgccttcagagggttgcacaccctcgccttcagaggactaaggtcctcgccttgagagggctgcacgccctcgccttcagaggattacaggtcctcgccttcagaggactacacgtcctcgccttcaaaggactgcacatcctcaccttcataggactacatgtcctcaccttcagagggctacacgctctcaccttcagaggactatacgtccccgccttcagagggttgaacgctgtcaccttcagaggactgcacgtcctcaccttcagagggatacgcgccctcaccttcagaggactacacgtccttgcctttagagggctgagcgccctcgccttcagaggactacacgtcctccccttcagaggactacacgtcctcgccttcagagggctgcacgccctcgcccgtcctctccttcagaggactacatgtcctcaccttgagaggactacacgtcctcgccttcagagggttgcacgccctcgccttcagaggactacacgtcctcacctttaa

SEQ ID NO: 29794 - DNA, 141 bp, Glycine max
  Peptide Sequence Number=SeqID_146572
atggagttcctcgagctaaaacagggaagtatgacagtggcagagtatgcagcgaggtttgagaaccttgtaagatttcatgaactcgctcagcctctcatcttctggctaagcgcatcatccgctaagcgcctcatctga

SEQ ID NO: 29795 - DNA, 468 bp, Glycine max
  Peptide Sequence Number=SeqID_146573
atgaagctaacagacctcaatgaaaaagcccccatcacagactgccatgcagacgcgggtcagtggtttaacacccatggggaaatttcggacaatacagaaaaaggaatagagggggagcacgaaaaagcattgcctcttgaggtatctatgcctcacaacaacattttgaatatcacgaatcccagcatggtctatgctgcctctggtcaacacgacttaaaagtggcatctgaggaaatgggccaacagacatgtggcccaactctttctgccacaaaggtttatgtgagaagaaaggaggtgttgaggagtaatagcaaggcccagcagtttgagaaatcaattgtggacttcaacccagcctctaaaactgaccctctgccttcattacacgaggactctatagagctgcaatgtgcccttttgaaggaaatgggcttgacttatggggaagatgataacaag

SEQ ID NO: 29796 - DNA, 1114 bp, Glycine max
  Peptide Sequence Number=SeqID_146574
agggctacatgccctcgtcatcaaaggactacacgtactcatattccaaggactacacgtcctcacctttagagggttacacgtccttgccttcacagggctgcacaccctcgccttcagaggactgcacgtcctcgccgtcagaagacttaacgtcctcgccttcagagaactgcacgtcctggccttcggtgggctacaagtcctcgcctttagaggactacacgtcgtctccttcagaggactgaatgttctcgccttcagagtgttatacgtcctagcctcagaagactgcatggggctgcttgtcctcgccttcaaaaggcttcacgtcctcgccttcagaggactgcatgtccccaccgtcaaaggggtacacacgctcgccttcagaggactacacgccgtcgccttcagaggattggatatcctcgcattcagagtgctacacaccctcgcctttagaggaatatacgtccttgcctttcgaggactacacgtcctcgccttaagagggctacacgtccacgccttcagagggttgcacgcccttgccttcagaggactgcatgtccttgccttcaaaggattgcatgtcctcgcatttagagtgctacacgtcctcgcctgtagaggactgcacgtccttgctgtcagaggactgcacgtcctcgccttcagaggactgcacgtcctcgccttcagaggactacacagggctacacgttgtagcctaagaggactacatatcgtcacattcagagggctgcatgtcctcgccatcgatgggctgcatgtcctcgccttcagaggactgtgggtcctcccctttagaggactgcacattgtcgccttcatagaactacacgtcctagccttcagatggtttcaagtcctcgtcttcattggactgcatgtccccgccttcagacggctacacgccctcccatttagaggactacacatcgtcgcctttagaggactggacgtcctgatgcaatcctaccccgcaagggcattggctagaagactccaagtagattgggctagagatccaaggaaaggccctagggttctcatgagccttagggtagatttcgagcccatgggctaa

SEQ ID NO: 29797 - DNA, 549 bp, Glycine max
  Peptide Sequence Number=SeqID_146575
atgctttggttgtgttataggcagggtgaaggagatcgccgaataggcagggtgaagggggatcacaaaaagggtcaaataatctgtgttgagaaagcatgcaattgctattacaaaagcatatcttgcgagaaatatcataggtgtaaaatccagcaggaggcaggcaaagaagtgattaacaggacaattagaaaatcgggaacctgttattcttttgtaacatttatttatgcttttcttcttcaacagatccaacttatgcagctatttttggctgctgtaggatggtattcttccttagttagcaattgtttcctcgcttctatgttggctattaatcagccggtgggatggaagtctataccaagccttataaatgagatgtatatggaaaaggctattgtgcccatgctccagctgttgacatgtgtccaatttattggtttttttgggcatttctacatcacacttctaggtatcttgattccagcacgtgcggctttgtgttttgcatatgaggttttgcttttgttgccttcctgctaa

SEQ ID NO: 29798 - DNA, 207 bp, Glycine max
  Peptide Sequence Number=SeqID_146576
atggtcacctgggatgactcaaacaataataagagtagcagttcaaacgatgagcaagccaacatcttcctaatggtagatacagacaaaaaagttgaggtaaaaacttgctttaaatctgatacctcttcttgtgctacatcaaacgatgcagaagatatgtcctctgatgttcttcttcaaaatagtcatatgatttctctttag

SEQ ID NO: 29799 - DNA, 234 bp, Glycine max
  Peptide Sequence Number=SeqID_146577
atgactgtggcgcacgatgagccagtggtccctgcgccagatgttgaggctgacgtatttctggatgacccgatggcaccagctgatgtagaggacattgtgacagacattcatgcggacacaggcgtgcaggctactgaggatgagcatgagggatttccgggtggtccgagcgacccatccgtgctgacccagtatgcggatcacgttgcttgcagtgtatggacgggagag

SEQ ID NO: 29800 - DNA, 504 bp, Glycine max
  Peptide Sequence Number=SeqID_146578
atgttagtaaatgaaggtctccggacaaaattagggtatgacaaatcttatccaaggaaagaccaaggtcaaggcatcttaggggcggcaccttctaagcccaaagatgataaggggaagacaatagaaaaacaaccccctaaggctagtatgcaagagaagactagctctataaagtgctttaaatttcttggaaaaggacacattacttctcaatgccccaccaagaaaaccatgaatatgaagggccaagacatttatagtagccaagatgaggctactacttcaccttcctttagtgaaagtgaagaagcaaaaggggaagaatctagtgaagaaatctacccccaagaagaaggacaacctttaatggttaaggaggagtgtaaggaggtaagtgtctcctccaagaggttagctaagaaggaaagtcattttgcaataaagacaaacattaaagaaacttcccatcttagacaacctccacatctttctcctttgtaa

SEQ ID NO: 29801 - DNA, 324 bp, Glycine max
  Peptide Sequence Number=SeqID_146579
atgacaaaagatagcaatagatacccagtaggtcgagaacccaaaagggcaatgagaggcaccgtgcatgagcctcaagcaaacctgggggcagatcagaagttcttacccatgggctcgtacttatcccatggagccgaaatctaccctaaggctcatgagaaccctaggtccttctcttgcgtctctggcctaatcttcttggagtcttctatccaatgcccatggggggtaggattgcatcattccctcccgcttgaaaatgatttgacctcaaatccagaggttcttaaaactttgggcttcttccctcaacacctgtaa

SEQ ID NO: 29802 - DNA, 1165 bp, Glycine max
  Peptide Sequence Number=SeqID_146580
atgtctaaacgtccttcgatctctttcagcgattttgcagtaccggaaagaggcgtgtccatcgtgctcgtcgccaagggcggcggctttgcggacgaggcggccgcggctgctggcggtgcggaaaagatcaagcgtattgctgaaatttccgggttcaccggtgctttgggcaagacggcggaagcgatcgagacgacttccagcggtgtcgacaagatcgttctggtcggcgtcggagaaccgggcaagcttggcaatgacgactggctgaagatcggcggcgcggcattttcacgaatcggcaaggcggagcgcgcaaccgtgacgctggcactgcctgaaaccaccatcgccggtgatgaagccgccgatctggcgctgggcatgatgctgcgctcctacaagttcgaacgctacaagacgcgcaagaacgatgaggaaaatggcgatccgaaacacgccgcgaagatcaacatctgcgttgcggatgcccacactgcgaagcgggccctcgaagtcgccgaagcggtggcggacggcgttatccaggcgcgcaatctcgtcaacgagcctgccaatattctggggcctgtggagttcgcgcaggaagccgaaaagctcgaaaagcttggcgtcaaggtcgaagtcctcggcgaaaaggaaatgaagaagctcggcatgggcgcgcttctcggcgtggcgcagggctctgtccgcccgccgcgtcttgtcgtcatggaatggcagggcgcgaagagcaaggaaaagccggtcgcgttcgtcggcaagggcgtggtgttcgatacgggcggcatttccatcaagcctgccgctggcatggaggacatgaagggcgacatgggaggcgcggcagccgtcaccggattgatgcgcgccctggctggccgcaaggcgaaggtcaatgcaatcggcgttatcggtcttgtggaaaacatgcctgacggcaacgcccagcgtccgggcgacatcgttacctcgatgtccggacagacgattgaagtcatcaatactgatgcggagggccgtctcgtcctcgccgacgcactgcactatacgaacgaccgtttcaagccgcgcttcatcatcaatctggccaccctcacgggtgcggtcatggtcgcgctcggccagtatcatgccg

SEQ ID NO: 29803 - DNA, 288 bp, Glycine max
  Peptide Sequence Number=SeqID_146581
atggagtataatggaaccacacattttgttaggcttcacaaatatggcagccgatactttttttctgatggcctcaaacagtttagaagaactcacgacattgacgacagtgtcatcatgcagtttttggctcctgacaaaaatacttccttcgaggtggatgtcattggacctatccttaggcagggccgtccaaggtccattatggcaaccaggagacacatctttacagccgatgtcaccgaacacatgatgcaacagaccctccctttggtaatggtttgctag

SEQ ID NO: 29804 - DNA, 484 bp, Glycine max
  Peptide Sequence Number=SeqID_146582
gcaacaaaaactttatacggataaccactcgggtatttccggccgtcagcgtgactcaaaagtcagtatgatagatcttgtgagcgcggaagatgacgtcgaagaagacgatgttagtctctgcgtgttatcaggcttttcgtcttacagaatgcaaaacgtttatacggataaccactcgggtatttccggccgtcagcgtgactcaaagtcaggcgcagaagacgacgttagtctctgcgtgctatctggcttttcgtcttacagacaacaaaaagtttatacggataaccactcgggtatttccggccgtcagcgtgactcaaaagtcagtatgacagatcttgtgagcgcggaagatgacgattttcgtcatacagaatgcaaaaagtttatacggataaccactcgggtggccgacaaaagcgaggctcttgctcctacgtatcctccaatgaggaactcagacctacgtagttcttga

SEQ ID NO: 29805 - DNA, 456 bp, Glycine max
  Peptide Sequence Number=SeqID_146583
atgatgctgatcgtgccggtggtcgcgggcattggcgtcggttttgcaggctatctcacagcgccggtcagttatgtgtcggagtccgtgctggtgctggatatgcggcggttgcaggcgcttcccaatgaaagcgccatcacgccgctgccacaggacagtcccgttctgcgttcggaactcgatatcatcaattcccgcatgatggcgcgcaaggtcatcgacatattgcaagcggagaacataaccgtgccgacgcaattccgttcgcgcacggttttatcgtccgcctcggatgcggcgtcgcaggccaagggcgcgcgcgaggtcgatccggccctgcgtgagcgccagcagatagacctgcttctttcgcggttgcgcgtcaccaatgacgggcggtcctacacgatcttcatttcctatcgcgcatccgaccgggtctatgcggcgcag

SEQ ID NO: 29806 - DNA, 469 bp, Glycine max
  Peptide Sequence Number=SeqID_146584
atgaaccttcacggtgctttcccgcagtttcagttcataggcgatgatcttgttcgccttgccccggcgcagcgcattgaccacttcggcctggcgctgggtgaacattccgccgagaggctgcaggcgctgcgaattcggatcggtggcatgccgcagggcgagcacgctgctggccggaacgaaggttcctcccgccatggcaagccgcaatgcttcgacgcagacattcacattgaccgaggtggggatataacccttcacgccatggtcgagcgccttgaggacctgcgagatttcttccttgtcggccagaagaatgacgggcgccggggcgcagtccgtaacgatgcgattgagataattgccgaccgctgggtcggaaaccttctggccgccgatattgaaaagcaccgcgccagccgtgcggccccgacgctgatgctgccactgctcgaacgagctgaat

SEQ ID NO: 29807 - DNA, 369 bp, Glycine max
  Peptide Sequence Number=SeqID_146585
atgcgaaacatcggtcagttccgcgacattggcgggttcgatgggctttgtgaagctgggccagccgcaatgggactcatatttgtcggcagaggcgaaaagcggttcgcccgaaacgatgtcgacatagattcccggctccttgttatagagatattcgccggttccagggcgctcggtgccgctttcctgcgtgacgcgatattgctccggcgtcagcctggcaatcgcttccgggttcttgctaatctaggacgacgagagcaactattccagcccgccgcaaatgacgaactgttgaagaaccgcaaaaccggaaacccggacctaccggctgatccggacgcgtggaaaaatttccatggtcag

SEQ ID NO: 29808 - DNA, 714 bp, Glycine max
  Peptide Sequence Number=SeqID_146586
agtgacagacagagacagaagaaatgagagatggagcgaaacagacacggcgaggacgagtgtgaagcaggaagaaccatatggagggcgacgagtcaacattttcggaagggacaatgactacgctgaggaagaaaactggactaaggtggtaagcagaagatcaatgaaggttatgcagaaatcctctttagcgggaagacaatcacaaaatctggagataggggacaacaacaaacactatcgccttaactggaggaacaatgccgacattacctccttttatttcacccatttccccgacgaagctaatgaagagttgctatggaggcacttcaaaaactggggtgacgtacgtgaagtatacatcgctaaaaggctcaacaaggatggcaggagatacgggttcatgcggttcaagggagtctcggatgcaaaaggattggagaaaaagaaccccattaggaggaagtacaccgacgaagcaagtaagccctgcgggataactactggtgctcttcggagatcatatgtggacgtgatgactaagggggggggggggtgccaaggagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttggga

SEQ ID NO: 29809 - DNA, 288 bp, Glycine max
  Peptide Sequence Number=SeqID_146587
atgattcatttggttgaggtcagatgggggctcgggttcactttagcaacagcactggtagcggcaactgcaaccgcattggcttccaataccttcttcatgctcatcatggcctccatcattgtggccatttgctctttcatggcctccatgtcggccttcatctgcttttgcacctccactacttcacccattactctagctctagcacgggttcgaaatgggtttatgatcccaacatggttggctcatgaggaaaacgcaagcatcatgcatgagaaaacatga

SEQ ID NO: 29810 - DNA, 1572 bp, Glycine max
  Peptide Sequence Number=SeqID_146588
atggaagttatgctcgcccctcgttcaatacgcctcatcgccccttccggttattgccacaatcaggatgccgcccgccgcgcggtggagcgcctgcaggcggaaggccatcaactgcaaaacccggaagccattacgcgccgctggcagcgttttgccggtgatgacgcgcagcgcctgcaggatgtgaatgcactggcgtcgctggcgtcgctgccggatatcgtactggcggtgcgcggcggctatggtgcctcacgcctgctcgatcacctcgactatgtggcgctgcagcgtcgcctgcttaatcagcctgtcgcgctgtgcggccacagtgatttcaccgctattcagctggcgctgctggcgcaaaccgggctgatcaccttcagcggaccgatgctggccggcaattttggcgcggaggctttatctgaatttaccgtcagccacttttggcagacgctaacatctcctacagtcaatctggcgtggcgcagcgccagtccggatcgcggccgctggcagggcacgctgtggggcggcaatctggcgatgatctgctccctgattggcacgccgtggctgccgcagattgaagacggcattctggtgatcgaggatgtgaatgagcatccgttccgcattgagcgtatgctgattcagctgcagcagagcggtattctggcgcgccagcgcgccattgtcaccggcagcttcaccagcaccgccctatccgattacgacaacggctttgatttcgccacggtgtggcagcggttgcgtgacgagtaccagattgcagtgatcagcgatctgccgtttggccatgatgccgataccgtgacgctgccgctcggcgccagcgccacgcttgagattgaccagggcgccgcgcggagaccgctattgaagccgctgtacgaagacttgtggatctccacgccggaatttcccgccgaagagacggccaatgatttaatgatgcacgggtttatgctgcgccatccgcgcggcaacctgttgattggccgcgttgagcagttgctggatcatgaagtgctcgcggacgcgggcggcgtgattcgccactattttacccactggcatgaagccgcgccgggcgcgcgggccattcagcagcgcttcaatagtgcgctgtattgccacagccgatcgctcggcccggtgagcctggtgattgagccggacgaaaccttcacgcatcaggacgtgcactttggcgactttcacctgctgcccacgccgggccacacgccgggcagctgcagctacctgtatcactcaccgctcggccagacctacctgtttgtcggcgacaccctgacgcgggattaccatcgctggattagcgtgctggtgccggacagtaatccagcggagctgcagcagtcgctggagctgtaccgctcgctgcgtccggatgtggtgctgatgagcaccacgcgcgggcatctctcctgggcgaaggtcgatttacagagctggctggccgcgattgatgaagcagaacagtcgccgctggatctgcgccagcagccactgctgtga

SEQ ID NO: 29811 - DNA, 1081 bp, Glycine max
  Peptide Sequence Number=SeqID_146589
atgtcctcgccatcagaggactacacatcctctcctgtagaggactacacgtcctcgccatcagagggctacacgccctcaccttcagagaactatacgtcctcgccatcagggggctgcacgccctcagcttcagaggactacacgtcctcgccatcggacggttgcatgccctcaccttcagaggactacatgtcctcgtcatcagaggactacacgtcctcgcctgtagaggactacatgtcctcgctattagagagttctacgtcctcacttggctgcacgccctcagcttcagaggactacacgtcctcgccattggagggctgcattttctcaccttcagaagactacacgtcctcgctatcagaggacttcacttcctcaccgtcagagggctgcacgccctcacctatagaggactacacgtactcgccatccgagggcacctttagaggacaacacgtcctcgccattagagcgctgcacgccctcagcttcagaggactacacgtcctcgccattagagggctgcacaccctcgcctttagaggacttcacgtcctcaccatcagagggttgcacgccctcaccaccaaaggacaacacgtcctcaccatgagagggctgcaagccctcagcttcagaggactacacgtccttggcatcggagggctgcatgccctcaccttcagaggactacacatcctcaccttcagagggttgcatgcccccacttgcagaggactacacgtccttaccatcaaagggctgcacgccctcatttgcagagaactacatgtcctcgccatcatattgttgcacgccctcaccttcagaagactacacgtcatcgccatcagagggctacacgccctcgccatcagaaggctgaacgccctcccctttagaggactacacgtcctcgccatcagagggctgacaccctcaccttcagtggactacatgtcctcaccatcagagggcagaacaccctcaccttcagaggactacacgtcctcgccatcagagggcagcacgccctcaccttcagaggacttcacgacctcaacatcaaagg

SEQ ID NO: 29812 - DNA, 639 bp, Glycine max
  Peptide Sequence Number=SeqID_146590
atggtgatggtcgttccggttctgcgcgctcctgcgcgaccggcttctgtccccctatcggcactgcaggagggaactgaagggttgtgtgaccagaacgtgaagcagggtctcgatgtcgagcaggatcagcatgcggtcgtcctgcgtgccgatgccggagatgaagcgggtatcgacggcggcgccgaattccggggtcggacggatctgctctgccgacagcgggatcacgtccgagacgctgtcgaccacgatgccgaccacgcggtcgtcgacgttcagcacgatcatcacggtgaaggcgtcgtagcgggcatcgtccaggcgcagcttcaggcgcaggtcgatgaccgggacgatggtgccgcgcaggttgatcacgcccttgatgtagtccggcgcatccggcacgcgggtgacggcgtcgtagccgcggatttcctgcaccttgaggatgtccacgccgtagtgctcggcaccgagggtgaagctgaggaattcgccaccggcgctggcggtggagctggtcttgtcgttcatcgaggggtcctggttctgccggaagtcccggtgtcaggctcgatatcggcccctcgtcgggggactttaggtgtggcccccccgcattgtcgcgag

SEQ ID NO: 29813 - DNA, 351 bp, Glycine max
  Peptide Sequence Number=SeqID_146591
caaaacctagaggggcccacgcacctcttctgccagccactgctcactgccgccagccactgctcgccaccgctgtcctctgcttgccaccgcaccatcggacacaagagcacgattcaaggtcagcgacagcaggttcaagttctcttctcgcaatttcccaaagatctgcggaattttgaatcactactgccggccactgctcgcaaccgtcgtcctctgcctgccactgcaccatcggacacgggcacgattcaagaccaacgacaacaggttccaattcttttcagatctacagaacttttaatttttttagacaatttctgtaaaaaaattgatgttaagttgtga

SEQ ID NO: 29814 - DNA, 330 bp, Glycine max
  Peptide Sequence Number=SeqID_146592
atgggagaaagaaaaaagagaaaagaaggaaagaaagctcctgatcaaggatcgaaggaaaaacagaagaaatatgccgagagtggagaaaacaacgagactttttcaagtctcacaagttatccagaactacgtaggtctgagttcctcattggaggatacgtaggagcaagagcctcgcttttgtcgaccacaccgccttttgttgcaaagactcaagagctggtagcccgcggagacaccttacggttatccgcacctcgtcattcagtgaccccaagtgtgattgatgagcagaggccaatgtggtcatctgcgccttttccgtag

SEQ ID NO: 29815 - DNA, 273 bp, Glycine max
  Peptide Sequence Number=SeqID_146593
atggaggcttcttccatctatatcgtggcccccgccatggacatggtgttgtggtggattacaatgcttatggttatcattgtagggttttttctcatgggtttttgggcttgggttgatccatttttaacccacaaaggggtgcaaatagcaaccgggcccacttgggcattccagattcttcctccagaaggttgttgcttctggaggaagcaacctagctcgcctgggcgagctgggtggcaagctcctcccctattttgctatatatag

SEQ ID NO: 29816 - DNA, 408 bp, Glycine max
  Peptide Sequence Number=SeqID_146594
atggctcaagctggagaaattcttcatgacaaaatcaatctccaacaagttgttgaaacaaaatctatttggcctccacatgaaagaagatcaagatcttgcaatgattttgttagcgcctcccccccccccccaaaacaccctcatatgagaattgtgagttctctaagtattggaaaaggttgtatcacacttgaagaagccaagtctagtctctactcaagaaaacttcgacacaaagcatctgaaatgaataagaggaaaaggaaaggatttaagaaggacaaagttgatgcaaaggatatatgtaattattgcaaaaacttggtcattggaagaaagattgtcccaagaaataacctattatgggcattggtcaaaatgactcctcatcagaaaatgatttag

SEQ ID NO: 29817 - DNA, 237 bp, Glycine max
  Peptide Sequence Number=SeqID_146595
atggttgttatgttgtatttgtttccaatatcttccttagggcaagaggattacaacaggctgaggcccttgagctacaggggggcagatgtctttgtcttggctttttctttagttagtcgcgcgagctatgagaatgtgctgaagaagatttctcttttgttctctaatttgtatgccctgcccagtggatccctgaactccagcattttgcccctggcatcccgttggtgttag

SEQ ID NO: 29818 - DNA, 507 bp, Glycine max
  Peptide Sequence Number=SeqID_146596
atgtctagatatgaagtacttactccttcgtactccctccaaggaggcttccccgtgaacatttcaataattgtacagcccaaaatccaaatatcaacaacaaaagcaaggactcttaaggccgagggtgaaggtgtcgttagggttgaagaattactggtcgtcgggatcggaagggtcagcgtcagatcagatctcaatgatgatgcagttggtctcctcgaggagattttggctgatgacgttgtcatcgaaggagccaaggttgacaccgatggtgccacagaggacgaggatgatcttgatgctgttgaaggacttctggatttggcagtcgtagggaagcacattgttgctacggctttgtgtgttagaggtccgcaagcccacgctggtgctgccctcacaatggagcccaatgaatcctcatgtgtcgttaggtcgagtcttgaactccaaaggtcacctttggccgctgttacaaaagtagtcagggttgtgctataa

SEQ ID NO: 29819 - DNA, 948 bp, Glycine max
  Peptide Sequence Number=SeqID_146597
atgagtaatagcgcactaaaaccgttaaagaaacccaacgagggtttatctcaccatggcgaaaggctgactcggattcacatctcatcgggagtaaatatgattacgctgtggggcaggaataattcgaccaacgttaagaaagtgctctggacgctggaagagctggatttaccgttcaatcaaatcatggctggcatggcgttcggcgtgaacaaagaggccgactatctggctatgaacccgaacggcctggtgccgctgctgcgcgatgatgaaacagacgcgacgctttgggagtccaacaccattgtccgttacctcgccgcccagtacggtcagggacgcctgtgggttgaaaacccggcccggcgcgcccagggcgaaaagtggatggactgggcaaaccagacgctgtccccgacccaccgcgtgatcctgatggggcttatccgcacgccggaagctgaacgcgactatcccgcgattcacgccgcgcaggatgcctgcgaaaatctgtttgcgatgatggatgacgagctggcgaagcacgcctggttctccggcgaggcgttcggcacaggcgatatcgccgtggcgccgttcgtctggaacctgaccaacatgggtctgaagtggacgccgcgccctcaccttgagcgctggcttaaacagctgagcgatcgcccggcttaccgtaacgtcgtgatgatcccgttgcccgtccgtctcgtcggtcaggacatacagatacccatccggccccacccgcacgtcgcgaatacgctggtcccggtcgcccagaatgcgcccgtcctccgtcaccttgtttccctccacgctcagcacgatcacgtccttctccttcagcgcgccgataaacagcttgtttttccactgcgggaaaacgtcgctgttgtagaacgccatgccgctcaccgcgggtga

SEQ ID NO: 29820 - DNA, 192 bp, Glycine max
  Peptide Sequence Number=SeqID_146598
gtctctgctatgacacaaaccaagcaacgaggcggtgccgggaactttgcagaggacccggagcgcgccagggaagccggtagcgcgggcggcaaagtcagtgggggcaatttcaggaacgatcctgagagagccagggaagctggaagaaaaggaggtcaaaaaagccgtcgcccctctaagcagaagtaa

SEQ ID NO: 29821 - DNA, 384 bp, Glycine max
  Peptide Sequence Number=SeqID_146599
atgaagaaaatgaaggcacatggtgtttgtggaggcttatgctgcataggggcaacttcaggaatcaaggcaggtctagccttgtcacaaatccactcctcaaggagaagaggtcagaggaggcgccatccactagagaataagccatggaaggagaagcttcaccaccaagagagtgccttggataagaagcttagagaggaagcttcaatggaggaagagaatgagagagagagagataggagggggggcatggaaattgaaggagaagaggcagagaagttgaattttgaagtgaggctcacaagtttctcattcatcaaagttatgacaagtgttacgcatgcttctatttatagcctagcacatgggaagcttccttga

SEQ ID NO: 29822 - DNA, 354 bp, Glycine max
  Peptide Sequence Number=SeqID_146600
gcggagataccttatggtcatccgcgcctttcgtcaaccaaggggaaagacttcgacggtatcaggatgatgttggccggacgatcaggtgcgatggaaaagggaagtaacatggttgttcagccttgtcgttttcaagacgctgaaaagtcgaagggaagcattgttgcgcaatccgtaaagttccgcaacattccagaagtcaaagaaggggttgttgcgggtatgcaaatagcgatcaggcccacttgggccttcaaggatgttccaacagaaggcggtgccttctggtggaagcaacccagctcacctaggcgagttgagcggcaaccacctccctcttttcccctataa

SEQ ID NO: 29823 - DNA, 186 bp, Glycine max
  Peptide Sequence Number=SeqID_146601
atgtcatatggacacactaagcgtagctgtgcgctaagcgcaccatacaaaactgccaaaaattataagatgaacgcgataagcccatctgtctctctaagcacgttcatcttttctgttcagttatccgttgaactcgcgaagcgcagctatgcgctaagcgagtattgtgtattagacacttag

SEQ ID NO: 29824 - DNA, 399 bp, Glycine max
  Peptide Sequence Number=SeqID_146602
atgtcagccttatgtaaagcctccaagctacacattgttcaatggagtgcctcgggacgccaccatgtaggcgcatgtagcgttaggattgtaccatcggggaaatggaggttgataaacccttcccaggctcactactgccagttggctgctgagtttcctttctgggaaattcctcagcgggttggtgtttatgttgggattgggagttgcatttggtctgggttgtataggaaatggattttgtgggtgatgttggggaggtctctgcggttagttaggtgctctaggtcggaggggcgttgggtagggaggaggaccgatattggccgagtagtggtactgattgttgcctttgatcttgatgataagattactaatcaacttactaaggattga

SEQ ID NO: 29825 - DNA, 162 bp, Glycine max
  Peptide Sequence Number=SeqID_146603
atggtggtaaccatcagaatgaccactgttcagcacctggtgattgtcaataaaaagaggaggctcattatctacagaatcaagctagacctcaacagagcttccaaggaaattaccaaggctacaaaggggtctaccataaccgcaagctcaaccagatag

SEQ ID NO: 29826 - DNA, 1264 bp, Glycine max
  Peptide Sequence Number=SeqID_146604
atgcgccagcaccttctgcgtctggctgcccagcaccacggcggccatgccgcggcggccgtgcgaagccatggcgatcaggtcgcagtggcgctcgcgggccgcgtcgatgatggcctggtacggatcttcgtgggtggcgcgcagcgtttcgcaaggcacgccggcttcgcgcgcctgggtggcggccgcgctcaagaggcgttcggcctgggcgcggatctggtcctggtactcgcccaggctgtgggccacctgcgccgcgcccatggcgaagacgtggaagggttcctcgaccgtgaggatggtggccttggcgcccagcgacctggccagctcgaggctttcgaccagggcttccgaggacaattgcgagccgtccgtgggaatgagaatgtgcttgtacatggtgtctcccgtgtttgtgcggcggccgccgcgacttgcggcggctacgtaacactgtatcgggcgggagacggacgccgtttgcgcgtaatcaagggttgcgcgcggtcaaaccgccacgcgtggcgccgcgtgctcgtccatcagcgcgcaggcgcggtcgacgtcgccggcgcgagcggcttcgatgaaggcgtggtgctcgcgcgaggaacaactggcgtcgtgcgagctctggtacagcacggtgatcacggcgctgcgcgccgacagctcgcgcagcatgccggtcagcaccgagttgccgacggcctcggccagcaggatgtggaagtcacccagcaggcggttgcgcgcctgcacgtcgccgctttccacggccgcgcgttcctcggccaggtgggcgtcgatgcggcggtagtcggccgccgtggcgcgggtgacgaactcccgcgccagcgcggcttcgaggatgcggcgcaccgcgtagacctcgcgcgcctcgttggcgtcgggcttgctgacgaaggcgcccttgtcgggcacgatgttgatcagcttgtccttggacagcatcagcagggcggcgcggatcttggtccggctgaccttgtagacgcgtgccagggcctcttcgcgcaagcgggtgccgggcggcaggcggtgcgccacgatggcggcggcgacttccttggcgatgtcgtcggcgctggggtcgggaggtactgcctgggtcatgaagcgcgggggcgggaagacggtatgggcagccagtctatcaaaaacccgcgcacgcaacatttattgcatacgaaaattgttggcgaaccggccttccgcgcgcccggtggagccg

SEQ ID NO: 29827 - DNA, 330 bp, Glycine max
  Peptide Sequence Number=SeqID_146605
atggacccggaggagcccaacagggccctttccagctctggttacgggcctctgtcagtcctacagggtgcccgtccccctcaggatcgcacccgcaagacacctagtggacccgaagaagtccaacagggtcctaggttctacggagtgcctgtcgcccccagcaagttcatcaagccccctattaaccgggctttcatcaagaagtactacgccccgaggcaggcacagggcgagacaccacaacagcctagggatggccggcaacgggcaacaaatgcactgccaccacttctagagttcaccttagctcatccacgaaaaggttag

SEQ ID NO: 29828 - DNA, 351 bp, Glycine max
  Peptide Sequence Number=SeqID_146606
atggctgaagaaggacgcactccctccacaagacgagcgtactccttctcctcctccttagaattaaattgtcatcataaaaaaggaggagattgtagaagcaaagactttgcctttgatgttttgatgatgccatatgatcatgatgttttgatgccttatgaaaatgcacttttcaagtttaattcaagacaaaaatccaagaataacggatacaacaacaagaagatctctagtgttttaggaagggaattccaaattgaaactgcaaaaggtttggccaagaaatttaagcaaaaatgtctttttcaagagatttactctctggtaatcgattaccagaggatgtaa

SEQ ID NO: 29829 - DNA, 165 bp, Glycine max
  Peptide Sequence Number=SeqID_146607
atgtcgcaaaactttatggattgcttaacgatgggtgtcaagttcctcgaagcggttaagcgaaggttgcatgccatcaaacaatggtccccggacgaaattagggagccgattgggaaaataacaaaaattgtattttcccctcaccgggggctccgtacttga

SEQ ID NO: 29830 - DNA, 324 bp, Glycine max
  Peptide Sequence Number=SeqID_146608
atgggagcaagagaaagcaagttaaggaaatgggtgatgagtggtggaagtgcttattataagcgcttagaaggcactctattggtacctaagggttatgttccaatatgtgttggcaaaactgatgatacttgcaagcggtttatggttcacactagagcacttcgtgatgcatatttcaaagagctgctgggtaggtctgctgaggaatatggttttaagaatgaaggggttctgaggatccaattcgaagctcaagattttgaagaatggttgatcaaaaggtccaattccaatgagaagattacaaatgagagcacttaa

SEQ ID NO: 29831 - DNA, 699 bp, Glycine max
  Peptide Sequence Number=SeqID_146609
ttcattttccatgtcttcaaaattagagatgagacgaacctcatactagttgctccctttagggacctatgcaacatgggagggatgcacgattggctcgtcaattatttttccaagtcaaaaaccattgtggtccctatgcctttcaccacttatacttacattgctgatcctgctaatgtagaacatgtgcttaagaccaacttcaacaattatccaaaggaattgttgatgagaatgactttagactccatatgtaaggttggatttggagtggaaattggaacattggctcccaatttaccagagaatagctatgctcatgcctttgacactgcaaatatcatagtaacacttcgcttcatcgatccacttaggaaaattaagaaaatgctaagtataggatcagaagtacaacttgaaaagagtatcaaagtcattgatgatttcacttactcggtgaagcaagatatattatcaagattcatagaactaggagaaagcaatgcaacagacaagagtttgaaagatgttgtgttgaactttgcgattgctggtcgagacacaactgcaccaaccttatcatgggccatatacatgtttatgacacatgctcatgttgctgacaaactttacttggagctaaaaaaatttgaggagaatcgagcaaacgaagaacatttccttgcgtcaatgtga

SEQ ID NO: 29832 - DNA, 420 bp, Glycine max
  Peptide Sequence Number=SeqID_146610
atgagcttcactaaggatcccaagggcatcttagaggatgatgtattgccagatggaaccaaaataaaggcagggggcatggtaacttatgttccatactctgtgggaaggatggagtataattggggtcctgatgcagcttcatttgtacctgagaggtggttcaaggatagagttctaaaaactgaatctccattcaaattcactgcttttcaggcaggaccaaggaatatgccttggcaaggactctgcatatcttcagatgaggatggggctagctattttgtgcagattttacaagttcaacttggtgccagatcatgtagtgaaatacaggatgatgactatactatcaatggcatatggtttgaaacttaccatagagagacgttcttgagatgctttcaggaatacacttga

SEQ ID NO: 29833 - DNA, 420 bp, Glycine max
  Peptide Sequence Number=SeqID_146611
atgaggatgaacgcctatgaatcatccaagatctataagcaaaagataaaggcgtatcatgacaagaagctacagagacagaactcccaaccaggccaacaagtcttgctcttcaattccagactcaggctatttccaggaaagctaaagtcaaaatggtcagggccgttcgtgatcaaagaagtaagaccccatggatttgtagaattggtggaccctacaacacatacaccggagaaaagatggatcgtcaatggggaacgcttaaaaatttacaatggaggccagttagaaagattaacaagattttgtttagggtcttcacaaactatcagtccacctgaggatggatccaccgctgttgaccctagaggccttcatctagcaggttgcttggccaggagtccaaccctctactga

SEQ ID NO: 29834 - DNA, 180 bp, Glycine max
  Peptide Sequence Number=SeqID_146612
atggaagagaaggaagaattccctaagggagagttctcagtgcgggtgcctgtattcgtgcttagcgcatgcacatgtgcctgtatttgcgcttatcacgcctcttcctcgcctagcgccaatgcttgttttcgtggtgagtgcacgctgcgcgctgaacgcatcttgggttgggcttga

SEQ ID NO: 29835 - DNA, 1897 bp, Glycine max
  Peptide Sequence Number=SeqID_146613
tgatgcactgaatagcttcttatgtctcagatatgaacggtttgttgttgcacttgaagaagcatcacgagacatgctacctgctctaaaaaacaaggcattaaaggccgtatacgtgctactgagtcggaagtcagagcaagaacgtagactactttctgcacttgtcaataaacttggggatccagataataaggcagcatctaatgctgactttcacttgtccaaccttttgtctgaccacccaaacatgaaggctgtggttattgacgaggtggattcttttctctttcggcctcatttaggacctcgttcacagtaccatgctgttaacttcttgagccaaattcgtctcacaaataaaggagatggaccaaaagtggcgaaacgtcttatagatgtatattttgcattgtttaagggagtgaatagagcatttccctttgtctcaagtaatgaagctgatgacattgttgacattcaaacgccagcagaaatgttcattgcacttcttctcagagcaatgaaaagggatattaatttaaagcgcgtggctgcattttctaaacgtctattgcagattgcacttcagcagccaccacaatatgcctgcgcatgtcttttccttctttctgaactccttaaagccagaccacctttatggaacatggtgttgcagaacgagtctgttgatgaggaacttgaacactttgaagatgttatagaaactgataatgagcctagcactgtatcaactaaacaaaatgatgatattggagttgttcagaatggtgaggatggcaattctgactccagttcttctgaaagtgaagatgatcttccagcatcttctgaagatgatgatttggatgatgatgcttcagaggatgcagattttttgcttgcaaagaatgaaaaagaacataagaaaccaaaaaaatcaaaatctgtatctgataaagaaggtcagcagtcacaattatctgtcaagaagtcttcccttcctggaggctatgatccacgacacagagagcctttgtactgcaatgcagaccgtgtaagttggtgggagttaatggtgcttgcttcacatgcacacccttcggttgctactatggccaaaactcttctttctggggccaacattgtctataacggaaatcccttaaatgacctctctatgactgctttcctggacaaattcatggagaagaaagcgaaacgaagcacatggcatggtggttctcagattgaacctgccaagcagatggatgttaacaaccaattgattggagcagaaattcttttactagctgaggaagatgtacctcctgaggatcttgtcttccacaagttctacacaaacaaaatgagttcctctactaaaccgaagaaaaagaaaaagaagtcagctgatgaggaagcagctgaggagttgtttgatgttgatgatggtgaggttgatggaggggatgagagtgacaatgaagagattgagaacctgttggattctactgatccaactttaggaccagacagtgactatgattatgatgatttggatgaagtagctgatgaggaagatgaggacttgattggtgatgttagtgatgcagagatgaatatggatataccctctgatatggaagaggaagaggttgatgcttctccacctgatgatgatgacattgatattcaggttggagatgttgatgatgcctctgatggtgatgaggaggaagctggcaaaagaaaacgaaagcatgaaagtggtggtaagaaaggtgtatctccatttgctagttatgaagagtttgagcatctaatggaagatgatgaccatgctgagaagaaatcttatcccaagaaaaccaagtctaagaaaagaaaaggttaa

SEQ ID NO: 29836 - DNA, 255 bp, Glycine max
  Peptide Sequence Number=SeqID_146614
atgcctgttgttgattgtatggacataatcagcagggaggaagatttgcccctaaaatatatgcagcagaatcactaccccgtacaatacacatcatcttctgcaagcagaaaatctatggtgtccattcaaataaaaactttgaacgaaaaggcttggcttaaattgaaggtggtgccagcaacagcaagcacaggcctaatcagtgggaataggagctactggaccactggctggtatgtgaaatatacttga

SEQ ID NO: 29837 - DNA, 522 bp, Glycine max
  Peptide Sequence Number=SeqID_146615
atgacgaagaatcaaagtttgcattgttgtgagaagatgagcagagttggtgctgatgttttgaacgtggacttggctgctgcagtgaacaacctcttcaatcttcctgaaaccatgcagaagttcatttttccttcttctcgtgctcctgatcaacatgagaccagagggatttctagcatcattccagtggacattttggacacttccaaggagtatatattcttcatggatgttcctggtctctccaagtctgaaattcaggtgatcgttgaagatgagaacacacttgttatacgaagcaatgggaaaaggaagcgtcaagatggagaggatgaagagtgcaagtatcttaggttggagaggagaggtcctcagaatttgctgaggaagttccgtttgcctgagaatgctaatgtgtcagccattacagctaaatgtgaaaatggggttctggctgtggttgttgagaagcaccctcctccaccaaaatcaaaaactgttgaagttgccattgcttga

SEQ ID NO: 29838 - DNA, 309 bp, Glycine max
  Peptide Sequence Number=SeqID_146616
atgcggttgtacatcgaagaaaatcctccccgcctggttgccctaggaagagtttatgagggattcacaaccgttcacaacatccctttgttgcatgatcaagtgaaggtcagtgttgaggaggttaaaggtgcagatgctcccattcctgtacccactgacaaggttatgtgggatgctaccatgtttgtggtgtttaatgaagactttcccttgtacataaagaatgaagatctgcctaaaatagacacggtggttaatgtctcagcatctctatcatacagttgtggattcagtaagtcaatttag

SEQ ID NO: 29839 - DNA, 249 bp, Glycine max
  Peptide Sequence Number=SeqID_146617
atgaagaactggatgcagaattcaaaacgggatgtctacctaggagcctaccaaaatgggacaaacaactaccttaaaggaataattaacagcaacatcaatattttaatgttccctgtattcagcagtgctttgaaacgacttgacgatactccacaacctaaatccaaggctggtgctaggtggattgttgttaagtgcaatagacaaaaaggaagcactgagtgtggctattccttgatgcactag

SEQ ID NO: 29840 - DNA, 234 bp, Glycine max
  Peptide Sequence Number=SeqID_146618
atggataacttaatttctaacacaaacggctataccaaagatatcctcttggtcgtggcttttttggcggcaaaggagttgcggaaaatgcctgcaataagctccctgaaagcacatccacgctttcaagccgagaacaagaatatatataaacgaattgaaggccttgttaagaagcatcaggccattcctgctcagttggcattagcatgggtacttcagcaaggcgactaa

SEQ ID NO: 29841 - DNA, 2361 bp, Glycine max
  Peptide Sequence Number=SeqID_146619
atggctaccactggaatttcatcttctgagtggcgtaagctctccccgggtgttaccacggccttggcatcggcttttctcgaatggttgctgatctttttcctgtttatcgatgccgttttttcttatgttatagcaaagtttgctggttactgcaaattgcaaataccgtgcctgttgtgctcaaggcttgatcatgtgttaggcaaggaggacttgatttgtagtggtcataagacggagatttcttctttagtcctttgtcgtgcacatgataagcttgtaaatgttcaaggaatgtgtgaaagttgcctcttctcttttgctaccatcaacaaatccaatgctgaaacttacaggttattggtgggtaaattaggggagggatctgtgaccagattcgatcaggatccattacttggtgaaaattcaaagtgctgttcttgttgtaatgagcaatgggttttaaaaggttatgatcgaaggttggtaattaccaagtcaattgggtctggcaatgctgattttgatgaatcaaacgttgttggaaacaaatttcacaagaaaagaagagctaaaccatttgtatcatccagagctacacaccttagaaataaacaggcagatcctttgtctcatgtcggttacactgagctaaagattacttcggatactgagtctgaaccggatgtttccttatctgatgatgatggtacgagcataccagttcagggtacatatgacaccaaggaagatatagaagttccatgtgaacatatggagcctcacatccccgattcaaatgagaatttggcttttgagaagctagggacttcagcttctggacttcagccatcgttatcagagtcaggaatgcaattagaaaatacagatgttcatggcactaaatctacagcagaaacaacagaaagtagagatggcttggccaaacttgattctcagcagcatgttgagagaaatgctgtttgtgcttccccaagagagcttatttcctttaatgaagtccctgcatcatcaaataaaataggagttcctgttgaagtatcaaaggaaaactatgatttgacaactgatgaagtagggacaaaatctaaacaaagaataaccacagactgtggggaaataattgagtcagttgataagctgacaacatctgaagcaggtttagagtcaacccccttttctagtgatattggtcagcaaaatcccaatttactagatcttggtgatgcctataagcttgctgtcagtaacagcagaggaagacctggcatgcctgtagaacattggcttggaaaggattctacaagaattagtgaagatttgaagatattgctgtcacaattttcagctactcgagggactgatctgtctgttaatgatatcagtcctagattgtctataaacagtgatgaagtgaagacttctgatgtttctaactctgctggaatccagatacttcaaaaaatgatttcacttgagcgaaatgaatatggtttgtctctagatggaagccttgttagtgaaattgaaggtgaaagcgcagtcgacaggctaaaaagacaagttgaccatgacaggaaacttaatgctttgtataaagagctggaggaagaaagaaatgcttctgcagttgctgcaaatcaagcattagccatgatcacagggctgcaggaagaaaaggcaacattacatatggaagccttgcaatacttaagaatgatggatgaggagtctgagtatgaaacagaagctttgcaaaaagctaattgccttcttgttgagaaggagaaagagatagaagagttggaagctaagcttgagttatataggaagaagttccctgatgaatcagtgctggaaagcatggtggatacaaactctgaaatgaaggatgaaagtatccttggaaagtcagtttctgaaaatactaatatatctgacaaatctgaagttctacccacatctctggaaaaacagaatgttcaatctgtaaaaaattcaccattggagtttcaagatgaaaggttatatatttcccaacgtttgaagaagttggagaagcaagtttactttttcctgaatattcatcaatctcgggataattggctaaattctgaaaacgatgaaaaggaatctctggaaaattgtgagaagttggataataatattctaatgcaagaaactgtttgttctcctaaattaaattcagatgacatgggtgatgattcctcatccaaggaacctccagtttgcaagcaaaatggtgaacttggatacaatggacatagctcccctgcgctctgtaggaataatgatttatcttctactggtagtttg

SEQ ID NO: 29842 - DNA, 1335 bp, Glycine max
  Peptide Sequence Number=SeqID_146620
atggctaaccatgatttgatacttggccaaagtcataatttagcacttggccatgaccagcaactgatgctgaaccataatcatagtttgggcctcagcgggaaccatgatttggaattgagacgaactgatgatcaacatttgggtctggaacaaactcatgatcatgaaccggtcttaggaattgtcaatgaccatgaattggatttagggttaaaccatgatgatgaaggagttcacacatatgggcatgagaatgagttatcaatggatcaaaaacctgagcatgatgaccatgagatgcccattcccacacaaaatcatgacttggacataccagagaacaatgatttggctgtttcagaaaatcaggaatttgatgagaacatggccctgactgtggtccagaacccggaaatgagtattgaatctgctgaagcaatcggtttccatgaatcccagcttatggttaccacaccccctgtaattcaagctcgtacattagctattagtcccaattatgaattgtcagtgggacaagaattccctgatgttaggagttgccggagggcattgagggatacggcaattgctctgcactttgagatgcagactatcaaatctgacaagacccgctttactgctaaatgccaaagtgaaggatgtccctggcgcattcatgcagcgaagctccccggggttccaacttttactatcaggacagtccatgagagtcatacatgtggaggaatttcacatcttggccatcaacaagcctcagttcaatgggttgctacctctgtggagcaaaggctaaaggagaaccctaattgcaagccaaaggagatattggaagaaattcatagggttcatggcatcactttgtcatacaagcaagcatggagaggtaaggagcgtatcatggctgcaatgcgtggatcttttgaagagggataccgcttgcttccacagtacattgaacaagtgaaacgcacaaaccctggcagtattgcatctgtttatgcaaaccctactgataattgcttccaacgcctcttcatatcctttcaagcatcaatatatgggtttttaaatgcttgtcgaccacttttggagcttgatagaatatatttgaagagcaagtatcttggtacattacttcttgctactggatttgatggtgatggggctctctttcctttggcatttggtgttgttgatgaggagaatgatgataattggatgtggtttctgtctgaacttcataacctgctggagattaacactgaaaacatgccaaggcttacaattttgtccaacagacagaagggaatt

SEQ ID NO: 29843 - DNA, 438 bp, Glycine max
  Peptide Sequence Number=SeqID_146621
atgttgcagaggctcttgatcgtgcacggacacaccaggacccgttgctgtcaatgtcgtgggtggcagctgtatggcttgccttgtgcacatgctgtggctgcgcttctgtctattaggcagaatgtgcatagattcacagaaagctgttttacagttgcaacctataggaagacatactcacagaccatacatccaattcctgataagtctctgtggaaggagttgtctgaggctgagggggatgtcaatgcttccaatgctgatcaacttcaacttcaaattgctatgaaccctcctaaatcactcaggccaccgggtcgacctagaaagaagcgggttcgtgctgaagaccgtggccgtgtaaaacgagtcgtgcattgtagtcgttgtaatcaaacaggtcactttagaaccacctgtgcagctcccatctaa

SEQ ID NO: 29844 - DNA, 1269 bp, Glycine max
  Peptide Sequence Number=SeqID_146622
atggctgaagtggatcagtacacgggcggtgagcatgaggttgaggaaacgattgaggttgaggcggaggaagaaatgcacggtggtgaagaggcggttgttgttgcggagaagaagtggccgggttggcccggggagagtgtgtttcggatgttagttcctgcgcagaaggttgggggtatcattggacgcaaaggagagttcattaagaaaattgtcgaggagacacgagctcgcgttaaaattcttgatggtcctcccggaactgtgcaaagggctgtaatgatatcagctaaagaggaacctggttcctctgttcctcctgctgtggatggcttattaagggttcataagcggattattgatggtttagagagtgattttacccatgctccttcaggtgtggcggggaaggtttctacaaaacttctagtgccagcctcacaagcaggaagtttgattgggaagcaaggagggactgtaaaatctatccaagaagcatccaattgtattgttagagttcttggagcaggtaaggttgagctttttgcactgtgtactacagctgtaatagagcacaatctggacatgcttttaagcgattcactgttgctaaccatctgcatggctttctcttctgcagaagacctccctatttttgcccttcaagatgacagggtggttgaagtagtaggggatcccactggagtgcataaggcattagagttaattgcctcccacctaaggaagtttttagttgatcgcggtgtaattccaatttttgaaatgaatatgcaaacagctaatacccaccatgcggagcacatgccaccccaccaatcttggggtccacctcagggtcttcctccaaatgttggtggaggttctggttttggacctccttctcaatacatgccacctccacgacaacttgatagttattatccaccagctgaaatgcctcctccagtggacagacagccccatcaaggtatatctgcttatggaagagatgcttcaataggtgttcatgcatcttcaaatactcaatctgcaccttccattgtcacacagatcacgcagcaaatgcaaattcctctatcttatgctgatgctgttattggaacagctggagcaagtataagctacatcagacgagctagtggggctactgttaccatacaagaagcaagaggtgttcctggggagatgacagttgaaatcagtggaactgcttctcaagtccaaacagcacagcaactaatacag

SEQ ID NO: 29845 - DNA, 917 bp, Glycine max
  Peptide Sequence Number=SeqID_146623
tgcatagaaggcctgatgttcatatcaaaactgcaattaacaagaaattaaacacgactgctgatgggaaagttcctaaaactgcaccccagtggcttgaactgaagactcacgttcaacgcggaggctatgagtgtgggtattatgtgatgcattggatgtggaacataattggcgcgaagttgaagagtgattggaatgtggtgctatcttcatgtatgagaggtcgcaaacatacagtagttactgcagagaccatcaagggtaggctcttgatggaaatgaattatatgctagcatatggttctgggaaagcttctttgaggctattatggaattccggtagcctagatatacttctcccctttgaggctgcttatttgctcaacatggatttcaaagacaggatagaagaaccaatatgcttctggcagcaaccttatcgttgcaccaagtctcacactctttcagtgcctgtcactggtctatggacaattcatttttctttttgggatctagaactaaaacctgagaatgggtcagggggaatgggaataaagattgggtggacaaagctaagtacatcgggaatctatgttttcagggttggtatcctagcattacataaagcattgagtgatcgactaagggaccctttggcagttgctgcgtttagccttgcagtccataatggtggaaatttgttggaagcgataaacataacagggatgatcaacaaaccacatgatgccagatttcctgaattattagatccttcaggtctggatgctgaggcattggaagctgagattctggatcttgctgagtctgttagagggacaatattgcagatgacaaatgagcattttgtgtctcaggctatggctgactatcctcaatcccctcgttcgaatctg

SEQ ID NO: 29846 - DNA, 486 bp, Glycine max
  Peptide Sequence Number=SeqID_146624
atgggaagggaagttactggcatacaggttatggaaaagaagccaaatggtgccataggggcttcaaatggcagtttaagtgatagaatgcgtgtttctcccaaaattgcggcaatggttcaagcaatggatcatgagataaaggaatctgctgaagctaattcgtttgagaaacatcatgagaggaaagatgttttgagtgccaaaaacatgaaattaaatgctggcttgccagaagaggagaatgagaaatctgatcaggttccaagcccctctgctccacagccatctgatcaggttactgaaaagcatgtcacccacgcacaggctgttgatactgaagctgacgcaagtggtctgaacttatctcctaaagctaacaatatacactcgcctaattcctctaagaattcacagactggaagggaacgaccgctgaagtgggtgccaccagggaagacttccaacgtctgcttggagaattaa

SEQ ID NO: 29847 - DNA, 687 bp, Glycine max
  Peptide Sequence Number=SeqID_146625
atgaaaaaggagcgagtcctctccctgcctctcccgctccgctcgtctctacttcctcttcctcttctctgcttgtttctagtgacaattaagttcgtcgttgaaaaagtgattaactacagtggggttatttcaccacaagcaaagcacattgacccagaaatggcgatgtcacaactgcaaacaagcacaatagatatgttagatttggcagttgagtacattaagaacctgcaacaagtggtgaatgtttccatatcttcaagggacagttattgcattgatgttgttcttcgttgcttagcaataactgatgatggacttgaaccccatcatctcaatgatggtggtattcttggcaccatcatggctgctggctttaaaggtaccatcacaggtgagcttcctcggtttcaagctggagttacaatggaaatatcctgtttggatgcttggtattctgacaaagatggcaccttagagtgccgagcaacatacatcgtgaaaggactttgtcgtaggtgctgtctcccagaagtcattcttcgttgcatgcaagtttctgtttctctaatgggatcgggagtcctgcctgattgtcatgatactttgatagagctggttggcagtcctgaaactgactttcttcacttgtttagtcaacagcaattacaggcaagattataa

SEQ ID NO: 29848 - DNA, 1407 bp, Glycine max
  Peptide Sequence Number=SeqID_146626
atgcagaatcacaggctgaagcagcagcaacaagctctgatgcagcaagctcttctccaacaacagtctctctaccaccctggtctccttgctcctcctcaggtaactgagccgcttttgcaagaagtttttgcgggtactggcccagttgaagcttgtaagcttatcagaaaggataagtcatcctatggattcattcattactttgatcgcagatctgctgctcttgccatattatctctcaatggaaggcatctatttgggcagcctatcaaagttaattgggcatatgcgagtggtcagagagaggatacgtcaggtcattacaacatttttgttggcgatctaagtcctgaggttactgatgctacgctagatgctagggttatgtgggatcagaagactgggcgttcaaggggatttggatttgtttcattccgtaatcaacaggatgcacaaagtgctataaatgatttgactggtaagaaatttgttattggcttaacaaccttagatggtaagtggcttggaagtagacaaatacgctgtaactgggcaacaaaaggtgctggtggtactgaagagaagcaaaactcagatgcaaaaagtgtggtggaactaacgtatggctcatctgatggtaaagagacctctaacagtgatgctcctgagaacaatcctcagtatactacggtttatgtgggtaaccttgctccggagttgtgccttggtgacttgttggtcatgggttcgaatccggaaacagcctctttgcatatgcaaggggcgagccctggtgcagcggtaaagttgtgccttggtgacttgttggtcatgggttcgaatccggaaacagcctctttgcatatgcaaggggcgagccctggtgcagcggctgcgtacaacatccctcccccataccttcgcatagcgaagagcctctgggcaatggggtacgaagcaactcaacttgatctccatcaccacttccattctcttggagctggagtgattgaggaggttcgtgtccagcgtgataaagggtttggttttgtgaggtacagtactcatgctgaagcagctctagccattcagatgggaaatgcccagtctcttctctgtggaaaacaaattaagtgctcttgggggagcaagcccactccagccggaactgcttcaaatccccttcccccacctgctgctgcatctttgcctggcctctctgcaactgatcttttggtgtatgagcgacagctagcaatgagcaagatgggcggcgtccatgctttgatgcatccccaagggcaacatcctcttaaacaagcagctattggagctagccaggcaatatatgatggtgggttccagaatgttgcagctgcacagcaaatgatgtactaccaataa

SEQ ID NO: 29849 - DNA, 945 bp, Glycine max
  Peptide Sequence Number=SeqID_146627
atggtgatgctcatccgttgctcttgcttcttcgctcgccctcgcttctcacaacctcaattctacggcaacaacaccaaacccttactcccagggaaattagcttttctttctctaaaacctgacaagggtgttccacactttgaagatacgcttgatgggtcttctaagatttcatgtttgctgcactgctcaaagtgtaaggaagacatacaccaaaggttcccatcactgatatttgttgcgagcaatgttttgatgttctctatgcctaacacagctttggctgaaacgtgtgaggctgataactctgttttcaatatgcctatactgctggcagtagcactcattggagccacagttggagggttgcttgctcgacaaagaaggaatgaattacagcgggtaaacgagcaattgatccaaatcaatgcagctttacggaagcaagccaaaattgagtcctatgcacctagtttgagttatgctcccattggtggtggtaggatacttgataatgaaattattgttgacccaaagaagcaagagctaatttctaagttgaaaaatggaaagaactttctaaggaatcaacaaccagataaagcattcacggagtttaagaatgcacttgagcttgcccagaatctgaaggatcctattgaagagaaaaaagctgctagaggcctaggattttacaaggtgctccatgaatacacaattgaaatgttgcatattacaggagcctcactgcaaagacagggaaagtaccgagacgctattaaataccattctatggttttgggcatctcggaacgggaaggagaggactcaggcagtacagaagcatttggtgcaattgctgattgttacactgagcttggagagcttgagaaagcaggccaattctatgacaagtatattgcaagactggaaaaggactaa

SEQ ID NO: 29850 - DNA, 108 bp, Glycine max
  Peptide Sequence Number=SeqID_146628
atgggggtctctttcaaggtgtccaaaaccggcactaggtttcgccccaagtcgattccccaacttcaagatggctcatccgacaattccaagtcccagccgatatga

SEQ ID NO: 29851 - DNA, 816 bp, Glycine max
  Peptide Sequence Number=SeqID_146629
atggccaaaaacagtactaccttaagtgcctgcctagaaggagaagcttcggcaatttcaaggttaaataataatgcttttcccaaaatgcttcacgagctagagaaacagctaaagggattcaaatactcaattaccgagttatatggtgcacttactgaattaaaatatgagagtgctgctgagcattttgccaagttaatgtggagtggaaatagagatgtcactgtcactgagtatgcagagttgccactaattccaccatacttgcatcctggataccatgatcatcaatacatttatggggtgaattttgcatcttccggagctggagatttgcctgaaactaatccaggactagtgattgacctgaaaactcaagcactgtactttgcccaagttggcaagctattgaggaaaatattaggagaagagaaagccaagaaattgttgtccacagctgtctatatcttttccgtgggaaccaatgactatgcagtccctttctatacaaactccaatggcactgtggttcttccataccctcaacaaatttttatagacttagtcatttgcaacattacaacagcaattaaaggaatttacaatgaaggtggaagaaaatttgggtttgtaaatgtggctcctctgaatcgctctccgtttctaaggacatttgtaaatggaacaacaatagatgcttgtcttaaagaacaaggttctgcacttgcaaggctacacaataattctctttcccaaatcacgtcgaaagctagaaaaacaactaataaaggaattcaattactcaattcttaa

SEQ ID NO: 29852 - DNA, 216 bp, Glycine max
  Peptide Sequence Number=SeqID_146630
atggaaaattatcgcagaaaatacaaagctttggctcaatcaatgaaaaaatggggtgggtggaactgtgaaatggggtgtggtgttaccgttttgcccttgcctgtggtaaacggtaaagttgatgtttttactggcagtgctatctgcaatggtcagcatgcatcatgcatcatgtgtgcagaccacacgtgcctagcacaggttcctttttag

SEQ ID NO: 29853 - DNA, 210 bp, Glycine max
  Peptide Sequence Number=SeqID_146631
atggccactttttggatgtttccaggcttgagctcgcctaggccagcatctggcttacctgggccatggaatgccttcatccttaagcaaccagctcttctgggcgagttgataccttcagctatgaatgacagcggaatcgagaagaaagagagagaggagacaccacttcaaggagaagatgagtctagaagaaactcaccaccatag

SEQ ID NO: 29854 - DNA, 345 bp, Glycine max
  Peptide Sequence Number=SeqID_146632
atggtgaaaaaaccagctcacctgggcgagctcactgcttcagggttaagtttcagctcgcctgggcgagctgcaactgtcccaaagttccaaggttcaaaagtggagagaattgagagaagaaggaaagaagaagaaacgaagctgaggcactaccgaatcgggactgtgatcgtccccacgttgtttcttgttcggtgttcttcgcaccagtcgatttttcaggagaatgatagatcttatccagcgcaagttgttgcagcccagatacgcacactgctatataaacatgaaggctgcacgagtttttccaccaagtccgggattgaagagttatttttgtga

SEQ ID NO: 29855 - DNA, 198 bp, Glycine max
  Peptide Sequence Number=SeqID_146633
atgacaacggaggcggtgaaatggtggcaacagtgtggtggttgtgatggaatggtggcaacagtgtggtggttgtggtggaatggtggcaacggtagtggcggtggcaagggcaatggtggtggtgatatggtgatggtgaaatgcaaacatacaaagacaggaggacatgtgttccgcttgtatgtattagggtga

SEQ ID NO: 29856 - DNA, 258 bp, Glycine max
  Peptide Sequence Number=SeqID_146634
agtgatcttgttgaggctggtgaaaacattgctcagattccccagtcatctgtttcatctgaaactctttcattagcagatagggaagcttctttcacattgaacctgtttccagatggttattctattggaaaaccctccgagaatgaagcagctagtcagtcaaaataccaagattttcccaagtcgttacatccatatgacaggtcgtctgagagtctattcttggtaattgtcttggaagttggaactctatag

SEQ ID NO: 29857 - DNA, 1503 bp, Glycine max
  Peptide Sequence Number=SeqID_146635
atggcgaccaaaaatttacctatggagctgcacgaaatcaccaccgagttcgaaggatccgacccggactccgaatgggacgattcgaaagaagaccctgatttcgacttgctcgaagaaactcatagcaagttctcaatcctctcacttaagcacaaggcaaaagcgcgcgttgtcgaagataagggtctaggcgaggaggtgaatgcttctgctcatgatggagagaactttcagaaagttcaaaaattaatccaagtgggaccgttagagaaattgaaagtggatgaatgcaagttgtatctgaggaagaatggtctgaggctaactggaaacaaggatacacttatacaacgcataaaggagcatttagatattttaaatggaggggagaagaagtatccaccttcaagctttgtgttgaattgtaaaggtgatgcatgcactggtgatgttgttttgtttgagcaaaatgtctatgaaatgtttaacatagcatccaggagtgcaagtggtccaccttgtggcaaaaggattgtcgcaggccgcatagtgaaagaaagttatggtgctgctaaacaacagcatacgtttacgtgctgcggtctccatttcttgaaggatttttgttatatcccaagaaagaagcacattatccctcttggacagcagtataaagagctgcgtaacaatatgctttttctaaagattgaagtactctggagcaaaggagaaaagcctctccctcccctttaccccctactgataaagggtcgaaacctttataggttaaagactttgagacagaaatgggaggatgaagcaaaaaggcagaaaatattgatggaaaaacactcaaggggatctcttgctagggaagatagagaagcaaggatgcaagaaaaggaaaagaggaaaaaaattaaggaaaatagggtctccaaaaaggattcagcaaggaaccaaagtcaatcaaattcacacattacaaggccacaatatcaacctcaagaaacaaatgtacccattaatccagaaaagccagaatttccatctcgaaattcaggtttatctgccaacataaggaaagaaacatcctctattgtacataaaccagcagctgtaactggacaccatgttgattctaaaactttaggaagaacctcatttactgacaatatgcataatcagcaagcttggagcacaggtgactgtaggaatatttctgatattggtcacatgaggaggggagctgatcatagtgcatactacaattatggtgactcccatttcagagaaaaaccaactgttattctgaaataccaccatcattatcatcataggatgcctttggcaaatgcaaaccactctcaacaggtgctaccagatagagaaagctatgataagcaaaagcaggtgtgtagacattatgcccgtgggagatgctattatggggacaactgcaaattcttgcatgatttgagagacaaagggaatgtgtga

SEQ ID NO: 29858 - DNA, 555 bp, Glycine max
  Peptide Sequence Number=SeqID_146636
atggctaagactaggccagatgctaaagcttctgctgggaagaagaaaaaagtgctcaaaaagggaccaccttcttctcaaattgccaagcggtctcaaatacttcataggaagggtcccttctcctctcaaccagctcaagttgattacgtagctacagaggatcatctcctcacattacccaatactcattctgcggatttgcttgcacaacagttctgttcactgtttaatctgcctattgtagatggtacgcgaaggatatgtgaaggaagtgcccggatccaacttaaaccaaaccgtgtgaaccttccattgggcaatcaatctacttccccatataatgctgtagctgaaatgcaacaatatggagaagccattcctggtcaaccatccattgaagttgcaaaaccagctagtggcagtaatgcacctataaacctctctcagaatcttgtaacaaacccaaggattttgccacctggaaaccctcaagccttacagatgccccaaggacttctctctggactcacaacatgcagtacagcatgttga

SEQ ID NO: 29859 - DNA, 357 bp, Glycine max
  Peptide Sequence Number=SeqID_146637
atgctgcagattccatttatcatcattaaaaatgcgattgtttctccacttccaaatccaccacatcgaagcgatacaggtaccccaagctccactatcttgagatttaatccaagtgaggatatcctgcacaaggaaagtggatcggtgatagaacctcatgcacatcctagaaatggggacaatctcgtagacaatggagggaatcctcattgggatgggagcaatgagtgcaggcagcagaaaaggccatgttcctccgaaatctggtggtgttcgttgggagggagttatggtgaaccagccaaagcatcaatctcagcttctcaagaatttttaatttccacaaccacttaa

SEQ ID NO: 29860 - DNA, 3639 bp, Glycine max
  Peptide Sequence Number=SeqID_146638
atgtatttggaggccattgagtcaggtcacttgcctggggatattcttgatgatatacctgccaagtatgttgatggagcacttatatgtgtggtgcatgattatcgaagatgctcttctgataaagggagtagtgtgtctgcagaaagttctactgttagcaaagtatgcctcaagatgtcgttggaaaatattgtaaaggacatcccatcgattactgacaagtcttggacatatggtgatttgatggaagttgagtcgaagatactgaaagcattacaaccaaaacttcatctagaccctactccaaagttagatcggctgtgtgaaagtccacttccaacaaagctcaatttgccaagaaagcgattaaaaaatatgccagagtttgctgttacttctaccaataaaattcatgggaagaaagtatgcatagatagagtgcaagaaagctcaattagcagagtaggtgatgtaggaaacactgcatccaatgctattgtgcagcagacccatgaaaatccagccatgcaaaatcttagtccaaatgttgccatggccttgagatctaagaattttatacctgattcttccatccctaactttcctatgatgacccatcaatcaagatatgcaatggctgttggaactcagagaagtttgcaggagcagggacccgctccttccattaattcatcagtggcttctcctgctacacaatatgctgataatgcaaactcaggtgcctctcttcttggaaaaagggataatcaagatggacaagcatcgcctttgtccaatattgctaaaagaatgaggcctggttccactgttgttgatgcaatgcagcatcagcaaataggctcacacgttgaagctcttcaaggatcagatatgaattggcagaattcattgcaacaacaaccaatggccagaggtattcagtatgcaagtggtggcattcagaagtttcctcagcaggtttttgaagggggggcaaatcaagagacaggggcaattccctttgcttctagtcagcagggcatgaggttggttgccaaggaagaacagtttgaaatggaaaaattagatggtgcagaaataaactgcaataaaagtgacatggaaatggaaatgaacaatttagatccacaacaattgcggcttcagcaacgattgccacagcatgcattcatgaggcctaatttccctcaggcagcctggaacagtttgggtcagcatatgggcaaagaaacaaaaaaagaagaccagcttcagaaaaggaaatcagtacagagtcctcgcttatcctccgcggcattacctcactccccattgtcttcgaaatcaggtgaattttccaatggtgcagttggaccaagttttggaccatctgcaatggctgctgcacctgggacatcacaaaaagacaaggcagcaatggcctcagttcctgctactgttggaactccatctaatgattctacacaaagacaacatgcacaactagctgcaaaacggagatctaattctcttcccaagaccccagcaatgaatggagttggttctcctgttagtgttggtacaaccagtgtcccattgaatgcaaatagtccctcagttgtgacctcgggttttgttgatcaaaatcttcaaaatatgcttgaaaggttctcaaaaattgaaatggtgacaatgaggcatcaacttaactttaagaagaacaaggttgatgactatcccattaagaagcagaatccatatgtaccaaataatctatcagcacttcttgctaatgctaatgcaactaataatgagggattgccagaggagtcaatttctatttcaaagtcgcttataggtgggagtatgaatgcgtgcaaaatgagaatcttaaatttttgtgtgcctgagcgtgtagttcaaggaagtattgttactataattccgaggatgcgaactaggatgattatgtttgaaaaatctgatggtactgtggctatgcattgtggggtgattgaagaagttgattacgtagctgcagaggatcatctcctcacattacccaatacttttgattacgttgctgcagaggatcatctccttacattacccaatactcattctgcggatttgcttgcacaacagttctgttcactgatggtacgcgaaggatatgtgaaggaagatgatcgaatccaacttaaaccaaaccgggtgaaccttccgttgggcaatcaatctactacccctaataatgctgtagttgaaatgcaacaatatggagaagtcattcctggtcaatcatccaatgaagttgcaaaaccagctagtggcagtaatgcacctataaacctctctcagaatcttctaacaaacccaaggatgttgccacctggaagcccccaagccttacagatgtcccaaggacttctctctggtgtttcaatggcttcaagaccacagcaaatggactcacaacaagctgtacagcaacaacagcagcagcagcagcagcaacaacaacaacaacagcagcagcagcagcagctgcaacaaaatcaacacacactcattcaacagcagaatccccagttccagaggtctcctatgatgcttgggacaaatcagctttcacacttaaatccagttggacaaaactccaacatgccattaggtaatcacatgctcaacaagccttcagctctccagatgcagatgttccaacaacagcaacagcagcctcaaatgcaaaggaaaatgatgatgggacttggacaagccgtgggaatgggtaacttgagaaataacctagttgggcttgcaccaatgggcaaccctatgggaatgggaggtgcgaggggaataggaggaagtggaatctcagcaccaatgacatctattgctggcatgggaaatatgggtcagagcccaatgaatcttagccagacttcaaatattactaattccataagccaacagtttaggtccggatcattaaatgcagcagcatctgctgaccttatatcaaggcttagattggtacattcgaatcgtcaaagcatgctagggtcccctcagtctaacctagctagcatctcaggggccagacaaatacaccctggtgctactcctagtctttcaatgttgggcagggctaatacaatgcagcgaccaattggacctatgggtccaccaaagatgatggcagggatgaatctttatatgagtcagcagcagcaacatcaacaaccccaacagcagcagcagcaacaccaacagcaattgcaactccaacagcatatgcagcagcaattacagcagcaacagcaacaacaagaaacaacttcacaattgcagtcagttgtttcacccccacaggtgggatcgccatcaatgggcgtaccaccattgaaccaacaaacgcagcagcaagccagccctcagcaaatgagtcaacgaactccgatgagtccacaaatgagctcaggtgcaattcatgccatgagtgctggtaatcctgaagcttgtccagccagtccacagttgagctctcagacccttggctctgttagtagcataacaaactcccctatggacatgcaaggtgttaacaagagcaactctaatgcacaatga

SEQ ID NO: 29861 - DNA, 360 bp, Glycine max
  Peptide Sequence Number=SeqID_146639
atgaaacacagctccaaactcgaaagtggaggacacaatcaagcttatcgataccgtcgacctcgagggggggcccggtaccagcttttgttccctttagtgagggttaatttcgagcttggcgtaatcatggtcatagctgtttccggagggcgacagatcattgcaattgttggtcttcaacgaggaattcctagtaagcgcgagtcttcagctcgcgttgactacgtccctgccctttgtacacaccgcccgtcgctcctatcgattgaatggtccggtgtcgtgttcggattgcggcgacgtgagcggttcgctgaccgcgacgttgtgagaagtccactgaaccttatcatttag

SEQ ID NO: 29862 - DNA, 324 bp, Glycine max
  Peptide Sequence Number=SeqID_146640
atgttgtgtcgtgacgactcccgcggggacaccgtctccggggcccccggggagtcgcacttaacagatttgagttccttggcgcacgaagcgccggggtttgtgtttgtcgcgagggacgaggaggccgggcgcacggggcgccgtggtcatcccctccctcccgacggttcagtggacttctcacaacgtcgcggtcagcgaaccgctcacgtcgccgcaatccgaacacgacaccggaccattcaatcgataggagcgacgggcggtgtgtacaaagggcagggacgtagtcaacgcgagctgaagactcgcgcttactag

SEQ ID NO: 29863 - DNA, 1780 bp, Glycine max
  Peptide Sequence Number=SeqID_146641
atggttaggctaaatgttggtggacagtacatatctccaacacacgactctggccttacaaggatgtggtatgatgacacgccttacctttatggtgcaggcactggtgtgaccaaccaagctgagaagaatgttccaattgattaccagaccatgccaaagtacattgctccttctgatgtttactccacgtcaagatcaatggggactgacaaggatgtcaacatgggcttcaatctcacatggatcttccaagttgatcccaattccatgtaccttgtaaggttgcatttttgtgattactattactccaaggtcaatgagattgttttcgacgtatttctcaacaaccaaacggcacaagctcaagctgatgtcatagggtggacaggaggtaagggagtgccaacttataaggactatgtgatatatgtccaagatggggagggtgatgacaagctttggctggctctccacccttcacctgactcaaagcccgagtactatgatgccatgctcaatggagtggaaatattcaagctcaatgacacagacttgtctggtcccaatcctcagctttcggagatgctcctcaggcagcagaaagaggatgaggaagcaggtttcactagccacagagcatatcacaagcatgctgttattggtggagctgctggaggtgctgctggtttagcttttatggctgcattatgcgttgtgtacaacaagaagaagagagctccagggtcagagggtcagacaagctggcttcccatctatttgaactcacacagcaaatcctctgcctcgtctgggaagagcgttagcagtgccaacttatctgccatggctcaaggtctttgccgttatttctccttgcaagagataaagcaagcgacgaagaattttgacgaggccaacgtcattggtgttggtggatttggaaaggtgtacaagggtgtcattgataatggaatgaaggtggcaatcaagaggtcaaacccgcagtcagaacaaggagttaatgagttccaaacggaaatagaaatgctttccaagctgagacacaagcatttggtgtccttgattgggttctgcgaggaaaatgatgagatgtgcctggtttatgacttcatggctcttggcaccatgagagagcatctttacaagggcaacaagcctatgtctactctgtcatggaagcaaaggttggagatttgcattggagctgcaagagggcttcactaccttcacactggggctaagtacaccatcattcatagagatgtcaaaacaacaaacattctcttggatgaaaactggaatgccaaggtttcagattttggcttgtctaaaacgggtccaaacatgaacactggtcatgttagtactgtggtgaagggaagttttggctacttggatcctgaatacttcaggaggcaacagttgactgaaaaatctgatgtatactcatttggggttgttctgtttgaagcgctgtgtgccaggccggttctcaatcctagccttccaaaggaacaggtcagtcttgctgattgggcattgctttgcaagcagaaaggaactctagaggatctcattgacccatgtctcaagggaaagatcaatccagaaagcttgaacaagtttgtagacacggctgaaaagtgcttgtctgatcatggtaccgatcgtccctccatgaatgatctcttgtggaatctcgaattcgctctcaacctgcaagaaaatgttgaaggtggttcaactcattctgctc

SEQ ID NO: 29864 - DNA, 1009 bp, Glycine max
  Peptide Sequence Number=SeqID_146642
gtttcgtattctactacttgaaacctaactcttccttcttcttctacattactcctatggctcccgatgcttccgacgcacttgcagtaaggcagaaagttcaattatttctgaacgcggctcgtactggttcaattgatctcttgaagaaattggcgttgcagctggacgagggcaaggatttggcgaaatcggtggaagcaataaaggacgccaacaagagaggagcactgcattttgccgcgcgagaaggccaaacctctgtttgcgagtacctcttaaccgatttgaagctctctgtcgattctcaagatgatgatggcgagactgcactcattcatgctgctcgtcagggacataccgccaccgctaaatatctgattgaccacggtgctgatcctactgtggctagcaatttaggggccacggcattacaccattctgcggggataggagatgctgagctgctcaagtacttgctgtccaggggagttaatcctgatctagaaagtgatgcgggaacacctttggtttgggctgctggtcatgcccaaccagctgctgtcagtgtactgttggaacatggtgcaaatccgaatgccgaaactgatgatggtattaccccactcctttcagctgtggcagccggttctctagcatgcttagagctgttaattcagcaaatggggacaatagcagatataggttgggaatggaagcttcagtggggtaggttcttcttggaggctgaaatagacacgcaacagtacatgtggagatgggagggagattcgagcggtaagtatacagtggggagtgcttacgaattactcaataggaatttgccgttggagaggaaagactgcctacaaagaataactcaagaaggaggaatgtggaaactaatgacgtcacctgcccattttgcagaagtcatgatgaggacgaggctcacttattcttcacttgtgctaacatcttgccgctatggtgggaatcgtgatcatgg

SEQ ID NO: 29865 - DNA, 381 bp, Glycine max
  Peptide Sequence Number=SeqID_146643
atgttggtgaagagaatgatggacaatgcaaaaaactacaaagctgttggatcttactatcccatgatttgtgatcttgtgatcccttcccaagtggcacctgaagcaaaaaagagagcagcagaagcaaagtcaagaggggatggggcttttaaaaggaatgaccatcatatggctatagatttttatacccaagcaattgatctgaaccccattgatgctactttgctatccaatagaagtctctgttggattaagttgggccaagctgagcatgctttagctgatgcaaaggcctgtagagctttaagaccagattggccaaaagcttgttatagggaaggagcggctctgcgtttgttgcaggcatgctatctctga

SEQ ID NO: 29866 - DNA, 309 bp, Glycine max
  Peptide Sequence Number=SeqID_146644
atggcaaaggtatctttgtttgtggtgtgtgtggtttgcgttctggcattggcctctgctcagagtgctaccaatgtgagagctacttatcatttgtaccaacctgaacagcataattgggacttactcgcagacagtgcatattgctcgacttgggatgctgacaaatccatggcatggcgcagcaaatacggttggaccctctgggcctcaggaccaacaagcttgtggcaggtgacaaacactagaacaaaggctcaggaaacggtgagaattgtagatcagtgcaaaaacgggggcttgcggtga

SEQ ID NO: 29867 - DNA, 4599 bp, Glycine max
  Peptide Sequence Number=SeqID_146645
atggcttcggagttagggcaacagacggtggagctctccactctcgtcacacgcgccgcccacgattcctacgcctccctcaaagaactcgtcgataaatgcaagtcctccgaattatccgacaccgacaagaagattagcatcctcaaattcctcagcaagactcagcagcgcatgatccgcctcaatgttcctttaatacaacactgtcagctactggcttcaactgtttcgaatcacgacatgtgtttcacacaagctgcggattcgttgttctttatgcacgaggggcttcaacaggcgcgtgcacccgtttacgatgtaccttccgccattgacattcttctcaccggaagttaccagcgtttgcccaaatgtatagaggatgtggggactcagtatgctttgaccgaggaacagcagaaacctgctttgaagaagctggacacgcttgttcggtccaagttgcttcaggtttctattcccaaagagttttctgatattaaggtttctgatggtaccgcaatgcttagggtagatggggagtttaaggttttgataacacttgggtatagagggcacttgtctttgtggaggattttgcatttggagctgcttgttggtgagaagaacaagcctgtgaagttggaggcaacgcggcgtcacttgcttggggatgatttggagaggcggatggcagcggcggaaaatccattttcggtgttatactcggttctccatgagctgtgtgttgcacttgtcatggacacggtcataaggcaagtgcaggttcttcgacagggaaggtggaaggatgcaattcggtttgagctcatatccgaggggcatggagcgagttctagctctgcgcagaaccctgatggggaatctgattcgtctgccatgcgaactccagggttgaagattgtgtactggttggattttgataagaatgctggtgcgtccgaatcgggcacatgcccgtttatcaaaatcgaacctgggtcagatcttcagataaagtgtctccacagcatctttgtcatagatcccttgacggccaaggatgcagagtttgttttggaccagagttgtatcgatgttgagaggttgctgttgagagctatttgttgcaacagatatacccgtctattggaaattaaaagagagctggtgaaaaatgttcaggtctgtcgaaccacggatgatgttgtgctccagtctcaaatgggtgaacctgatattgaatataagcagaaagatgagaagtgccacagcaaggactttgagggccatgaggtgttgcgtgtgcgtgcctatggctcttcttttttcacacttggaattaatatcaggaatggccgttttcttcttcaatcttctcaagacatagtggtttcttccgctttattagaatgtgaagaagctttgaatcaggggtctatgactgcagcggaggtctttataagcctgagaagcaaaagtatattgcacttatttgcatctgttggaagggttttaggccttgaggtatatgagcatggattcaatacagttaaaatacccaagaatgtttcgaatggttcagcgatgctattgatgggatttccagactgtggaagctcttacttcctgctgatgcaacttgataaggatttcaaacccttgtttaagttgttagagactcagcctgacccatctggaaaagataatttatccggtgacctgaatcaggtgctgcggatcaaggaaatcaatataggacagatgcaggttcaggaagatgaaatgaatttaagcctggttgactggggaaaattacgttctgttttgcccagtgctgttggtccaaatcaaacatctggagatgagtttttttctgatgttcaccttgagaattccatacagattgcaaaaggtcatccatcaggtttttcatcacttgttgatgaagtgtttggacttgagaaagggtcttcaatgcctccattctctgttaaaagtcttccatcatctgtgaatacatccctcccttctcaatatggctctgtccctatgaatttccatagtttaaaggctggaagcccttcgccgaagtgggaagtaggaatgcagatgtcacaggttagtaatgtaacaaaagcttctggtgctactaaccactatagtgtgaagggcccacttcagtccagttctgttggctcgataacaactggacaaggaaggaactctgctgggaaaaaactatctgcttccaagtctgaacaggatttggcttctcttaaatctccgcattcagttgacattagttcctcttctgcaatggatgaagaacagctaagattgttgagtgatacttccaacgatgctttatctggaagtcggtcatctcgactattatctcctccacgaccgactggctctcgaatgtccataccaaattccagacctaatggacttgaagttgaatcatttaaggctgctggatccagttcatgtgctacaactcccgtatcccaaacactggaatcaacagttagttataacacgggtgaagatgttacctccaaaaatgataagaaatctagaaaacgaacagcttcggatatgttgactttgattccatctcttcaaggtgttgaaagcaacccaggaatctgcaagagaagaaaaatttctgattcatctggctgtcaactatctttgccacaaggtgtcatgtccgctgaaatgatacccaaaaaagaaggatacagttatggaagtttaatcgcagaagtaaataaagggaatgttccatctagcatttacattgcggctcttcttcatgtggtcaggcattgttcactttgcattaagcatgctagactaaccagccagatggatgcattagacatctcatatgttgaagaagtgggtttgagaagcggatcctctaacatttggtttcgacttccacttgctagaggtgactcatggcagcatatatgcttgcgacttggaagacctggttgcatgtactgggatgttaaaataaatgatcagcacttcagggatttatgggagcttcagaaagggagcaataatacgccatggggttcaggtgtacgaattgctaatacatctgacttagattcacatatacattatgatccagatggtgttgttttgagttatcaatctgttgaagtagatagtataaagaaattggtggctgatatccaaaggcttgccaatgcaagaacatttgcccttggcatgaggaagttgcttggtgtaagagcagaggagaagtcagaagagctagttacaagttctgacaccaaaacatccagtaccaaggttgctccggatactgcagacaaactaactgaacagatgagaagggcatttagaattgaggcagttggactgatgagcttgtggtttagctttggttcaagtgtccttgctcgttttgttgttgaatgggaatctggtaaagagggttgcactatgcatgtatctcctgatcaactttggcctcataccaagtttctggaagatttcataaatggaggtgaagtttcaccgcttttggattgcattcgactgactgcaggacccttgcatgctctggcagctgcaaccaggccagcaagagctggtcctgttccaggggttgcagctgccttatcatctattcctaaacagactggtagttatatatcttcacagggacttctgcttggtaattcaactactaatgttggtcagccaacatctggacctggggcaaacactgtcatgcctactgctagtggtctcactagtcaaaccctttcaatgttagctgcttctgggcgtggcggcccgggcattgttcctagttcacttttgcccattgatgtctctgttgtgctccgtggtccatattggatacgaatcatgtacaggaaacagtttgctgttgacatgcgttgctttgcaggagatcaggtgtggttgcagcctgctacacctcctaaagagggtcgactttctggagggtcactgccttgcccccagtttcggccttttatcatggaacatgttgcccaggaactgaatggattggatcctagtttcactggacaacaagcaggtgggctggcaaattcaaataatccaaaccctggttcaggatcccagatgatggctgcaaatggaaatagaataaacctgccaatttctgctgcaatgcctaggacaggaaaccaagtagctagtttaaaccgtgtgggaaatgctttagcaggctcttcaaacttagctttgatgacatcagctgtctctcttcggaggccacctggaacagttgtccctgcacatgtcagaggtgagttgaatacagccattattggtcttggtgatgatggaggatatgggggtggttgggttcctcttgttgctcttaagaaggttttgagaggtattctaaagtatcttggagtgttatggctttttgcccagttacctgaacttttgaaagagatcctaggatctattttgaaggaaaatgaaggcacacttttgaatttggaccctgagcagcctgccttgcgtttttttgttgggtaa

SEQ ID NO: 29868 - DNA, 670 bp, Glycine max
  Peptide Sequence Number=SeqID_146646
gtcaaaggtggaagcacatgtggcattggtgggaccaagcggatcagggaagtcaacagtcatatggttgactcagaggttctatgatcctgatcaaggaaaggtgatgatgagtgggatcgatttgagggagattgatgtgaagtggttgaggaggcaaatggctttggtgggtcaagaaccttcattgtttgctgggagcataagggaaaatattgcatttggggacccaaatgcttcgtggactgaaattgaagaggctgcaaaggaggcttacatccacaagttcatcagtggccttcctcaaggttatgaaacccaggttggtgaaagtggggtccaattatcaggtggccagaaacaaagaattgctatagcaagggccatattgaagaaatcaagggtgcttttgcttgatgaagcaagcagtgccttggacttggaatcggagaagcacatccaagaagcccttaagaaggttaccaaagaggcaacaaccataatagttgctcaccgtctttccacaatcagagaagcggacaagattgcagttatgagagatggggaagtggtggagtatgggagccatgacaatctcatggcttcaaatcaaaatggcttgtatgcttgcctagttcgagcagagactgaagccaatgcctttgcttga

SEQ ID NO: 29869 - DNA, 405 bp, Glycine max
  Peptide Sequence Number=SeqID_146647
atgtgtgatcgtgcataccctaagaaactagcctttcaatatcttgaagagctcaggaacgagtttgagcgtgttaatgggtctcaaattgaaactgctgcaagaccttatgccttcattaagtttgatacatttatgcagaagacaaagaaactttatcaggatacccatactcagcgcaatattgcaaagttgaatgatgaactctatgaagtccaccagataatgactcggaatgtgcaggaagttcttggtgttggtgaacagttggaccaggtcagccaaatgtccagtcgcttatcatcagaatctcgcatatatgctgataaggctagagatttaaaccggcagaaatatcatgctgcaattggaaattgcgtgctaggaattgctttggtaatttag

SEQ ID NO: 29870 - DNA, 1584 bp, Glycine max
  Peptide Sequence Number=SeqID_146648
atggcatccctcattcccggagttctactgaagcttctccaaagtatggattctgatgtgaaagttaatggggaatatagatcagtccttctgcaagtgatcagcattgtgcctgcaataaccgggtctgaattatggcctaaccaaggtttcttcttgaaagtctctgactcttctcattcaacttatgtctcactctcaaaggaagacaatgagcttatcttgaataacaagttgcagcttggtcaattcttttatgtagacaggatagagactggaacaccagtccctattcttgttgatgttagacccgtccctggccggcacccttttattggaaatcctaaggatttaatgcaaatgttagaaccatcagagggtccagtgcaatctgataaccatagagttaatcgttcaaaatccatgaactcaacaaaagccaaagagagcaaaagtccaaggcagaagattgttattaaagaggaaaaagctgctgttgcatccaggtacatgcgaggtgttagaactccaacctcaaatgtgaatgtgcaagatgctaatgaagaaagaaaaggaaatgattttgagaatggtgtagatagtaagaaggtggcatctgcaaaaacactctcagtgaatacaactcgtagtctacaacttgaaataccatcaccaaggcaaagggttgctcaatctaacatccaggagactgtcatgtcgcctaagcgcatattgaccaaacgtaattctacaaaacaggaaactacaaacttgaatgttttatccagcagtgaagataaaagctatagcacagaggcaattccatggtcctctttgccatcaagccttttaaggcctggaaaggaattgcttagaaggaaacatctagcctcacaggttgctgttgaagctcaaagcgaagttactgctacttcagtccttgtcaagtttttaagcatgtttgccaacatctgcacttcagctgcatcagagaaccctcacgtcacactgaataagtttttttccttccaagaactcatggaccgatcaaattgtataagtacaactcctcacaaagataaatcatttcagctatataaaacctcttctccaacagaaacagacaaaactgacaagaaatcagatttagtgcctggtaaaagttcatcaaagtctccaaaatactcacctgaattatccgaggctgagaaacaagaatgggtaactggaaatggtctaaaagagataaatgagctgagagaagtcctttcaattgaaacaagatcatggtttttgatatacatggaaaaaacattggatgtctggttttccactatctcccgagagaagaggggaaagacgaataaggatactgcagggaggcaaatgcaacatgccaataatatagctctcaccttgtcacaccttaagcaagcaaatgaatggttggaaaagcttagaagcacttcaaacatggaaaatgaagagctggtggaaactgttgacagattgaagcaaaatgtttattcttgtttgctcctacatgttgactctgccgcatttgctttggaaaaccgagtttga

SEQ ID NO: 29871 - DNA, 285 bp, Glycine max
  Peptide Sequence Number=SeqID_146649
atggcaactgttcttcttcctcccgcgttttacgaagttggattggaagattgtgaacttagaaagatggtgaagttgactatgattgctcgtgttactgatggtcttcctctagctgaaggtctggatgatggtcgtgatcttaaagatgcggaattttacaaactgcaagtcaaggctttgtttaagaatctctcaagaggacattatgaagcatcaaggatgtcagttgaaactggcccttatgtttttcagtatccttatagaatcatagttattgcataa

SEQ ID NO: 29872 - DNA, 414 bp, Glycine max
  Peptide Sequence Number=SeqID_146650
gatgcgggtcagcttgcgggtatcgatgccggaaatggcgacgatgccctgttcggacaggtactcgggcagcgattgcgtggaacggaagttcgacacgcgggcgggacagtcgcgcaccaccaggccggcggcgtagacgcgattggcttcgacgtcctcggcgttgacgccggtgttgccgatgtgcggataggtcagcgtgacgatctggccgctatagctgggatcggtgagaatttcctggtacccggtcatcgcggtgttgaacaccacttcggcgacggtatggccaggcgcaccgatcgacacgcctcgaaaaatggtaccgtccgccagagccagaattgcaggagggaagcggttgatcccctcgggaaagagttgcggcagcacagtaaaccccggttttag

SEQ ID NO: 29873 - DNA, 589 bp, Glycine max
  Peptide Sequence Number=SeqID_146651
atggctcctcaaaacaattttcctttggaatcatcgattctaactcataagctattagctggaagctctatgtttggtgagctgaaatttgtgaataaagtccagttgaaaagggaaacaaaaacgtcatttgcactctctggtggcattgacactataatctcttgctccacggctgagctagaaactctgaaaattgtacaaagcacaattgcgaagcagctttttattgatgaagccactgttgaaatcatgatggctttggaagagaaatttgagatttccattggagagggtggagctgagaacatctccaccgttcaagatgctgctgatctgattgagaagggggagcgaggggtggtagatccagaaggagaagaagaagcagaggtggtggtgcttccgaaaccagactgggaccgaacaatggtgatgctgcgacttatcggaactgcctccgccaccgttgaccggacggagattccgccggagaacgaattgtactttcggagcttccccagacccgtttccgagtgtgagggtacttataatgagaaacagaaggatgaggatgaggacttaacag

SEQ ID NO: 29874 - DNA, 1224 bp, Glycine max
  Peptide Sequence Number=SeqID_146652
atgggtatatcgccggagaccacggaagaaggttatagtgttgtgtttatcgtcaaactcgtgaaccagggacaccagacaataacagagaagatcggcggcgaggaggatatggacgacgacgacgagatccagtcgcatccttcgccggcgagcggatcccctccgtcgtcgccgaggtcgaacggtcggataacggtgacggtcgcggctccggcgccgcaggcgcagccaccaccgccgaatagtctggcattagcgcttccgattcagcagccggcgaaggggaacggcggaggaggaggaggaggaggaggcggtggagggagggaggattgctggagcgaaggcgcgacggcggtgctgatcgacgcgtggggagagaggtatctggaactgagcagaggaaatctgaagcagaagcactggaaggaggtggcggagatcgtgagcggacgagaggatttcacgaaggcgccgaagacagatatccagtgcaaaaaccggatcgacaccgttaagaagaagtacaaatcggagaaggcgaagatcgccgccggtgccaccagcaagtggccgttctacgaccgattggaacaattaattggtcctagcgccaagatccccggcgccggaaacagtaattcacaaccgcagaaagttccgttagggattccggtcggtgttcgcagcagcgcgaatcagtttcaccatcctcacaaacagccacagaggcagcaaccacaatcggttccgttgaagaaccagaagattcagttccggcgccgcggtcctccggtggattccgattcggaggagcgcgacgcgtcgtcgccggcgtcgagcgacagttttccgccggagagcttcgagcggaagaggccgcggttgatgagttctaacaccgcgaaaggaagcggagaaagacggaaggcgaagggttggggaagcgcggtgagggaactgactcaggcgattctgaaattcggtgaggcttatgaacaagcagagagttcgaagctgcagcaggtggtggagatggagaagcagaggatgaagttcgcgaaggatttggagttgcagagaatgcagtttttcttgaagacgcagctggagatttcgcagctcaagcttggaaggaaaggtggtaaccctagcaacaatctcaatggcaccaccaacaataacaacaacaatcataacaataatagtgacagtgaatga

SEQ ID NO: 29875 - DNA, 3708 bp, Glycine max
  Peptide Sequence Number=SeqID_146653
atgaagtctgacacgtttcttgattatgctgtattccaattgtctccaaggcgttcaagatgcgagttgcttgtttcaagtgatggaaacactgagaaactagcatccggattggtgaagccattcttgacccatttaaaggttgcagaagggcaggttgctcgagcttcttcatcaatcaagcttgaaatcgatagacataaaaatgctgagacgtggtttacaaagggaacgtttgagaggtttgtgcggtatgttagcatgccagaggatttggaaatggtcaatacctttgatgcagagatgtcccaattagaagcagcacggaaaatatatgctcagggtgcaggagagcgttcagatccacaaggtgggaatggagctggagccataacagtggctgatgcaaccacaaaggaactcctaagggcaattgatgtacgattgagtgcagttaggcaagacctaacctcagcatgtgctcgtgcatcagcctccggtttcaacccccacacagtttcactcctcaaacatttcgcagatcgattcggtgctcatcgcttcaatgaagcatgcactaaatacatgtcactgtacgaaagaagaccggaccttatcagtcactggccaggtggcgatgacagggaactccgttcatctgttagttctgacatgtccatcgacaacgatgatgggcccaaccaagcccaacccaccgatccacctaagcccaagcctatttccaacttcgcttcgctgcgacgtagcagcaccagcgtgaactcgaaagacgagaccagcgacacccccaccaaagaggaaacggagtcgccggcgtcggctccggctccggcgactgccccgtcggggcggcggctgagcgtgcaggaccggatcaacctcttcgagaacaagcagaaggagaattccggaggcagggcgccggagctccggcggctctcctccgacgtgctgcggcggtggagcagcgccagcgacatgagcatcgacgtcggcagcggtgataagaaggattccgacagccccttacccacgccagcatcctctgtttctcaaaccaagtccgttgtcgtttctgaagacaaggatcaaaacgacaacaaattggagaaatttgcgaaaaccgatcaagggtcttctcaggagacagggaaagtttcggtttttgatgaggcgaagaacggggggtttaaggatcaggtgggtagtggtggtggcttttctgagacgacattgaagaagggctcatccgaggttgttgtcgttggtcctatgttgtcttatggggatgatgatgtgaagttttatggtggggtgaaaaatcatgtggttgcaccgtcacttattaggggaccccgaagtcattctcgatctctatcagcacagtttgaaggtggtggcaatggactcaaatttagggatgtttctgttcgtgttgatcaatcgtcacagaatgaggttgaggatactccttcttcattccctaacaaggaagaggattcccaaatcccaaaaatgaagttccagaaaccctcatctggtagaaatgaacaacaaatgagcatggcacatggtaaaagggatggtgctaatgaaagtagcaagatgaaacaagttttggagactccggataatgcacgtgcaacttcaactccgcctttagagcagcaacaccagagggtgaggcaatctaaagggaatcaagggatgcatgatgagctgaaaatgaaggctgacgagcttgaaaagctttttgctgagcataaactgagggttcctggggaccagtctggttctgtgaggagagtcgagccggccgatgtgcatgtggaacagtcacagtatagaagaggtggggtgggggattcaactcctcagttgccttccagaagcaatgtgactgaagtggctgcgagttctagcaatttggcaagctttgatgctaagttggttactaagatggtggatagtcggaattatggtgattctttgaggcaaaatttttctgatcttaacttgagtgaagattctagaggaaagttttatgagaagtacatgaagaagaggaatgctaagcttcgagaagattggagtatgaacagagctgagaaggaagctaggatgaaagccatgcaggatagccttgagaggagtagagctgaaatgaaggtcaagttttcggggtctgcaaacagacaagattcagcatcaggtgctcaccgtgccgagaaacttagatatttcaaatcaaatattaagagagagcagcatccaatagattctcttcagaatgaagatgatgaagatctatctgagttctcagaagagaagacttatggtgcttcaaggcaaagtaggaaaatttttcccaacagacatataccttcaggcacacctcgtacaacagctgtgtcggtctctcgttcatctggtggcaggcgaagagacaatcctcttgcccagtctgttccaaacttttctgatttaagaaaagaaaatacaaagccttcttctggagtcagtaaaacaacccgctctcaggtaaggtcctattcccgtagcaaaagcaccactgaggagatgcaaggagtcaaggaagaaaagtcaaggcaaactctgtccttacggaaaagttctgctaatcctgcagagtttaaggatttgtcccctttgaactcggatgggattgttttgtctccgttgaaatttgatatggatgagagtgatctaggcccttatgatcaatcacctaggcctttccttaaaaaagggaataacataggttcaggttctgttggcaatgctatccagatgaaagcttcaacggcatctgatactcagaaaaataaagaatttgaggaccctgaatttgatgaggaggattctttgcagattgccatggacgaacatgatgacattgaaactatggctatcgaagatgttgcttataataataatggaaaggtaagtctgagccaggaatctggtaagtctggtaattctggatctgaaattggtgattctgcaaggtctcttgctcaggtagaccctatttcagggggtgaaatggctactgggtttacatcaacattcaatggtgtgagatctctgcaggactctcctgttggaagtcctgtgtcatggaattcacgcacgcgtcatcctttttcatacccacacgagtcatctgatattgatgcttctatagattctccagttggaagccctgcatcttggaattctcattctcttaaccagggtgacaacgatgcttcccgaatgaggaaaaaatggggaagtgctcaaaaaccatttcttgttgctaattcatcccaaaatcaaccccgcaaggatgtcactaaaggttttaagcgattgctgaagtttgggagaaaaactcgtggatcagagagtatggctgattggatctctgctacaacttctgaaggagatgatgatactgaagatggccgagatctggccaatcggtcatcagaagacttgaggaagtcaagaatgggattctctcatggtcatccttctgatgacagcttcaatgagaatgagctgttcaatgaacaggtccaatccttgcaaagctctatccctgcacctcctgctcattttaaactgagggatgatcatatatcaggaagttcaataaaaggtgatccctgggtaacataa

SEQ ID NO: 29876 - DNA, 3757 bp, Glycine max
  Peptide Sequence Number=SeqID_146654
atggctgctgattctttctcctttgagggtgactccttctcaagccaccagagaagacactatccaacaccagtgagttatcacactgtgtatggctctggctctggctctttcatatcatccagctctctaaccaatccaagagctcgccgccgcaacccagttcctgccacaccctttgcttcagatgatgaccattcatggcaaggagaagtttcgtggaagttcgaggccaccgggtggcgcgactatagcacaaactttggttctgttctcagtccatggccagagagctccccttctggtcacagccgggtatttcgtcgatcagccaatgattactacctttcaagaacaagtaggttcagaggtctggcaaactcttcttatgaacaatctggctatggtagagttgaacttcagagctatgatgctagggacaatgattatagttactttgatcagcatagtcggccacaaggattatcaagatcggggttcatccaagagaagagtagtaaaaaatgtaagactagtccattggctgaggaagatgagcttagtatgatagattatagcataacacatgatcacgttatttcacctaataggaatggtcatggtcttgaattaccatattctaaacatggtcatggtggtgattatggtgggaattatcatgttggtcatgatggaccatcatcacacggtagccaaatttatagaagtggtggggattacacttatagtcaccatgacattgagaagctttcagcatatgatgaagagggtgaagaggatatggatgaggaagatgcaaggcctccaaagactgttgggatttttagcttgtttaagtactcaacaaagttggatttggtgcttgtgtttgtggggtgtttaggggctctcataaatggaggatcgcttccttggtattcttatctttttggagatgttgtcaataagatctcagaagctgaaaatgacaaagcacagatgatgaaggatgtagagaggatatgcaaatttatggccgggctagctgctgttgtggtatttggagcatatttgcgtaaggatcgtgctgctcaaagaattagaacagagtatctaagagcggttcttcgacaggacattactttttttgatacagatatcaacactggtgatattatgcatggaattgctagtgatgttgcacagattcaagaagttatgggagagaagatggcccacttcattcatcatatatttacattcatatgtgggtatgcagttgggtttaaaagatcatggaaagtctctctggtggtattctcagtcactccattgacaatgttctgtggcatggcttacaaagcactttatggtggcctaacagcaaaagaggaagcttcttataggaaagctggtagcattgcggagcaggccatcagttcaattaggacagtgttttcatttgttgcagaaagcaaattggcaggaaaatatgctgagctactgcagaaatcagctccaataggggccagagttggttttgctaaaggtattggcatgggagtgatctacttaataacctattcaacatgggcactggctttctggtatggctctgtattaattgccaggaatgaacttgatggaggttcagctattgcttgtttctttggtgtcaatgtagggggaagagggttggcactggcactttcatattttgcacaatttggtcaagggactgttgcagcaagccgtgtattctatattatagagagaatccctgagattgattcctatagccctgagggtaggaagctttctggtgttcgtggaaggattgagttaaaaagtgttagctttgcatacccatctcgtcctgattctcttatacttcattcccttaacttggtgttaccatcttcaaaaactgtggcattggttggtgccagtggtgggggaaagtctactatctttgctctcatagagaggttttatgatcctattgaaggaattattaccttggatggtcatgatttgaggacattgcaagtaaagtggctacgagatcagattgggatggttggtcaggagccaattctctttgccacatctattctggaaaacgtgatgatggggaaagataatgccacaaagaaagaggcaattgctgcttgcattgctgccgatgctcacagcttcatctctagcctaccactaagctatgacactcagtgtgtagtaggggacaggggtacaaaactctcagggggccaaaagcagagaattgctttggctcgagcaatggtcaaagatccaaaaatccttcttctagatgaacctactagtgctcttgatgccgagtcagagtctgcggtccaaagggccatcgacaagatatctgcaagccgaacaaccattgtaattgctcacaggatagcaacagtgaagaatgctcatgctattgtggttcttgagcatggttctgtcactgagatcggtgaccatcgccagcttatggcgaaagcaggagcatactacaaccttgtcaagcttgccaccgaagccatttcaaaacctctagctatagaaaatgaaatgcaaaaagctaatgatttatccatctatgataaacccatttctggtttatcaggatcaagatatttagttgatgatattgatatcccatggcctaaaggcttaaaatccacgcaggaggaggaggagaagaaacatcaagacatggaagacaagcaagacaaaatggcaagaaaatacagtctttctgaagtatggaaactgcaaaagcctgagtttgtgatgctattttcaggacttattctgggaatgtttgctggtgctattctgtcccttttcccattggttttaggcatatccttgggagtatattttggccacgacactcataagatgaaaagagatgtggggcgcctttgtttaacacttgttggccttggatttggttgcatactttccatgacaggacaacaaggtttgtgtggttgggcaggatcaaagctgacacaaagggttagagacctcttgtttcaatccattctgaaacaagaacctgggtggtttgactttgaagaaaactccacaggagtgttggtgtcaaggctctcattagactgtgttagttttcgatcggtgcttggcgacagattctcagtccttcttatgggattgagttctgctgctgttggccttggtgtgtcctttgcctttaactggagactaacccttgtagcagctgctgtaactcctttcgcgctcggtgcaagctacataagcttgatcataaacgttggaccgcgagtggataacgactcttatgcgaaagctagtaacattgcttctggtgcagtgtcaaacataaggacagttactacattttctgcacaggagcagatagttaagtcctttgatagagccctgtcagaacctaggagaaaatcattgagaagttcacaacttcaaggtcttatgtttgggttgtttcaaggttccatgtatggagcatacaccttaactctttggtttggtgcataccttgtagaacacgacaaggcaaaacttggagacgtgtttaagatctttctcattcttgttctgagctcattttcagtgggacaacttgccggtttggcaccagatactactatggcggcggcagcgattcctgcagttcaagatatcataaaacgtaggccactgattgacaatgatagaacaaaag

SEQ ID NO: 29877 - DNA, 399 bp, Glycine max
  Peptide Sequence Number=SeqID_146655
atggggcagctcgagcggcaagcttttcgcaaagcttacggtaaaatctgggacctagccatggtagaagtctccacagaggccattgcctccctcgcccagtattatgatcagccattgaggtgcttcacctttgaggacttccagctatcacccatggtagaagaatttgaagagatcctaggatgttctctagggggaaggagaccatacctcttttcagggttctatccctcattagctagaatttctaagatagtccagatcttggcgcaggaattagaccacagaaagcaagtcgaaaatggggtggttggaataccaagaaaatgtttggagcgatcgacgcttttcttgcctatcataaccacaaggaaagcccggttgtcgctatgctag

SEQ ID NO: 29878 - DNA, 1176 bp, Glycine max
  Peptide Sequence Number=SeqID_146656
atgaatcgtagcgaatcggagtgggcctttcagcagttcctacaggaagctgctgcttcttcttcctctaattctgatcatcatcatcttaaattcaaaaacgaattcaacatcaacatccctgttactactacttctattcaaaatattaatgttgattcccaagactaccatgctattcttaagaccaagcttaatctcgcatgcgctgctgttgctatgactcggcaaataattaaccttctaagagctttccgccttttagcaaaggctgctttagacctgatcgatgagggatctttggtcaaatctcaaaaccctgccactttctctgacagtggaccacaggcatctaattcttctgaagatggattgcaggctaccttaaaaggatctggcccttctggaaatgatccctctaaattacaaaataaagatgtcaaagcacaaattgggattccttcctcatcttccatgcaaaacaaacctgctgtcgcaatgaggccaacgataagtggatcatcaggagaacaatcagatgatgaggaagtggagggagagattaatatgactgaaaacatgactcctgttgatgcaaaacgagtaaggaggatgctttctaatagggagtcagccagacgctcaagaaggagaaagcaggctcatttaactgagctggagacacaggtctcccaattacgaagtgaaaattcttcgttgttaaagcgattcacggatgtgagccagaaatacaataatgctgcagttgacaacagagtactgaaagctgatgttgaaacattaagaacaaaggtgaagatggctgaagagacagtgaaaagaattactgggttgaacccaatgcttcatgccataactgagatgtcatcaatggcaatgccatcgtttgatgaaagtccttctgagacatcagctgatgctgctgtttctgtgcaagaagacccaaatcatcaccgttgtcaacccacttctaataatgggttgggaggcatttcttcaattgaaactgtgcagcagaatgttgcagcagtggtaggtggcaacaaaacggggagaacaacttccctgcatagagtggctagcttggaacatcttcagaagaggattcgtggtggtgcagattcacgtggacctccttctaatggagaacaataa

SEQ ID NO: 29879 - DNA, 777 bp, Glycine max
  Peptide Sequence Number=SeqID_146657
caacagcaacaacagcaaaattcaaatcctgcaccagaggaattaagtcaatctgaaataagtgaaatatgtgactacttcagccgtcgggtggcttcagaaccctatgatgcttctcgtgttgcatcattcataactatgcttactttacctgtatcagtactgagagaattcttgaaattaattgcttggaaaaagggattatcacaggcccaagttggagatgttgtttcagctcaaaagccacggattgaattatgtcttgaaaatcattctgggttgaatgtggatgagaactctgagaactcatctgcattcaggagcaacatccattatgaccgcctgcataattctgttgattttgcgcttactgttgttcttgattctgctcacatccctcatgtcaatgctgctggtggtgccgcatggttgccatactgtgtttcagtaagattgagatattcatttggtgaaagtaccaatgtatcatttattggcatgaatggtagccatggtggtagggcatgttggttgcgtgttgatgattgggagaaatgcaaacagagggtggcacgaacggtggaggttaatgggaactcagccgcagatgtaagtcaaggttatgcttatgcagttctattggagatgagctttgctgtaatggaagaagtgcacagatcattaactaggttgtacaatatctttgctgatagtgtagtatcatggtataacttcttgggtggtggctattgttattgtacagatgacatcaaatga

SEQ ID NO: 29880 - DNA, 483 bp, Glycine max
  Peptide Sequence Number=SeqID_146658
atgtgcaacatcggggattgtgtacggcgaaaacatagcttgaatcttgtggttaaagtgaaaatgaacaaaataaccttagatgacacagaaacatatgaatgtctattcaaggagtattgggaaattattaaggtaaaagaaggattgactagtggtgatatccttgctgcactgcccaactacaagaagggtgaagaagaaaagcaaaatgattcgatgtcacgggttattgatgatgattctaagccagccaaacggaagaggtacaattcagagatgaaagaaggattgactagtgatgatatctttgctgcacagcccaactacaaaaagggtaaagatttactgcatcatagaaaaaattgtaaaggtgaagaagaaaaacaaaatgattcgatgtcaaggcataggggtgaagattatataagccagccagccagaactggtacaattcagaggagaaaaataatgataaaatag

SEQ ID NO: 29881 - DNA, 1341 bp, Glycine max
  Peptide Sequence Number=SeqID_146659
atgaggtgctttctaccttgctttcgtacttctaaacggaggaaccacttgcgttccgccgatgaagcccaaaaccatgtgggagaaggagctgttgaagaactcattgattccatagcagagtcaaaaacaacaaatgaagagcaattgaataagagtgttgaaaccaaggatgatcggaaagaggaagcacctcaaatagatgagacaaataaaagatcgcatcaagaagagtcttcggagtcactgttctctctctccatttcttctaggaaaaaagcttcagatgccgagcctgaagttaacagtcctattcgactcgtatgcacaaaagaagcatttgggtcatccccaagtgttgaagaaaggaagccatcagagaacaccaagcaaccaagtttcaatgccataaagaaggaagaagaaaccaaggaattaatcaagaatgaaggtgaaaaagagaaagcgaatgaccccgtcactcagtatagatatcgagattgccctgatgacgggtacgacgatattaatttaaatgttaatgatttggatgctacacttaaagatgatgatgatgatcctcccagtgagaagaaaggggaagcaggcgctgatgttaaccaaacatgggttcaagaagagtcctcagaatctttcttttctctgtccgctaattctagaatacgaatttcatcagctgaagcggagaatgaagttaacagtcaaatgtcagcccctgctacaaacagcatcacacaaggaaagattccagatctttccttagtgctgaatccaattcagaatcttaccaaagggagggtagtcaaagcaaccctgaagaatgataaagaaaacatcaacatggtagtgaaagatatcaacatacccattagtccagagcctagtttgaagctgtcaaaccgcaaggcaaagcagaggttcgatgacaaaattggggtagacaccagcctctcgagctggttggttgaatcatcggaaaccacaccaatttccatcaacaataccagttctgtgggagaacaaacaccaaaaggaagaagaggctcaccatggagtcgcgaggataggccaattttaggagcattaaccgttgaagagatcaggatgttttctttatctgcatcttcaagaaggtctagaagccggagtcctgacgagacacccataataggtactgttgggagctattggagtcacacagagcagaccatggatttagaattcaacaaaagtggaaaggatgtgaaaccaaagaggagttcaactgcattgcagaccagactagaaagagcgtttgaagccagtgctgcagaagtttga

SEQ ID NO: 29882 - DNA, 939 bp, Glycine max
  Peptide Sequence Number=SeqID_146660
atggatccattaaactgtaacaacccgaatgtcaagtttcttctggctgactgggagagattacctggttttggtattagtgcccaaattgctggaatgtgtgggcttcttgctattgcaatcaatgaaataagagtccttctcactaacttctataaaagagctgatcatgatggatgcaaagatataattattgtgatcaatactatggcattgatatggggcgagccgtggaagtatttgcaaccaacaaccgatataaatggaagtctggtggcttctcacagaaaaatggatagacgatggtggagagcacaggctgtacgctacttaatgaggttcccaactgagtacacatgcaatttattgaatgaagcccggcatgctgcctttggaaaaatagcagcggaaatggttcttgaaagtcctgctgaagaatggcctaaggaaaatagtaacaaggcggggtctgatattgaggaatatgtgttgtctaatcacaagccatggattcctagtcctcttctaagcatgcatgtaaggatgggagacaaagcgtgtgaaatgaaagtggttgagttcgaagaatatatgcaacttgcagccgccagatcaggaggcatttcccaaaccttaatagcatatggctgtccacagagatgcagacaaaaccaaagaatattctggttggaactttcgcactacactaaggtaagacgccaaggaaggactaatgtgtcaatggcgaagtatgaagctagcttggggagggagagcagcactaattacccacgggttaatttcatgatggctgctgactctgattttttggttggagcgttgggatctacttggtgcttcctcatagatagaatgagaaatactgggggaaaggtcatggctggctatttgagcgtcaacaaggacggattttggtag

SEQ ID NO: 29883 - DNA, 525 bp, Glycine max
  Peptide Sequence Number=SeqID_146661
atggatacctcttctagaatttcaaagatgcgtaaccgtgaacgtgagagacttcgtgggcctcaatggttgaagacattgcaaggagcattgctcagctgtacgtacactgtacttgactatgcacaaaccggtttgattgcagcagtgttcttctttaaaatgatggaatggtggtaccaatctgctgaggagagaatgtcagctcctacagtatatcctcctccccctcctccgcctccaccaaaggtagccaaagaagggataccactaccaccagacagaacaatttgccccttatgctcgcaaaagcgtgcaaatccatctgtagttactgtttcagggtttgtcttctgctatgcttgcatatttaagtatattactcaggtgagagctctagacttgatggctaaatttaagctattggaatacaaatcactctacctaaatttaagttttttgatagccaggagttacataatcccactgtgcttgtcagatgggatcactcaaacaactgaataa

SEQ ID NO: 29884 - DNA, 1065 bp, Glycine max
  Peptide Sequence Number=SeqID_146662
atggagcctttgatggtcaagaaaatggtttctgcagcttcctgtgagacttctgaagccaatggtgtggttaaagaaaagaagagctggtttggttggaacaagaaaagtttgaagagtagcagtgatgatcctgaggattccaaagctgtgaagaaaaattccaggtttggctcagaaggtagcaatcagagatcagctgatcagcaaaagtcagcatctgactttctgagggaggatagtgtagactctaagaagggaaaagataaaaacattaaaaagaagaaaaaaggagcaaacaatgagagtgagtataaaaagggtttaagacctgtgttgtggttgacaccagacttccctctaaaaactgatgagctgctgcctctgcttgacatcttagcaaataaggttaaggctattagaagactcagagagcttttgacaactaagctacctcatggaacttttcctgtcaagcaccaaaacacagagagaacagagagaccagaacccaaggccaaaatgcagttgcagatggctgaaatcagcaaacagacaaggcagagacacagatggctgaagtcaaaatctaagaccagaaacgcagttctgttgcagcagcactggggtacgttagttttagctctgtttcagcagagagcccctccaaaacacgttgctatcccaatagttcctactatccgggtgcttgtcacttttacaaaatttgaggagcttcagccagtagaggagttttcaactccgctctccagcccagcacatttctatgatgccaaatccaaggaatcagaggggtctagttcatggatttcatggatgaaaggaagtcgtggggggcagtccagtgactcagatagtcacagatacaaggatgaagttgatcctttcagcatacctgcggactacaaatgggtggacgccaatgagaagaagcgcagaatgaaggcgaagaaagccagaagtaagaagcataagaagcaagcagcggcaaaaggtggagatggagtgcagcatcaaaggacggaggatgtagaagaacagtaa

SEQ ID NO: 29885 - DNA, 975 bp, Glycine max
  Peptide Sequence Number=SeqID_146663
atgtcggcggttgcacctccgtaccagctcctagaaatcaacgtgatctcggcccaagagctggcccagtttgtcttccgcgtcgacgacaacttcctcaattccgacaactccgtcatcatggtcgagatctactcccacgcctggctccgccaggtcctcatcggcaccgtcgccgtcctggttaccaacctcctccctcccaaccgcaaacccaagctccgcttcgtagccctccaaattcgccgtccctccggccgcccgcaagggattctcaacatcggcatcaacctcctcgacagcaccatgcggagcatgccgctttattccgaactcagctcctccgctgtgggctattgggacaacatcattaaaaacaaaaacgcgaaaaccgaggacgacgacgacgacaatactcagcatcaccacttgcccttggattctagtcttttgacgctacaacgttgtcagagcgagaaaaacgactccaccgttaatgattacgcctaccatgggaatgcaaagcattacggttacgatgggcaggattcggacgagggtgtgcggaaaggtggcgttttcaacgaaggctcgcttatttcagatgggttgttacccatgccgccgcctgcgccgtgcacttcggagatctcggggatggatgggtggtcggagaatagcggcacggaggggatgaagacgaagattgagaggtggaggaacgagcttacgccggcgtatgaggactacgacgatgagaggaagaaggtgatgaggaaaacgtcgaagcgcgtgggtcagacgtcgagacggcgtgggcgtggcggcgggccgtgttcatgtttcgggtcggtgtttgggattgagatttcaattacttgcggcggggggaaccgccggaaaggacagggaggtggcaagggccgtgtaactaccgcgtcgtctgaactcacttacgatgattcctatatttga

SEQ ID NO: 29886 - DNA, 282 bp, Glycine max
  Peptide Sequence Number=SeqID_146664
atgggagctggctatgcccgaagtcgttaccttaacgcaaggagaggggtgccaaagcttgcgttcttcaccaacaggagagtgagtgcaaatgaggagttgacatgggattatggtattgtttttgctgatcacgaccatcctattaaagcatttcagtgttgttgtggaagcgtgaattctgcttttagtttggctggcttttccattctcatcaagctttatctgtatattgtttgttactttctaataaataatgttcaggaggcttttggtctttga

SEQ ID NO: 29887 - DNA, 1479 bp, Glycine max
  Peptide Sequence Number=SeqID_146665
atggctgaaaaaactggtttttgttacggaaaacaaagtgatggttttgctagtggaagaataagccttggaagactagaagttttaaaagtaagcaagtttgagagagtttggagctgcccaagttcgcatggtaaatcacagggctttgtattttacaaacctttagagattccagatggttttttctgcctaggtcactactgccagtccaatgaccagccattgagagggcatgttcttgtggctcgtgaaacttgttctgaacctgaacttgaatctccagctcttaaaaaaccaattaactactctttgatatggagtgctgattcaccacatgatggatgtggttatttttggttaccaaatcctccattaggatacaaagcaatgggcatagtagttaccaacaaaccagacgaacctgaagttgaagaagtcagatgtgtacgagccgatttgacggaaacatgcgagacttgtgatctattactatccatgagctcaaaattttcaagaatttcattcaaggtttggaacacaaggccttgtaaaagagggatgtggggtagaggtgtatcagttgggacattcttctgcagcacctattctaactctgaaaaaatagcagatattgcttgcttgaagaatcttgactccaccttacatgccatgccaaacataaaccaagttcatgcactcatcaatgaatatggccccactgtatacttccaccctgatgagatatacttgccatcatcagtgcaatggtttttcaaaaacggagcacttgtgtattcaagagacagtgagaagggtaaagcaatagattaccagggatcaaacttaccaagtggaggaacaaatgatggtgcttattggatagatttgcctactaatgatgatgctagaaataatctctgggaggaacatttactgacattgctatgtgggttttttgtcccttcaatggacctggaatacttcaagtgggcacttcacgcttcgcgtgagcaacttcacaggagaactatggaatgggtagatgcattcggtttggagtttatagaaggaaacaaaccagttgtttattcatcaaggcatggccatgcaagtttccctcatcctgggagctaccttcagggatcatccacacttggaataggagcaaagaatgaagcagctaaaagtaaactgacagtggattccagcaccagatacaaggttgttgcggccgagtatcttggtgagggagcaattgctgaaccatgttggttgcagtacatgagagagtggggtcctacagttgtgtatgactcacgttctgaaatagataagttgatagacctgcttcctgtgtttgttagattttctttggtgaatttgtttgaattgtttcctacggagctttatggtgaggaggggccaattggtccaaagggaaaggccaactgggtaggagatgaaaagtgttactag

SEQ ID NO: 29888 - DNA, 894 bp, Glycine max
  Peptide Sequence Number=SeqID_146666
atggccaagtttgaccctgagatagtccaagagttctatgctaatgcttggcccacggaggagggagtgcgagacatgcgttcatgggagaggggtcagtggattccctttgacgcagatgccctcagccaattcctgggtgacccgctagtttttgaggaaggccagcagtgtgagttcagccagaggaggaacagggttgacgggttcgatgaggaagccattgcccagctgttgtgcacaccggggcaggattttgcccgaaccgctgcagggaggcgggtgcagatcatgcgcaccatcatgaccactttgacccagacatggatgacactgctgctcagcaatttcttgcctagcgatcacaacttcgatctccctctgcctaagtgccagttggtgtatgccatactgacacggatgagcgcccacgtggcccagtcctacggagttcccgtcactcccagtaaagtaatccgaccgatcacccggcccttcatcgagaagtactgcacgcctaggcaggcgcagggtgatgcacatcaggccgcagacgcactgccaccacctcggcaaaccgatccagctgggtcactgggcgtggagcattatctacagcatttggttcaccagcaggccgccaaccaccgtgggcaggtgcagatacatgagtgtctctaccgattcagcctcagtcagcaggggcagggttccgccttttttgcatgccctactccagagcagtttggggctgaggtcgcatggcctggagactggctcgatgcccaggcaggggaggagcctgcaggatcccccggtgagccagatgagtcccatatggatgaagatatgactgacttgctcggtttcttgggagggagcggagccacgtga

SEQ ID NO: 29889 - DNA, 156 bp, Glycine max
  Peptide Sequence Number=SeqID_146667
atggagaaaaatagagagagagagagagaggggcttacaagaaccagaagacgttgtaatcgaatggtagcgagtgagggcctggtggaagcacttgatggagaagccaaacttgaaaagatgatggctgatggggataagaaagcactactgtag

SEQ ID NO: 29890 - DNA, 501 bp, Glycine max
  Peptide Sequence Number=SeqID_146668
atggcagagttgtgcctagtgcccaatgtggtcattcctctaaagttgaaggtgtcagactttgataagtacaaggggactacttcccctaagaatcacttgaagatgcactgcaagaaaatgggggcatacataaaagatgaaaaactacagtatcagtacaattcttatatagctctagatagaatacaactacaaaacatgtgcaagaaggagcataagtcgttcaaggaatatgcccagaggtggaggaacttggcacttcaagtagcacctccaatgatggagagggagatgataacaatgatagtagacacgttaccggtgttctactatgagaagatggtgacttacattccttcaagctttgttgatttagttttcgccagcaaaaagatcaaagtgggtctaagaagaggcaaatttgattatcctactttgatgaatgggaagcctgggggaatggagagaataagaatgagggaggaaaccatgccgtga

SEQ ID NO: 29891 - DNA, 369 bp, Glycine max
  Peptide Sequence Number=SeqID_146669
atggaggccatgaaagaccaaatggccgccatgatggaggccatgttgagcatgaaaaagatagtggaggtcaatgcggctgcagttgccactaccagcactgccactgaggtggatcggactcacccgtctggcataaatcaaataagtcatccattccccgacgtggtaggccaaggaggagaagcattgggaagtacaagcggtccccatgttgtgcaaagcaagaactctttcccatcgtatggtttgcctcccaactatgcaccacccgatgttgcacacgctcccaatgagaatgtcaataactccactcccatacttattgagagccaacaaccccaatttgatcatgcacatgtctcttaa

SEQ ID NO: 29892 - DNA, 252 bp, Glycine max
  Peptide Sequence Number=SeqID_146670
atggaacctatagctaggaagagaactcttgtcatgaaagaaaacactcctaaggaaactaggaataagatcccacaaccgaaagccagatgtaaagaaaaacatagcaggatactacctcgagaatccataaagataccatcaaaagctacaagtcctggttttcctctagccacaacatatgtattgcatttggtggggtgggaccaaacaactagcttatgttggatcgaatggcctcagaataattaa

SEQ ID NO: 29893 - DNA, 274 bp, Glycine max
  Peptide Sequence Number=SeqID_146671
gaaatgcttgtgcattgctggttatgggaaaggggttgatggggacccggtgctgagaggaaggaggataagggctacgtgggggtacgtgagctcagttgaaggtgggcaactggggatggtgggttcatgtgtaatttgtggatgtgggagagttgatttgcaccatcgcccgatcacatatgacggagtgggtacctggagatatgtcgcggggggtcaggagaccttggggacgtcaggtgggggtgctattgcccaaaaccaagcttga

SEQ ID NO: 29894 - DNA, 261 bp, Glycine max
  Peptide Sequence Number=SeqID_146672
atgcaaaaatttaaacgtcctgctcctcctagggctggtcttcattcaaatccagtgctggagctactgatgaatcttgtacaagctgctcaggctctgcagctggtgcagtatcctcaggtgttggagctgaggaagggggaaccacagatgatgcaatcctaccccgcaagggtattggatagaagactccaagaggaatgggctagagctgctaaagaaggccttggggttctcatgaatcccaggctagatttctga

SEQ ID NO: 29895 - DNA, 237 bp, Glycine max
  Peptide Sequence Number=SeqID_146673
atgaatgcttctccagctgcagtagctactggaacttccatagcgggatctatgtcaatttcggatatagttgaagtcgaatcggggacgggagctgcacggatccgcgaaagaagtcagtctttctctctcatctcattgttgattctgagtccaaagctaatgctttctgttccacccgaacttcttcacttgctttctttcacatttcttgttcaagtctatactgtactgtaa

SEQ ID NO: 29896 - DNA, 261 bp, Glycine max
  Peptide Sequence Number=SeqID_146674
atgggcccgaaatctaccctaaggctcataagaaccctagggccttctcttgcatctctggcccaatctacttggagtttttctatccaatgtccttgcggagtaggattgcatcaaagaagtgcgaacaacgaattaatgattgaagctggtgcaacaaagggaataggggaaacaatctggggtgggagttttgtgggcagagtagcattgttctcagccgaaggagagaagaaagggctggtttcaaaccttttgtag

SEQ ID NO: 29897 - DNA, 742 bp, Glycine max
  Peptide Sequence Number=SeqID_146675
ggaagaatacgcgaaggctttggcggatcaaggtgaatgggcttcattccttgatgtcttagcgctattggtgttcagagtcatcctctttccaaatgtggatgggctagtggatctagcagcgatcgatgccttccttgtttatcaccacagcaaggaaagtctggtcattgttattttggctgatgcctatgacacatttgattggagatgcgagaatagcagtgcaaggattgtctattgcacccccattctttatgtatggctaacctctcacatctttcgtcatcaaagtagacccgtctgtccccttcaaggtcaccacatgtgtgccgagaaagggaaagcaaattgggagcagctcctagctggtatggaaggaagggctggagttttgtcctcatataaagggttcacaaacgtccccttgatgggaacgaggggttgtatcaattataatcctatactttccataaggcaacttggctaccccatgagaggaacgccatcagaagaaagtattgcgcctttcatcgcacgaggcttcagtgaccccaatgcaaaagtgcttcaaagagttcgaaaagcatggaatacggtgcaaagaaaagataaggagcttaggggaagcagcaatgggatcgtcggcggctatcacaagtggctgaaggctagaatgcaagagataacttggctcccgaagctaaagatttcaagtgaggaagaggctgaaaccccttag

SEQ ID NO: 29898 - DNA, 225 bp, Glycine max
  Peptide Sequence Number=SeqID_146676
atgaatgctttgggtggtgcaacactcttttgtaaaatcactcgtgcacccaacatcttcatgatttgtgtacatagggactcgttaggtaggaataatcaacatgaaaatacagaaaaaggggttcccatgaaccctaagagaataaaggtcattcctgagtggcccgctccaccaagtgtgttgagggaaaaagcccagagtttcaagaacctcgggatttga

SEQ ID NO: 29899 - DNA, 312 bp, Glycine max
  Peptide Sequence Number=SeqID_146677
atgtggcagagcttgaataaaataatagaaaaagaggaaaaccttttatttaagaccaaaaagcttttctctctcctcactcagcaaaacagaaatttcagacagccctctctctccctcacgttgccattctcttcttcttcattctccattgaagctccacacaaagcttcaacctttggccatcatttctgccccaaatcgcgaaaggagagcattttcggggtcgtgaagtgcgtggctacgagtgggacttcgaaatttcagacatttgctgaaagcttgttgaaattgccatgttggatgagttag

SEQ ID NO: 29900 - DNA, 231 bp, Glycine max
  Peptide Sequence Number=SeqID_146678
atgggtgctgactccatactcatctgggaggtccaacctataggcattgttattgatcctcgaagccgaggtgctgccgaatcgcgatctccctctgccatccaaaggcaagcgagtccgttggcatatggagaccatcatggtcatcatatacatttcgaagatgacaatgtcttcattcattgcatgcttccaaaaggtgacaattgtaaaagcaaagcttcatggtga

SEQ ID NO: 29901 - DNA, 204 bp, Glycine max
  Peptide Sequence Number=SeqID_146679
atgggaggtgcaaatagcaattttcaaattttgatttgggcattccagactatttttcgaagctggattgcttctgaaggaagcaacccagctcgcctgggcaagctaggcggcaacctcctccccctttgtcctataaaaaggcaaaaggggactgttctaagggtccctgattcccctgactatgcatttcaactgttttag

SEQ ID NO: 29902 - DNA, 261 bp, Glycine max
  Peptide Sequence Number=SeqID_146680
atgtcgatctccccctgcggatgtatcagttgggatcatgcccgcaagacacccagtggacccggagaagtccaacagggtcttggggtttctagctctgattacgggcttttgtcccctactaatcaagctttcatcaagaagtactgcgcccccagactggcacagagcaaaacaccacagcagcctggggatggctggcagcgggcaacaaaagcactgccaccacctctagagttcatctcagctcatccacaataa

SEQ ID NO: 29903 - DNA, 417 bp, Glycine max
  Peptide Sequence Number=SeqID_146681
gctggtgagtcaggaagagctgcaacttcattatctgagtcatcgggaatgagtatcaaaggtggtgccggtggagctagtggaggtggtagaatctcaaccttcggggaagccggtgggtctactattggtggttgcagctcagctggtgcaggctctatccttgttggtatgggactgggggcacaacctcgggagatcttcctaacggcagctgagcttcaggccaggccactttatctaaaaattgctccatggatactattggcctattatgagccaactgctgctggaggtgggttggataatgaagggatgtctttagctcttgctctctttcttgaggccatctatctcgctaagcctaaaacttgtcgtaatgatgtgcgcttagctctccctgagccacgcttagcg

SEQ ID NO: 29904 - DNA, 111 bp, Glycine max
  Peptide Sequence Number=SeqID_146682
gcaatggctctgaagaagcttcttgctaaaagggctaggaaggccaccataggggagggatccagtgtagccccgcaagcggagattgagtttgacggacaccatttctga

SEQ ID NO: 29905 - DNA, 258 bp, Glycine max
  Peptide Sequence Number=SeqID_146683
atgatgatgaaggacaattaccggttgaaggggactcttctctccttcagagtattttggacaggttcaatgaacttcaaacctatgttggtgcgaggtttgatgctttggaatgacaagtggacatgcgattcgatgcaatggactcaaggatcacaaaggattgtcatcatcaaaaagggggagattgtggaagcaatgccttccaaggttattttgatgatgccaaagaatcaagagttaagcaaaattccatag

SEQ ID NO: 29906 - DNA, 1092 bp, Glycine max
  Peptide Sequence Number=SeqID_146684
gatagagggctacacgtcctcgcctttagagggctacacgtcctcaccttcagaggactacacgtcctcgccatcagaggactacatgtcctacccttcagaggactacacatccttgccttcagagggctgcatgacctcgccatcagagggctacaagccctcaccttcagagggctagacgccctcgcctttagaaggctacatgccctcgccttcagaggactacacgccctcaccttcagaggactacacgtcctccccttcaaaggactacacgtcctccccttcaaaggactacacgtcctcaccatcagaggactacacgtcctcaccttcagagggctacacaccctcgcctttagaggacaacacgtcctccccttcagagggctacacgtcgtcaccttcagaggactacacatcctcaccttcagagaactacgcatcctcctaggactacacgtcctcaccattagaggactacacgtcctcgccatcagaggactacacgtcctcgatttcagagtgctacacgccctcgccttcagaggactacacattcttaacttcaaaggactacacaggactacatgtcctcgccttaagagggctacacgccctcacgccctcaccatcagagggcttcacgtcctcgccttcagagagctacacaccctcgctgtgagaggacaacatgcctttgccgtcagaggactacacgtcctccccagggctacatgccctcaccttcagaggctagacgccatctcctttagaggactacatgccctcgccctcagaggactacacgccctcccctttagaggactacacgtcctccccttcagaggactacacatcctcaccttcagaggactttacgtcctcgccttcagagggctacacgccctcgcctttagagaactacacgtcctcccgtttagaggactacacgtccttgccttcttagggctacacgccctcacactctcacctttagagggcttcatgctctcgccttcagaggactacacgccctcaccttcagaggactacacgccctcaccttcagaggactacacgtcctag

SEQ ID NO: 29907 - DNA, 192 bp, Glycine max
  Peptide Sequence Number=SeqID_146685
atgaccaccttccaagtaaaaaaagaatcacttgattcgccccttttgaaagaactacgtaggtctgatttcctcttggatggaggtttttctaacgttttcctttcaataaactttggtggcgactccgcgcattttcctcctatggaagacgcacccatgagcctcacctcgcttgcccgcaaagggtag

SEQ ID NO: 29908 - DNA, 426 bp, Glycine max
  Peptide Sequence Number=SeqID_146686
atggtttacgtaaaccttgatgtttgcaaccctctacttgatatcattgtaaattaccaaaattatggatttaaagtgggagacagaggatgctgtggtacgggcaaaatagaggccgctgtgctatgcaaccctttgcatcccacgtgtccagatgtgggagactacgttttttgggatagttttcatccttcagaaaattacggaaataacgatgaccaaacacagaggataaagaaaaacaagcccaaatattcgcagacatacacgattatttccaataggttatttgtgaagcaatatatgtcatcaccaaactcttccgcaatgccgttcattggatgtgcaattattgttctttgtagtgagatggaaactcgtgcttttctagcatgtcttcacgatttgatgagtgacgtcatgtaa

SEQ ID NO: 29909 - DNA, 474 bp, Glycine max
  Peptide Sequence Number=SeqID_146687
agtctcattgaaaatgggatattggtggtgacaaatggagtagagccaacagaggcacgacacaaatcgattgaagaacaaaagctgaaggatttgaaggcaaaaaattacctctttcaagcaatttctcgtgatgtgcttgaaacaatccttaacaaggacacttctaacggtatatgggattcaatgaagcagaaattccaaggttcaaacaaggttctaaagatatcccatgaagacaaatcaggaagaggaagaggtagaggtatatttagaggtggtcgaggcaaaggaaggggaagacaacccattaacaaagctgtcattgagtgtttcagatgtcacaagttaggacactatcaatatgagtgtccagattgggagaaaagagccaactatgctaaattggaagaggaagaaaatgagcttttattaatgtcctatgttgaacaagccaagaaggaagaagcatga

SEQ ID NO: 29910 - DNA, 396 bp, Glycine max
  Peptide Sequence Number=SeqID_146688
atggctgctattttggtggtggaggagcatctactgttggttgaggctgttgaagctacagtggttgcagcaatttccttgttgatgggaggtcgaatgggtttggctgttgtgacttgcactccatcgaaacttcagaggcttgttattaaagctagaaaacccaatgctttgtttgatttttctgggttcactaggttctcaagagagaaaggtcatctagatttgagtgcctatgatcatatgggttctcatgatccgcaaccactttcccgtcatgttgaaaacgaagtcacggccttagaatcaaagcagatggtctggaaagctgggcttactaaagagggagttcttgagcagtattctaaaagtgtagggccaatggatcccttatga

SEQ ID NO: 29911 - DNA, 315 bp, Glycine max
  Peptide Sequence Number=SeqID_146689
atgtggtatggaacactcatcatcaatttcgtcaagccacatggagctatggtattggatgatctagccacaaagatgacatggattgtgaatggcagcaggatcaaacactacttgggtgcagaaacaaggagttttcgtcccaggagactcgcctgggcgaatatatcaggtaaaaataacctgcgaaattcacccaacctcgctaaggactggcctaggccaatcaatgaaatttacttaaactcacttgggctagtgaagagttgcttgggtgagtggtctgcagtaatgaaaaataaaacaaaggagtga

SEQ ID NO: 29912 - DNA, 297 bp, Glycine max
  Peptide Sequence Number=SeqID_146690
atggatcccctatccaatgatgttggaggaaggacaacaatgcaaatatacttcaaggagagaaagggctatagaatctatcattcaattgcattttccatctgtggttggccgcctgttgatcagccaagtgatgcatgtacatttgcatttggagttccatcctctgtaggtgtgttgagatggaatccaaggatgactattgttgtggtggtgttggagcatctgctactggttgaggccgttgaagctgttgtggtttctgcaattgccttggcaggaaattcttgtcaatga

SEQ ID NO: 29913 - DNA, 396 bp, Glycine max
  Peptide Sequence Number=SeqID_146691
atgtcagggtgttggtctggccagtggttcagggataaaggggatgccccactttatttccatgatacacatgcaacactgatgattaggaaattttatgcaaaactggtcatgcatgcacccatgtggacactcaagcatcaagtttttatggccataaaagctggtgtagaagcaaagcttcatgatgaatcaagattgattcaaagatgttttgatgataacaaagatgatgaaaaaggtgatgacaaaaagctcaaaggtcaatcaaagaatgagttcaagatgtttaagatagaatcaagaacacttcaagattcaagaggaaagttgaagaacacttcaagattcaagaggaaagttgaagaacacttcaagattcaagaggaaagttga

SEQ ID NO: 29914 - DNA, 234 bp, Glycine max
  Peptide Sequence Number=SeqID_146692
atggttcttaatgaaatagaagtagtaccaggtgatgaggacgaggaggaagacgatcatgaagatggggtgtcagaggaggctaaggaagatgatggggagcgtgacaatggcatagttgaagcagaagggcaggaaagggttgagcggtctagaaactcacgccatggatggggagtcaccgaggaggtagtggtggttccggtgggagtggtgtcagtaaaggtgtcgtag

SEQ ID NO: 29915 - DNA, 126 bp, Glycine max
  Peptide Sequence Number=SeqID_146693
atggcaatctttcttcctgttgttgggcttgttgaccctgacaagttaaaacctgattatctagttggtgttaacaaagatagttacttaatcttggatactttgccttctgagtatgattcatga

SEQ ID NO: 29916 - DNA, 264 bp, Glycine max
  Peptide Sequence Number=SeqID_146694
atggcagaaatgattaaaaatccaagaataatggaaaaggcacaggctgagttcatcccatttggtgctggaagaagaatgtgccctggcctcacatttggcttaagcaatgttgagtgtgtacttgcaatgttgatgtatcattttgattggaaacttcccaacggaatgaaacatgaagatttggacatgactgagatatttggaataacagtcactagaaaagataatttatatctcattcccaaaacttttcatacttag

SEQ ID NO: 29917 - DNA, 621 bp, Glycine max
  Peptide Sequence Number=SeqID_146695
atggaacgctacccatctaaagttctacttcagttgacctattgcatgactggtcttgacaaaagccaagacagatgtgttcctggtcgcggctccacaagctcatcaaacccaacatccacccttggtgaatctcacttctccaaatgctcacaaaacccaaggtccacccttggtgagtcttgcttctccaaaggcttgcaaaatccaaggtccgcccttagtgagtttcacatcgccaaaggctcgcaaaaccaaaggtctgcccttggcgagtctcttttctccaaaggctcgtcaaacccaagatccacccttggtaagtctcgcctctccaaaggcttgcaaaacccaaggtccactcttgatgagtctcgaatagctaaaggctctcataatccaaggtctacccttggtcagtcttgtttcaccaaaggcttgcaaaacccaaggtctgcctttggtgagtctcatttctctaaaggcttgctcacaaacccaaggtccgcctttggtgagtctcgtttctccaaaggctcacaaaactcaaggttcgcccttggtgagtctcatttctccaaaggctcatcaaacccaaggtccacccttggtaagccttga

SEQ ID NO: 29918 - DNA, 369 bp, Glycine max
  Peptide Sequence Number=SeqID_146696
atgttttgccgcttcaaggaccatttattcaaggtcctagctattgacatcgtggatgatggcttgtcactaatgttcaatcaggacgaggaaccctacttcctgttctactggcaatttgatcccaccaggttcaagtctttcgacgaggatctgttgacccttatggagagggttgacaaagctatattggagcaactaccagcctcgctggatttgcgagccattttgtctcttccttcggcagacgagccttccactgccttggatggtaaagtgccttaccttgtccttttttgtgtctcaggtattatgggtgacttctcttggaggcccctggtgaagaaggtcaaacttggaaggggttaa

SEQ ID NO: 29919 - DNA, 258 bp, Glycine max
  Peptide Sequence Number=SeqID_146697
atggtagaggtctccacggaggccattgcctccctcgcccaatattatgaccagcctttgaggtgcttcacctttggggacttccagttaacacccacggtggaagagtttgaagagatcctgggatgctctctaggaggaaggaaaccatacctcttctcgggattttatccctccttagctagaatttctaagatagtcaaaatctcgacacaagaattagaccgcggaaagaaagtcgaaaatggggtggttggg

SEQ ID NO: 29920 - DNA, 729 bp, Glycine max
  Peptide Sequence Number=SeqID_146698
atgacggaggtcaatgtgactatagttgttgtcgcaagtaccaccatagaagtggacctgactcacccatctgacctcaatcaagtaaatcctccagtctcgggtatagtagggcagggaggcgaggcgttaggaagtatgggcgacccccattttgtgcaagttcagaacaaacattccttcccaccatatggcttgcctcccaactatacaccacccaatgttgcacatgctcctgatgagaatgtcaataactccactcctatactcattgagagccaacaaccccaatctgatcatgcacatgtctctcaacccatggaggagacacatgatgtaccccaccacaatctggccgacttcgatccttaccccggacatgccattgaagggcaagcatttggtgtgggaagagtccctattgccaaggtggaaagggaaaaattcaatcatatagaagaaaggctgagggcgattgaaggaagtggagattatacctttgttgacatggcagagttttgcctagtgcccaacatggtcattcctcttaagttaaaggtgtcggactttgataagtataagggggctacttgccccaagaatcacttgaagatgtactgtaggaaaataggggcatacgcaaaagatgaaaaactgttgatgcatttcttccaggaaagtcttactgaggcaaccgtcacctggtatactaatctggaacctttctga

SEQ ID NO: 29921 - DNA, 183 bp, Glycine max
  Peptide Sequence Number=SeqID_146699
atgaacagcagaaaccaatcaaggtacttaggaacggatgcaagtggggatggggtcacaactgaccgatcgttgccccttctctgcgctaaacaagcagagaacgtcgcgcaaggcagcccagtatcctttggattcgcagtattttactaccattgtttgtttttattaattaacgcctaa

SEQ ID NO: 29922 - DNA, 172 bp, Glycine max
  Peptide Sequence Number=SeqID_146700
tgctttaaaaggtcttgatgatgctccacagcctaaatcaaaggctcctactaggtggattgtcgtcaagatgtccaccatcattttaggaacttttaggaataattgggaagcgtattttaacgatcctagatcattggagccagagagattaaaggcattgcagatctag

SEQ ID NO: 29923 - DNA, 354 bp, Glycine max
  Peptide Sequence Number=SeqID_146701
atggctgtaataactcccgggaagatctaccaacatccggtcccaaaatggtatgatcatgacgcaacttgcacgtaccatgggaaaaccaacatcgatggcgaggagctacctttacccatgaactctgataggcagaatcatcttaggcagtggtcagatgccgggacgaagctgaaggcagaaaccaatcaaggtaaaacggtaacgcggtcacagtttgccgcgcaatgtcatttcctattttcaggtactgagggacggacgcaagtagaggctagggtcacgaccaatagatcgtcgtcccttgcccagctctggacaaacgaaaaatgccactgcaaggcaacctag

SEQ ID NO: 29924 - DNA, 102 bp, Glycine max
  Peptide Sequence Number=SeqID_146702
atgatttctgttaaccctgacccgggaagtcaggtggaaggcggaggtcccgttggttgggatattggtcggccgaatgatgttccggttgaacgaaattag

SEQ ID NO: 29925 - DNA, 426 bp, Glycine max
  Peptide Sequence Number=SeqID_146703
atgcgtagtgattgcttagtgaaattctccattctcaacctttttcggagccccaagaattgcgttttcgttcatgtgtcctccaccttcgaggttggagctatgcgtagtgattgcttagtgcaattctccattctcaacctttttcggagccccaaaaattgcgttttcgttcatgtgtcctccaccttcgagtttggagctatgcgtagtgattgcttagtgcaattctccattctcaaccattttcggagccccatgaattgcgttttcgttcatgtgtcctccaccttcgagtttggagctatgcgtagtgattgcttagtgccattctccattctcaatcttttcggagccccattaattgcggtatcgttcatgtgtcttccaccttcgagtttggagctatgcgtagtgattgcttag

SEQ ID NO: 29926 - DNA, 339 bp, Glycine max
  Peptide Sequence Number=SeqID_146704
atgtcgtcaccttcaaaggactacacgtcctcgccttcagaaggttacatgccctcgccttcagaggactacatatcctcgccttcagagggctgcacgccctcaccttcagaggactacacgtcctcgccttcagagggctacacgctctcgccttctaaggacttgacatggctacatgtcctcgactttagaggactgcacgtccttgcctttagagaactgcacgtcctcgccttcagagggctgcatgcccttgccttcagaggactacacgtcctcgcttttagagggctccacatatgcgccttcggtggacttaaggtcctctgcctttaa

SEQ ID NO: 29927 - DNA, 285 bp, Glycine max
  Peptide Sequence Number=SeqID_146705
atggccacaatgatggaggccatgaagagcactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctaggaaagttattcctaatacccaaacatggtcattcccaagttcaaggtgctggactttga

SEQ ID NO: 29928 - DNA, 254 bp, Glycine max
  Peptide Sequence Number=SeqID_146706
gatcttgaagaggacccagaggagttacctcctgaacctgctatggacgcccttgacttacctgaggatgatgaagagccactccctgatgttgattctccagaggatattatgtcagcatctgaggcagactctacagagaagagtggccctggagggacagcgaatagtgacgactcttcatcggacgccactattggtggtatcagagcagaagttggtatcagtggcgactatgatccagaaggtgctag

SEQ ID NO: 29929 - DNA, 447 bp, Glycine max
  Peptide Sequence Number=SeqID_146707
atggttccactcagatacactccaccaacttcaggtaaagtccaaagaacaggaaaacctttaaggtttctccaactattgtcacccacgccaaaaactttcatctcagtcttttcagatacatcaagtgagagcatagtcaacgcaattgctacaaccttgtatttgtcacttgacggatcattgccaaacccaaacattgttctacgaccgatgcccggggaaaaagacagcgctgacgattctctggatatcacccttgtcgccttgttccagaaacaaacatggtatccttttggtatttcgctaaccccacagtgcaacccattacatgaaccgaccagatgggatggattcgaggcagacattttttatcgattgaaggtgttccaaatcgtccttcgcagcagatttgcaaaggtgcaatttgatgaaatagggttctga

SEQ ID NO: 29930 - DNA, 429 bp, Glycine max
  Peptide Sequence Number=SeqID_146708
atgtgtgattttcaaactttaaaaaccagaatacacaatacccttaagctaaccaacaagcaatttttggatgaaatttactaccggcaacctttcacgtatgcagctactatgacccctactcatgatgccctgctatattacaatgggaggtggaacatgtcacgccaaaatgagtttgttggttactcgttcacaggaaaaactcccaaaaactttgacattcccaccagatgtaccatggatgaactgaaggatttgatcaagcaagttgcgcctcgtgggattcccccttatggtattgatgaaacacaaatggtgctcattgagtctaactactggaaaaagattgggccaatagaaattttagctgttttcagtaaacctgtagtgcaaatggaagacgagttgtccttgtcgcaaaattag

SEQ ID NO: 29931 - DNA, 180 bp, Glycine max
  Peptide Sequence Number=SeqID_146709
atgacaggtggatgcactactcgggtcatatcgttccagcaagtgaggccacgcatcagatcctttgccagatggtcatgccccgcaaccccgagtcgtccctcaggccccatagacggatatcccccacgtgccggagctaggagcactgtcgacatctacgaggcacgctgtagatga

SEQ ID NO: 29932 - DNA, 684 bp, Glycine max
  Peptide Sequence Number=SeqID_146710
atgacaattcatgatagtgtaaagggaagaaggaatctaccaaacgacaacgacaccttcgtcgagcgtttgagccttggcgaggacacggtcgaagtggttttcgctggaaataggttgaagccacaggagagggaaatcagcggagaggcggaggaatggaacccgaacctgaagccgaagctgaagcagaggggtagtgaatcgggtttggttgatggggttattgaggagagtggtggatgcggaagaattcgaatgtgttgtgacattgctgggaaatggagaaacggaatgaggtttctgcttcttcttcattctttgcgcttcttcttcacgtccccatcaatcagcggcacttacaagcccaagtcaacctcagaggatttcttcttcttcttcttcgttgaggaggttgtcgccattgttgccgtgattaggaggttgtcgcgttgcattgaggaggcttccgcgaacagcaacgccaccgtccaccgtcgagagagcttcgtcaccgtccactatcgaggtaagcgctgtgaccctgtccttcttccaccattgttgccgccgatagcggaacgtgatctgaaagttcttgtgagttttacggatcacctgatccgtaagcatgttatggatcaagttgatccggaagatgcttacggatcacttgatccgtaa

SEQ ID NO: 29933 - DNA, 228 bp, Glycine max
  Peptide Sequence Number=SeqID_146711
atggcacatagtttgtccttaagtagaaaagccattttggtcacaaccgtagtccctctctccatagacgccgcatcaccacaggacatcatttttggcacgatgacaacaacttgcacaaaggaggataggggttgcttgtcattctccctaatgctagacggagagagtcacttagagagcatttgcctctccagtttcccaacaaagacaaatgacaatggttga

SEQ ID NO: 29934 - DNA, 423 bp, Glycine max
  Peptide Sequence Number=SeqID_146712
atggatgtaatgttgtttctttgctgtagtggtgaaattttgtcttgcacactttgggagaattactgtactcagttcctatcctatttgaatgaacgtggggatgatgggccgatggttattatattgacacatgccagaataaaagatgcacagggaagttatccagcttcagtgagcaattccttcaaggcgtcaaaactattgattaatgatcctatattggaaattcaagaatttaaagagaggcttttagatttaggtgttgaggtgagtcgagttttgctacctggcgatcaagcaagctcacaagtttcagggggaagtcagctatcatcaaaggattcgtttctttcaaaggctgaagtcaaaactattttagaaatcaatgccatttctgagttggaagtcgaatttggctag

SEQ ID NO: 29935 - DNA, 330 bp, Glycine max
  Peptide Sequence Number=SeqID_146713
atggttagagagggagtccaggaaaactcacaagttactatttcaagcactttccataagatttttcaggtgttagatatatggaaggtttttgttagggaggtggagaatccattgttgcttgaaaaccagcttcacaacatctttatagggaacttgaagattatgggaaaggacaagtacgggttgaaaaattgtatgctcatgatgcgtcagaaagggagattcacaaatgtcatgtgggaaaagaagggtgtgtgtggtttgaaaattgacaaggaagaatggtggggacaagaaattaaggtggaagaatgtaatactgattag

SEQ ID NO: 29936 - DNA, 228 bp, Glycine max
  Peptide Sequence Number=SeqID_146714
atgaagaacggagaaaagagggaggtggttgctgcccagctcgcccatgcaagctcaactcgcccaggcgagcaggattacaccgccttcttttggaacctcaggaaggctcaagtgggcctgggattacgcaacaatgcttgtttcgagggttccgaagggtgcaaacaaggttcaaggaccgactgcaagtactcccggatgaaattagggtatgctgtagcctaa

SEQ ID NO: 29937 - DNA, 362 bp, Glycine max
  Peptide Sequence Number=SeqID_146715
attatgcctttgctaacctagaagagttgttcctagcacccaatatcatcacccctcctaagttcaaggtgctggactttgacaagtacaaggggactacttgccccaagaaccatctaaagatgtactgtcggaagatgggggcatacgtaaaagatgaggaattgctgatacattccttccaagaaagtcttactggggtagctgttacctggtacactaacttggaaccttcacgagtccatgctcggaaggacctaatggttgccttcgttaggcagtgtcacccaagtggtacccccaatgatggaaaaggagacgataatcgtgatggtagacacattatcgatattctactatga

SEQ ID NO: 29938 - DNA, 402 bp, Glycine max
  Peptide Sequence Number=SeqID_146716
atggcttatccacctacctcgcctcctcctcctccttcttctcctcctcctcctcctccttatcctctttcaaacgcatcagctttgtcggctatcgtgaagcggacacgcaaagcctcacgtctacgatccttgtctactagaccacctagtgttgagagacctgtggtccacgttgatcctgctaccagcaaggccgacggtggacgtcacgtacgagaactggaaggaggtccctactgctcagaaggacttgatttaggaggacattcagacctcacaaggaaatgggcccttgcagccgctcaggatggtgtggatgacactgtctatgagagatacggcatacgcatggaaaaatgggcccagtttttccagactcgcagagatccttcttgggag

SEQ ID NO: 29939 - DNA, 552 bp, Glycine max
  Peptide Sequence Number=SeqID_146717
atggaaaacatcttaaggtccaaggagtattggcaagttgtatcgaatggaattcctataccagaggccggcatggcaatgacaaatgcacaaaaaactgaaatagaagggttgcgtttgaaggatctcaaggcaaagaattgtcttttccaagcaattgatcgcccaatcttggaaactatcctttgcaaggatacatcaaaggacatttgggattttgtgaagaagaaataccaagctatttgggtgagaaaaattcttgaagagctttgtttcaagcaacaaggaccaactccaatatattgtgataacaattcagtaattaagctctctaagaatccagttttacatggccacattaaacatatagatgtgaagtatcacttcttgaggaatctctcaaatgatggaatcataaatctgattttctgcagaagtaaagatcaagttgctgatatacttactaaacctctcaaagcacctttatttcagaagctacaaaattgcttggtgacgtggggtatttcaatggattctgttattgctggataa

SEQ ID NO: 29940 - DNA, 411 bp, Glycine max
  Peptide Sequence Number=SeqID_146718
atgacactaatgaaccaaagtacagatcctcgtatctattctatagcacgatatggtaggtcttactcttccatgcaaagtatagttagtgtgctactatggctgaaaggaagaggagatgagtacagaaacattctgggtttgggaactattccaacaggaactcaattgcaaacctttgatgcctccagcttcatcggcaacaatctatgtgggccaccactgcccataaactgcagctccaatgggaaaactcatagttatgaaggaagtgatgggcatggagtgaacaggtttcttagctgtggcacggtacccggagtgggtggccaacattgtcccagtcccgaaaaaggacggcaaggtttgaatgtgtgtagactaccgggacttgaaccgagccagtcctaa

SEQ ID NO: 29941 - DNA, 138 bp, Glycine max
  Peptide Sequence Number=SeqID_146719
atgggcgtcgaacaaggaggagattcaatattgggcaaccatgtgggagttgtggttacagcatgggcatctctctcttttttcttaactccacctgttccagtcctcctattgccagcacttgttgaagtagcataa

SEQ ID NO: 29942 - DNA, 330 bp, Glycine max
  Peptide Sequence Number=SeqID_146720
atgggggcatacgcgaaggatgagaagctcttgatgcatttttttcaagagagtttggccggggcagctatcacttggtacactaatctagaatcttttcagatccgttcttggaaagacctaatggttgccttcatcaggggagcatgggtccttcaaagaatacgcccagaggtggagggatttgatgactcaagtagcgcccccaatgatggaaagggaaatgatcacaatgatagtagacactttacctgtgttctactacgagaagatggttgggtacatgccctcaagtttcacggatttggtatttgcgagcaaaaggattga

SEQ ID NO: 29943 - DNA, 609 bp, Glycine max
  Peptide Sequence Number=SeqID_146721
atggggtcggaccaagtgccaccttttaaaaagaggttctatcatgtcaaagtcaagaatctagagctagctagattgcgaaaactagggcaatggatggatcaagttcagtgccaagccttcagcaagatgcttcacttttggggactttcagttagcaccaaccatagaggagtccgaagggatctcaggatgcccgctagggggaggaagccataccttttttctggattctatccttctatggcaagaatagaaaaaatggtcaagatctcggaacaagagctagactatgtgaagcaaaataggaatggagtggcagggataccaaggaagcgcttggaggagaaggcgaaagctctggctagccaaggagaatgggcagcattcatcaacgtattagctttgctagtgtttgggacgatactattcccgaatgtagacgggttggtggatctagtggcgatcgatgcctttcttgcttatcaccacagcaaagaaagcccgatcatcgctattttggcagatttatatgatacattcgacttgagatgcgagaagagcagtgcaagaattgtctgttgtacgcctgctctttatgtatggctg

SEQ ID NO: 29944 - DNA, 867 bp, Glycine max
  Peptide Sequence Number=SeqID_146722
atggatggatcaagttcagtgccaagccttcagcaagttagcaccaaccatagaggagtccgaagggatctcaggatgcccgctagggggaggaagccataccttttttctggattctatccttctatggcaagaatagaaaaaatggtcaagatctcggaacaagagctagactatgtgaagcaaaataggaatggagtggcagggataccaaggaagcgcttggaggagaaggcgaaagctctggctagccaaggagaatgggcagcattcatcaacgtattagctttgctagtgtttgggacgatactattcccgaatgtagacgggttggtggatctagtggcgatcgatgcctttcttgcttatcaccacagcaaagaaagcccgatcatcgctattttggcagatttatatgatacattcgacttgagatgcgagaagagcagtgcaagaattgtctgttgtacgcctgctctttatgtatggctggtatcccaagtttttatttatcatgaaggtagatttgtctatcccctacaaggtcatcacatgtgctctaaaaagggtaaagcaaattgggaagaactctttgcaggcatgacggaagcatccattagttggttcccatggtggaatgaaggaggggaaggagtgttatgtcatttaggctaccctatgagaggtgcgccgtcagaggaaatcatcatgcctttcatctcgcgaggttttaatgaagctaatgcaaagatacttcagaaaatctataaagcatggaatagagtgggaagaaaagataaggagcttaggggaagtagcaatggcgttattggtggctatcacaagtggttgaagtctagaacataa

SEQ ID NO: 29945 - DNA, 246 bp, Glycine max
  Peptide Sequence Number=SeqID_146723
atggcacttgggaccatggcagcttgcccaagcgagctaagacttactcctaaagtaactggcttgcccaggcaagctggttccttcagcctgaagccatttgagggcccaagtgagccaaagactagcctgggcaagctagggtccatgaaactcaataaaaagacctttttgccccttctttttggtatctttctcattcttgatcaaaacattgaacgatctttcgtcttatgcggtaactag

SEQ ID NO: 29946 - DNA, 240 bp, Glycine max
  Peptide Sequence Number=SeqID_146724
atggccgagagaaattccgaggagctttgtggggtagcaacaatgagctcaagctccgaagagaggaaagagaccggtcacggggaattcaccataactaagaaagcacaaaggaacccctataacactcgatccagaaaaatggataatgaagagggcgtgcaagagcagatgaaggccgatctatcggccttaaaagatcaaatggcttctatcacggaggccatgctaaaactctag

SEQ ID NO: 29947 - DNA, 354 bp, Glycine max
  Peptide Sequence Number=SeqID_146725
atgacaagcaaaagtagctcgtggcggtcaccggtggttagtggtggtggaggaggagcttggggtgttgggggagggtttaggggaagagaaggaggaagaagatggatgttttacgctgctagacggtgttacaaatcatcttgcaacccctcgattgaatcacaccagaatgagagggatccaaaggctgaacagtgcagttcgaaaggtttttcgatgtttcggaaaagaatacaaaaaacacccaaaagggagggcaaaagggtcatttggaagctttttctgactgttggctcactcaggctagcctttggctcgcttgggacaccaaataacttcatggtgaagtaa

SEQ ID NO: 29948 - DNA, 183 bp, Glycine max
  Peptide Sequence Number=SeqID_146726
atgcatagagaagaacagtttgatcggagcgcaatcttcaaaactcaactcgaggatttggtagagaatgaagcctccaatccttcctttgtggtttcttcgagacttgtgttgtctggagacttggggagtgtgaatctcaggcatgacccatatatgtatatgcggagtgtgacttactga

SEQ ID NO: 29949 - DNA, 132 bp, Glycine max
  Peptide Sequence Number=SeqID_146727
atggctcgcgtgaggggaccaaagcttttgatgctccgcccgccactccgtaaggtactgatcgaaactccccaggatagattaggcatcgaacaaagctttgtctctaccccagaaggtagctcaacatga

SEQ ID NO: 29950 - DNA, 249 bp, Glycine max
  Peptide Sequence Number=SeqID_146728
gttcagggttcaattattgacaaaatcattcagctcataaagggtgcaaatgatacaattataattcaaggtgagctttttggtcaaaaggcttgtgtatgcacaatcatggccttcatcatgtcctcattgatcgaggccgtacccgaatcaaataaacatgaaaatgcagcaacacatacaccagttagcccttcgtccgttaagcatgaatgccagttaggctcagaggccattaatccaacctga

SEQ ID NO: 29951 - DNA, 537 bp, Glycine max
  Peptide Sequence Number=SeqID_146729
atgagtcttcattcttcatctagtgttaatggtgagggttctactcctaaggatcccttgtataagatattagatgagttgagatcccttaagttgtggaaagaaaaacaagagagaaaagaaaaaggaaggcataggtcacatcttagacctcacttccatagaagagaaaaggaaagaaagcctcaagaggctaacattaacctctcatacttccatgggaaggacaatgtagaggctaacttagtttgggaaataagggtagagcaacaacttaaaaagaagtctacatcaaaatcttatggctctcactcttatccaaagaaagaccaaggtcaaggcatcttaggggtgacaccttctaagcccaaagaagataaggggaagaaaatagaaaagcaagcccctaaggctagtatgcaagagaaaactagctctctaaagtgctttatatgtcttggaagaggacacattacttctcaatgccccaccacaaaaaccatgattatgaggggccaagacatttatagtagctag

SEQ ID NO: 29952 - DNA, 360 bp, Glycine max
  Peptide Sequence Number=SeqID_146730
atggaagcaacaggcaaccaaatatttgaattgtggtttgttggcttttcctttagtttacctaggaatacctataggggccaacctgaggcgacgtcagatgtgggatcccattatccagaaatggtgcctaaatcaatggtggataagctggtggacctgaccaaaacaagattgcatggattaggtgggagacaatgtgcttaccaaaagaaaaatgatgaggacatgaccaagagcaagggcaaggatccacttgaaggacttggaggacctatgacaagggctagagcaaggaaagccaaggaagctcttcaacaagtgttgtccatactatttgaatacaagcccaagttttaa

SEQ ID NO: 29953 - DNA, 204 bp, Glycine max
  Peptide Sequence Number=SeqID_146731
atggagttcgcgctaagtgcaaccttgggctttctcgtgggccttcttcacgctaagcgtgagttagccgctaagcgagcaagtgcattgggccggtcttgtgcgctaagcgagctatccaaatctccaactcttcttcaaggctttttcttcaagtttttgcatcaactttcctccaaagcacttgaaattttcttcttttga

SEQ ID NO: 29954 - DNA, 174 bp, Glycine max
  Peptide Sequence Number=SeqID_146732
atgtacaacttcacaatgtttgataacattgtaaatggctctaccacccttgactatgtaacaggcacttatcctatagcaatacataattcaacgtatggttcccaaagatttgtaaataatgacatgaaggaaactatggaattcaaggatcagttggctacttcttactga

SEQ ID NO: 29955 - DNA, 232 bp, Glycine max
  Peptide Sequence Number=SeqID_146733
atgaatgctcaaaatttcgaaaacattggactttcgccgttggactttgtatactcgatttgtaatatgtttgaatcagatgaagtttctacaagtagcggcacgaatgagttgccttcatcacagattaatgaaaaatcagagaacgattttattgggaatattcctggttcagaagtacaggctgctgcaacttcaacaaattcagagccgaataaaaggccaaccccaa

SEQ ID NO: 29956 - DNA, 159 bp, Glycine max
  Peptide Sequence Number=SeqID_146734
atgaacgaagatcagacgaagaacggtgaagaatggcggataatcttcatggatttgctcacggaaacgtctcagaagcaatacggtagcacctcggcttggattttcttcatggaaacacggaaaaagggaggtgtttgccgcccagaggcttcttga

SEQ ID NO: 29957 - DNA, 231 bp, Glycine max
  Peptide Sequence Number=SeqID_146735
atggtgtggcatctccaatcatctttcttccatttccattccgctgccattgatcttcaaaaagaaaaggactccattgatgaagaagattcaaggcctacaagctccacatggagctacgtcaaattctctccacttctgaacattgagaccccttcaaacacccctaggatgcctatttataagcaaagggtcactttggggaagttgcagctcacccaggtgagctag

SEQ ID NO: 29958 - DNA, 213 bp, Glycine max
  Peptide Sequence Number=SeqID_146736
atggagatccataggcaatgcaagatagtgatgcaagttgatagagtaagtggtcaccacattgcaatggatgttgttacattgcctcgtcctttccttcaccctgggagccatgaactgaggcaaatgattttcttggatggcataaaggatggtgtttcacttgttttttggacacctagggtgatcgacaacgtccaacatgcaaaataa

SEQ ID NO: 29959 - DNA, 270 bp, Glycine max
  Peptide Sequence Number=SeqID_146737
atgtttttcaagtgtgatgacgtcgtgcccattgccttagaagatgcctttcgtgaactgagtagttgtgctaagcagaccctgtgggctcagcgtgcatccaccgttaagcatagcttcagcgcgcttaacgtgacaagggaatatggaagtgcacaaaaatcaaggccgcgcgctaagcgcgagatcagttcgctaagcgagacgtttgtctcttgccaggctcagcgcacagctggtgccaagcccaaatccacttactcgcgctaa

SEQ ID NO: 29960 - DNA, 366 bp, Glycine max
  Peptide Sequence Number=SeqID_146738
acgcgtggggtgctaataccttactcgtgcgtaaaaacaactcccgaacctttcacacttaaagttcgtagaccacaccttttccggtttttccgacattttcctcaaataaatgttggtggtgactctgcccgccttcctcccttggaagatgcacccgtgagcgtcgccctcccgctgaagggtaggttgcgacaaagtgcaatcaacttggtcacatcaaagcaaattgcacctcaaacgagcaatggcctgagaagagtgataagaaaagtcatgaagaaagaaagaccaagaaggcttacatcacttgggatgacaacgattcatccgaagaatctgaaaaggaggaaatcaaccttctaa

SEQ ID NO: 29961 - DNA, 423 bp, Glycine max
  Peptide Sequence Number=SeqID_146739
atggaactactccttttaagagctggacttagggaagaggaaagaacaagcatagctaggttccttagtggacttaatatggaagtgagggacaaggttgaactccttccatatagggacctagatgagctagtccaactttgtataagagtggagcaacaacttaaaagaaagccttcttcaaaatcttgtggctctcactcttatccaaggaaggaccaagcccatggaattttgggggctgcaccttcaaaaccgaaggaagataaggaggtcacattgcctctcaatgcccccacaaagaaaaccatgatcatgaggggtcaagacatttatagtagtcaagaggagactacttcttgcccttcctctagtgaaagtgaagatgaagtaaggggtgaagagtctagtgaggaagtctaa

SEQ ID NO: 29962 - DNA, 135 bp, Glycine max
  Peptide Sequence Number=SeqID_146740
atggggccccaagagctacaaaatggggcagatgaggaatgggtttatgcaagacacatattaagtagaagacaaagaaggcctccttcttggggggctagagccattagtgagataccattctggaagaactag

SEQ ID NO: 29963 - DNA, 2209 bp, Glycine max
  Peptide Sequence Number=SeqID_146741
gatgcttctgtgattgggttcactgagagttgtgtgctgaagattaagcttgaggtggagatcaatgggttggaagagatctggtttggagtgggagagagtgaagatctatggacaagttctattgggatttctgtatatctgcacaattcagacttcaagtgcattagtgatctaagcagcaacaacattggaggaaatattccatccagtttgccagttaccttgagaaacttttttcttgcagccaaccagttcactggaagtattccgacctctttatccactttgactggactgacagacatgtctcttaatgagaactttttaactggagaaataccagatgcttttcagtcacttacacaattgatcaatctagatttatctcataataatttgagtggggaattgcctccttctatggataatttgttggctctgaccaccctacgcttacagaacaatcaactttctgggacacttgatgttttgcaagaccttcctctgaaagatttgaatgttgagaacaaccagtttgctggcccaatacctccaaaattgctaagcatccctgccttcagacaagctggaaacccattcaatgttaatggtactacaactcctgcttcttcacctcgctccccagcaatagcaccaccaggaactcctatttctggggcaccacccggaactcctgtttctgggacaccgccatcttctggtcgtgtacctactaaacaggctgatggaccaactgcagatttattctctttattccaaggtgtagcagaagagaacgggatgacagaaggtccaagcaacatcaaattggtgcatatggagccaaaagagggtcatcaagcagagagcaggagaacttgggttactccaaatccacagggtgagcaagagaaggatgtgcatagaaatagaatggcaacaataccaaagccagtagagcatgagatagatacgagtactctagaagtatattcaatgcctcctcctccccctccccctcccccgcctccacccccgcctccacctccacctcctcctcctactgagaaggtgattattgagccagcctcatcccgcagtgggactaatgtcaatcctgtgaatccatccattagaagttcagttcctcctcccacttttgcaaaatttttcgccattgcatcccttcaacagtatacaaatagcttttctcaagaaaatcttataggaggaggcatgttgggtaatgtgtatagagcagagcttcctaatggaaagttgcttgctgtaaagaaactggacaagagagcctctgcacaccagaaggatgatgaatttattgaattgataaataatattgacaaaatacggcatgcaaatgttgttgagcttgttggatactgttcagagcatgatcaaaggcttctaatctatgagtactgcagtaatggatcactgtatgatgcactccactcagatgatgacttcaaaacaagactctcatggaattctcgtattcggatctcacttggggcagctagagccttagaatatctgcatgagcaatgtcagccacctgtagtacatagaaatttgaagtctgccaatattctccttgatgatgatctatccgtgcgggtctctgactgtggtctagctccattaatagcttcgggatcagtcagtcagctctcggggaacctgttaactgcctatggctatggagcgccagaatttgagtctggaatttacacataccaaagtgatgtgtacagctttggagtgatcatgttagaacttttgactggccgtcaatcgcacgatagggcacgagcacgaggggagcaatttctggtcagatgggcagttccccaacttcatgatatcgatgcattatcaaggatggttgatccttcattaaatggaaattacccagcaaaatcattgtcaaattttgcagacattatctctagatgccttcaggccagcaatgtccgaggtcgtcctatacttactaaatatgatgaggaaggagtctcagcaaagtatctaatgctgaagaactctattcagtatctaacgcaaaagtttcctcctcaatgggaaacctcgtggtttggtggggattacattgagattgatctttggcgtgtgaatcatggaaatgtgtggagaagaaacaaagatggagggggaggttctaaag

SEQ ID NO: 29964 - DNA, 371 bp, Glycine max
  Peptide Sequence Number=SeqID_146742
atgccgatctccccctgcggaaggatcgcgcccacaagacacccagtggacccggaggagcccaatagggccctggggtttccagctctggttacgggcctctgtcaatcctacagggtgtccgtcccccccagcaaggatcgcgcccgcaagatacctagtggacccagagaagtccaacagggtcttggggtttccagctctgattacgggcctttgtcagttcaacggagtgcctgtcgcccccagcaaggtcatcaggcaatagacacaccgccgccacctctaaagcccctcagctcatcttcaaaggctagagcattgcctacgacccgtggccgactagcaggcgaccaagtccaaagccaaag

SEQ ID NO: 29965 - DNA, 453 bp, Glycine max
  Peptide Sequence Number=SeqID_146743
atgtggtcattaaagcttttcctagcaaagtcagaactgctcgcatcaaagaggtgggttggacctctccttcccaaggacctttcaaaattaacactatatcttgcttggccaaaagctcttcagatggttcttgaaggggtttaccaatctcatccttttgctgctttggtggataagattcctaaactcatatcttatgattggaacttgtcatttcctcatacccttagagaaggaaacaggatagcagatttgtgggcaaaacaggatgttttggaggttgcttctctcgtttctcattgcagccatcctcttgatctcgaggatagtctcttagctgatgctataggcatcctttccatctcgagcaaatttaaaacagattattgttgcacaatgcaaaacgaacataatgcacacacaaaaacaaaaaatgcaaaacgaatataa

SEQ ID NO: 29966 - DNA, 216 bp, Glycine max
  Peptide Sequence Number=SeqID_146744
atgaaggagttcaactttttcattgaggatatggagttagtggacacacaattggtaggaggaaattcccttgagttcgagccagagagaataaaaggtctagacagaatattccttaagggttgtttccatcgagtacaagaagcacatgcaattgtttgtcctattgcttatttcctcttgaatcagagcatgccacatagccttatctcctag

SEQ ID NO: 29967 - DNA, 468 bp, Glycine max
  Peptide Sequence Number=SeqID_146745
atgggagaagaactgaagaagacaattggtaatatcatggatgatataacattcaaataccctttgaatacatttactagtattgagaagtacaaattgatcttctggtcattgaggtttcatggtaaaattttgttccgtgagattgctctagaagtgtataggatatggcagcctttggagaatgtgatattgattaggtggaacctgagggatgtgcctcaggttccatgggaggctaagggaaaatttcaagataatttagcattcaactttccacacaccctcaaaccagtttcagttttggatttggttactgcttgccctgcaagtccaaatctaacattttcatggggtcctttggattccaactcttcttcatggttagagttttatcaggctgttaagtacactgtggatcaagaagagaggttgctaccacaagagtgtatggctacatgttcatag

SEQ ID NO: 29968 - DNA, 600 bp, Glycine max
  Peptide Sequence Number=SeqID_146746
aaaaaaagaagaaggagtagagacgagagtcgtcatggactaatcatggaaagggcaagacagacgaaatcagtgtcttatctttgctttcctcttatctccgataaaaggctcctcgcgcttggtatcaaaggttttcttattttgttgctaccattgggttctctcacaaaacaatatgctgcaaaaattattgaacgtgccggcatgtctaactgcagttcatgtcctactcccgttgacactatgtccaagcttagcgccaccggcgatgctccttttaacgatccaaccaaataccgcagtcttgcaggggctcttcaatatcttactttcactcggcctgatatatcttatgtcttgcagcagatttgtcttcatatgcatgctccgacaaatgagcatatgagtgctctcaagcgtatcatacgctaccttcagggtacgttatcccatggtttgcatttgtacaaatccaccattgatagactaatctcttatacagatgctgattggggtgggtgtcctgacacccgtcgttccacttctgggtattgtgttttcctcggagataatatgatatcttggtcttccaaatga

SEQ ID NO: 29969 - DNA, 735 bp, Glycine max
  Peptide Sequence Number=SeqID_146747
atggtgcttattgagaacattatccaaactagtgctaaagaaattttccctagttacattggtcaactagatgaagagagtgttacaggaattcagtcatcagctagattatcatggctacatctcattgatttgaaaatagcttttgaaaaaaggattaagtctttggtagaccattctgggatcttgctatcctttgatgatgatatcatgcaaaaaaattcttctctatctgtattttgtgatcatccagattggcttgatctatgggctgaaatagagctaggtgatgccctaggtaagttgaaaccagacatccaagatgagaataattgcagaaagaaagttcaaagtgtggttctttcatcctatagtgatgatcacaagtctcctctgatttctaatgcctttcttcgccatctagcatctattattgatcgatgccgatcattgcctagtgtatttttgaggtcaaaatttctcagatttagaggtgtttctattataagaaatttttttgattccatacttatccgctgccaagaagctaaaggtttgactaccttaaccgatgatgattctgtaattaaagttacaatttctgtcaatgttgctcattcctttcaatttgttctaaaggaatggtttgaggatgtctttttccttgagatgggaatggatgaggatgataaaacagaattggaaagtaattcaaatagttatgaaggaaattga

SEQ ID NO: 29970 - DNA, 912 bp, Glycine max
  Peptide Sequence Number=SeqID_146748
aggccaacacgccctcaccttaaaaggcctacacgccctcgccttcagagggctacacaccctcaccttcagaggactactcatccctgccttcaaaggactacacgtcctcactttcagaggactacacgtcctcaccttaagagtgctacacacccttaccatcagaggactacacgtccccgacttcaaagggctacacgtcctctcctttacaggactacacgtcctcaccttcagaaggctacacgtcctcgccttcacaggggtagatgccctcaccttcagattactacacgtcctcactttcaaaggactccacgccctcgctttcgtggggctacacgccctccccttcagaggacaacatgccctcaccttcagaggaataacggttctgaccttcagagggcaacacgccttcaccttaaaaggcctacacgccctcgccttcagagggcaacacacactcaccttcagaggattactggtcctgaccttcagagggcaacacgccctcagcttaaaatgcctacatgtcctcgctttcaaagcactacacgtcctccccttcagtggagtacacgtcctcaccttccgaggactacacatcctcgccttcagaggactacacatgctcaccttcagaggactacacctcctcgccttcagagggctagattccctcaccttgagagtactacacgtcctcgccttccgaggactctacgccctcgctttcatagggctacacgccctccccttcagaggactacacgtcatcaacttcagagggctacacgccctaaccttttgaggactacacgccctcgccttcagaggactgcttgtcctccccttcaaaggagtacatttcctcaccttccgaggacaacacgtcctcgcctttag

SEQ ID NO: 29971 - DNA, 1023 bp, Glycine max
  Peptide Sequence Number=SeqID_146749
atgaccacaccttttaaaacaaaagatatcaatgaagaagtcacctccaaagacatcaaaagcctaatggaacaggctaattacagaaacaaatatcttcaggtattaggggagtccattaaagcaaaggcatcttctaaacagagaactcatgaagaatctccatcaaatatcctgatagaaaaacccttattcaaaccatttaaggttagtgaaaaagaaaaacaaaagattaggaaactaagaaaacacaaatcccttacagaaggggtaggtgacaacaatagtgaattattaaataaaattgatagtttacttaagttcacccctaaaacacctcaaccttcggaggaatcatccaaaatgagaacaagaaatacctccaaattaattaatgttattaatgaagatagtgaccaaaactcagaacaaacatctgaagaaggctcaatatctggaaaagacattaatccaataaattccaaacattggaaaacaccctctaaacttaattatcaacgaccaatcgccactgacctcctattagaaggaagaggcgaaagtaattttaaaagctttagtgcaaataatttctatgaatggaatatagatgcccaaacaaaatgcaatattatgaatacactccaacacatgaccatggtagccacggcataccagacatcccatgagtgttcggaggaaacaatcatagatatcctagttgcaggattttctggccaattaaagggatggtgggataattatctcactaatgataagaaggagattcatgacgctgttaatacccttatttttacaatagcccagcattttattgatgacccatcactctggaaagataggtcagtagaactattatcaaatcttaagtgtagaactttagcagactttagatggtatagagataccttcctaactagagtttacaccagagaagatagtcaacaacctttcaggaaagaaaaatttctagctggtcttccaagatcattaggagacaaa

SEQ ID NO: 29972 - DNA, 561 bp, Glycine max
  Peptide Sequence Number=SeqID_146750
atggatgtaacaataccatcaggttataagagcctgcgggatggagctttcaaagacatcaggtggttctggactcagaacactggaagtgttccctctgcaaactcaaggctctcgccccttcctccagagccttacgatcgtggggcaactattgacatcccccttgataatgcaaaggacataaaagcaaaggagaaggaacttcaagctaaagaggctgaattgaaaagaagggaacaggaactaaaacgaagggaagatgctatagcacgagctggaatagttatagaggagaaaaattggccacctttttttcccatcattcatcatgacattgcaaaggaaataccaatacatcttcaaaggatccagtacattgcatttacaacatggttgggtttggttctgtgtcttttatggaatattgtggcagttactactgcttggatcaaaggagaaggtccaaccatctggtttcttgcaattatctattttatttctggtgctccaggatcctatgtgttgtggtatcgccctctttatcgtgctatgaggtag

SEQ ID NO: 29973 - DNA, 304 bp, Glycine max
  Peptide Sequence Number=SeqID_146751
tgctcatttctttttcccctctttctacaagcagttgcacattgccttttgcattttagcggcagttgctccaccaattatcttcaaaggaaaatctctcacaggcattttggctgcgattgacgtgttgggcgacaatgcattggttgggatattctacttcattggatttggctttttttgtctcgagtcagtgctgagcatctgggttatacagcaagtatatatgtacttccgtggcagtggcaaggctacagttttaaaacgtgaggctgccagaggcacaatgatggcagctctatga

SEQ ID NO: 29974 - DNA, 1713 bp, Glycine max
  Peptide Sequence Number=SeqID_146752
atggctttccaacacgaaaacgggtcgaatattgacccgaatcctattggggtggagacagcaatggcttcccagcacgaaaatgggtcggaaattgacccgaaccctactggggtggagacatcaatgtcttcccttcacgaaaacgggtcggaaattgatcagaaccttattggggcggaggcacatgaagcggaggctgaaaagtttggaactttgggttgtgctggtcctattgaggaaggcttggagaagatcactttggtgggttcctctctttcagttgaggagaacggtgttaaggatgatagtgaaattgaagttgaaattgagagtgagagtgaaagtgaaaattcagagtctgaaagcccttcttctgattctggtagcggaagtagtagtagcagcagcgacagtagtagtgatagcgaggacaccgacgatgatgataaagatgatgatgtggaagttgaagaaggcgagataagtggttccgatgaagagaaaatggttagttggagcatggctgatgaggatgatgatgaagatggtgatgtgggaggaggacccatcaggtcaaagaacgagcttcagaatctgcctcctgttcctccggtcgatgtgactttggaaccacaccatcaaacactgccagtgggaattgttacgtcgattcttggtgctcaagtcattgtggaaggagtggagaagcatggccctcttaatgagggttctattctttggttgactgaaagtagaaaaccattaggtttaattgatgaaatttttggaccagtcaagaatccttattatgttgtgagatacaattctgaaagtgaagtccccacggggatccatgagggaaccttgatctcctttgttccagaatttgctgatcatgtgcttaataacaaggatctttataggaaagggtatgatgcatctggtgcagatgatgaagagttgtctgatgaaatggagttttcagatgatgagaaagaggctgaatacaagagaatgcaaaaacagacaaagagaggcgcaaacgatcaaaatcatggcaagaaaaaaaacaacagaaagaaattttcaccgaaagagcatgcggcacctaccatccatgctgcaccaatgcttcatcatggaaactgtcctcctttttctggcactggacaaggtcttatggggggaactaccccacttccacccttaaacgtagctccaacctttgctacaaatggagtctggacaaacggaacaacatttccacatcagcaacagtctcccatgcttcctaatggatatcccacaaatggcatgccatggtacccacaaaaccctcaaatttctcctcagtttcctatgccaggaattccatttcaacagcaattacatcccaatcagggatctcttcccacaactatgctacctgggatgcccgatatgtttgctcaatcccaatatgcagcaggacttgccggtcaaaatcaaatggcatttgggatgggttcaccctttccacagagtcagccacctatgtttgctgcacagcagggttttccatccaccgaattgcattcccaaagaaacctgaattttcattctaatactatatctggcgcccgatctcaatttcatccgcgttcaaatgctaatcgtgggagaaaaacatttcatggtgcaggtaggaaagggtggcgaccacccaagtga

SEQ ID NO: 29975 - DNA, 630 bp, Glycine max
  Peptide Sequence Number=SeqID_146753
atggcgaacgggttagagagagaaagtgggttgacgttgttcagcgaggaggagctgagggaggtgagtggggtgaagcgtgttggggactatgtcgaagtcacgtgcgggtgcacgagtcatagatacggtgacgctgtggggagacttagggttttcgttaatgggtaccttgagatcacttgtgaatgcacccctggttgccaagaagacaagttgactccttctgcatttgagaaacactctggaagagagactgccaggaaatggaagaataatgtctgggtaattgttaatggtgagaaggttccattgtgtaaaacagtgctgctcaaatactacaatcaggtgtcaaaagctgcaaatggctcccatagatcccataatggtcgggcttgtcaccgtgatgagtttgttcgctgcactagttgcaataaagagcgtaggtttcgtctgaggactaaagaggaatgccgcattcaccatgatgctttggcagatgcaaattggaaatgttctgatcttccatatgacaaccaatcaatacttgctagtttgctgagtattatgcaagctatagtatacagtcttggtgatgatgtcattatgtctcaagccgggggagattaa

SEQ ID NO: 29976 - DNA, 240 bp, Glycine max
  Peptide Sequence Number=SeqID_146754
atgggtgaatacaaccaactatcattaagaatctcatccttagaccaaaaacaggcaaaaggtggaataccgcaaagagaaagcgtacccactaaaaaagaagtttttgtaattggtagaactatgaaaagaggaagaagtcgagctacaagaaaaattcccgcggctaccatagtagcagcatgtataagggcggaaattggagtaggcccttccatagcatctggtagccatacatga

SEQ ID NO: 29977 - DNA, 270 bp, Glycine max
  Peptide Sequence Number=SeqID_146755
atgacgagatccaactcgaataacgaggttgtggcgctgcaaggtctagtgttgttattcgacgcatctagatctggtgcgatgcggcgcaccgtgagcaagtggtcagaagcattcatcaagaatgtggttcgacggtggctagaccactctgtcaagaatgcgtcagaagcattgtcgtcaaaggttgtggagaccttgtcggaggcgctgccaaaggatgtaaataatggtctgcagtggatcaattatgaaaatggttcaccctag

SEQ ID NO: 29978 - DNA, 303 bp, Glycine max
  Peptide Sequence Number=SeqID_146756
atggctaccccaaccagctctccttctcttcctcctcctcctactggtgttgcatcacagtttccatctatcttgaagcgcacaagaaatgccacacggctaagatcattggcaactagactagttggggtagagagaccgttggtccatgtcgatcctgcgactgggaaggccgacgatccccacaataagaagttaagaacatatttggggatcgtcactcgttataaggtcaatgtcacatacaagaattggaagcaagtccctgctgctcaaaaggatttgatatgggaggatattcag

SEQ ID NO: 29979 - DNA, 255 bp, Glycine max
  Peptide Sequence Number=SeqID_146757
atgtgcaagggactcgtagaggacacgcggagggagttgcaaaggtggctggaccgtggtagacggggtagtgatgggttgcagggaaggagtgttggggggcacagggaagggattgcactgagaggcccaatactgctcacaacaaggagagaaggtccaagaagcccattacagaagctcaatgtggaaagccgaatcgagtgcatctttgaattgttggtgaatatttatggcaaaagctcaatgtgctga

SEQ ID NO: 29980 - DNA, 1782 bp, Glycine max
  Peptide Sequence Number=SeqID_146758
atgacagtggagaggaggcagcattttcccgtggaactcactgcagtggatcacaaatcgcaagcacgcagccagagaagaccgccagagttctggtcagagacgacggagaaaacaaaacttcgaaaattcaattcaacttccaaccattatttaatccgcaactataaattcaagtcagagtcctaccgaaaaaaaaaaggatgtgtgggatccaagactaagaaaacggacgaggcatacgtcactcttttgtacggggatgaattcttgttgggtgttcgagttctgggcaaatcaatacggaacactggatccaacaaggacatggtcgtgttggtctccgatggtgtgtctgattatgccaaaagcctactccgggctgatgggtggatagtggagatgattagtttactggctaatcctaatcgagtgcgtccaaagagattttggggtgtctacacaaagctcaaaatatttaacatgactgactacaagaaagttgtttaccttgatgcggacactattgtggttaaaaatattgatgatcttttcaagtgtgggaaattctgtgctaatttaaagcattctgagaggttgaattcgggagtcatggttgtggagccatctgcaactctttttaatgacatgatgagcaaaataaaaactactgcatcttacactggaggcgatcaaggatttctcaattcatattactctggatttcccaatgcacatgtttttgagccaaatttgagcccagagatgtttagttccagacccattcctgaaatggagcgactatcaacactgtataatgctgatgttggtctttacatgcttgctaacaagtggatggtagatgagaatgaactccgtgtgattcactatacactgggcccccttaagccttgggactggtggacgtcttggcttttgaaacctgttgatgtctggcaggatgtaagggagcagcttgatgaatcccttcctggaacaggagggggccagaattctaaagacagttttcttgtgaaatttctgtttctgctaccattctgtgctttactcttctgctgctatcattcatttacaaagaatcaagggtacttcagtacactttgcagaagctcactatgtgatcaagtcagacacctttattataggattagatcaaatggaccacttgcatataatagtatttcgacatcaacaaccaattcagtccatcagctcttaaatggtgctcagaacaaggctcctgcatatttgggtggcatttctgtctgtgtctgttttgtggttgcagtggtgtctctgggactagctctcttgattgttcctcggcaagtgatgccatggactggattgcttttgatgtatgaatggacattcacaattttctttatattatttggaggttatatccatttgatttatcagtggggaaaaatagtgggatcacgcgtagcatcttccttgtcacagcctgggtctgattatgattccgaaaaacgtcatcagcgacagatatcatcttgtgatgttgctacatggtactatggtttagggatggccctgttggccattgcagctccatcgttgccttgtctttttggaattactgccttgtttttaaggttaggtttgatggttgttgggggcataatattggcttctttcatgacatatgcttccgaacatcttgctatccgatcatttctcaaaggctttgatgagcgcgaaaatgctcgaaatagtggctcatgtttcttatgttga

SEQ ID NO: 29981 - DNA, 300 bp, Glycine max
  Peptide Sequence Number=SeqID_146759
atggattggaatacgtttatatctaacgagtttggaatgccagttggatggagaaatatggataatgaaagtcaatttttttaccaacccaaccttttatgtggagtcgagcctaatgatgatatgagagataataatgatgaaaatgtgggtggtgaagacattgatatgcaaacgcaacctagttatggcaaagggcttacaatggagaagctgctacacatcagaagcccgcttatgacaaagggcttacaatcaactcatacaagctttcaacgcaatacaatttcaaccagttag

SEQ ID NO: 29982 - DNA, 1041 bp, Glycine max
  Peptide Sequence Number=SeqID_146760
atggttgcgtgtgatatgcagtccttcatttcgtcaatgctacttgaggcaatggggacaaaacctcgtgatggctatcgtcgccctcgttgggagcctgcgctcccaatcttgtccacttgcaaagatggtgatgatttgaaactttctggaatcctcaaacatcttgggtacttcattgatagttccaaaggaattattctttctggtttccatccaaagacatattatgtgtacaatactgtgaccaagcaaaagtatgaactcccagaacctcagcagttctataaagttctgtgcatggcattgattgttgaggaatatcttgatagtgacatatgctacaaggtgatccgtgcaagatgtgaatgcaaacttaaggaacgcaacactgtctcaattgagacttattcatcaaaaactagacaatggaagcaatccactctgatgtgctccacaacttttgcattgtgcccaaggacggcagctatggtggttggaggggttgtacactggtttgcaatgtggggaaaacttgccatttatgatcctcgtcttggagacaggtatatagccttgattaaactaccaacaggtgtgttaacacatgagcatgaggaatctgttcttggggagtcatctgatgggcttttgcagtatggccagagcaataatttgggcctggagatatggatacttgagaaggaatcaggagccaactcatctatttactgcaactgcactcatctgaagtacaagtggattctgaggtggagattaaactttaaagtattatggaagcagatgccgtctttaagcacacattctaaagaaacccagatattgtcattccttcctcagaattctacttctatcttcattaggtcggggtggaatattttgctgtgtgatttggagaccaaaacggtggaaattgtcaattatcagggtcgtggaggaaccatttcatgggaatctagcaaagtagttccttactttctaccagcttggccacacacttcctcggtgtcggtgtcatga

SEQ ID NO: 29983 - DNA, 237 bp, Glycine max
  Peptide Sequence Number=SeqID_146761
atggaattaattagaggaaaggaaacagcatggagttgggaatggggcccaaagtgcgtctttgcttgggaagaaataattgagtgtgttgatgacacggtttcacgtgtttggggtgttgctggcgaaattgcaaatgcaaatgtcaacaccacattgccttttgcattagttacttgcaacttcgagcagagaccacaggtctggagcaacagctctttgtcttgccttaaatga

SEQ ID NO: 29984 - DNA, 309 bp, Glycine max
  Peptide Sequence Number=SeqID_146762
atgcaaaaaactccaaagaaaacagtgaaaataacctacatatcgagtcctgtgttagtgagggcctacgatgcttctgagtttcgatcagtggtccaacaactcacgggcaatgactccaactccaacaagaaggttgaaaggcctcataaggggtatagctctactttgatgcatcaaagggtcatgcaaagtcatgaagatgcccatgggatcgggttgtatcattacaacagatcaacgacgacttctctggagttggatgaagattactactggaaagaacttgcacgttctgttttgccgtga

SEQ ID NO: 29985 - DNA, 1290 bp, Glycine max
  Peptide Sequence Number=SeqID_146763
atggcgggcattctctccagcccggcgctggcgcagatcaccttgttcggcgaggcgctgcagccggggcgcggcggggtgatcgccgtgctgctggtggtggcgttgatgtgctgggtggagaaacgcctgcgcacgctgctgccggaatcggttgagctgatccttaatccattgctgaccacgctggtcaccgcctcgctggcgatcctgattctgcagccgatcggcggcattatctccgacgccatcgcccacggcgccaatctggcgatcgacaagggcgggctgctggtgggggcgctgctctcggggctgttcctgccgctggtgctctccggcctgcaccaggggctggtgccgatccacgtcgagctggtgcaggcgcacggttccaacccgctgctgccgatcctggcgatggccggcgtcgggcaggtaggggcggcgctggcggtgctgttgaagacccgcaacgcgcggctgaagaaggtgatcaaaggggcgttgccggtcggcattctcggcatcggcgagccgctgatcttcggggtgaccttgccgctggggcggccgtttatcggcgcctgcctcggcggggcggtcggcggcgcgctgatcagctactggaaggtggcgacggtaatcaccttcggcatttcggggctgcctttggcgttgaccatcgtctcaggagtagcgtttgagcgacaagcagcaacaaccggccgcagaggggcgccgcgtggtctttttcgatctggacggcaccctgcatcaggaggatatgttcggcagtttcttgcgctttctgctgcgccgtttgccgctgaacctgctgctggtgataccggtgctgccgccgatcggcctggcgctgctgctgctggggcgcgccgcgcgttggccgatgagcctgctgctgtgggcgattactttcgggcgctccgaagcgaagctcaaggcgctggagcggcagtttatcgaggcctttcgccagaaggtgaccgcgtttccggtggtgcaaatgcggctgcggcagtatctggacgagcacgatgccgaagtgtggctgatcaccggctcgccggaacggctggtggagcaggtgtatcacgattcggcgtttctgccgcgcgtgcggttgatcggcagccgcatcacgcgccgctgcggcggttgggtcttgactctgcgctgcctggggacgcaaaaagtggtgcagctggagcagcggctcggcgcgccgctaaagctgtacagcggttacagcgacagcaagcaggataa

SEQ ID NO: 29986 - DNA, 245 bp, Glycine max
  Peptide Sequence Number=SeqID_146764
atggagacgagagatgcgaccatggccagagacgcaaccatggtcagatacgagaccatttttggagacctgaccatgtgcttcattgttgacgccagcgaaggtgaaggtgaggccacccgaccatggccggtgacgctaccatggccagaggtggtgacgcaaagtgaaggtgttgacgaatgtggccatgaaggagaggaagaagatactgaggagaggaggagaaggggaagcttcaggag

SEQ ID NO: 29987 - DNA, 198 bp, Glycine max
  Peptide Sequence Number=SeqID_146765
atgcaaacatgtcataggattgggctactattacagtgcatgatcgaccctcgtttggttactcaaggcactaatagatatgctttgactgaaaaggcattggcaatagtgcgtggagtaactaatgatggaaatgtcaaccccaatagaggtccaagtggcacaagatgtgggtgtggccgacaaggacgtggatag

SEQ ID NO: 29988 - DNA, 225 bp, Glycine max
  Peptide Sequence Number=SeqID_146766
atgggtggtttagttctcattgtcatgagaggcttaactatgcacaaaaaagataaaaatgtatggaggagtagaagatggtatagagcgcgagtaagtggttgggcgctaagcgaaatcttcctacttagcgcatcttcacatgacttcaagttctccaagcagcttcctctcgctaagcgaaatcttcccgctaatcgacttcagcgcgctgagcgagcctaa

SEQ ID NO: 29989 - DNA, 310 bp, Glycine max
  Peptide Sequence Number=SeqID_146767
atgactcctaaagaagcttggagtgggagaaaaccatatgtgaatcacttcaaaaaatttggatgcattgcctttgcccatgttcctgatcagaaaagaaagaaacctgatgacaaagctaaaaaatatgtgtttattggtgtaagtgaaacctccaaagcttacaaattgtttaatcctagtacaaagaaaattgtgaccagcaaggatgttgtttttgatgaagaaaacacttgggattggaataggcagcaacctacccaagtatttcttgatgaaaatgacgagaaaggacaaacttcagcctctg

SEQ ID NO: 29990 - DNA, 828 bp, Glycine max
  Peptide Sequence Number=SeqID_146768
atgaatcaagatacaattacagaagagcaagctttgaaggcatctacctcttcaagaggcagaggtaagggcacagggaaaagtggtagaggcagaggacggggagatcaaaacaacaacgatggcagaggtagaggacgaaatcaatttgataaatctaagattgagtgttatcggtgtcacaggtttggccattatcgttctgaatgttatacaaagctgccacgcgacaaagaaaaggaagcgatttcaaagtttgttgaagagaatgaagctgaaacactactgttcaaaatagtgaggaaccaaaatcagatgtttgacattaacttgttaagtgctagtcaattacaagagaagggatatgtcattactattaaacatggtgcttgtgaaatttatgattctactagaggtgttattgttgttgtacaaatgagttccaataggttgtttccattgaagatcgaaactattcagtcttgcttagtggctgaaatcaaagatccttcatggttatggcattttcgttatggccacttgagttttggtggattaaagactcacaatcagaagaacatggaaaaatctgaagcatttactgcattcaaattttttaaagctcgtgttgaaaatgaggctggaaaaaatatcaagacccttcatatagatcgtggtggtgaatattgctcaaatatttttgaaaatttttgtgtagagcatggcctacgaagagaactcacaatagcctatacatcacaacaaaatggtgcatcagagaggaagaataggacaattcttaacatggtaaggagcttaaggacatga

SEQ ID NO: 29991 - DNA, 2085 bp, Glycine max
  Peptide Sequence Number=SeqID_146769
atgggctggatcttcaagatttcccagctatttgaataccaaaatacaccggaagaagaacggattacagtggcctccttctaccttgatggggctgcgttaagctggtatcagtggatatttaggaacggcttcatcacttcttggtcagggttcttacaggctttggaatccaggttcgtgccttcgtattacgatgaccctaaaggagctcttttcaagctgacgcaacgtggcatggtgaacgaatacctaaccgagttcaaacgtgttagcacttcaacctatctcgcttccacaagccatggctcttgcaaagctgcgagatcgccggcaagcgccactgcgaccccacaacacccatctccgtcatatcttccccctaaccggaagtcacaatccacctatgtccaaaggacaccagacgagatggccctccggcgggagaagggcctctattacaactgcgacgaaaaatggagctctacccatcgctgcaagggatgcatgcccttgtttatcgccgacaacccttctcctgtaccagatgaacctatccttgaccttccctcaacaccatcaccagaacaagaaccagcaacttctttagactttgacccatcctcagacctaaattcccctcacgttagccttcatgctctctctggccttccctcctccgagactttccgtctcgtcggagttatcaatcacacctctctcaccatcctcatagatagtggaagtactcataacttcctccagccccgtattgcccagttcctccacctaaaagcccaaaacacgagccctctccatgtcttagtgggtaatgactcagtcctcgactgtaaccaagtctgccccgatacctcgctgtccctccagggccaccaattcacggtcacattccatttgcttcctatcagtggtgcagatgcagtcttaggcatagaatggttacgacaatttgggcctataaccactgattacaccacgttttccatgaagttcacctatatgggtcggcccatcgagttacacgcagatgtcactactggaccaaagccaatctcagcaccacaggtaaaacgtttacttcaaaccgaatccgcatcagccttattccacttaaaactgattccaaacccacaacctcttcttcctcacccgatacctgcaattgagtcacttctcacccgttttcatcacctgttccaacacccttcttcccttcccccacctcgcaccatcgttcaccatattaacctcctccctaacacaacaccaatcaatgtaaggccataccgttacccacaatttcagaagtcagaaatagagaagcaggtattggagctcctctcttctggcttaatccagcctagtatgagcccttactcctcgccagtgctcttagtaaagaaaaaggatggaacctggaggatgtgcgttgactaccgtgccttgaacgcagtcaccatccgcgaccgttttccggttctgacaatcaatgaattactggacgagctagggagtgttgcttggttctctaagttggatctcaggcaagggtttcaccagatcctaatgcatggccctgatgttgagaagacggctttcagaacacaccaagggcactacaaatatcccgtgatgccctttggattgtgtaacacaccgtccacctttcaggcggccatgaacaccttactaacaccatttctcatgaagttcgcggccgtattctttgatgatatcctggtatatagcaagacgttatcttcgcatctcgaacacctcgaggtcatcttccagactctactccaaggtcagtatcatctcaaacgaaccaaatgcctctttgctcagaaccaagtggaatatttagggcatatagtgtctggcagaggagtcgagcccgagccttccaaggttcaagccatggtgcagtggcccataccattatcgcctaaggaactcagatccttcctcggacttactgggttttataggaagttcatcaagaattacgcgatgatcgcggctcccctcacatcactcttagccaaagacgcgttcgaatga

SEQ ID NO: 29992 - DNA, 276 bp, Glycine max
  Peptide Sequence Number=SeqID_146770
atgtgtaaggccttgcgctcctcaactacaacaagcttcggtggtgtgattctcccaaggctacttattattgttggtgtgattttacttgttggttctacacggttagtaagattcctttcttgttcttcacgacaaaaaagaagcaatgtggagaagaattttggccttagaggagccacttcttcccgtgtgagagaaccaagtccaagtgctgtcattcaagcagcaacattaaatcatttactatcatcatctgccaaagaaaaagcttga

SEQ ID NO: 29993 - DNA, 1257 bp, Glycine max
  Peptide Sequence Number=SeqID_146771
atgcagtgtttgtcaacagaccaaggcaagtacacaacgtcccgtcggccttcttcaaccactcccgccaccaaccggggtctgggaggacatatccctagatttcatcactcagttgccgccatctcacgatattccaaaggtatccaccttggagctttacccactaaccactctgcattcaaggttgcctctctattcatcgaaatcgtctgcaaacatcacggatttccgaagagcatagtctccgatagagacccactcttcctgagttccttctggcgtgagctcttccggctaagtgggacgcgcctccgcatgagcacggcttatcacccacaatccgatggacaaaccgaagtcatgaatcgagttctagagcaatacctcagatccttcgtccacgaacaaccagctacttggtatcgttatctaacactagcggaatggtgttacaacacatcccttcattccagttcagggctgacaccgtttgaagtcatttatggtaagccaccaccggcgttgccacattatcttcagggtgcatctgcaaacgaggtcgtggactctctgatgtcctatcgtcaagagatccatcagaagctacaacgtcatcttcacaaggcgcaggagaccatgaaaagactggcggatgataagtgccgtgacgttaacttcaccgtcggccaatgggtctacgttaagctgcgaccctttcgtcaacgaacagtagcaggcctgatacaccccaaattgtccaagagatattttgggccgtttcaggcaatagaacgcgtgggtcaagtttcttatcgactcaaattacccgaggaagcaaggatccaccccgtgttccattgttcacttttgcgcgaacaccatggcccttccccgacaccactggatagcttgccgttacaattcattgctcagaaaccagtagcacgccctttgtgtatcctggattctaaaatcgaaacatcatcatccccaccaacaagactcgtgttagtccaatgggagggtcaacctccagaggacaccacctgggaaaagtggtcagaaattcgggaccttcatcaccttgaggacaaggtggtgttcgcgggcgagggtattgttagcaatcatctacaagatctcgaggatactgaagctgataaaggcaccgagagcctggaaccagaaaccaaagaagcaaggcccaaacgaacaacttcaagacccagctatttgaaagactacgaaccatga

SEQ ID NO: 29994 - DNA, 198 bp, Glycine max
  Peptide Sequence Number=SeqID_146772
atggagtcaggtgacaggcgggggttttactctagtcgtccggagacatgcgagcccgacgatgcacgagattcttctctgctaggcgggaggcaatcaagttcgatggcgtggggaagtgtcgtggttgtcccactttatcgctttcaagacactgaagttttgatgacgcttctgatgccttttctttctttctga

SEQ ID NO: 29995 - DNA, 339 bp, Glycine max
  Peptide Sequence Number=SeqID_146773
atgatatctggtgaaccagttggtgaagtaagaattgtttcagatatgcatgagcgtaaagctgcaatggctcaagaagctgatgcatttatcgccctccctggaggatatggaactatggaagagctgttggagatgataacttgggctcaacttggaattcataaaaaaccgaatcatcctccacaggttggtctactcaatgttgatggttactataactctttgctcgcattatttgacaatggtgttgaagaaggcttcattaagcatggtgctcggaatatacttgttgcggcttcatcagccaaagaacttatgatgaagatggaggtctga

SEQ ID NO: 29996 - DNA, 433 bp, Glycine max
  Peptide Sequence Number=SeqID_146774
atgttggaaaacacaacacgaacaacacaaacacaaaacaatgacacgttagtgaaggagttacctcttccactagcattgcagcaacaccccaatgtagaccccaagattgtgaaaagaacaacttctgaacgtaggttgtcttttcatttgcgtaagaagatgccaaagagtttttcagtggcaagaaattgggatcaaaagggtaattacaatgatgcagggaagaaggggaagttgttgaaaacagataatgactctatgtggatgaagacaaaaggaaagttgaaaaatgatgattctgtgtggatgaagacaattatacttgggggaaagagtgttcctgatgagggcaaagcgaagaaaatctcagcatatcatcctaggaaggcgtctgtgtcactttctagacaatgttctttcattaatcctg

SEQ ID NO: 29997 - DNA, 315 bp, Glycine max
  Peptide Sequence Number=SeqID_146775
atgccctttatggaaaaagatgagttttttacgacagaggaagataagaagaaaaagacggtgttgcaaaagaaagctgaccagttcattggccaattcaatggtggcgtcactgaaaacttgacggttgccagagttgctgccgcaaaagacacagaggctcttgaacttgcctttggggaagccatgttccatttctttctttctttctttcttcctccgtttgatgatgatgatgatgattttgtcttagaggaaatccaagaccattggaacagcgaaaacaacattaatttataccacatccggtcctaa

SEQ ID NO: 29998 - DNA, 261 bp, Glycine max
  Peptide Sequence Number=SeqID_146776
atggatgcacctgacctcaactttcagatgcaatgcggtacgtaccgtatccaataccaaggaaatagccctaagcgtgtctacacgacacctcacttaggaaaccatgcagtatttttcgaggccacccagtcatgcaccgtaactcccccaggtgatcaacctatggccacaaggagttccctaccaggtgacacaccccctagtacaaagtacatactgctacagtttatactatttcccgtgtcatatgaggtatga

SEQ ID NO: 29999 - DNA, 1242 bp, Glycine max
  Peptide Sequence Number=SeqID_146777
atgggtgcatctggaaaatgggtaaaagcattaatcggactcaacaacaagagcgaccttggtgggaagaagaagaaatggaggctgtggaagagttcttctgcgggagaaaacagatctcaaggcaacgactatgctagtagtgtggcttcggattctttcaattttgctgtggccactgtggtcagagctccacccaaggatttcaaactcctcaagcaagaatgggccgccacccaaatccaaaccgctttccgtgccttcttggcaagaagggcattgagggcgttgaagggagtggtgaggcttcaagctcttgtaaggggtagactagtgaggaagcaggctgcggtcacattgaggtgcatgcaggccttggttcgtgtccaggcacgtgtaagagctcggcgcgtgcgaatgtccattgaggggcaagcagtgcagatcatgctcaatgaacgccgcaccaaagctgagctcatcaaacaagctgaggaaggatggtgtgatagcaaaggatcattgaaagatgtcaagacaaaattacagatgaggcaagaaggagctttcaagagggagagagcaattgcatactctcttgcccacaagcaatggagatcaacccccatctctaattcaagagcaaacgccgctctcaacaatcacgagatggacaaggcgaactggggatggagttggttggaacgttggatggcagctaaaccatgggagagtagattaatggaacaaacccatcatgctgatgccacagagaagacccctcctcctcctccaccaaagaaatgtgttgactcctccaattcaaaaacatcagaactatgcaatattaaaatcagaaagaacaatgtcagcacaaggatttctgctagacctccccatattggacaagctactcgcttgtcatcgagtccaagttctgagtttcactatgatgagagctgctctaattcatcctcaatctgcacatctacaactccaataccttgtgacaggacagaggatagtaacaactctaggcctagttacatgaacctcaccgagtcaaccaaggcaaagcagaaaaccagcaatcatcagtacaatagatctcagaggcagcagtccatggatgagttccagtttctcaaaagaacagcagttttctctaatgcttctgacccttcaaccaacttttctaggccactttacctaccaacctacatggataagagttcacggtga

SEQ ID NO: 30000 - DNA, 1410 bp, Glycine max
  Peptide Sequence Number=SeqID_146778
atggaaaaagaagagaaaggaaaagatgaatacgaattaatatttcatatgggaagacaaccactaatcttggtagcagatccagagctttgtaaagaagtgggaataaaaaaattcaaagacattccaaacagaagcattccctctcctatttcagcttccccccttcaccaaaaaggtctcttctttaccagggactcacgttggtcaaccatgcgaaacacgatcttgtcagtgtaccagccatcacacttggctagcttagtgccaacgatgcaatcattcatagaatccgcaacacaaaatcttgacaccccaaatgaggacataatcttttccaatctttccttaaggctagcaaccgatgtgattggagaggcagcatttggtgtcaattttggcctctctaagccacattcagtttgtgaatcaatcaagagtgttagtgttaacaatgtgagaaatgatgatgatgaggtatctgatttcatcaatcaacacatttactccacaacacaacttaagatggacttgtctggttcattctccatcatacttggtctacttgcaccaatacttcaggagccatttaggcagattctgaagagaataccaggcacaatggacagcaaaatagagagtactaatgagaagttgagtggtcctcttgatgagattgtcaagaggagaatggaagacaagaatagaacttcaaagaatttcttgtcactcattttgaatgcaagagaatcaaagaaagtatctgaaaatgtcttttcacctgattacattagcgctgttacttatgagcacttacttgctgggtcagctaccacagcctttaccttgtcatccattgtctacttggttgctggacaccgagaggttgagaaaaagttgcttcaagagattgatggatttggtccacctgataggattcccacagctcaagatcttcatgacagttttccttatcttgatcaggtgattaaagaggccatgaggttttacacagtctccccattggttgcaagagaaacatcaaatgaggtggagataggaggttaccttcttccaaaggggacatgggtatggttagctctaggagttctagcaaaagatccaaggaattttccagagcctgagaagttcaaaccagagaggtttgaccccaaatgtgaagaaatgaaacgaagacatccttatgcattcataccatttggaattggtccccgggcatgtattggtcagaaattttccctacaagagatcaagcttactctgattcatttgtaccagaaatatgtttttcgtcattcagttgacatggaaaaacctgtagaaatggaatatggtatggttctcaacttcaagcatggtatcaagcttagagtcataagaagaacgtaa

SEQ ID NO: 30001 - DNA, 276 bp, Glycine max
  Peptide Sequence Number=SeqID_146779
atggtgtccatagtattggaatggttatttccttttccatgtgtagccatgttcaccacccttctgatgttaataggaggattattgggttatctttatgggccctattgggggcttaggaaagttccaggcccaccaacgctgccgctggtaggacaccttcccttactggctaaatacggccctgatgtcttctcactccttgccaagcaatatggcccaatttacagtgttttagtgcatattgcctgggaagaagtagatataatcacataa

SEQ ID NO: 30002 - DNA, 231 bp, Glycine max
  Peptide Sequence Number=SeqID_146780
atgtatatcaggataaagggtgtcacatttagcagtcgaaattgcatcgacaattgcagatacagtaccattaacagtgtttgtaccatgtctacaccggaatctatgacacacaataccatgaacagtgtttgcacaatgtcgttgattcttgatgcatacaatgatgcacatagtgtctctacaagaaacctaacgggcacaatgtcgatgcacattgtctctacatga

SEQ ID NO: 30003 - DNA, 174 bp, Glycine max
  Peptide Sequence Number=SeqID_146781
atgacgatgacgatgacgttaacgttacggttacggaagctgaacaaagaagaagaattagatgattatgacgatgaagacgacgatctgcgtagtactcgcgtgtggttgctactctctagtcacgtgacatctcacgagctcagctcttcactggataatcaaatattctaa

SEQ ID NO: 30004 - DNA, 930 bp, Glycine max
  Peptide Sequence Number=SeqID_146782
atggacttcaccactttcgcaaattccatatcctattctcatgcaattcctccaatacacccttatcgccttcaaccctctccttttccccttcacctcccattttcgaatttaaagcgttcgggtttggttaagaatcggctaattgctcgttgcacttctaagtccgatgaatttggttctgttaatgggttgcaattcacgcccaataagctttttgtggaggaggtcttttttctttacactttccatttcccctccatattacagaattttgttggagcagctattggggctgaatatggggaaggctttgagacttttagggcagatggaccactaaaagttgatgtggactatttgaatgagaaattgcaagatggttttcttcagcgcatacgctatgctatgaaaccagatgaagcttatggactgatcttctcttgggacaatgtggtggctggtacacgagctctaaaaaggaaggcatgggagcagctggcctttgaagagggaaaggatattccggaagaaggtgatatgcacaaattactgttttatgcaggtgctgattatgtgttgcataagttttttctctcagataaggcggaaaatgagctgaataggctaaagttaaggttttctcagatatattatgataatcttgtcagacttgaaaaaccaatggatggcctcaatgactggttggaagcagtttatacagctcgcatcccctgtgctgtggtttcaagtcttgatagaagaaatatgttagaggctttggagcgaatggggctcagcaagtatttccaggcaattgtgacagaagaggatggaatggagtcaatagctcatagatttctttctgctgctgtcaaggtagagttccatccacctgattctatttttgatgaaatgtttctggcttga

SEQ ID NO: 30005 - DNA, 1680 bp, Glycine max
  Peptide Sequence Number=SeqID_146783
atggccgaaactcgagacgccgccgccgatggggtgcccggaactcccgccataagggaaatgagacccgagaccgcgacccatgcgggaatcgggtcgggtgggattcggagggtgaatttccgagcggagattgatacgtcaccgccgtttgggtcggtgaaagaggccgtgacccgttttggaggtagcgggccttggataccgttttttaacaacattgaagattttgacctaaagaaagtggaggaacaagcagcagagttggagaaggatttgattgtcaaggaacttgaaacgcttgacgtgctcgaagaactgggagctaccaagaggattgtggaggacttgaagcagcaattacagaaggaggctatgaaatgtttagcaactcaagatgtaaattcatatgaacaagttggaactactgttattaaggagatggataaggaaaattgtggaagtaatgtcaatgatcaagaacaggtgatgcaaattccaagcccatgctctatgtcatcatcacctgatatgatcttaatagagttgaaacaagccaaattgaatctaggcaaaactataaatgaacttggggtgatacagtcctctgttgaatctttgaataagaagatgaagaaggagaaactttttctggagaggacacgcgaaaagctagcaacaaagtttgcagcagtatctgctcaagagagggtccaagagcaaacaagattaaatccaccagcacctcatgtagagttcaattttggtaacactgcaaataatttcaattctgattctaggcagtgcaatagaatggccgagacaagaagacctgaaccttcaaagcccttgaatgtgtatgaagaatatggatttagtgttaagactgctgagatgaggtggcttgcggctaaaaagatggaagaagctgcaagggctgcagaagctattgctcttgctgaaatcaaggctctatctaataatgctgagagatcttcaggattagttctgccagaaccggagaaagtcacttttgcttttggagagtgctctcccctaaacctcaaggctcagatacccgaggaatcaaccttgaagaaggtaatagattccaactttcaagttgatgaaacaaaaatttccaaactgactattctgaagaagttggaggaagcagctgaagaagttctacacagcaaacaagtcttgacagatgctttaaacagagttgaaaccgcaaacagaaagcagcatgctgctaaggaggctctaaggagatggattcctgaggatgatatgaaggagtataataacactattaactgcaacaagtttcatcaagctggaatttatcaagattctctgcaggatgtaaccaggtcaacaacatcaaacaatgatccaaagcctgctttaaggaccacaatttcaatgagagatgtacttagcagaaagcaggttcctgaaggatatgctacaagaaaggagatggaagagcacactgaacgacaaaaggtagcattgagtcaaatgcttcaggcattgagggaagatctaactcttccaccgaagaccgagaaagatgggagcaatcagaagccgttcgtagcacagaggaagaaatttggattcattcaaatatcactccccttggcaaagccaaataagaaaaggggatga

SEQ ID NO: 30006 - DNA, 1227 bp, Glycine max
  Peptide Sequence Number=SeqID_146784
atgctttgcgtcaacacgtgccttcacctctttcttacccagaaaatcaacttgcgtcttttcctccaaatcaaccaccccaatttcctgcaccctccaagttattctggaaaatcttgttcaggaacagttgcagagccaaaatctacagctgctgctgaaccgcttttgctaaatgcagttcgcgggatagatgttgaaagacccccggtttggctcatgaggcaagcagggagcggattgtgttgctttatgaaaatggaactgcttttggactctgttgggagttaccaaaccatctgtgagaaatatccttcattccgtgaaagatctgaaaatgttgatctcgtggtggaaatttctctgcaaccgtggcatgttttcaagcctgatggagtgattttattctcagacattcttaccccactttctggaatgaatataccctttgatattgtgaagggtaagggtcctgttatatttgatcctattcacacatctgcccaggttgatcaagtgaaggagtttattcctgaagaatcagttccatatgttggtgaagcactgacaattttgaggaaagaggtggataataaagctgcagtccttggttttgtcggggcaccgttcactctggcatcatatgtggttgaaggtggttcatcaaaaaacttctcaaaaataaagagattggctttctcagaatccaagatcctgcactcgttactgcagaagtttacaacatcaatggcaagatacattcaataccaagctgacaatggagctcaagctgttcagatctttgattcatgggcaacagaactcagtccagtggattttgaagaattcagtttgccttacttgaagcagatcattgatactgtgaagaaaagtcatccagacctccctttgatcctctatgcaagtgggtctgggggcttgcttgaaagactagctttgacaggtgtggatgtagttagcttggattggacggttgatatggctgacggtaggaggcgactgggaccgaatatagctgtccaggggaacgtcgaccctggtgttctttttggttcaaaagagttcatcactgatcggataactgatactgtgagaaaagcaggtagagggaaacatatcttgaatcttggacatggcattaaagtaggtacgcctgaggagaatgttgcacatttttttgaggttgctaaatcaatcagatactaa

SEQ ID NO: 30007 - DNA, 322 bp, Glycine max
  Peptide Sequence Number=SeqID_146785
gttacccacagatcatagagagattgagactgctctgtgcataccagggaaatggttcattttgaatgctgagggccatccagggaggattctcaggaaggatctgactaccttggcccaggtgtggagtgctctctcgtactccaacctggcccctacatctcacacctcagaccttactatggacagagccaaagggaaagggattgctttaaaaatttcaagctttcctggagaaaaggaaggagattgcttagaatttttaactatccacggtcagtgcattgatggtgctcatgtttcatacttcataattgcatga

SEQ ID NO: 30008 - DNA, 375 bp, Glycine max
  Peptide Sequence Number=SeqID_146786
atgacgataacacttgatgatgtggcatcattacttgacattctcattattggtgctttttacaattgtgaacatatggataaggaagcaacaattcctgtgctttttgaggagctgaatatagggatgcctttaatgagacaaagaaaacaagaggtattcatgggagcaactagcttgacatatctttatgagcatcttggtgatgctagttttgctggcacaaatcagattggttgctatgccactcttcttcaggatatgaagatacctctctgtcgcaacctacccttcggcgggagggcgacgcgtgactcgcgggatgcgtgttccacgaaaggaatacgcgcggagtcgccaccaacgtttatttga

SEQ ID NO: 30009 - DNA, 481 bp, Glycine max
  Peptide Sequence Number=SeqID_146787
atggcctcatctagctactctaactctccctgtgctgcctgcaagttcctgagaaggaaatgcatgccggattgcattttcgcgccatatttcccaccagaagagcctcagaaattcgccaatgtgcacaagatattcggtgcaagcaacgtgagcaagcttctgaatgaggtgcagcctcatcagagagaggatgcagtgaattctctggcctatgaagccgaggcaaggataaaggatccagtttatgggtgtgttggggcaatctcagtgctccaaaggcaagtgattaggctccagaaggaacttgatgccacaagtgctgatttgattcgttatacttgcaatgaaatgccaactactactcaagatggtagaaggattattggtgaagggggtggttcttctcttggtcaatcttctggttactattacccttctccttggaacaatgatacacttggagatggttatcacagag

SEQ ID NO: 30010 - DNA, 300 bp, Glycine max
  Peptide Sequence Number=SeqID_146788
atgatagagaccaaggaaaacctccaagaagagaaggaagacctaagaggaagaatccctcaatcaaagccaaaagaatctaaggagaaaaaaggtaaagaggataagcttgggcttgaaatacctatgaggggaaaagtaaagaaaccccagaagcatttagaagcgatcatcggactacaacctcaaggccaaagtgagagaagagaactcaagatggtgcacttgattcaagtggaagaaagtcccaacctaattattaatgtaccaacatgggcttacaacctaattttttcttaa

SEQ ID NO: 30011 - DNA, 624 bp, Glycine max
  Peptide Sequence Number=SeqID_146789
atggtttacagcaatgaaccagatgaagaagcttgctctgaaggaaggcggacattttgggataaaaatcgtgttacacttgattgttacataacaacagatgaacttagagaagcaataactgaacaccaaatgggagatgaagctgctatagatgaagtcttcaacgatgttgactttgacaaagagatcttcactcatgtgtgtttatgtagtacccctgttgaaaaacaaaaaattgatacatgggatctagccacaaaagctggggtcacagcagcattcattatgtttgtgacatttgcagcttcagctataacccagtgtagacaaactcatgaatgttctactatcacgtggcttgcaagggtagcctgcaggaaaacgtacttcttggttactgttatatcagagacaactaaggataaagacaataaatctaaagctcaaattaaacatcaggggtttcatcaagttcagtgtactaacttagaccaaacaatgctcaatgaaagtgataatctggcacatgatgacaccactgatgaaggatggcaggaggctgttcctaaaggccgttcactcattgcccgcaagtcagcttcatcaacgagccccacataa

SEQ ID NO: 30012 - DNA, 201 bp, Glycine max
  Peptide Sequence Number=SeqID_146790
atgatgagaacaatgatccagagggaatggagggaggaattggggtttcctgtggcccagaatgccgttgactccgactcgaagtgccattccgcttcttcgatggttctgccatttgagaagttatttcgggatttcaatcggttcaaaagaaagggattgaaaaaagatgaagtttgggctttgtggggagtgatttag

SEQ ID NO: 30013 - DNA, 420 bp, Glycine max
  Peptide Sequence Number=SeqID_146791
atggtattagcggaaagagtgatgataccgctagaaggagagatcagttgcaaaatcgtaaatgccaaaactgataaggaagtgtgggatattttgaagttgtcttacaaaggtgctgagaaggcccataaatctaagtttcaatctctgcgaagggaatatgaaagcaatatgaaggtgtatggagaagacatcctagacaacaaggtggtggacaaaactctacacaccatgaagaggaaattttcaaaggtagaggccaaggaaattatagaggtagaggaatggggaaatatcaatcaaggtagaaacaacaatttagggtcatttggccgaggaagaggtggagatacttttggtagtgctaaccaaggaagaggcagaggcttagagttgcagactgcagattcaaacaagtaa

SEQ ID NO: 30014 - DNA, 471 bp, Glycine max
  Peptide Sequence Number=SeqID_146792
atgatatttttatctgctagagcatgtgatattctaaagaaattcaagatgaaaaattcaaaaccaatttctactccagctcaagaaaacttgatgctgaaaaaggaaagtgacaaaaaaatggtggatgcaactcaatacaagagtattggaagtctaagttatatgactgggactagaccatatatagtctttggagttggtttgctcaatagattcatagaggaatcacatgtttgtcatttgcaaggagttaagagaattctttgttatatcaaaggtactctgaccgacggaattttttatgctaacgataatgatgtgaagcttgttggatacacagacagtgattgggcaggtgttggatttcttctgcaattgctttttggtccactttttctttatgcaaatatgttcaacggaaattcggtttgctggaaagcgcaccggatcgtcaacctaaattactaa

SEQ ID NO: 30015 - DNA, 153 bp, Glycine max
  Peptide Sequence Number=SeqID_146793
atggagtatgtgagagatgtgaaattggaaacaggcacagagaatcttttccaaccagaaagtcttagaaggaagacttgggtgtatttcttgaagcaaaattcagaagcttatgatgccttcaagatgttcaaggcacttgcagagaaatag

SEQ ID NO: 30016 - DNA, 318 bp, Glycine max
  Peptide Sequence Number=SeqID_146794
atgggtataatgcccaatcaggggtggcctcctgtggtggtatcattcaggattcaaatactagacctattgtgtgctttcatcgttatcttggacgttgcaatgcattgtaggctgagttgcaagctattaaattggttgatccaacaaggcaatccttcttcaaaataccttcaacctatggtcaaggatatcaaacagatgctctccttgcaaggatggaatacctcctttgatgatatttatagggaggctaatgggtgtgctgacctcagccaacttgggttattaagggagttgtctattctttcttgttga

SEQ ID NO: 30017 - DNA, 321 bp, Glycine max
  Peptide Sequence Number=SeqID_146795
atggggtgtggggaaaatggattgagggttggaattgggtggggaaagggttgtgacttgctgcaaaggctgaagggaagggaaggggctcaagtgttagtggttcgggcaatggttgaattgcaatggtggggggctgtaaatgaagagacgatggttgaaattgggcctggggttgtgcatgatactgagggtaaaagttatagggatatgatggaaaactggattgttgggttgatgaaggagattaagctcatgaaagtatcatttctccctgtcatcaatcaagatgatatcaagataccaagttggtacatttag

SEQ ID NO: 30018 - DNA, 666 bp, Glycine max
  Peptide Sequence Number=SeqID_146796
atggaagaagaatattttgatttcgagaagaaggtttcgataaaggagacgatgtcgatggaggttgatccagccaaagtccttcttttgcttcgcggtttcctccaaattcagcaacgcagggccgaagcatattccaagctcaaatgtgggttttctgactacatggcttctggaggggaattggcttacaagcagctctgcagtgaaatcacgatagagtttaatgattgctcaaaaaaagtccttgaaatggagtcactctttacaagccctgattactgccgagtcgatctagcacagctccttagagctattcaagatcaggaaaagctgaaactgcaactaaaaacacctcttcaagcctattttactgtggtggccaccaggaacatgactgccaccatccaggtgttaaagaaagccggtcgcccatctgaacgtctggtaagccatgagaattgcaaatttacaaagccagcagagcatgagtgtgttcatgttcaggagattacagaagcttctgggactgaagaagcagaagcagatgctgagtatgacaatgctctaaaagaagctattagaggtgtccaggatgctgtcatggccataaatgaacgtatggaagaagtcagatatgaaattgctgcccttgaagcagaatga

SEQ ID NO: 30019 - DNA, 1446 bp, Glycine max
  Peptide Sequence Number=SeqID_146797
atgaattacacctcattgaaaaccaggcaaaggttatcgttcctgcttcgaagttgcataacgcattccgcagctttgcaatgccacgcccaaagcttcgtccaaggtttgctccccaacgccgttctcgaaactgacctcttgttagtctactctaaactcggccttctccgcaaagctcgcaaagtgttcgataaaatgctcgacagaagaaacatgtactcgtggaacatcatgattgcctcctatgcccagcattgcatgtattatgatgtcttaatggttttccacgagttcaagcactgctgccttaggcctgatcattacaccctgcccccgttgttcaaggcatctgtgggagtggacgatgcttgcattggaagcatgtgccacggtttggttataaggattgggtatgaaggatatgctattgtggcaaattctctgcttgagttttatgttaagtttggggcgatgcctcaggctttttgtgtgttttcgaacatgtcatgtaaggattccgtgacatggaatttgatgatctcgggatttggaagggccggtttgtattcggatgcaatgcattgtttcagggagatgctaagtttgaatgagatgatgagggtggatttcatgactcttcctagcgttattaatgcttgtggaaaggaaggagacttgttgaaagtgagagaagttcatggctatgtagtgagaagctttggttttgatgcagatgctgccattgggaatgcattgattgatgtgtattgcaagtgtggatgcttgaatgattcagaaaagattttcaggaccatacgccacgtgaacttagtcacgtggaccaccatgatatcttgttatggggcacatggaaaaggggaggaatctcttttgctgtttaagaagatggtagatgaagggtttaggccaaaccctgttacactcacagcaatcttggccagttgtagccgctcaggtatgatagatcaaggcaagcacattttcagctcaatatgttcagactatggatttgagcctactgttgagcattatgcttgtatggtggatcttctgagccgctgtgggtatcttgtggaagcacttcagttgttggaaagcaagaaatcatcagtgacaggaagcatgtggggtgcccttcttgctggttgtgtaatgcacaaaaatgttgaaattggagaaattgcagctcatcggctattccaattagaaccagataatgctagcaactacatagctttgtgtggtatctatcaatctcttggtatggttgatagcttgttaattattaaagaaaaaatgagggacttaggtttgattaaaagtcctgcttgtagctggatcaatattgctggaagaacccatattagaccacctgtcccatcctctggctcagatgatttgcaaaataatatatcaaattag

SEQ ID NO: 30020 - DNA, 228 bp, Glycine max
  Peptide Sequence Number=SeqID_146798
atgatatcagtcagaaaaggtgcactatggccatggtacaatccaccacagtcgtggtcaggaaatagtgacattgaagttctggggcattctggattgagtatgaccctcatgatttaccacaaccattgtcagatggttgatgttgttctggaaagtagctatgctcttatcatggtcgtgttgcataccacaactagttatcaagtgcaaagtttcaaatcttga

SEQ ID NO: 30021 - DNA, 252 bp, Glycine max
  Peptide Sequence Number=SeqID_146799
atgttatcacgtcagcttggtggctccaagaaaagacctccctccaagacacctactgctgctcatctgctctcacgaacgaaagttcgagatcatcacaggcaccaaccacatggtacaaaaattgcaaggggatatccaataggtcactgcacccctcatgtacatacacagcatacatccaccatgatgacatcatcaacatcaacatcatctcatctcaatgtcatcatcaacatcatttcatcttaa

SEQ ID NO: 30022 - DNA, 285 bp, Glycine max
  Peptide Sequence Number=SeqID_146800
atgatagtgatagtggctcctcttctaggccagaaggaagtaacatgtctccttcccaggaaccaatattcaaacgaagttgctaatctggggatgatccatgtgttagttgtttttgctttgatgttttcccgtgtttacccagtaggtagcagatgtttcaccaataaaactgacattgaattgaaaactcacaatttaaattcaagtctgaaagtaataatggacgtctggtgtagcaagaaacagggtaaaatcacagtcaaaattgacaacactttgtaa

SEQ ID NO: 30023 - DNA, 207 bp, Glycine max
  Peptide Sequence Number=SeqID_146801
atggccatagtaaccttgtcttcctcacttgtccataccttctcttcctcacttgtccatacctggaacattgtcttcttcactttttcattccttgtttatatggaggacaattatgtgaggaagatgtcagatgaagtggatatggatgctgacatggacaatgatgtcaaaatagatgaagatattcatatccattatggataa

SEQ ID NO: 30024 - DNA, 822 bp, Glycine max
  Peptide Sequence Number=SeqID_146802
atgtcatgtacaagaagtggtgaccacaccagacctactgcatctgtaggtaagcatgaaagacatgtagttgtagatgagaagcaagagatttacgcaggttccaaagatgttgcagctgatgatgttgcacttaaagatgttgtgtttggtggtggacctatggacaaatcagtcttcactgaatatactaatcatgtggcttataggtgtagggatgagaagtgggaccaggctattagaccttacttgttgcacttagtagcatgttcaatttttgctgacaagagttggacacaggcaagttttgcaaatacaaagcaacttgatggttatgcaactctattgcaggaatggatatacgagcattttcctactattagatatattaggctggggtcagacatgcatctacatttgtctaagagagtgttgtgccaatttggctatactcaaactattcttcgacacttattcgtgtttacaacggtacaattatccatacaagatgttgacgagaggtgcttgaattttgtataccacttgatcaggccagacgagacgattagtgggctcttaggttgtgctacagtgataccaaacataggagatgtgccagagacaagtacccaacataattcagtttatgacatctgtcgtaaggttgttgaacccttgcaggaaatgattgacttaaggatggtgattgagggcaccactgcatgggataacgttcgagcaacacttttgttgttgtctgaaggtactcatggtggaaataataatagaggacgaggtggcagaaatgttcggggtagctag

SEQ ID NO: 30025 - DNA, 1062 bp, Glycine max
  Peptide Sequence Number=SeqID_146803
atggagagaatcagagtgaaggaggaagaagcaatgacatgtggaggtggtggttcatcatcttcaagctttatttctccacaggcacagcccatggaagggttgcacgaggtgggtccccctccgtttctgagcaagatctttgacatggtggaagatccttccacggattccattgtttcatggagcatggctcgcaacagctttgtcgtgtgggactctcacaagttttctgctcacattctgcctcgttacttcaagcacgccaatttctccagcttcattcgccagctcaacacctatgggtttaggaaagttgatcctgataaatgggaatttgcaaacgaaggttttctggcaggacaaaggcacttattgaagaccataaagagaagaagaaatgtgtcacacagcaatcaacaaaaaggaggaagtggagcttgtgttgaagtggggaagtttggactagaaggtgagttggagaggttgaaaagggatagaaacattttgatggcagaaattgtgagattgaggcaccaacaactgaactcaagggaccaattaagtgccatggaggcaagaatgcaagccacagagaagaaacagcaacaaatgatgagtttcttagcaaaagcactaagcaatccatctttcatgcagcaattagtccacaaaaccccccaaagcagagaagtgttgttgggtgttgaaatcaataggaaaaggagactacctgcttgtccaagtgtggagaacttgcaacaagataatcaagatttggcaactatggagactgatatggacacttttttcgcaccggcttatgataatgaattcggtaatgaaatcgatgagcctgcatcgattttggttgaggattcaatcttggaggactttctcaacaaagacttgattactgggaatccggaggatgaagttataattggtgattgcacccaagtcgatgtgccgatggaggatttggtagcaaaccctgatgattggagtgagcaattgcaggaccttgtggatcatatggactacctaggatccaaaccatag

SEQ ID NO: 30026 - DNA, 228 bp, Glycine max
  Peptide Sequence Number=SeqID_146804
atggcctcctatggtgaaagatcagcaattcctccaactggggaagtaggaaggtcagctgtttctccggttggtgaatcaagaggggcagccgctcaagagaagagagtggattcaccagtggagattatgggtcagctggttttggatcaacctgcacaggtgtgggctcaggcggagcagcctcgttgggtctcaccaatggaagttgagttcggaccaggctag

SEQ ID NO: 30027 - DNA, 351 bp, Glycine max
  Peptide Sequence Number=SeqID_146805
atgacaaccaatccagtgagtgattcatcccgtgatgataaactgaacggagccaaaccacaaatcacacccttatcactctcacaatcacatccttatgctatcacgggcgccgacttggacgagtttggggacgaggtggccggagacgtggagggcgacgagggactcgaggccgccgacggaggagcctccgatgaagacggcgggggtgcggtggtcggggagggggagggcggcgatctcgtggtcgtccaattcgatgacggtggggttgacgccgatggtggcgaggagcttcttcatgacgtggcacatgcagcaggaggagcgcgtgaagattatgacggg

SEQ ID NO: 30028 - DNA, 885 bp, Glycine max
  Peptide Sequence Number=SeqID_146806
atggaagccaaagcagattatacacaagatggcactattgatttccgtggccaacctgcagtttcatctaaaactggcaaatggaaggcttgcgcttttcttgttggctatgaagcatttgaaaggatggccttctatggagtggcttcaaacttagtgaattaccttacaagccaacttcatgaagatactgtttcatcagtgaggaatgtgaataactggtcaggatctgtgtggataacgccaattcttggggcttacatagcagattcttacttgggtcgcttctggactttcactctctcatctctcatttatgtcttgggaatgactcttctcacagtagccgtgtcactcaagagcctgaggccaacatgcaccaatggcatatgcaacaaggcttcaacctcacaaattgcatttttctacacagccctttacactatggcaattggggcaggtggaacaaagccaaacatctcaacttttggtgctgaccaatttgatgacttcaatcccaatgaaaaagagctaaaggcttccttcttcaactggtggatgtttacctcattcttgggtgctttgatagccactttaggattggtttacattcaagagaatttggggtggggactagggtatggaatccccactgctggtcttctattgtctttggtcattttctacattggcacaccaatatatcgccacaaagtaagcacaacaaaaactcctgctagcgacataattcgtgtgccaattgcagccttcaggaatagaaaactacaactccctagtaacccctcggatctctatgagcacaacctccaagattatgttaatagtgggaaacgccaagtctatcacactcccactctgaggtga

SEQ ID NO: 30029 - DNA, 246 bp, Glycine max
  Peptide Sequence Number=SeqID_146807
atggattgtggtatggtattaagtgggtattccattcaaccttccttatacaatttacatgaacatgctgagaaatatgaagcggaaaggaaaaaccaatcatattacatatgttgctctgttgaaccaaattttctaggacatatattatatgacacattctacaagctcttaaaagaacaaaaaagtgagatgataatgaagggtggcatgagggtgaagaaacttttctttggggatcaatga

SEQ ID NO: 30030 - DNA, 297 bp, Glycine max
  Peptide Sequence Number=SeqID_146808
atgaagttcgaccctatcccaatcgattcatgctccaaagaacaccaaacgatctataaggaatggttcaattgtgttgatttagttatagcacaacacacttcatctttcaatgattttgttttgttccaatttacagcacaatcggttcatgctccaaagaacaccagacgatctataaggagtgatagcgatggtcggattacagggagtgatgcccccaagttttttgccacgtccaatttgtgctactggagaagcatgcgaggtgattgtggtgtctatagaacacattga

SEQ ID NO: 30031 - DNA, 1246 bp, Glycine max
  Peptide Sequence Number=SeqID_146809
cagctaatagaaagaaactagatcctagggctgccacttctgtatttttgggttttaagccaaacaccaaaagattcattatgtttgctcttaaaaccaaggccatatatgtctctaggaatgtgatcttctatgagaattgttttccattcattggccaagacaaacctgatcatgtcactgtccttcctattcctccttctcattccattaatcaatctgatggtgtctcatcagaattaccaattgatcatatcatgcctgtgccaaataatactaattttgatcccttgaatttagagcagtcctctaatataaccaaaagatctctgagacagacacacagactaagcaagtataaggacttccatgtttcatacccatctttaactgtagccaattattctgtagcttctaaggatcctatctggatagaggcaatgaatgcagagattaagcctttagaacttaatgatacttgggttttaactgatatgcctcaaataagaatgttattggctgcaagtgggtgtataagatcaagcacaaatcagatgggtcagtggagagacataaggccagttgccaagctaaccacaatgagacttctattggccttagctgctatcaataaatggtatcttaagcaattagatgtgaataatgctttcttacatggtgatttaaatgaagaggtgtacatgatgcttcctcaaggtatgcaagtagccaagcctgggcaagatttaggtgacttgagatactacttaggttttgaagtagccagaaaacctactggtatcaatctatgtcaaagaaagtatgccttagacattcttagtgatgatggtatgcttggatctaagccagtatctactccatcagattatgctactaagctgcaacaattaggaactcctctttcattagaagattcttccttttttaaaaggttaattggtaggttgatctacttgactaatacatggccaaatatcacttatgttgtgcaacatctgagtcaatttgttgttgcttccacctcagctcatcaacatgttgttgttcgaattctcaggtatattaagggatccccaagatcaaggattttcctttctgctgtaagtaaagttcatttaaagggatttagtgattctgattgggctggttgcattgacaccagaaggtctatctttggttatgctatgtacattggtgactcattgatttcatggaaatcaaagaa

SEQ ID NO: 30032 - DNA, 438 bp, Glycine max
  Peptide Sequence Number=SeqID_146810
atggagttcgttaaaatcaatatggatggttctttttcgccaaattctcgaacaggggcttgtggtggtattattcaggattcaaatagcaaagttttgagttgtttctccaaaaggctaggctattgtaatgtgatattggctgagctttggagcttgaagtatggtattaagtttgctttgttcgaaatggatgctcgcgaggttgttcatatgattgatgggataaagagtgttcctagttctttgagacctttagttgaagatatcaggaggatgctttgggctaatggttggcaaaattctattgttcacattaatagggaagctaactctattgctacctgggctaccaaatttggacatcaaaggaattggtcatctttcttggtggatgatgttaggagagctattgctagccttctaaggctgccttag

SEQ ID NO: 30033 - DNA, 888 bp, Glycine max
  Peptide Sequence Number=SeqID_146811
atggccgaagtgatcaacaatatgccccccgaatccctagaccacgaccaatctccctccgcttccgctcctcctccgccggccgcctcttcctccgccgccgacgatctccctccgccgcctctccctcttccgccgcgccgccgggaccgtagggacgaccgcgatttcgaccgccaccccaaccgcagccgcgattactacgaccgcgacagggacttcaagcgccgccgcagccctagccccggttaccgtgaccgccgctactcacccccgccgccgtcgcgccggtcgcctccgccgtacaagcgatcccggagaggcagcccccgcggcggggcctatgtacctgatgatagatttggctatgattattctggtggctatgaacggggagcaggtggaaggactggttttgcagatgaaaagtcttatggcaggcttgctcatcgatctgctgggggatatcataatgggatttctgatgtggataatagtcgcggttatgcagatttgccaagtggaggtgcacaaaggaatttgatgtgtgacaaggctgtgcaccatgtgcacctcagttctcctttagccataaataggcttctgaaatacagattcaaatgcactctgcaaagactgaagtactggtttaaaatcacctgcaagtacaaattacattcaaatagaagataccttattccaatggaaagtttagaaagaaggtattctgtcatggcaagtaaatttctggaaagtaacagagacaatggttgtcttagaacactaagggtctctttgggagaagtggtaaagaggggaaagcttacaacaagtagtacgctttccctcccctttcttccttttccacctctttcaaacaggtcctga

SEQ ID NO: 30034 - DNA, 921 bp, Glycine max
  Peptide Sequence Number=SeqID_146812
atgattgagactaatgaggccaagggttttaggtatgtgaggccagaaggaacagggcatgaagaaacaagaaaatctggttctgactgggagaagaaacttgattcattttggcagggaaggttgaatggtcaggatccattggaagtgatgactgccaaggagaagatagatgctgcagcaactgatgtgttggatccacatgttaggaaaattagggatgagaaatatgggtggaagtatggttgtggagctaagggctgcacaaagctttttcatgcggctgaatttgtgcacaaacatttgaagctaaaacaccctgagcttgtgatggaactaacatcaaaattgcgagaggatctttattttcaaaattacatgaatgatcctgatgctcctggtggaacgcctgtcatgcagcaacctcagaaggataggcctcttaagcgaagattaggaggtttagagggccgattgaaggatgaccgtggtaaccggcgagaccaggacaggagtgacagaataaacggagataggcctgatggttccccatcccatgaaaggcaaatgggaaatcatgatgaagcaatgtatgatgcatatggagggctcggtgtacctcaatttacctcagatatggcccctccgccagttttgatgcctgtacctggtgctgggcctttaggaccctttgtccctgctccaccagaagttgcaatgcagatgttcagggagcaaggaggaccttcgtcatacgatgcctcaggaaggaagattcgatctggtcctcatatgggtggaccagcacccataattgctgttcctccatcctttagacctgatcctcgacagatgcgaagttatcaagatctggatgccccagaagacgaagtcactgtgatagactatcggagcttgtag

SEQ ID NO: 30035 - DNA, 240 bp, Glycine max
  Peptide Sequence Number=SeqID_146813
atgtctcattctagagagagttttttccactctaacagtagcaagatgttgtcaccagaagttcgcccaattggtgagagttcaaatgatgactcttctcatcgtcatgatggttctgatgtcgctagtgaccaagaatctagtgttcccattgctggtgccatcataattgttggcgttgctgccattgtcagtcaaaacattgggggggagggggggataaggtcgagtagcctttga

SEQ ID NO: 30036 - DNA, 417 bp, Glycine max
  Peptide Sequence Number=SeqID_146814
atgactggaaaagaaggagaaaactcaaaaggaatttggaagcttctaagcggcaaaatggcacgtccatttagaccattagatctctccttgaagaaacaaatcaatgatagcaacgtcaaggttgaggacttgaggttatctttcacaaagttcgtacaactaactttagagcttgtggaacatatgtactacacagacttggcaagtctccgtattcgaagggaaattgagatcttatcatccaatttcacctctataaaagcggattatcaaggttcaagtaaactaacttttaatccaacctatattctgatacttgtatgcatctgccccactaacttgagcttcggagtatctttacaagtacaccccaccattgttcgtggaggacctcatggacaagtactgccatga

SEQ ID NO: 30037 - DNA, 1251 bp, Glycine max
  Peptide Sequence Number=SeqID_146815
atgcctgctgttaaaatgaaggctaaggcaattgcaacctgcaaaaaagatgggagctatcctcatgtgtctcagaattcaaataaaatatctaaatccaccgttgttagagtaactaatgaattggtaaatttagctatctccagccaaacatctcaaaatgatttttgcaaaaatgaagaatattctatggatcttgacaataaaggagacatgggccagccctctctttcattcaatggatgtacagattcaatggagcagactgatatttcattcaatggatgtacagattcagtagtagcaagggattctttgtcatcttctctttccccagattcagaagcaattttgccttataatgggcttaattatgcccattgtcagcaatttgaaacagttaatagggaacagttcacatgggaacctcagctggatgacaatttcttcagcactttccaaatgtttgaccttgactctgcatatgaaactgggtttcccattgatgggctaactttatttgatgacagccaaagctattataacctttctgatcttctatttcctgggacaaattttaccatccatggcactgaggaaaatatggagtatcccactctcaaggagacaataggagcagcagattttacttttggaggatcctctatagggtttcaacagacgtctgattcttcatgggttaatcatctcatgtgccatcaggccattccattcactgaagaactttctgtcatctccagtgagatttcttcagacagagtagattattgggatcaagagacattcattaagggggttttagagttagcagatgatgctaactcattgcctgcattactcatcaatgaaacaagcaaaaggaagaaggttacccttgtccttgatttggatgaaacgctgatccattcttccatggggcaatgcgatggtgcggctgacttcacatttaagatgatcacagacagggagttgactgtatatgtacgaaagaggccctttctccaagaatttttggtgaaagtatcggagatgtttgaaatcatcattttcacagctagtaaacgcatgtatgctgaaacattgcttgatgttcttgatcctgataaaaagtttttttctcgacgagtgtaccgagaatcatgcacctggaaagatcgccgctgcgtcaaggatttgacagttcttggaattgacctggcaaaagttttcagttcattgtttcttccatga

SEQ ID NO: 30038 - DNA, 159 bp, Glycine max
  Peptide Sequence Number=SeqID_146816
atgaagggtatggcaacgaacttgcatactaaggtgaaggtgttaaggttgaaggagtatgacgtccagccaaggtggagaattgttgtgtgtggctggacgatcatggtttggacaaccggggtagacaagggaaattgtactcagctagttggttaa

SEQ ID NO: 30039 - DNA, 405 bp, Glycine max
  Peptide Sequence Number=SeqID_146817
atgaaagggataccagtcgtgggtgcctctgaaaaggggaacctagcaaacatggcaagtccctcgcatcaagagcttgatgatcactcgttgatcattgacctgcaaagagagattaatcccttgaagcaaagaaacacccaagagatggagaacgccattcttagagagtatgttcctacaacattgaaaggtgcatcgctccatcggtatactcgattgccaagaaactccattgactcatttgtgacacttgtcgcatgttttggagcccagtacgtgtcaagaagaccacaccatctaacagctatggcattcaccaacattaggcaagtagaagatgaatcacttcatgagatttcatggaaaggttcttatcagtctcagttcggattcaaaacgtga

SEQ ID NO: 30040 - DNA, 294 bp, Glycine max
  Peptide Sequence Number=SeqID_146818
atggtggcgaaggaggtgtggttgtctgcagaggtgtccacgacgaattgcaccttggattgcacgaggaggaggttggaggttgagggtgagggaggagtggcattagagagagaagcgtgtggctttacaggcttggtggatctcctcggcggagtaggggtaagagtggaggaagaagaaaatggagctcatagagataagaaggaggaggaagaatatgatgtttctaacgaaaatcgaaataaaggacggaaaattaagaattttaaaaacttaaaaagactaaagtga

SEQ ID NO: 30041 - DNA, 695 bp, Glycine max
  Peptide Sequence Number=SeqID_146819
atggcaaatagaagttgtacaagaagtgtgaatgcctcaagtcctcttccatcgattactccctttcaatgttctactgaaccatctggatctccatcagatgcagaaagccaacatgaggattacaatgaatttaaaagcaatgaagataaagacgacaatcaatacaagaaggaggaaaagaagaggaagaagaaaaaactgagtgaagagaacaaaggtaaggagtataaggagtttgaaaacaatgaaggtgaagatgatggtcaaggtaggaagatgaagaagaagaaactgcatgacaagagcaaaaataatagtgagttcaatagcaatgaaggtgatgtcaatgaagttgatgatcaatgcaagaagatgaagacaaagaagaaagctatggcagatattggtgagtctcctaatcctgcacacagtggatcatccaaacccaaacgagtaactttttctgatcaagtggatgtttgttgtgatggcttaatccctgggaaaagagagtctcatggtttgggagatgaaggtctagatatggttctccattgcagatctcatcctgaaattagagattattggaaggaaattggaacagccttacctcagaggccttatgttagtgtgtatactcgtgctcatattttgttagaaaggggcaagaatcgtgaatggacacctgaaga

SEQ ID NO: 30042 - DNA, 159 bp, Glycine max
  Peptide Sequence Number=SeqID_146820
atggagatcaatgcatcccccgacaacattaattcagtcaagtacaacgtacatgaaaaacagccttaccgaacttggtaccactttcagcccccacaaaattggatgaatgatccaaatggtatgctagtgaacttctcctacttccagttaaattag

SEQ ID NO: 30043 - DNA, 282 bp, Glycine max
  Peptide Sequence Number=SeqID_146821
atgcgtctcataatggctacgcatagtcaaaatgtctttttcaagggatttcctctcagagccctatcaccctgtgtaatcgattacacaccattggtaatcgattaccagaggccatttaacattctgtctgcatttttaagccctgtaatcgattacacacacttggcaatcgattaccagaggccatttaatctcttgtctccatttttaagccctgcaatcgattgcacacccttggagctcgcctgtttaggtacgtcacaggttctcactgactga

SEQ ID NO: 30044 - DNA, 435 bp, Glycine max
  Peptide Sequence Number=SeqID_146822
atgccacatacaagaggtggtgaccacacccaacctattgcatctgtatctaggcatggaagacgtgtaattgtagatgaggaagttaaagctagtagcacattgaaggaagttgagggatttggaccccctcataaggagatcatgagagtggtacaaaatttagggttacttccattgacaaaatgtagttatgaaaccactgacaagagatttttatcttcttttattgagaggtggcatcacaagaccaacacctttcatttgaccctaggagagataacaattgcacttgatgatgtgtcatcattggtgcatattcctattgttggtggtttatatagttacccgcacacgtctaaagaggtggttattgcattattaatggagcttttgggagtggacaaggaggatgcatttttggagactaaatag

SEQ ID NO: 30045 - DNA, 441 bp, Glycine max
  Peptide Sequence Number=SeqID_146823
atggctatagtaatcttgtcttcctcacttgtccatacctcccccccccccctcacttctccatgcccaaaacattgttttcgtcacttgttcatttcatgtaagcattttcattacccaggttcacttgcacaggtttatatggaagatgattatgtgaggaagatgttagatgaagttgatatggacaatgacgtcagaatatatgaagatattcgtatgcattattggcaagagattggaaaaattgttgattgtagtgaagcattcataactacaaagatttttgctactcaagatgaattattgaaatgggctcgggatgtttcatttgaaatgagttttattgttgtcattttgaggtcagatacatcaaatagacaacctggacaaaagacatttgttgtgttgggctgtgaaaagggtgagaagtataggtga

SEQ ID NO: 30046 - DNA, 1779 bp, Glycine max
  Peptide Sequence Number=SeqID_146824
atgtccaactcagtgagtgaggaagaaactttagctggtctttctgctttaagaaatacgagaaaatcagaaaaagacaatactattggaactgctagtaatccaatctatatggtggctagagacggcgggaatataaaagatcagatatggcgtacacttaggttcattgcagtgtcctttttcatgatttctggtgtaggagcacttattgaagataaaggaattagtaaaggacttggtataaatgaagaagtgcaacctagcatggaatcaagtacaaaatttagtgatgtaaaaggtgttgatgaggcaaaggaagagctggaagaaattgttcactaccttcgagatccaaagcgctttactcgtcttggtggtaagcttccgaaaggagttttacttgttggtccacctggcactgggaaaacaatgttagctagagctattgctggagaggctggggttccattcttctcctgcagtggaagtgaatttgaagagatgtatgttggtgttggtgcacgaagggtgagggatcttttttctgctgcaaggaagcgagcacctgctataatattcattgatgagatagatgctattggaggaaaacgaaatgcaaaggaccaaatgtacatgaagatgacattaaatcagttactggttgagctagatggattcaagcaaaatgagggcataattgtgattggcgctactaattttccacaatcattggataaggcattggtgagacctgggcggtttgatcgccatgttattgttcccaatccggatgtaaaaggaagacagcagattttggaatcacacatgtcaaaggttctgaaggctgatgatgttgatctaatgatcattgccagaggaacacctgggttctctggtgctgaccttgcaaacttgattaacattgctgctatcaaggctgcaatggatggtgctaaagctgtgagcatggctgatttagagcatgcaaaagacaagatcctgatgggaagtgaacgcaagtcagctgtcatatctgcggagtcacggaagttgactgctttccacgagggtggccatgcccttgtggccatccatactgatggggccctccctgttcacaaggcaactatagttccccgtggaatggctcttggcatggttactcaattgcctgaccaggaccagaccagcgtttcccgtaaacagatgcttgctcggcttgatgtttgcatgggaggtcgtgtcgctgaagagctaattttcggagagaacgaagtcacttctggtgcatcctcagatctcaggcaagcaaccagtctggcaagggaaatggttaccaaatatggcatgggcaatgaagttggactagtcactcacgattacaaagatgatggtaggagcatgagctcagagactaggcttcttattgagaaagaggtgaagcaattcctggagagggcctacaacaatgcaaaaactattctgaccactcacaacaaggagcttcatgcacttgcaaatgcccttctggagcacgagacactttcaggaactcagataaagacattgcttgcccaagttagatctcagatgctgcagcagcagcagcagcagccaccccaaacaattgaagctcagagcagtttacaatccaacacggtgcctccatcatccagcaacccggcatctgctgctgccgctgctgctgccgccacagctgcagcaacagctactgctgccgccgccaaggctaacagtgctccagtgggatcttag

SEQ ID NO: 30047 - DNA, 246 bp, Glycine max
  Peptide Sequence Number=SeqID_146825
atggccgattgtggtgctgaaagcgaaaggaaagttacgatacgaaacaatcatggcgaaaatctcgtcgggatcttacataacgcggcttcaatttcgcttgttatcgtctgccatggcttccaatcttccaaggtggaaaggattcccatggtgtaccttgccgctgctctgggaaaagatggatttagttcttttcgcttcgactttgcaggaaacgggttagtgaaggaaaatgaacaataa

SEQ ID NO: 30048 - DNA, 429 bp, Glycine max
  Peptide Sequence Number=SeqID_146826
atggatgccttgatatctgagattgaaagaactacaccgaatttgaaggcattagaccaatatgaagctctgctagaaaaagagagttgtttattgttggaaaggtcttcggctttcagcacaattttaaccttgctttttttaattaagccagctaaccagccatcaagcacactcccagatagtattggcaacatgtgtcaataccttgcaaaaatcagagacatggtgcagagcttggtaccaaaagatttggatcagttaaagaagccctcttcaagaacaagggaactccacagaccaataatggatattggaaggtacaaagagagcaaatggactgcagaatctacaacaggtgaaatagaacctgagcttttgaatgcaaagaagacaatgaaacatcattcttctatgattgaggattga

SEQ ID NO: 30049 - DNA, 243 bp, Glycine max
  Peptide Sequence Number=SeqID_146827
atgtaccttcgacgacggtcacgacataactgtcttagtaggctaggcggtgacattttcatgaatataccgcttctccaatgcagacgatcaaaatccctcactttcttgtccattgtgcgctattactacaaatccatcactcaagcgtccactatgtattgttttccaccaaaggaacccctcttgcactaccctaacctaagcctcgcatcgcggccttactcctacgccctagcatga

SEQ ID NO: 30050 - DNA, 240 bp, Glycine max
  Peptide Sequence Number=SeqID_146828
atgagagagttagaatatctgaaaaaggaattgttcaaccttaagtttcttgtggcttcattcatggatcacaaatccagtgtagagaaggaaattgaagcatcgaactcgaagatgttatcatgtttaacaactgaacaagatcttagaagggagattgaggagcctaatgaggagcaggtacttgcttcagtggccaagatcgaggctttgaaagaaatgacagatattgaggcttag

SEQ ID NO: 30051 - DNA, 2445 bp, Glycine max
  Peptide Sequence Number=SeqID_146829
aacagcgatatggtgagttttctgaacccggaggagttcgaactgagtgacaaggatcgttccatcgaagcgttggagaaatggagatccgcagcgtggttggtcaagaaccctagaaggcgcttccgctgggccgcggatctcgtcaagcgcaaacacgccgaagataaacgccgcaaaattcagagcacgattcggaccgtttttaatgttaaatgggtagaaggccaatttatcagcgctcttcctcaagctgaatacaaggtgtcagaaaagacgagagaagctggttttggtattgaaccagatgatattgcatcagttgttcgaggccatgattacacgaactataaaaaaattggtcaagttgaagggattatagagaaactccgtgcctcagtcgatgacggtgttggtcaagccagtatagataccaggcaagagatttatggagtcaaccgttatactgagaaaccttctaaaagcttcctcatgtttgtttgggaagcactgcatgacttaacactaatcattctcatggtttgtgctatagtttctatagctatagggcttcccactgaagggtggccaaaaggtgtttatgatggtctgggaatcatacttagtatattcttggtggtcattgttactgctatcagtgactaccagcaatccctgcagttcagggatttggacaaagaaaagaaaaagatctttgttcaggtcacgagggacagaaaaagacagaagatctcaatttatgatttggttgtgggagatattgttcatttgtcaactggtgatcaagttccagctgatggaatttatatatcaggatactctttgataattgatgagtcaagtttgacaggtgagagcgaaccagtaaatatagatggaaaaaaaccttttcttctttcaggaaccaaagtgcaagatggtcaggggaagatgatagttacaactgttggcatgaggactgaatggggaaagttgatggaaactctaagtgagggaggagaggatgagactccactgcaggtgaaattgaatggagttgctacagttattggtaaaattggtttgactttttctgtgctgacatttgtggtgttgacaataaggtttgttgttgaaaaagcagttcgtggtgagtttgctagttggtcttcaaatgatgcattgaagctgctggactactttgctattgcggtaaccataatagttgttgcaattcctgaaggactgccattagctgtgacactcagtcttgcttttgcgatgaaaaagttaatgaaggataaagcactagtgagacatctttctgcctgtgagactatgggttcagcgacctgcatctgcacagataaaacaggaacattgaccactaaccatatggtggttaataaaatttggatatgtggaaagagcaatgagattaaaggtaatgagagtgttgacaaactaaagacagagatatctgaagaagttttaagcatccttttgcggtctatatttcaaaatacttcttccgaagttgttaaggacaaagatggaaaaatgacaatattgggaacaccaacagaatcagcattgttagaatttggtttgctttcaggtggtgattttgaagcacagcgtggaacatataagatacttaaggttgagcctttcaattcagtgcggaagaagatgtctgtgctagtcggtcttcctgatggaagtgtccaagctttctgcaaaggtgcatcagaaatagtattaaaattgtgtaacaaagttattgatccaaatggaacagctgttgatctttctgatgaggaggcaaagaaagtctctgatattataaatggatttgcctctgaagctttgagaactctttgtttagctgtcaaagatgtaaatgaaacccaaggagaagccagtatccctgaagatagctattctctgatagccattgtgggaatcaaggatcctgtgcgccctggggttagggaagctgttaaaacttgtttagctgctggaataactgtccgcatggtaaccggtgataacataaatacagctaaggctatagctagagaatgtggcattcttacagaggatggtgtggccatcgaaggaccccagtttcaggacttgtctatagagcaaatgaagagtattataccaagaattcaggttatggcgcgatccttacctcttgacaagcataccttggtaacccatttgaggaagatgtttggtgaggttgtagctgttactggtgatggaaccaatgatgctcctgcactgcatgagtcagacattgggcttgctatgggcatatctggaactgaggtttgtgcccatgatttgtttactatggtgtgtctgatggtattaagtgtagcagttctttgtactgtttttgctttgttgcttggcatcttgttttttcgataa

SEQ ID NO: 30052 - DNA, 417 bp, Glycine max
  Peptide Sequence Number=SeqID_146830
gcagagttccaagagtttattgaccagatgaggcttgtggatgatttgatcaagttgtgggggtgtcctccgaacggttggctggagcatcatggttttgtggggctactgggtgagtggtggaaggagtttcatgtggctgggtggaaatcttttgtattcaaggagaagctgaagcttctgaaggcaaagattagggtgtggttgtgtgatgagatgctggtggatagtgagcagcgtcgacttgttgtctcagggttctggaggagggtgcaagccaaggaaagtatgttggctcagaagttgcaagttaggtggattagagaggtgtcataccctaatttcgtccggggacctttgcttgatgacatgcgacctttctttggtccttgtgaggtgcttgacacccatcattag

SEQ ID NO: 30053 - DNA, 222 bp, Glycine max
  Peptide Sequence Number=SeqID_146831
atggctttggatgagcttttagacgcaagtctggatgaagattctttgcatgttggagaggttttggctttttgtgttgttagagccaaagattatcactttttaaaccctcatcttattgaagttcctactcatgaacctttaaggttccaatcagttcttcaatggacatggagtctagctatggaccttcgaatattcttcctcggaaagggcgcataa

SEQ ID NO: 30054 - DNA, 352 bp, Glycine max
  Peptide Sequence Number=SeqID_146832
gtacacgatgaattcggttataacagtgttgtatttcaatggaagggtatatgaagataatgatggtgtaatatttgaaggcagtaaaaaagcgattcagattaaacgtggaattagtttcaatgctttgaagaaaaaaattggagacaaggaaaatatattgccttgcaaatttgcgatggcgaagacgttgaaacgatgctggaaagttttaaacaacaacaagaaatactcgttagacgaagatgacagtgttgacggtatatcagatacagacaatgaagtccccgagaacagttttagaaaggttctgagaaccgcactttatataagattgagagatacttgttaa

SEQ ID NO: 30055 - DNA, 240 bp, Glycine max
  Peptide Sequence Number=SeqID_146833
atgtctgttttggtgaatgaattgttggctgaaattttgatcctaagtgaatattcaactcctaaaactttggtaaacaagcctagtgagttcaacatacataggaaggttggaagatcttcttcatcaatggattcctttgcttcttggaagatacatggcagcggaatggagaaggacgagagagaggagacgccacttcaaggagaagatgagtctagaagaagctcaccaacatag

SEQ ID NO: 30056 - DNA, 1062 bp, Glycine max
  Peptide Sequence Number=SeqID_146834
atggctgggttcttctctttaggagcaggaaggcagaacaaggcggaacaagaagaagatcaaagagaagagaacgttaacaacgccggtggtaataataacagtcaattcttgttcagaaacaacgttagcgaagagatctacaacaagggattcgagatatggccacaatcctcgtaccaccaccaccagaacttgaccaacttctactccttcggtgtgggccctagtcgcaggaacaaccacaacaacagctcctccaacaacgtaaacgacgacgtttctgtgtctttctcggatgagtcgaaccggttcgggttcacggtgatgagctccggtggcggcggcggcggaggaatgaactgtcaggactgtgggaaccaagcgaagaaagattgtcaacacctcagatgcagaacctgctgcaagagtcgagggtttcagtgtcaaacgcacgttaagagcacttgggttcctgcggctaaacgccgtgaacgacagcaacaactttctgctttgcagcagcaacaaaatcaacacccacagtttcgtggagatcactcaaaacgacacagagaaagcatcgaaggtgctgctgctggttctctcgcttgcgttccagttccgatcaccaccacagactttataagattcttcttcggtgatgtgtatgttctgtggcgtgaagaggtgtgtatcgggttggagctggggcaatttccaccagagctaaactcaccggcggtgtttcggtgtgtgaaagtgagtgcaatggacgcaccggacgagcgttacgcgtatcaaaccgcagtgaacataggagggcacgtcttcaagggaattctctacgaccaaggaatggacggtccttatgcgggtgcaggttgtgagggttcctccggtgtcggtggcgaagctcagccactaagtctcatggccgccgccacaaccaccaccgccgccacaacaacaagcggaaacccttttgaggcttcactctacacggctccgatgaatgcctacatggctggtacgcacttcttcccaccctcaagatcctaa

SEQ ID NO: 30057 - DNA, 294 bp, Glycine max
  Peptide Sequence Number=SeqID_146835
atgagcttagaaagaaacttaacatatttggtgatcaccttacttatcatgtcggtgaccgtttatgtcatgtacaagatcgttatgaaaaaacctacaataccagtatcaccaccagcgacaatggcagaacaagaagacacaggagtgccaccaccaccaggagcaacagtggcggaacaagaagcaagcgcaaccaccaccaccaccaccaggggatgtagtcatgtattattgagtatcaatcccaaacaaaaaagatggttatatgctaaaacaaaagccagaggttaa

SEQ ID NO: 30058 - DNA, 171 bp, Glycine max
  Peptide Sequence Number=SeqID_146836
atggctgtggcatttaccctaagaggaaaagagctagttcaagccagttctttttgggaaataacttttatcccatcatctcaagaaagagaggtaactaaattagaacttcttctagcaccggcaaatgagtggaagaacttggaattgatatcgccacccttcaactag

SEQ ID NO: 30059 - DNA, 402 bp, Glycine max
  Peptide Sequence Number=SeqID_146837
atggagttaaagtgtgcaaagggactccaatcctctcacttgttatttgctaccaattgtttctcttttgcaaggcaggaaattggaaaaattaaagagatacttaacgatcttttcaatgctaaaactgtttgcaaaatccagaaaattcttcttttgaatgtgcaagaagacaagctaatatggaagtttagccacaatggaatgtatactgtgagaagcgcattcttcaacatcatggaattaatcttggacaacgagcacctcaaagtagctggaaaatggaattcgatttggagtattcatgcaccaccaaaaatcaaacactttgtttggagactccttcgagggtgccttccaacaaggcaaagactagtgcacaaaagagttgaatgcccatag

SEQ ID NO: 30060 - DNA, 150 bp, Glycine max
  Peptide Sequence Number=SeqID_146838
atgtcgttgctctccatctcgatggtggcacggtggcaaaaagggccagtgaagtggcttgaggtgcaatggcgaagtgggtttcgagagagacacgatgtttcgagagagtgtgtggtgcttgatgagccaagagggttgatcaactaa

SEQ ID NO: 30061 - DNA, 411 bp, Glycine max
  Peptide Sequence Number=SeqID_146839
atgaccagctcgctactcttccacttacccacttcaccaaatgaatcgttgcactcgcactgttactcttcatcttgcaccactcaacacttctttggggagaggaattgttgttgtagagtgaggtggaggggttggtggaaatggttcgaggcattgttggagttcaaggatttaattattgtgtggacggtggatgatgataaggattataacaagggtggagttttaggtttagggtttttcccctttgtaagtgaaaaatttaggaataggatgattgagaggggctgcggggttagggtgttggctggggttgttatgtgggaaacgcttttgctgaagttatgtttggcattcgagaaagggattggtagagtggagcaggagaagaagctcatggctttcgcg

SEQ ID NO: 30062 - DNA, 183 bp, Glycine max
  Peptide Sequence Number=SeqID_146840
atggaaactgaacaacatcctccacaacaaagcccatcagtcattgccaacatgcatgatgaaggtctacaaccacatcctcaatcatatgaattcacgccacaacctcatcatcatcaagaagattatgaagaacaacctgttgttcctaatgaacaacttcaaccacaagaacatggatga

SEQ ID NO: 30063 - DNA, 394 bp, Glycine max
  Peptide Sequence Number=SeqID_146841
atggcagcggaatggagaaggaagagagagaggagacgccacttcaaggagaagatgagtctagaagaagctcaccaccataggaggccatggataagagcttggaggaagaaggagatgaatgaagggagaggaagagaagagcacggaattttgtgctctaaaagagctctgaaatttgaaattgaactggacgaggttcaaagttctcggctccaacttcctggctcgaactgccagttcgtgaagaacgacattgatctcacttcgaagacaccagaagctggaaccatgagaagagatgcctgtccaatagcactcggaaccccaaatccagtgccaattcttcaccctcccctccttttcgcagacgaaggcgcattctattctaacg

SEQ ID NO: 30064 - DNA, 270 bp, Glycine max
  Peptide Sequence Number=SeqID_146842
atgttggggcttaccgttagaatagaatgcgccttcgtctgcgaaaaggaggggagggtgaagaattggcactggatttggggttccgagtgctattggacaggcatctcttctcatgtaacctggtgtcttcgaagtgagatcaatgtcgttcttcacgaactggcagttcgagccaggaagttggagccgagaactttgaacctcgtccagttcaatctacagggcttcaatgtcaatagggttcaatggaagggcaccataatgtag

SEQ ID NO: 30065 - DNA, 348 bp, Glycine max
  Peptide Sequence Number=SeqID_146843
atggaaattccgcaatcaccgtttttaatgttggacatgctagacaagttcttagcgttggcactgccggtcggggccaccaaggaccaccccttcacgtgcccgatgggcatggcagcgccaccgctcaaagggctgaaactgtcgccgttgctgctgtgcgtggcggagatggacttcgtgagggacacggagatggagtattgcataacacttgagccacaacgatatcatgttctaataaccgatcaccaaactgaaggatttttctcacataaaggccagctcacctatgtgacaccctttaacccaaaagcttatgtagttattgttctggacaataaataa

SEQ ID NO: 30066 - DNA, 534 bp, Glycine max
  Peptide Sequence Number=SeqID_146844
atgtgtagtgtcttcccaacatccctcaaagtggtggcattaacctggtacgatggacttccttcaagaggtagcattacactccatgctcctcgcccaatggcccatagcatggacgagttgtgcgaacaagccaaaggctacatccagatagaagagatgtcaaggtttagaaacgaggtccgacaaataggacaaaagcatgacaagagagaaggaggtaccaagaccgactcacataagtcagacgaaagggacaagcctgacaagcgccagcctctcccaaaagggcccaggtatgagcgttacatacctctgaagaccaatcgcattacaatcctcgaggaggccttcaacacagagttcgtaaaggggccgaacagtcatgctgcaggagcaagacaccgaggacatcaagaggattaccacaacaaccatgatgttgacagaataagagatagagcagaagatagaggaagacaaagacaccaccagcaaagacgagcaacaacctccacaggaacaggaaaatga

SEQ ID NO: 30067 - DNA, 306 bp, Glycine max
  Peptide Sequence Number=SeqID_146845
atgagtgaaaaaggactagatattttgagaaagcgaggcttactcgaaaatcacagggtagaacttcttcaattttttgagcattgcgtctatgggaaacaacatcacacaaagtttccaaaggttatgcacataacaaaggccatcatggactacacccattttgactactgggagccttcgagagttccatcactgggaggggcaagggcattggatagaagactccaagtagatcgggtcaaagatgcaagagaagacctggttctcatgagccttaggatagatttcgggctcatgggttaa

SEQ ID NO: 30068 - DNA, 546 bp, Glycine max
  Peptide Sequence Number=SeqID_146846
atgtctcatgttccttatgcaagtgttctaggtagtctcatgtatgctacgatatgcactagaccagacctagtacaagagatcggtgttgtgagtaaggtacaactgatattggactatggtattagaaccaaggtcaagagtttgattcccaacaaggcaattgctgaagaggagattgtttgttgtgttatgacattaattgtcccgtggtggagaccaagactcgtataccatggagacactccttgtgctcttgctagttacttagattctaactatgctacaaacttggatgcaaagagatctttgatcagaggtagagtacatggctctagtagaagcagcaaaggaaggaatttggctaaagggatcaagttcttcttgagaggactaagcacattggcatcagataccacttcatccgttctgggaagagggttgaagtctgattgcagtggaatggagaaggagaaagatgaatggagacgctacttcaagtacaagatgagtctagaagaagctcaccatcataggaagtcatga

SEQ ID NO: 30069 - DNA, 342 bp, Glycine max
  Peptide Sequence Number=SeqID_146847
atgggggacctgagtggagtttcgtgtgattttgctgtcattgatagtttgatggaggtgtggtggtacttggtaggtagggacgaaattttatgtagttacataggtgcttttggtggtgttctcctatcagaattggagttttatatcattattaccttggattaccaaggtaaaacttcaaatcctgttggaggaaaagaccaaacgcatctaagaaactgcataagttttgtccggcttcggttactcattgtcttggtagcgggaatggctagtctccttttggaaataggtaatgctcagcacttcatgcttgggaatgttcagattcctgaatga

SEQ ID NO: 30070 - DNA, 1311 bp, Glycine max
  Peptide Sequence Number=SeqID_146848
atgagtgttaacagcctcccaaaccaaattctttggaaccggattggaaccgtctctggcctgcaaagcagcattcctcaaggtctgaatcgtcagcacattggccttccagaacgacacacaattataaggaagattatgtttcttgcaaagatccttaaccaaaggcgcaatcttcctcaaatggcaccgtggcagccttggaaacagatggtgctccacctgaaactgcaaccctccatgaaaccagtccatccaaggagagcagtccacaccaagagtccccttagtctgcttctcgaaccaatcgccgccgctggggggcccaaggtacacctcagaagaaaaatggttcaaacagaactgcacatgctgaatacccgtaacagagaaactcacgaaaacaaacaaaagcctctcccaccaattgggcaagaaggaaaccaacaaagggtaccaaacccagaatgcaagcaaacccaaaagctcactgcctctgttctccaccttcctcttagacaacaacaagaaaaaagactgcgcaaacagattaaccctagcgaaacacatcacagggtaaaaagtccagtgctgaatctggaagtgagggaattgaaaaacctagaggagacgacgaaagaagggcaaatgctggagatcggggtcatagtcgaggctgttgcatgcaatgtggtgggcgttgtggttccacttccaccagccgatgctgattccggcgagaatgttgccggagagaatctgaattgcgcggttgaggcggcggctgagcatcacgttgtaatggccggagtcgtggcctatccagccgctctgaatccagagaaagcctatcaatgcagcggaaagcacgtgcacgaaagtgctgtcggagaagaggacgccgcagacagagagaggaaaaagggtgagaataagggagaggaggatggaggttgtgtggcccttgcggttgaagaggttgagcgcggagaggtcggagaagagcttgcggtagtcggaggaggcggcggagacggtgtggtcggaaagacggtgggaggtggagaaggcggggaggaggagggaggcggtgttgggagggtggaaggcgaggaaggcgtcggtggcgtcggtgccggcgagggtgaggagtgggagggggccgccggggtggcggtggagccaggaggagacgtcgtagatcttgccgtggatggagatccaggcgtcgtggcgcgtgttatgcttgcgaagttcatcggtggaaatgtaggatgtgggaggctccattggagtcgcagtgatgagtga

SEQ ID NO: 30071 - DNA, 1637 bp, Glycine max
  Peptide Sequence Number=SeqID_146849
tttgcccaggtcctcagtctgaatctgctggaaaatctgatgcatgtgaagggtgcccgaatcaacaaatttgtgccactgcccccaaaggacctgaccctgatctggttgccattgcagaaagaatggctactgtgaaacataagatattggtcttgtcaggaaagggaggagttggcaagagcacgttctctgcccaactggcgtttgctttagctgcaagggattttcaggtgggtcttcttgacgttgatatttgtggtccaagcattccaaagatgcttggcctagaaggtcaagagatacatcagagcaaccttggttggtcccctgtctatgtagagtccaaccttggggtcatgtcaattgggttcatgcttcccaatccagatgaagctgttatatggagaggcccacgcaaaaatgcacttatcaagcagtttctaaaagatgtctactggggagaacttgattttctaattgttgatgctccaccaggaacctcagatgaacacatttccattgttcaattccttgatgccactggagtagatggtgcaatcatagttactacacctcaacaagtctctcttattgatgtgagaaaagaagtgaatttttgcaagaaagttggcgtgaaagttctcggggttgtagagaatatgagtggcctgtgccagcctatcacagatttcaagtttatgaagttgaccgataatggcgagcagaaagatgttacacagtgggtttgggaatacatgagagaaaaagcaccagaaatgctgaatttgcttgcttgcactgaagtgtttgatagtagtggtggtggagcagtgaaaatgagcaatgatatgggggtaccctttcttggtaatgttcctttagatccacagctttgtaaggcagctgaagaaggttcatcctgctttgctaagaaagattgtgttgttagtgctccagcactaaacaagattatagagcagttgattgaaactaatgggtggtcaatgttagatctctggtccctcccgcgcctcttctcagagtcgcttaatttacagtctttacgcgaatcctttacgagctcgagctgtgacagaacggagtcggagcaatgccgcgacgagtcggcggcgatggttctgaaattcgtggcggtggcgtcgattctggtcgccggattcgggggagtctcgattccgctggtcgggaagtcgcggcggtttcttcgaccggacggcgacgttttcgcggcggcgaaggcgttcgcggcgggggtgattttagcgacggggttcgtccacatgctgagggactcgtgggacgcgcttcgggagccgtgcttggggacgcactcgcgcgcgtgggcgaagtttcccttcaccggtttcttcgccatggtgtcagcgctctttactctactggttgactttttagcgacggaatattacgagcgcagagaggcgcgtgggcgcgtggagcgagggaaggttgttgattatgatgaaggttgtgacgaggcgttgttggaaacgggaatcgtggaggttaaggatcttgggcgagggggaagacactcccactctcacgacggcgatgatgtggaaagtagtgttcgacacgtcgtcgtttcacag

SEQ ID NO: 30072 - DNA, 510 bp, Glycine max
  Peptide Sequence Number=SeqID_146850
atggaggaacacaggcaaacagcaccaaccaagcaagaaaaacaccaaccaaggactctctcttcactctgcaaactcaaaaacgcagactacaatttgaaggccaaacggattaaaaagaagaacgacgcgccaatggaagcagcgccttcaggaggcaggaaacgccattgccattggcgtttccctgcacctatggctagccctgcattgctgctgctgctgcctgaccctgctgcagtcaaagcgctaacgggaatggcgacttgcaacgtgaaatcgccagccatgtctgcgctttcgtccagagcttgccacttgtcggacatgcatgaagtcgccagttcaactggcgcttcccatgtaggcgcgagaatgaggagacacacggaagaaggagtcatcgagagagggaggaggtgccatcgagggaggggtatcgtcgcggtgggtgtaccgtcaaggaagggatgctgtcgcgggttggagaaggaaaaaggaaggtgttag

SEQ ID NO: 30073 - DNA, 2922 bp, Glycine max
  Peptide Sequence Number=SeqID_146851
atgtcttctcgtccccctcctctggaccccgtggccgacctcacccgccaagtcgccactctcaccaacacaaatgtggcgctcgttgcagctttggttgacggtgtcacttcgtcagaggaaacctctgcccatgcagctcaactaagcttacatgctttatccggtgataatgccgccgacacctttcgcttgtctggagctgatttgttctcacatttgcaggggggtgtctctagtaatgcagggtcacttattctcattggatttgtttgtgttgggattgatattgttttgggggccaatggggtttctcccactacaccggtaggcttgcatcacttccagagattcactagacttgatcctgaggcccagctattttcacttcatattattgatcctattaaacccctccattcaccacattcacccctcctacctgacaccaaacaccttgaccataatttcaattccctaattaccaaattttcccaccttttcactgagccctccaccctcccaccacctcatcccacagaccatactataccccttatgccctattccacacctgtcaacgtacgaccataccattatccccattcacagaagcatgaaattgagtctcaggtggccatatttctgcaaacaggttggatacaacctagcacaagcccattctcctctctgattctccttttcaagaagaaggatgggtcttggcgtatgtgtgttgattatcgtgctttgaatgcgatagcagttccagatcgtttctccctgcccaccattgatgagttattggatgaattgggtaaagtgagggtgttctctaaattggaccttacttgtgggttccatcagattcggttggcccctgaggatgttcctaagatcgcttttcgcacacatgatggacactatgagtaccttgtcatgtcgtttggtctttgcaatgcacccgctacattccaagccaccatgaatgatatatcccgggaattgctacacaaatctgttattgttttcttcgatgatattctagtattcaacactaccatggaagatcatttgggccatttatctcaggtattttccatcttggataagcaccactttcatttaaaacctgctaagtgttcttttggtcagagtagtatagcttatttgggtcatattgtgactgaggggactgtggaaccggatcctcttaaaatacaaggtgtaattgattggtctacagctaagtcagtgaaaggattgcgtggttttttgggcttgtctggtttttatcgcaggtttgttcaaggttacgccactcttgcttatcccctgacttcattgttgaagaaaattgcttttgagtggtatgatttggctcaacaggcattcaaaaagttaaaggcagccttggcatctgctcctatgcttgctctgcctgatttttctgtgccatttattgtgcaaacagacgcttctggatatgctatgggtgcggaattgctcacgcaagtgattcaaactcataaacaacagttttatttgtcaaaactattaggataccactatgatattcagtataaactagggaagactaacacagttgctgatgcattgtcacgttgttttgaacctactgttgctgaaataaacatgttatccactcctcagtatttgtttattgaggaattgcacagggaattgagctcagatgctgattatcagacacgctgccagcaagttattgcagacccttctctggctcaggatttcacagtttctaatgggttattgctgcacaaagggcgcatctggcttccctcttcatcgcgttttaaaaatttgttgctaaaagaatatcacgagacccccattggaggtcatgcaggcgtggtgaagactttgaagcgcctttctacaaatttttgttggcctcatatgtgtgatgatataaagcgctttgtgcgtgaatgtgttacttgccaacagacaaagtatgtgactagcaaaccaggggaattacttcagccacttcccattccgattcacatttgggaggatatctcgcttgattttgtaaccggattgccaccttctaatgggttcacaattttgcttgtggtgagtattgtctctgatagagaccctgcatttgtcagcaaattttggtccgagttgtttaaattcagcggtactttactctgtatgagctcttcttaccgtccacagacggacggtcaaaccgaggtgactaaccgcactattgagcagtatttgagggtctttgttcaccataaaccttccttgtggcatcgtttccttccctgggcagaataccattacaacacatcatttcactctggtgctggcttaacaccttatcaggtgatttatggtaaacctccaccttctgttctctcttatattgttggtacttctgatccgtatagacaagtctctctctctggtattaaatacaacaaactgcacaagcgttactatttcccttttcatgtgctggctcgcattggtcctgctgcatacaaattagagctaccttcatattcaaagatacatgatgtttttcattgctctctcttaaagcctcatgttggttccacccctgctgagagcaggcaactccctgcagattcattggagaaccatccactactttctccacttgctgtcttggactctcgaactgtcactactgagggtatttcgcagcaacaggctatgcgagaagtttacaaccttgaggacaagattgaatttgaaggggtgggtattgatacagtcactagaaatcaagggggtaaaactagcaactctcagtccactgttgctaaggaagctaggcccattcggaccaagaagcccccttcaaagtaccaagaccacatcctttacaaatga

SEQ ID NO: 30074 - DNA, 474 bp, Glycine max
  Peptide Sequence Number=SeqID_146852
atggctatttatataaaagagccaagaggtgcagaggaatttgcccaggcgagctgtagctcgcccaggcaaatttgtgacttagtgctgaaggcaccaattcacccaggcgatcaatcaaatgtttattcgactttactcgtcgcttatggcacccccaccaaacgcgtaggacgtgcaatttctaattgggcagacctggagatcaacttaggagcacaacataaacatgaaaatcctaatgagtcattgggaacatctaacaacaaccttcaaattgccccaagcatcatgcataggtcatacaatgctcaatggaatgccccggaactctcctatgataagcacatgtcacattggagttgtatcctctgggagatgaaggttgaggaatctttgatgggctcacaactaccattgcattatcgagcagatacgggagtaagtcagcatacaacactggaattgggatga

SEQ ID NO: 30075 - DNA, 180 bp, Glycine max
  Peptide Sequence Number=SeqID_146853
gtgggactcacaagcccaggttggataggagcagatgtatgccatctcaatctccacaagacattttgcatccctcatggaggaggtggccctggcatgggtcctataggtgtaaagaaacacttggcaccatttttaccatcacaccctgtgatagtgcattgctttcacaagaactga

SEQ ID NO: 30076 - DNA, 693 bp, Glycine max
  Peptide Sequence Number=SeqID_146854
atgcaagaagtagaacttgacatatggaaagaaggcttccttgggataaatcccttcaaatatccttacagttatactagggaagtgcatcttgatgaagagattgttgctcccaatccaaacagtcttatctttgagcataggccaacaacaagaaagttgataagtctcatatgtgccctcaatgttgttcttccatgggatcatactaggtctagtgagacttttcaaattgaggacatccatctggaggcacctgaggaaagtccaagctgcaatgactgggagcagacaaataatggccttgtgcttagaacgaagttgtctgcttacaaagaagaaaacatatcaagacaagcttcatttaaaaggattgaaaggctcaacactcgtatgcccttcatgcttgggctttttaagcatgagcttgagactatgaagaagaagattgagcttaccagtctaatttggtctattatgaagaggttctacaaacttaaggaaactcctttcaatatggtctgcttatggacaaggaagttctctgttgtgtttgatcgcacattctcctttgttgtgcatctgccctactccagattcacattcattcatcatgtgcaatttatccttgaagaagtggattctgatgttgaagctgcaactggtcttgatgctataactgttgaagtataa

SEQ ID NO: 30077 - DNA, 306 bp, Glycine max
  Peptide Sequence Number=SeqID_146855
atgcaagctgtgaaggaaaagctacaagattttaatgctgcacgtaaggccaaggctgaagcaagggccgaagaaaaggccgagaaagagattgctaatgccagaaagaatatagctcatgaggttaggttggcaaaagaagctgaagcaacaatggatatacacgtggaaaaagcaggaagaatagctgagaaagaaatatcaaagcatgcatctaagaatccaaacgttggttatgaaaacatgaattccacagatcctgctacagtggaaataacaaatggacccgcctctactattaactga

SEQ ID NO: 30078 - DNA, 132 bp, Glycine max
  Peptide Sequence Number=SeqID_146856
atgcatttggcgaaaaccaaggaagtgaaactgaaaaaacaagaggacattgaaggtacattgagtcctaagaaggacaaagacaaggacattgagtcctataaaagacagaagactattggacaattgtaa

SEQ ID NO: 30079 - DNA, 1122 bp, Glycine max
  Peptide Sequence Number=SeqID_146857
atggcaccaaggaagaatgaagtagttgtgattctagaaatcaacaatgaagaggatgcattcccaaaagattcattcatccttggtggttggcactattgtccctacgctttattttgggggattgctcgtcaaaatagagtgagtattagaggcaacatcaaaggaataaaagtagtgatctatccagcaaccatcaccgatgcatttggttgtcttaaagaaggtcttgtctttgacaatgactggaagaataatatctctcaagaaactgttgatttgatacagattaaaccccaaagtgaagaagaatcttgttccttttggtatgctctcactcagatcatgcgagatgttggtattgatgtgcctggaatggcaccatctatcgacacaacacagcttaaggggacccttacacctcaaccctcaccctttgtatcccttccacctcagtcaccacctcctccaccttctcaaacctatcctaaactttctctttctcccatcaacataaaggaagctacaacctttgctaagactatgaagaagtctctggctgaagcatgcaagaaggccaagttggatgagactttggaaatgaaggatgcctgggaactagaagaaggcgttcttgcttctgtcaaagctctgtttgctaaagatcataagaagaagttgacagaagaggcaagactagctgccttggtaggaaaagagtctaaagacattgtagaagaggttgttttggaatctttgatgactttgtctgtagaagtcttaagaaaagctgttgaagaggccaccatgatggaaataaatggggagccaatgcctgaatctattgtgaggcatgcaactgaacttatgtctatatatgctacaaagaaactagcagagatggaagttgtcactgtttttgaagatatagatcctgctaagaaggatgttattaaagcatatcttgcagaaatagaagatgatataatagaaacaaaccctgcacaatatgttgcaatggatgagaacaaactcagacatatggaagaagcttatggagtgctagagtctatgtctatagaggatatgactatatgtttggagcagagaaagattatgtag

SEQ ID NO: 30080 - DNA, 795 bp, Glycine max
  Peptide Sequence Number=SeqID_146858
atggagagtgtatttgccattgtgtattgcgatggtgatatactttcatcatctgaagacatgccattagaggataaggagaaggtgcttacagaggggctgtggttaatccatgatcattatttgattgtgcgtgattggagccctaactttcatcctcagacaaaggctatagagaaggtggtagcttgggtgagaattttaggtcttcctattgagttctatgatgctaaggtgttgtatgctattggagatcgttgtctagagaaaggaaaaccaaacacttggcaaggagaacatgtcaacaagatgaggaacaatgacaagggggcacctctaaaaggcaacgacatatatgaattcttgagaaataaggaagcatgtgataatgtcaatactcatgtggataatcaggagacaaacataatgaatcaaggaataggaggaatgaagatagagttccgtaggaagggtcctagagttcaaaatgggggttcgtgctgcgtcttcaagattctatttgagaagatggtcaacacaatcaagattgagaaattcacagggaacaaggcaattgggctcctctatcctatcaaactttttgaagaacagattgttgttgggctttggctcaaattagagaaactcttcatgacgaaatcaatctacaacaagttacttttgaaacaacatttgtttggcctccaaatgaaagaacgtacgccattgaaggaacatcttgatgagctaaacttggttttgatggagctatgcgacattgatgccaagatgtaa

SEQ ID NO: 30081 - DNA, 871 bp, Glycine max
  misc_feature (853)..(853): n is a, c, g, or t
  Peptide Sequence Number=SeqID_146859
atggcggcctttattgtggccatccgcggcacgctgaagcaggcggtgctgctcggtctggcagccacactttcccatacggcagtagtctgggttattgccatggccggattatggtttggtcggggctgggatgcgcatacttcagagccgtggttccagctgatctcgggagtcttgatcgtcctgatcgccctgtggatggcatggcggacctggaaagagagccagccgcacgatcatcatcaccaccatcatcacgaccatgaccatgaccatgaccaccagcatgatcaccaccacgaacatccgctggttgatgacgagtggcaggacgctcaccagcgcgcccacgcgcaggatattaaccggcgcttcagcggccaaaacgtcaccaccggacagatcgtggtgtttggcctgaccggcgggctcatcccctgcccggcatccatcaccgttcttctcatctgcctgcagctcaagcattttgcccttggcgcgacgctggtcttcagcttcagtattggtctggcgatcaccctggtcgcttccggcgcgattgccgccttaagcctcaaacatgcgacaaaacgctggcccgggtttagcgaactttcccgaaaagcgccgtggatctccgctgcgctgattactgttgtagggatttacatgagcctgcacggcctgagcgggattctgggcggctcaccgagaaatggaagcggccatccagctgatgcgttcccagcaccagctcgcgggtatcacagcgcaagccattttccgtcgggaagatatacggcgtatgcctggcctccaggggcaatctccagcgcccctgctgtgccgncagctttcggtccggata

SEQ ID NO: 30082 - DNA, 804 bp, Glycine max
  Peptide Sequence Number=SeqID_146860
atggctaatagggtgtccttgggccctctaacatttgcttcaacgtttgtacttgttggggatcattaccaactgccaccacttgcaaggttctcagaagcacatctagaggctatttcagctttgcagagtcaggaaattttggacctttcaaatgccttgatatatggtgacagattgaggtgtggttcatttgaggcagctaatgcaaaacttgagttttcaggcttaaactgtggtttgccttggctagaagatgttttgaatcctcgaagacctgttatatttattgacactgacaagttggctgctttagaggcaagagatcagaagattgtaaataaccctattgaagctcatataattgctgaggttgcaaaggagttagtaaaaaatggaatcggaagtgatcacattggcattattactccctataattcacaggcaaacctcatccggaatgatgcttccatgacttccttggagatacacaccattgacaaataccaggttaggctcaagctagcatcaagaatcatgttactacttaggcctttggacttgtctaccgaaaccccgacaagctgtgctgcttctctgcttggagactggcacatgataaatgtggctcatactcgtgctaagaaaaagttgatcatggtagggtcgcggagaactcttgttaaggttcctctattgaaacttctcatcaagaaggttgaggagcaatttggaattttaaccgtgactaagaaggatatctatcgaaaaagtgagctcaagagatgttctcaaattagatga

SEQ ID NO: 30083 - DNA, 660 bp, Glycine max
  Peptide Sequence Number=SeqID_146861
atgcattctgaagctgaagcactagaacatatgaagaaaatagatacaggccatcaaagtgtgtcattggagaataagacaggagattcaactgtgctgaagataggagattcggctaaagttgtgataaaacaagacatgaagggaggagagcataaatatgggtttaacaacaataaacgtgagaagccacagaaggtaaagctggtggatgatgaaactggtgacaaacatgagttgtttgaagtcctaaggatgccatctagatgtgtatttttgaaggtcttcatgttattccttcatcattcaacgtcttcatgccattccttccctgagagtttcaagatcatgccttctccacttgcctcccctcttcctcctcctccccctctttctgctccttcggacggatcggcttcgccgtctgccgtgaagcgggcacgcaaagcctcacgtctacgatcgttgtctactagaccacttggtgctgagataccagtggtctatgtagatcttgctaccggcaaggccgacggtccccacaggaagaaattaagaacatatttggggattgtggcacgtgataaggtggacgtcacctacgagaacaggaaggaggtccctactgctcagaaggacttgatttgggaggatattcag

SEQ ID NO: 30084 - DNA, 348 bp, Glycine max
  Peptide Sequence Number=SeqID_146862
atgcaggaaatgacactgtgggccttggagactatgattgagaatgagaggtcagccaaaaagcttaagcatttgaattcctatcaagaaagtgatgcaatgcctagtgtgattactactggagaagacaccattactgattgccgccctcgtgtccgccatcgccgtcattgttcatggcacaatgcaaccctaaggaagggtaatgttgtgaacataaaacttgtccagtgggttcgtgagttcattgttccattggacacttttgattctgctacatccaaagatcttaaggttgtcctaaaatatgactcaagccttggtgttgcatgttactacagaacatga

SEQ ID NO: 30085 - DNA, 216 bp, Glycine max
  Peptide Sequence Number=SeqID_146863
atgaaggcgtatcatgataagaagctgcagagacagaacttccagccaggccaacaagtcttgctcttcaactccagactcaggaacaccggagaaaagatggatcatcaatggacaatgcttaaaaatttacaatggaggccaccctctgaggttagagacaccactgaagtcgaagctagggatgacatcattatagatttggcggctgattga

SEQ ID NO: 30086 - DNA, 288 bp, Glycine max
  Peptide Sequence Number=SeqID_146864
atggttgagaagggtctggtgaggtttggggacttgcagacaatgagaagagtgagaactaggaagagattaatgatgaagaagatgcaaatggctatagtgaaggaggcagagaagtctattctgcaaaccgctagtggaactggcgagtttgctgtccgtgaaggaatcgccactgggaatggcaatttggtcatgcatggggaaccgccagtcaaattggcgagttccacagcacaggaggcaagttggcctaaattggagttgccattggtattggcgagttag

SEQ ID NO: 30087 - DNA, 327 bp, Glycine max
  Peptide Sequence Number=SeqID_146865
atggggtcgtttttaaagtttttccgcgagggggctgttttgtatgtaaattgcatggggtcacaaagcaaaccgccagtggaactggtgagtttgctctccgtgaaggaatcaccattgggaatggtgatttggccatgcatggggaaccgtcagtcaaactggcgagttccaacagctaggcacaggcgtagggaaggtcaggtcagggtgcaggactcagcgaagcaggagtggtgcagtagagaggcagtagtggtgcagaggacattgcccttcttcttccaactacgtggtttctctcttcttgatttttcagtattttag

SEQ ID NO: 30088 - DNA, 279 bp, Glycine max
  Peptide Sequence Number=SeqID_146866
atggagccagttgctatagaagcattgcaccttcatcttctccgttctctctttctccactttgaggtggagagcagtggcaccatcgacaacggcaaggccaagatgtgtcgagatgggggcagaggagaaggcatacgacacgagggggaagaagactctttacttgcgatggtagctagatctgtcgagacagaggcgaaggagaaggagtacgatgtgagagggaaggagtacgatgtgagagggaaaggggttcgaagcttgaatgtgttttaa

SEQ ID NO: 30089 - DNA, 189 bp, Glycine max
  Peptide Sequence Number=SeqID_146867
atgttatggaaaaaggtgagcaaagctcctaagatacaacggctggtcactcccctgaccctccaaagaaatagggcaaggattgcagttcaggtttctgttttgacttctgagtgtctagttaagcattgctgctatagtagtgctatggaactgaggaagcttcaacttgcacaaaataatacttaa

SEQ ID NO: 30090 - DNA, 261 bp, Glycine max
  Peptide Sequence Number=SeqID_146868
atggcagattttttagcaaaaaatggggaagaatgcacacatcttggtttgatccgtgccttagctgtatggacaatgggctgcattcgtgttgataaaattattgaatatctgtgtgatccccttcaaagatgcctaaaggatgatgatccatatgttcgtcaaacaacagctatttgtgtttccaaactttatgacataagtgcagagttagttgaggacatgagatttttggaatccctgaaggattttataaggtga

SEQ ID NO: 30091 - DNA, 591 bp, Glycine max
  Peptide Sequence Number=SeqID_146869
atgggaagggttgctacaaagttaaatatcgactttgtgatatccactagagacaatttctacgatgatggattgactggtatagatgaccctgcatttgaaatttcgttctcaaaaatctacactgccaagagcctccaaaagcaatggtatagtggtgagtccagacacaccaaccatggatgtaacaagcttacattgttgggcaaccatgactacaggggtgatgttgaagctcaattgaatccaatccttcagaaaattgatcctagatggatctgccaaagatcatttattgttgatactggtaaggtgacttcttggaatctcaatagaggttttatcttgaataaaattgctgagttcttcttcattgattcaacaccttttgtggacaagtattttcttaagccaaaggaccacaagtatgactcgagaggagtgcttccaagggaaaaatatttatcaaagctcttgaaggatctggaaatagcattgaaggattctactgccaagtggaagattgttgtggggcatcatcctgtaagaagcataggacatcacggtgacaccaaagagctcataagatag

SEQ ID NO: 30092 - DNA, 423 bp, Glycine max
  Peptide Sequence Number=SeqID_146870
atgaccatgcgacgcgatttgatcaaagccggcgtcgatccctcagacatcgtgctggattatgccggtttccgtacgctggattcgattgtgcgcacacgcaaagtcttcgacaccaacgacttcatcatcattacccagcgcttccactgcgaacgcgcactgtatatcgcccagcatctgggcattcaggcgcagtgctacgccgtgccgtcgcccaagaatatgctgtcggtgcggttccgcgaggtgggtgcgcgtctcggtgcgctggcggatctctatctgatgaagcgcgagccgcgtttccttggcccgctggtgccgattccggcggtgcatgaagtgcctgaagatgcgcagagctacccggcggtcacaccggaacagttgctcgagctggaagagaagctgcggaaataa

SEQ ID NO: 30093 - DNA, 180 bp, Glycine max
  Peptide Sequence Number=SeqID_146871
atggctctgggatggtggcctcagatgactcatcctccatatgctgaggtacctgggttgtgggaccttcgtcttccttatgaagagaaggctaccatctcattaaactactctactgtaggaatagagtctggaggtgccatcatctgtaaactctgtagtaaaatgatatgtccctga

SEQ ID NO: 30094 - DNA, 414 bp, Glycine max
  Peptide Sequence Number=SeqID_146872
atgtgttgtttctggcaggatggtgatcttgatttgaatgcttcccctcaagcacttgacaaattgttggttcatgtgcttgcttttaaggtcaggattcaatcaagattaaaaaatgcagttgtacttaaatactcaaaagacctggatttgatcaatgctgttctggagatgctggctgatagtgaggcatgttccaaaatagatccttccaatgttgattgcaatgatgctacgcatgctgaatgtcaatttgtgtctgtcacagctgaccatgatccagttgcggggttacctttaacacccagaaagcggatgtcatctaatgaagccgatgatgggttagggagctctcaaatttcgccagcccaactatcgtctaacaaattaacaagacattctcataggagctga

SEQ ID NO: 30095 - DNA, 355 bp, Glycine max
  Peptide Sequence Number=SeqID_146873
atatagagttgaagtcatggtcaattataaagatgaaaacacaaaatttctcctgtggaattgtgaatgcactgaattgattgggcagtcagctgatgaagtcaacaccctcaaaatagaagatggtgatctagatttaaatgcctccccaaaagcacttgataaactactgggtcatctgttcaccttcaaagtcaaaattcagccgcagtataaaaattctactgttttgaagtgctccagtgacttaactttaattaatgatgttctggacatgttgcctgatgttgagacatgttcaaagattgaagctacaacatcgtttgattccaatgatcctgtccacgatgaatgt

SEQ ID NO: 30096 - DNA, 995 bp, Glycine max
  Peptide Sequence Number=SeqID_146874
gcctggccggtaaacaccgcgaagatggcggtgcactccagccccatcacgctgtgcgggtagaggttgagaaaatacacggtcgtgaaggtcaggaaccccaccagcggcaccgactccataaagttgacgaagggcaggatcacccggcgcagtggcgtatagcgtgcggccagcacggcgaatactacagaaaacagcagcgaccaggccatgccgaggagaaagcgcatgctggttctgagcgaataataaagcaggttccaggcatcaagactaatggcagagacataaataccgccgtagcggttgagacagacgttgttttcgcagcgggggcgatgggtgggccggcagagtgggaaaggccgtcagaaggggagcggttgccgcattccggtgcgcgccgccgtaaatcaataaacctgcctgccgttgatgccggcggggaaaatgccggtggcgaaaatatgcccgttggcctggatctggtcgtcgggcagcatctccagcgggaactcggccgccaggcagctgagaaaggcgttgcgatcgtcggtggtggtaaagccaatcagatcgtagaacagcagcgacgcgatcagctggcgatgttccgggatgcgccgcagcagcgccgccgacgggaacggcaggtggaagaaaaacgcgcaggcgttaagcagcccttgctccttcagcgcctgggcgcagggcagcagttggtagtcgtcgatgcagacggtatcgccggggcacaggtgctcgcaggcgatatcggcaaaccggcggttcagctgccgataggcgcggtagttttccggcgtgaaatgcgccttctccggctggttgtggaacaccggccacaggccatcgtggtaatagccctgatagtggcggcgaaactcctcgatcgacagcggaaaggtcacctgatcgtaaccggcgcgttggcggcagctgatcgggcgctgcgcgaaattctgcacgtcgcc

SEQ ID NO: 30097 - DNA, 684 bp, Glycine max
  Peptide Sequence Number=SeqID_146875
atggcaagttttgggcctctttgctgcaaagctctagtgatagccgtggtggctatggtgatgggtgcaccaagctatggccaaatcagcacgccatgtaacgcttcaatactaggcactttcttcacaccttgcatgaattttctgactaatagcagtggcaatggaacctcaccaacaacggagtgctgcagtgcccttaaatctctcacaagtggtggcatggattgtttgtgtctcattgtgactggcagcgttcccttcagaatacccgtcaatcgaaccttagccatttctctccctcgtgcatgcaacatggccggtgtcccagtgcaatgcaaagcctcgggttcaccactccctgctcctggaccagtgtctcttggaccatctccttcgccagcatcagctccatctgctccctctggatttactccaacccctagtcctcaagcttctactgttctcccatcaccaacttcaccttctctggcaccacaatctgacacaactactccctctcttttgactccaccatctccatcagcggattctggtaacccatctgtaccaactggaagtggtcgcactaatctctctccatcatctgccatgacatcttacagtgtctcaccttctcttctcttcattgcacttggatttgctcttctcaaatactactag

SEQ ID NO: 30098 - DNA, 102 bp, Glycine max
  Peptide Sequence Number=SeqID_146876
atggccctctacgggtcggcgtttgcttactcgaacccactcaaggatactaggctgccttgcagcggcattttccgcttgtccagagctgggaagagatga

SEQ ID NO: 30099 - DNA, 561 bp, Glycine max
  Peptide Sequence Number=SeqID_146877
acgtcgtccgaggaagaccctgaggaggatcccgaggagctacctcctgagcctgctgtggatgctcttgactttctagagggcgatgaggacccacttcctgaggtggattctcccgaggaagtcatgccggcatctgaggcagactctacggaggatagtggcccgagagagatggcgaccggtggaggctcttcatcattgtggacagttccatggactagttttatatactttttgaggggacgccactatgcgcagccaaggcttctcctcgtgcctcctccatccctaaatcttcaaaccttcgtatcttactcaaatcttcaccaaaacacgtcccgtaaagcccaatcttcctctttttcactcctctttcacttccaccgattgaaatccactaaaacttcatcaaatgtcaaaaccatcaaagaagagaaagggatcatcctccaccgccgatgctgctgcccattgccgccacggaccatccgatgcacccacagcacctattcatccctctttgtcatctccaagatcatccacgttgttttcatttga

SEQ ID NO: 30100 - DNA, 1225 bp, Glycine max
  Peptide Sequence Number=SeqID_146878
cgggaacgcaaagcgaggcgcaaggaaagcgcggccgcgcggagtggtttgcgctgtttgcggtgtgcggcgaactcggtgccgtactgggcccggtggctggcgcactgctgactggattcggtttccgccaggtggcgctggcaggggccgcggtctttgtcatcgcgctgatggtgctgtacttttttctccctgctacaggtaacagcaaacaggcgctaaaaattgtcccctggtggatgacctttcgccagccgcgttttgtcgctttcatcgtggcttacagctcgtggcttttgagctacaaccagctgtatctggctttgccagtggagattcggcgagcaggcggcagcgagaaagatctcggcccgctctttatgctggcctcggtgttgatcatcgcttttcagctgccgctggcgcgctttgcacgacgcgtgggaacggtaaaagttttaccggtgggttttttgctgctctccgccgcgtttgccagcgtggccctgttcgcgtcgacaaccccgcctgacggctggctgcgattgatccctgcggtgtgtctggtgacgtttctgacattcggccagatgctgctggtgccgtcggccaaggatttgattccccggtttgccgaccccgcgacactgggggcgcattacggcgccctggccaccgccggcggcttcgcggtgctggccggaaatttaatgtttggaccgctgctggacaacgcgcttgttccttcaacgcaggctatttatccctggctgctgctggcgctgtttcccctgtgcagcgccgttgccatgaccggactggatctgcaaaaaattgccgaattccacgatcacgacggtttcaatggcgtgatgctggggcgaaaagacctcgactggcacctcgaattcacctgctgcccgggacatcccgttataccctcgccaaccgaagacgatctcctcgtcctctattatccggatgaaaatgcatggaagctggcatgcgaaaccatgatcgaagcggggcgtggggataacggagaaagcctcgtgcaatggttcagtcaggaaaaatttgcggttcgtcttgagtggggcctgcctgcggtagagcatcttgccggggaggtcgactgcgttgtcattgttgacgttatgtcgttctcaacttgcgtcagtatggctgtcaataatggtgcctgtgtctatccgtacccctg

SEQ ID NO: 30101 - DNA, 402 bp, Glycine max
  Peptide Sequence Number=SeqID_146879
atggggatgaggggttgcattaattacaatcccatcctcgccataagacagcttggctaccctatgaggggggcaccattagaggaaggcctcataccttttattgcgcgaggtttcaatagcaccaacaccggggtgcttcaaagggtctgcaaggcatgggaaatggtgcaaaagaaggacaaagaacttaggggaagtaacaacgggcccattggtggttaccataggtggttgaaagcctacgcacaaggtctggattggctcccgaatttgagagccactaaagaggtggagggtgaagctccggaagaagacgaagaggtacaagcccttagaacaaagcttgagaaagcccaagcgaccaaagaaaagttcaagtcaacaactgttaggatctga

SEQ ID NO: 30102 - DNA, 411 bp, Glycine max
  Peptide Sequence Number=SeqID_146880
gactgtaccatatccgctattggtgctaatcttggtcctggcattattggttttatcacggcacaagggagaacaaatccaaacgatgcaaatgggtttgtttttaagcattgcaatatcgttggaaatggtacaacttacttgggaagaccatggagaggttatgctagagttcttttctatgatactaaaatctctaacattatccaaccattaggttggcagccatgggatttcgctgggcacgaggatcacataacattcgcagagtatggcaattctggacctggttctgacacttccaagcgagtaagttggttaaagaaattggattcatcaacagttagcaagttggcaactactagcttcattgacaccgaaggttggctaaatacactgacgcagctctaa

SEQ ID NO: 30103 - DNA, 225 bp, Glycine max
  Peptide Sequence Number=SeqID_146881
atgacatggcacacggaggtgttgaaaaaattgaaatttggaaacttccggctatgcctcgacgacgttgttcatgcctctagccgcacgcgtgagcgcaagcgagatggagatgcattggccaaaggtgccgacagttttctatattgctatgctttcatgtttgcggtgatttttttgaggacttataggtcaaaagagagcaacgttggatttagtttataa

SEQ ID NO: 30104 - DNA, 198 bp, Glycine max
  Peptide Sequence Number=SeqID_146882
atggagatgaaaccctgtagcaaaagcagaaagactcacaggagacgcagagagagaaattcagaggctagaaactatttcgtgagagagacagggaattggaaagaaggattggtgccatatcttgaagaatttgagtcaagaagcaaggggccaaccaccttaagagctattggactaagaagcactccaaattga

SEQ ID NO: 30105 - DNA, 414 bp, Glycine max
  Peptide Sequence Number=SeqID_146883
atgtcctggggagaaacatttaaccagagaggaaattcgaaggaccatccaccaaagcagtccagagtcagaggtcatttggtgaagattgatgctgacagtctcaacacattcttggagacacctgtggtattagctgagggggagacattacccgcttactccagatactgttggttgcctacaaactatagagagatagaggctgccttatgcatacctggccgagggttcatcatgaactctgagggccatcctgggaagattctcaggaagcatctgactacactagctcaggtgtggagtgtcctctcatactccaacttggcccccacatcacacacttctgacttgacagtggatagagctaggttgatctttggcctagtctctcacttgggttccctgctctaa

SEQ ID NO: 30106 - DNA, 1536 bp, Glycine max
  Peptide Sequence Number=SeqID_146884
atgcgcgatatccgcggcaatgccatcgcgatgatattccaggagccgatgaccagccttaatccgtcgttcactatcggtcaccagattgctgaagcgctgatcgcgcaccgcaaaatcagcgcacgcgccgcccgcgaagagaccatccggctgctggaaaaagtgcgtattcccaacgcggtcaaacgcttcaatgattacccgcaccacttttccggcggcatgcgtcagcgcgtgatgatcgccatggcgctggcgctgcgcccaaaactgctgattgctgacgagccgaccacggcgctcgacgtcacgattcagggtcaaatccttgacctgatcaagaccctgcaggaggaggaaggcaccgccgtactgttcatcacccacgatatgggcgtggtggcagaagtcgccgaccgcacgctggtgatgtaccagggcgcgatggtggaaaccggcagcaccgccgcgattttttcagccccggcagcagagtatacccgcacgctgattgcaaccgtgccgcagctgggtgccatgcgcggcatcgatggaccgcgtaagtttgcgctcaacggcgaagcgccggtggcgcaggggcggcagacgccacaagggcaaacgccgctgctgtcggtgaagaacctcagcacgcgcttcagcattcacgaagggctgttcagccgtaaaaccggtgcggtgcacgccgtggagaatatctcgtttgatttgctgccgggtgaaacattgtcgctggtcggcgaatccggctgtggtaaatccaccaccggtcgctcgctgacgcggctggtgcagccggcctccgggcagattgcttttgacggcagcgacgtgctcaccctctcccggcaagaactgcgcaagctgcgctgcgccatgcagatgatttttcaggatccgtttgccagccttaacccgcgtatgtcggtcctggaagccctcaccgaaccttttttacagcatcggctgggcagtaaggctgctgcacagagcaaagcggccgaactgatgacgcgcgttggcctgcccgcaaccatgctgaaacgctatccgcacgaattttccggcggccagcgtcagcgcatctgcattgcccgtgcgctgatgctcgatccgaaaatgatcattgccgacgagtcggtttccgcccttgatgtcaccgtgaaagcgcagatcatcaatctgctgctcgatctgcaacacagcctgaatctgtcgtatctgtttatctcacacgatatggcggtagtggagcgcatcagccatcgtgtggcggtgatgctactgggagagattgttgagattggtccgcgcgcggctatttttgagaatccgcagcacccttacacacaaaaactgctcgcgtcggtgcctgtgcccgatccggcgcgccgccatttaaaacggcacgtggacgtcagcgagctgaagagcccggtgcgtgccaatggatttgtgccggaaacacggcattatcaggaagtgagcgccggacactgggtgatgcggtaa

SEQ ID NO: 30107 - DNA, 405 bp, Glycine max
  Peptide Sequence Number=SeqID_146885
atgacctctattcatgatgtcctgctgtattacaatgggaggtggaacatgtcacgccgaaatgagtttgttggttactcattcacaggaaaaaatcccaaaaagtttgacattccttccgaatgtaccatggatgaactgaaagatttgatcaagcaagttgcacctcatgggattcccccttatggtattcatgaaacacaaacgaaactatggttgatccgtatgccgcctacgtcgagacctcacatacacattgccttcttctgtgacacccctggcaatcctgatgcattcttccatgacctcgtgtgtctttgtgcctgccgtgactatcctaaggttgagcagacgctccaacctttcagtgatcgcatggcaaacatcctattaaatagaaaataa

SEQ ID NO: 30108 - DNA, 237 bp, Glycine max
  Peptide Sequence Number=SeqID_146886
gattcctttgaggagcaggcgacacagggatccttcgtcccccatggacgtcaggatgttctcactgctgctattggacgtctagagcaccctggacgtgtccgtgctgctggagccggtgtcaccatcaagcaatacttcagattggctccacggacatcccacaactcttccttactgtctcctaaagaattgcagcagctgacccagcaaatcagggaccagctagaggagtag

SEQ ID NO: 30109 - DNA, 559 bp, Glycine max
  Peptide Sequence Number=SeqID_146887
atgaagaacaaaaagaatggacctcaacatcggggaaaatggtactcgacccctcctaagcaatatggtaactgccccaacaatcagaggaccgttgctgtggggtttgcggctggtagtggtagcaaacccaatactttccccactcaggggtatattcagagagattgtccatatcccaagaaggagcaaaatgatgggggcctgaatgaccaaactggacatccgaaggccacaggaagagtctttacccttaacgatgctaaagcttcaaaatcgaaagatctaatccaagtgagtaaggatatgatgtttatctctgccaaccaagttatgacatctttaaaagaagatgctcaagtgtacatgatcttgtctaacctagaaatagagacagagttagtacccggtgatggacccatattcatagccccttataggatgtctcctatagagttaactgagcttaagaaacagttagaggagttgttggataagcagtttgttagacctggtgtgtcttgtaagggtcaagctttacctttgactaaactgactc

SEQ ID NO: 30110 - DNA, 222 bp, Glycine max
  Peptide Sequence Number=SeqID_146888
atgggtgccaaatacctcgaagtggtcaaacgagggtcgcatcccaacaacggatggtccccgaacgaaattaggttgctcaaagcagctcaagctaataaggatatcattcaaccgagagaaccttcatccaagcagtttgaaatctcaaatgaagctatatccaaggaaaaaggtgcacctgatgctatgatcatctacttaacaagttccctcttataa

SEQ ID NO: 30111 - DNA, 1233 bp, Glycine max
  Peptide Sequence Number=SeqID_146889
atggagccagtgttggacaaactcaacgcgtttgcgaaatccggccaggattttttcgacggacttttccgtcgccgcaatccggttgaaatccttaaacggttgcagagagaagcgttctctgatctcatgaaactgagagagcgtcaagataaggttgagcgggtgctttctttctaccagtcctcgaaagtgggtccctttcaagagaccaccactcacgtgagaggacaagtggatttcttaggtgctttgttggtgctgggtaacttagatgctgtagataagttgggaatcagaacaggggttgattcgaggttcatttttgaaacaaccatgggggacaaggctaccggtgctgctgagtttgtggccagtcatggagggaggagggaacattgtgaagaaaagcctctttctcttgccaagcttagttttacagcaaatgtcaatgattggttctctttcgtggctatgccaataggtgcccggtgcagagatgttgctattgcttctaattcctttcatcaggttggaaaagggcttacagatttttcctattttgggccacctcttctcaacctgcacaatggtactgcttttggcataactgtgagaaagtcaaatgttactgcttcattggctcaaattgtaactggtctgggtatgccacctagttctagtataacagataatagatctagcacttttgggcagcttgtgtatcaattttctagaggatcaaaactgtctattctgggtcttcaccatatgcctttatcatcaaagaaacttggaagatttggagctcttacaattccactactcgtgtccaagcaagatgaagatgaagtttctgaggcagtacctgaagtattgccattaataggaacaaagacacgtgtgccagctggttctattgctttaatggcagagtctgaacttgatgattttacaaagattggaggttgggtcgagatggacaaattaaatcccaaatatttacaattgggtgtaaccatatctgatgtgtctgaagattcatttggttggggaacgagtctcagtgggaggatgattggaaattcggcaaatgaggctcattttcaggctgaatcgtatctaaaatttaacatgggtaataatttttgtttgaagccaggtcttgtattgggaatagatgggaaatcgaaaacagctgccttagtgcttcgatctaactggtcactgtga

SEQ ID NO: 30112 - DNA, 537 bp, Glycine max
  Peptide Sequence Number=SeqID_146890
atgttctgtttagtgttgagcattgaggatcatgacatgtatataatcttattatcatcacactacaagaaaaatgacctatacctacggacaaaaactgttactataaataaaaaatccatagagcttaagggtgataaagctgcaaagagtggtgaaatagaagcagagtcaggtgatgagcataaccacacagagaatcataaaccatgcaacatgtccaaggagagtggaaattcaatcccaatcccacacaagggtcaaggaatagctgaaaaactcacattggagtttacatttcacttatggtgcctgatgggacttcatgggacttctagttcccagtgtggtgtcagaaagttggaccttcaatgtactgagaaaacacaacagcaaaccattgaaattagtgcatttggaagattttatttacaacttatcttatggcatacatacttattaatgtcaggcataggcacgctgcttgccactttagaagcagctgaaacaactttagaggcagctgaaccactttag

SEQ ID NO: 30113 - DNA, 594 bp, Glycine max
  Peptide Sequence Number=SeqID_146891
tgatggtcgcaatatctttaatgcttatgacttatcagtagattctaattgcaatctgtactcgccacttcgaccagctgttgacgtagcagaagtatttctttggatgatggcagttcttaccatattgtgtgcatcatattggtcagcttggacgacccgagaagcagctattgaacatgataagttgctaaaggatgcttcagatgaactcccaaacactaaatatgctagtgttagtggagttgtaaatatgaatgtgaaagctacagtcctttttgttgtatttgcttcgtgtttcctgtttatgctttacaaactgatgtcgtcgtggttcattgatgttttggttgttctcttctgtattggtggtattgagggcttgcaaacatgcttggttgctcttttgtccagggcgagccctggtgcagcggtaaagttgtgtcttggtgacttgttggtcatgggttcgaatccggaaacagcctctttgcatatgcaaggggcgagccctggtgcagcggtaaagttgtgccttagtgacttgttggtcatgggttcgaatccggaaacagcctctttgcatatgcaagg

SEQ ID NO: 30114 - DNA, 446 bp, Glycine max
  Peptide Sequence Number=SeqID_146892
aactgctgtacaagatggtttgtgaacctgatgaaactgatttgaacatgcacatacctgctgtcatgcttccactagatgcagtgtctgtgcaactacactcgccacttcgaccagctgttgacgtagcagaagtatttctttggatgatggcagttcttaccatattgtgtgcatcatattggtcagcttggacgacccgagaagcagctattgaacaggataagttgctaaaggatgcttcagatgaactcccaaacactaaatatgctagtgttagtggagttgtaaatatgaatgtgaaagctgcagtcctttttgttgtatttgcttcgtgtttcctgtttatgctttacaaactgatgtcgtcgtggttcattgatgttttggttgttctcttctgtattggtggtattgaggtattaacttccactaagtcagtttaa

SEQ ID NO: 30115 - DNA, 870 bp, Glycine max
  Peptide Sequence Number=SeqID_146893
atgtctcacttttcatggactgagtgcttaacggcgtcaaggtcatcggcagggaatagtagtaacgatgacacgaaccgtaaagaagtttacatcctgtacatgggagctgcggattcatcaaatgcttctcttaagaatgagcacgctcagattctgaattcagtgctaaaaaggaagctaattggcgcgagggtttacccagaccaccctgatgcgaagaatgacgacaatgacaaaacgccaagggattggaacggacgtggtgggtcatgtcttgggtcagccattctagccgcgtttgacgatgccattaactacggagtggatgagttgtcgttgtcgctcggtccattcggtgggatccaaaccgatttgacgaccgacccaatttcgatcggagcagtccatgccgtggaacgcagcatcgtggcggtctgcgccgcccggaacgatggacaaccatcgaccgttgtgaacgacgcgccttggattttaaccgttgcagcttccattatcgaccgtgatcttcagtccaacgtcgtcttgggtaataaccaagtcatcaagggcagagccatacatttctcccctctttcaaattctcccgagtatcctatgatatatgatccaaatgaagtcatagggaagattgcggtttatgatggaaaagatgatgattattcaactagtgaaaaaattgacatagtgcaagcgttgggaggaataggtctagctcatattattgatcaagatggatcagtaacatttaattatgaggacttcccagcaacaaagataagttcaaaagatggcgtcgcaatcctacagtatatcattcaaccagcaaccccgtgggaacaatactag

SEQ ID NO: 30116 - DNA, 3236 bp, Glycine max
  Peptide Sequence Number=SeqID_146894
ggttcgcagctcgtctatcaaaagaggaggcaacctcaattgctcacaaacctggtgtggtgtctgttttccctgatccagttctgaagctccacacaacacggtcctgggatttcctcaaataccaaactcacgtcaaaattgacaccaaaccaaatacggtctccaaatcttcttccgtcattggtatcttagacacagccattcttgccgcacttgacgatgccattgaggacggagtggatgtgttgtcggtgtcgttgggtgcatccactgggtttcgacccgacttgacgtccgatccaattgcgattggagcattccacgctgtggagcgtggcatcctcgttgtgtgctttgttgggaacgatggaccaagctcgtacacgcttgttaatgacgcgccttggattttaaccgttgcagcttccaccattgatcgggattttcagtccaacgtcgtcttgggtgttaacaaaatcatcaagattgtggtctgtgaaggcaaaaatgataaatattcaactagaaaaaaagttatcacggtgaaagcggtaggaggaataggcctggttcatattactgatcaaaatggagcaatagcatcaaattatggggacttcccagcaacagtgataagctcaaaagatggcatcacaatcctacagtacatcaattcaaccagcaatccagtggcaacaattctaccaacaacaacagttcttgattctaagcctgctcccctggtgccaaacttttcatcaagagggccttcatcgctttcaagcaatattctcaagcctgatattgcagcacccggagttaacattcttgctgcatggattgaaaatggcacgtacagaagagccacaccttatgactatggagtaggggaaatggcaacatctgaaccattgcaaccaggactagtttatgaaaccagcaccattgactacttgaacttcttgtgttacattggattcaacgtaaccgcggtcaaagtcatctccaaaactgtccctcataatttcaattgccccaaggatttgagctctgatcatgtctctaacatcaactacccttccatagcaataaacttcagtggcaaaagagccgtgaacgtgagtagaactgtcacaaacgttgtgtcagcagggaatggaagtaacgatgacactaaccgtaaagaagtttatatcgtctatatgggagccgcggattcaacaaatgcttatcttcggaatgaccacgttcagattctgaattcagtgctaaaaagaaatgagaatgccatagtacggaactacaagcatggtttctcaggattcgcagctcgtctatcgaaagaggaggcaaactcaatttctcagaaacctggtgtggtgtctgttttccctgaccccattctgaagctccacacaacacgttcctgggatttcctcaaaagccaaactcgtgtcaatattgacaccaaaccaaatacggagtccagttcttcttcctcctcagacgtcattcttggcatcttagacacaggtatatggccagaggcggcgagttttagcgacgagggttttggtcctgttccatcccggtggaaaggcacctgcatgacatcaaaagacttcaattcctctaattgtaacaggaagctaattggcgcaaggttttaccctgaccctgatgggaagaatgatgacaatgacaaaacgccaagggattcgaacggacatgggacccacgtggcgtcaacggcggtgtgtgtggctgtgagcaacgcatcgttctatggtctagccacggggaccgcgaagggtgggtcccccgagtcaagattggcagtttacaaagtgtgttataggaatgggtgtcgtggatcagccatcctggcggcgtttgatgatgccattgccgacggagtggatgtgttgtcgctatcgctgggcgtattacctctttcccgaccaaagttgacatccgacacgattgctattggagcattccacgccgtgcagcgcggcatcttggtggtctgcgccgctgggaatgccggacctctcaagtactcagttgtaaacgatgcaccttggattttaaccgttgcagcttccaccatcgatcgggatcttcagtccaacgtcgtcttgggtactaaccacgtcgtcaagggcagagccattaatttctcccctctttcaaattctcccgagtatccaatggtatatggtgagtctgccaaggcaaaaagagccaacttaggtacagcaagaaaatgccacccaaattcattagatagaaataaagtcaaagggaagattgtgatttgcgatggcaaaaaggatccgaaatatataactatggaaaaaattaacatagtgaaagcggcaggaggaattggtctggctcatattactgatcaagatggatcagtagcatttaattatgtggacttcccggcaacagagataagttcaaaagatggcgtcgcactcctgcagtatatcaattcaaccagcaatccagtgggaacaatactagctacagttacagttcctgattataagcctgctcccgtggtgggtttcttttcatcaagagggccttcaacgctttcaagcaatattctcaagcctgatattgccgcaccgggagtgaacattctcgctgcatggataggagatgacacatcagaggttccaaaaggaagaaagccctcactatacaacataatctcaggaacttccatggctactccacatgtttcagggcttgtatgcagtgtgaaaacacagaacccctcttggagtgcctctgcaatcaaatctgccatcatgacttctgcaattcaaaatgacaacttgaaggctcccataacaacggattcagggtcgatagccacaccctatgactatggagcaggggaaattacaacatctaaaccattgcaaccagggctagtttatgaaactaacaccgttgattacttgaactatttgtgttacactggtcataacctaaccacggttaaggtcatctccggaactgtccccgataatttcaattgccccaaggattccacctctgatctcatatccaacatcaactacccttccatagcagtaaacttcactggcaaagcaaacgtggtcgtgagcagaactgtcacaaacgttgccgaagaagatgaaacagtgtactctgccgttgtcgaagctcccaaaggagtatttgtcaaa

SEQ ID NO: 30117 - DNA, 435 bp, Glycine max
  Peptide Sequence Number=SeqID_146895
atgtcagcaatcagcagcgattgtgatttactgtttaagaaaagctacaatcagcgatggtggaattgttgcatgcttattcctatatggctgcctactatatctacaaacctactatatattgtagaatcatctaaagatttaataggcagccgtataggaaaaatctgtacttggtaccaagcaccatataatcgacaactaagagtgaaggcagcaaccaacctggaagcaggcaaagaagaagctcttcttgcgcaaagcgagaaactagttgttgcttatggtcgccatagcagctctgctcgctttccaatcaggcttgtaggcagagaactcattattcgagatgtgaaaaggttctacattttaaagacgggctatgctccttccgggattatgggtgaacatgaactaaggacgtttttcttgtag

SEQ ID NO: 30118 - DNA, 2064 bp, Glycine max
  Peptide Sequence Number=SeqID_146896
atgaaaggcaataatacacttttgttgcatttattctacactctcttgctgtttcttggagtgtcagcaggaaatggaaataacgatgacactaaccgtaaagaagtttatatcgtctatatgggagccgcggattcaacaaatgtttctcttcgcaatgaccacgctcaggttctcaatttagttctaagaaggaatgagaatgccctagtacggaactacaagcatggtttctcaggattcgcagctcgtctatcaaaggaggaggcagcctcaattgctcacaaacctggtgtggtgtctgttttccctgaccccattctgaatctccacacaacacgttcctgggaattccttaaataccaaacccacgtcaaaatcgacaccaaaccaaatgctgtctccaattcttcttcctcgtcagacatcattcttggcgtcttagacacaggtatatggccagaggcggcgagttttagcgacgagggtatgggtcctgttccatctcgttggaagggcacctgcatgaaatcacaagacttcaattcctccaattgtaacaggaaattaattggcgcaagattttacaccgaccctactggaaacgatgacgacgaaggggacaacacgccaagggattcggtggggcacgggacccacgtggcatcgacggcggtgggtgccaccgtgactaatgcatcgtactatggtctggcggcggggagcgcaacgggtgggtcctcagaatcaagattggcagtttacagagtgtgttctaactttgggtgtcgtgggtcggccattcttggggcgtttgacgatgccatttcggatggagtggatgtgttgtcgctgtcgctgggtgcatctcctgggttccaacccgatttgaccactgatccaattgccctcggagcattccacgctgtggagcgaggcatcctggtggtctgctctgccggcaattccggacccagctcctccacggttgtcaacgacgcaccttggattttaactgttgcagcttccactatcgatcgggattttcagtccgacgtcgtcttgggtgtcgacaaaaccgtcaagggcagagccataaatttctcccctctttcaaattccgccgagtatccaatgatatacggtgaatctgctaaggcggccagtaccagcttagctgaagcaagacaatgccacccagattctttagatgcaaataaagtcaaaggaaagattgtggtctgtgatggaaaaaatgatggatattcaactagtgaaaaaattggtacggtgaaagaggcaggaggaataggtctggttcatattactgaccaaaatggagcaatagcatcatattatggagatttcccagcaaccgtgataagctcaaaagatggcgtcacaatcctccagtatatcaattcaaccagcaatccagtggcaacaattctaccaacagctacagttcttgattataagccagcgcccgtggtgccaaacttttcatcaagagggccttcatcgctttcaagcaatattctcaagcctgatattgcagcaccaggagtgaacattctcgctgcatggattggaaataacgcagatgatgttccaaaaggaagaaaaccctcactatacaacataatctcagggacttccatggcttgcccacatgtttcagggcttgcaagcagtgtcaaaacacgaaaccccacttggagtgcctctgcaatcaaatctgccatcatgacttcagcaattcaaattaacaacttgaaggctcccataacaacggattcgggaagggtagccacaccttatgactatggagcaggggaaatgacaacgtctgaatcattgcaaccaggcctagtttacgaaaccaacaccattgactacttgaactacttgtgttacattggacttaacataaccacggttaaagtcatctccagaactgtccctgctaatttcagttgccctaaggattcaagttctgatctcatctccaacatcaactacccttccatagcagtaaacttcaccggcaaagcagccgtgaac

SEQ ID NO: 30119 - DNA, 1359 bp, Glycine max
  Peptide Sequence Number=SeqID_146897
atgggccctgtggcatgccgttggaaaggcacgtgtatgaaatcctactacttctattcatctaactgtaacaggaagataattggagcaagacattaccccgaccctcaaggagacagtgagtatgagacaccaagggataaaaatgggcacggaacccacgtggcatccacagcggcgggagccaccgttcctggtgcgtcatactacggtgtcgcggcagggaccgcccaaagtgggtccccaaaatcactactggcgatttacaaagtgtgcttcaaatatgagtgccctggctctgctgttcttgcagcgtttgatgatgccattgctgatggagtggatgtgatttcgttgtccgttgcttccctctccgagttgaaatataacccaatcgccattggagcattccacgccgtcgagcgcggcattctcgtggttgcctccgccggaaacaacggaccaagcttaaacaccgttgtcaaagatgctgtgcaaggggtaagtggaatacgtgtggttcatatttttgacccaataggaggaacagaaagaaaagattttggggacttcccagtaacagagattaagttcaaaagatgcaaacagaatccttcagtatgtcaattcaaccaggtattaaggatgcatcatggatggagtcactatttagaaacatcattggagactaagcctgcacccatgatgccatcctttgcagcaaaagggccttcagcaatttcgaagaatattctcaagcctgagattacagcaccaggagttaacattcttgcagcatggattggcaacgacaaagaaggagttccaaaagggaaaaagccctcccaattcaacatcaaatcgggaacttccatggcatgctcacatgtttcaggacttgcagctaccatcaaatctcagaaccctacttggagtgcctctgcaatcaaatcagcaaccatggccacagtaactcaagaaaacaatttgaaggctcccataacaacggataaaggatcagtagccacaccttatgactatggagcagggcaaatgacaatatatggagcattccacccagggctagtttacgaaaccaacactattgactacttgaactatttatgttacgttggatttaatataaccttggttaagactatctctagaaatgctcctaataatttgagttgccccaagcattcgagttctcatcatatttccaacatcaattacccttccatcgcaatctccgatctcaaagggaaagaattagtggacgtgaatataactgtaacaaacgttggtgaagaggatgaaacattgtactcccctgttgtcgatgctcccattgggtaa

SEQ ID NO: 30120 - DNA, 399 bp, Glycine max
  Peptide Sequence Number=SeqID_146898
atgaaagacaatccaattttctatgttctcttgctgtttcttggagagtcaagatcatcatctgcagacatcattcaagcagggaatggaagtgatgatgacactaaccgtgaactttatattgtgaatgagaaggccccagttcgcaacttcaagcatggtttctccgggtttgcagctcgtttaacaaaagaggaggcgaactcaattgcccagaaacctagggttgtgtctgttttcccagacccaattctgaagctcctccacacaacccgttcttgcgatttccttaaggaccaaagtacccctgtcaaaatccaccacccaaacacggtctacaactctgctccctcgtcagacgtcatcattggcatcttggactcaggttatcaaaactaa

SEQ ID NO: 30121 - DNA, 153 bp, Glycine max
  Peptide Sequence Number=SeqID_146899
atggcagcagagatgatggcaaccgacgaccataatggtgacaacatcatggtagtagctgcaacagtggtcatggtggtgatagtgacaatgaccatggtgacaaaggtggtagcggttgacaatggtgttaatggcgggagtgataattaa

SEQ ID NO: 30122 - DNA, 138 bp, Glycine max
  Peptide Sequence Number=SeqID_146900
atgggaatcttgggacttggagatcttggagttcaaggaattggcattgccattgggaagcttgatctatatgttgctgctgctgggataaatcctcaaagggttttgataacattggtatctttatgttgtcggtaa

SEQ ID NO: 30123 - DNA, 237 bp, Glycine max
  Peptide Sequence Number=SeqID_146901
atgtatattgttgtgataaaacggggccaggatcaccttgggctaccttctggagtggagacaaaacatgaacggcagaaaccaatcaaggtgcttaaggatgaacgcaagcggggatggggtcacgaccgaccgatcattacccttctctgtgcgaaacaagcagggaatgtcgctgcaaggcagccccgtatcctttgtattttgcagctttcttttactatttgtttgttttga

SEQ ID NO: 30124 - DNA, 387 bp, Glycine max
  Peptide Sequence Number=SeqID_146902
gttagaagtttgacaagcaacattaagttgatattggattcattgagaacttccactgtcgtggaagtgcagctttcactgatcacactttctacacatctcatttctgttcattgccatgttagcgatgcagtggagggggacaagttaaggaggtgcaatgagtggatgaagtggcttccctccgcccagcttcgggccaactctggttcaatatcccctagcggatcaagttctaataacctagcagctgattttgaaaagatcacagtggatgaagctatttcacataaagttaacactgagcctaccacaaatgaagatgctgcaggagagtcctcaactcagtcccaagtcccaaatgatgctactgtgagcagcaattaa

SEQ ID NO: 30125 - DNA, 585 bp, Glycine max
  Peptide Sequence Number=SeqID_146903
atggcctcatggccacccaaacctacagagattttttgtgtgcatgcgagggagaaagcgatggcctcatcgccatgtgattgctggccccatctctctcctccttcttccattgagcatgtctggaacgacatcaaactcgactctctctccaattcccctgttgacatagacttcaacaacaaccactctgtctctgattcttcttttcttaacctcacttccacttcctcttctgtctttcacaaacatgaccatgaccactctcttctttctgtctccaacacttccttcgaagcctccggctctaagaaaaccaccctgctagatcaacgccatgcgcgtataataaaaaatcgagaatccgcggttcggtccagagctagaaaacaggcttatagaaaaggcttggaagttgaaattgcccgtttaacggaagagaattccagactaaaaagacaattgaaagaggaaaatgttgtacctagatttaaagaaaagttgcagtgctgcttgtcctcctctgataaccctcccactcccagaatggccgctctgtgtagaacctcatcatctccattttga

SEQ ID NO: 30126 - DNA, 345 bp, Glycine max
  Peptide Sequence Number=SeqID_146904
atggaagaaaatagtgaaggttacaagcattactctactgatggtggcggtgtaactggtgttgcagtacgaacacaaaatcagaaaaaactcttcaaagtcattttatgtttaccaacttggccaatgaaagagtctaggagactagcaagacaaaacacacagaatacaacttgtcatcacaatgaactggagcaaatatttgaattcaccaaaatagatgtctattccttgaagttagaaagaattgaacgcacctcaagaaaaatatcagcactagacaattgcaaggaaataagcgggattcttagtaggattaataatgcctttttaaagacactttga

SEQ ID NO: 30127 - DNA, 1278 bp, Glycine max
  Peptide Sequence Number=SeqID_146905
atggttaccaccaccgttgattcttcctctaaccattactcacccactgctgctactgctgccgctgacacctctaataatttcccgcgaaaaaacctgccatccccgtgggcccaggtagttcgcggtgctgacgctgaacctaaccatcaatcgccgccatcttcttcctcttcctcgttctcgtccctcgattccattaattctaacggtcccgccgttcaaacaagcgataccaccgtgaaacctgcgtggaagaaaccggagtccaatggcgtctcggaagttgggcctgtaatgggcgctcattcttggcccgatttatctgagtccaccaagcccaccgctaaattgacatctgactcctctgttaagactgctgctgatgaagaatcactcaccaccactcctcaggatcctgttaattcagactcccctcagaaacaagccattggtaatgcaaaccctagtcctactcctgcaatgaactatggtatggctaatcgacaaagatcaatgaagcagcgtggagggtcaaatggctataatgttgggtctggtcctgttcagaacaacttctccggtgctacccagaatcttcctccaccgccaccaccgcccccctttcctgtgcttccgatgcctccaagaacatttgcccatgggataccaggggttccagttcctactccaagggatccttacaggaacaataactgggatgcaagacctccgcatgggggttttatgccaccaatgagtgagcatcggagtccctctcgcaggggcaatgctgggcaccatccacgtggagacggtccctatcataacagttatggcagcaggcgtgatcaggatcgtggaggttatgcaaatactagagatgctcatgtaaatcaacagaggatgcctccaaggggattaatgaggcccccgccacctaatcctgctccatttatggggcctcagcctatgcgaccttttgcaaaccctgctgggtttcctgaattctattatttcccaacgctacaatttgaaccctttgggggcatgccatttttcacacatgcacctcctcctgcaatgttcttcccagttgcagaaactcctctcaccaatacaatagccaaccaaattgattattactttagtgatgctaatttagtgaaggatgagtatttaaggtccaacatggatgaacagggatgggttcctattactctgattgcaagcttcccaaggtgtcatctgtataaaatgatggaaggaactggttag

SEQ ID NO: 30128 - DNA, 474 bp, Glycine max
  Peptide Sequence Number=SeqID_146906
atgaagccagctcacgatcacttgtgtgtgattgggttggctccttcccacattgctttcaatgatgaaggtggaatcacagccgttgatttcaatgttggaaagtctgatcgcagcgggataaaagtcactggaaagcggaagaagaacgcacaacactttgagtccaatacggctctgtgtaaaatttctaccaaaaatgatacttatattgtgagatgttgcgtcaaaggctcccttttagaaatcaatcaacaactaatcaagcagccagaactgcttaatgtttcgttcacaaaggacaagaaagagatgttgagaactgttggttgtggtagtatggatagtgggaaaatgcatgctggcagagaaggatacattgctattatcatgccaaaacctgctgattggctcaaggtcaaggcttcccttgttagccttcaggagtacaagaaatcgagggaagtcaattga

SEQ ID NO: 30129 - DNA, 1077 bp, Glycine max
  Peptide Sequence Number=SeqID_146907
atgacaaaccctaggtggctatctctcttgcaaagaagaacgggtagatccagaaagaaagaacacgaagaaggtagcttttgcggcacgccaaacgtgaatggagaatacctcgaggcattcagaacaaagtcttacgttgaaatatgcaacatagcacacagggaactgggaaatgcaagcactaatactaattcctttaagatgcaccttaccgaatatcttctagaaccaccccagcaagaaattgtagcaaacatgaaggtgcaccgtcttctggtggactacttcgaagccagcttagaagcatgccgttgttgcgagacaatcgttcaagctatccatcaaacaagacttgcttacgcaagagtcaccaatgtcgttgtcaagctaagccaaacagcgccttattatgaccaatcccaaaaccctatccacacacaactttcttccttcgtattattacaaaataaccctttgtctattgtgcagttccatgacattcacgacagatacatgaccctcttaagtaggctgttatcaaagaaaaggaaaattcaaagaatattaaccataaagagcgtttgcaagaaggttggaggaatcggtttaatcgtttcgcaaggcgttcttatggtggctttattggtatttgcgtttcatagtgtaattgggtttgtggctgctgcaccgtgcatagttggtttggtcatgaagaagagatttaagaggagttgtgaaaggttcaacactagaaactcttgtatgaaattgtgtgagcaacttgatgttgctgccaaaggggtttatgtggtgatcaatgagttggacactatgagccgaatggttaagaggttagatgatgaggttgaacattggagacaggttgctgatatttgtgtgaagaattactgtaagtgtgaaatattgaagcgggttgtgaaggaatttcaggacaacgaatctaactttttggatatgttggaagaacttgaagagcatatctatttgtgctttctcaccgtaaacagatttagaagattggttatggaagaaattatggggaaacaacgttaa

SEQ ID NO: 30130 - DNA, 984 bp, Glycine max
  Peptide Sequence Number=SeqID_146908
atggaactaaaattgggaaaaagattgagaaggaaaataagaaaagacaggaccagatggggatgtgcaatgaatcgttggatttgtttggatgcattcacggctcttgtgcatgtgagcaagaagggaggtgtcagacgagagaacgtgggaataattgaatggcatctagaactgtaccgatatgcacacacaaatataatgcaaatactaatggctaaagtcatgtttggtttggtctgcagcttcctcgtattatgctgtttcacaatcaacactagcgccttctcaccttctggatggaccaatgcccatgccactttttatggaggtagcgatgcctcggggaccatgggaggagcttgtgggtatgggaatctgtattcgacagggtacggaactgatacagcggcattaagtactgccatatttaacgatggagcttcatgtggggagtgttacaaaatcatatgcgattatcaaacagatcccagatggtgcttgaaaggagcatcagtaaccataactgccacaaacttctgccctcccaattttgctcttcccaacaacaacggaggatggtgcaacccacctctcaaacatttcgacatggctcaacccgcatgggaaaagattggtatctatcgaggagggatcgtgccagtgttgttccaaagggttccatgcgtgaagaagggagggattaggttcagtgtgaatgggagagactactttgagcttgtattgatcagcaacgtgggaggggctggatctattcaatctgtgtctatcaaaggctcaaaaactggatggatgactatgtcaagaaactggggagctaattggcaatccaatgcgtatttgaatggtcaatctttgtccttcagggtcacaaccaccgatggtgtaactaggtttttccaagacgttgttccatcaaattgggcttttggccagactttccctactagtgtccagttttaa

SEQ ID NO: 30131 - DNA, 504 bp, Glycine max
  Peptide Sequence Number=SeqID_146909
atgactacctctgctgattcttccgacttcattaagattactctgagcattgaaaaaggcacgtataacacgtggtccgaacttttcaaaattcatgctcgagtttttcaagtgattgaccatatcattccctctaaaccagccgcagatccctctctcaaaactaccaatccacagttatggcttcgtctcgacgccgtcgttttgcagtggatatatggaacaatctccgatgatcttctcaacactatcatcgaacataattccaccgctgcaaccgcgtggaatcgcttattcgacatcttttatgataacaagaattctagggctctctacctagagcaagaattttcgcgaactcatatggagcaattctctgatgcttcctcctactgtcagcatctcaagtctctctctgatcaactagctaatgttggtgcccctatatcaaatgaacgtttagttcttcaactcatttcgggactaaccgatgcatatgctgct

SEQ ID NO: 30132 - DNA, 470 bp, Glycine max
  Peptide Sequence Number=SeqID_146910
attgggccggttgtccagacacaagaagatctacctccggctactgcgtttatctcggtgacaacttgatctcatggtccgcaaaacgccaacataccttgtctcgttcaagtgctgaagccgaatacagaggtgtcgctaatgttgtgtctgaatcatgttggttacgcaacttactcttggaactatgttgtcctgtcacaaaagctactctagtatattgtgacaacatcagcgcagtttatctttccgacaatcctgttcaacatcaacgcaccaaacatattgaaatggatatacatttcgtgcgtgagaaggttgcttgcggtcaagtacgcgttcttcacattccctcgcgttttcagattgctgacatcttcacaaagggacttccgttgcaactctttgatgactttcgtgatagtctcaacattcgttcacctccagtttcgactacgggggtgtattag

SEQ ID NO: 30133 - DNA, 234 bp, Glycine max
  Peptide Sequence Number=SeqID_146911
atgaagggagattggttggaattggagttggagaaggaatttggagacgccatttctcgaacccgtttcgcaccccactccaacaaccttctcatttcttcttgggactccaatctttgcctctacgacatcaatgcctccctcctcatactccaaactccctcgcaagctcctattctcgattgctacttccaggacaacatcgtcctttcgccgtcgtctctgatggactaa

SEQ ID NO: 30134 - DNA, 246 bp, Glycine max
  Peptide Sequence Number=SeqID_146912
atggttgaagcaagtgcgggtcgtgaactgaacgttggttacgtttgctttttccatggggagtcacagagtgcgcatggtgattttgattttgatcttatcaccccaaaacactatacagctacacgccagcttggaatgtttgatttttatagagtgtgtaaggaaaaacaacattccaaattaaagcaagagtataattattgcggggtcatggagtacatctgccaagacttttccagttag

SEQ ID NO: 30135 - DNA, 141 bp, Glycine max
  Peptide Sequence Number=SeqID_146913
atggtcagcggagagaatgcactgcttgcgaagggaaggagatgcaaaggtggtcattacaagaaccttgtgggtttgtcaaggacttggagatcgagcgaagcaatgcatagagaggaaaccgaggaagctagcaagtag

SEQ ID NO: 30136 - DNA, 230 bp, Glycine max
  Peptide Sequence Number=SeqID_146914
ggagaccttgggaaggcatcacttatgctagaaggcttcactgccctccttactagcagcccagatctgttttgtgctcggcttgatgccatctcagatgttttagtcctggttcaaggtgtgaagagagaggctgtcccaaaaggacagggcccttgccgcaacacagcgctaaaactttcgactcaccggcggctggcttcgtcttcactttcaagctggaacagaac

SEQ ID NO: 30137 - DNA, 252 bp, Glycine max
  Peptide Sequence Number=SeqID_146915
atgcgcggagtcgccaccaacgtttatttgaggaaaacgtcggaaaaaccggaaacgtatggtctacgaactttaagtgtgaaaggttcgagagttgtatttacgcatagggaaggtataagcaccccacgcgtccgtcataaaggatggcaacctttaaccgaggtgtttcccttgctcctactgtcataccctaatttcgtccggggacctttgcttgatgacatgcgaccattctttggtccttgtgag

SEQ ID NO: 30138 - DNA, 1138 bp, Glycine max
  Peptide Sequence Number=SeqID_146916
cttctggggcgccgatcaccgcttgagctatggtttccagggggaccgcactgccactgactacgcgagagcaaccgccacatacaaccatctgactggcgtgcggacgtcgagccgggcaggaggattcaatttcgccaatgccaggaccactcgggccgatctgtatctccaggacgaaatatccttgatgaaggaccggctccttctcaccccgggtgtccgatgggccaattacgccatcaacccgagacccgattcggactatgtggtcgccccaggcaaggagcccaggaaacaatcccggagcaagttcgtgccgcagatcggcacgttgttcaagctcgatgatgtgcactcggtctatgccaagtatgccgagggcttcaaaatgcctaccgcacagcagttgtatacctcgttgcccggagtggggttgacgctcacacccaatcccgaactgaaaccggagagtgtccgttcgtatgaagtcggcctgcggggaaatttcgatggctccgccttttttgagcacgcgtcatattccatcggcgccttcaagtccgactacaaggacttcattcagaatttctataacatcccgggcactgacgaatacacctataggaatctgtccagggtcaacatcaagggaatggaagcgtctgggcgaatccagttcaacaaaagctgggccatgacgagttcgctcgcctggcagcacggcgactcccgctacgatgccgattcaagaaagcaagcgtatgacgctgttgtgccactgagggctgtggtcggcgtccaatggcgcaacccccaatggggtctggacctggaactgctgggcacttttgcgcaaggggtcaagcgcgcaagcacgcccgggctgttcaaaccgccaggatatgcggtgtatgacgcttatctcaactggagccctgccggccaggatagtggcaatgggcgttccgtcactttccaggtaggcgtggagaacatagcggatcgacggtacttcgttgcaccgcttgcggggtatgcactccgcccaagttcgtctgtagccgcaaccaatcccctcgaactacaaacggctcccgggcgtaccgccaggctgtccacgaagattcgtttctga

SEQ ID NO: 30139 - DNA, 216 bp, Glycine max
  Peptide Sequence Number=SeqID_146917
atggcgcgcctgattcgaatttgcgttcggggccatgacggacgtattggcgtcctttatctcatcgccattctcattctgggcttctgcggtatcgccgtttcgctgcgcatgattgcctggagcgccgcattctacgacgccctgcagcgcgtcgacggcaatgaaatcctgaagcagatcggcgttttcgccgcgcttactcttaccagcgcc

SEQ ID NO: 30140 - DNA, 221 bp, Glycine max
  Peptide Sequence Number=SeqID_146918
tcggagaagtggcggaggaggaagcggttgcggtagttgggatcggagtcggaggaggaggagaaagaggggggattggcggcggggtcgtcgaagaggtcctcgccggcgaagaggtcggcggggtcgaggcggaggggagagggttcagaatcagatcaccattctgttatgttgcttccttcacactcgcactccaaaattctaatcaattttattaa

SEQ ID NO: 30141 - DNA, 558 bp, Glycine max
  Peptide Sequence Number=SeqID_146919
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggatctcgttatccattcatgcgcgtcactaattagatga

SEQ ID NO: 30142 - DNA, 507 bp, Glycine max
  Peptide Sequence Number=SeqID_146920
cagctttaaaaaatgttgatatcgtcatttccgctttcaacgctggctggaccaatcctaatctttacgaggattttacaaaaggtgcattggcgatccagcaagctgttaaagatgcaggtgtaaaccgctttattgtcatcggtggtgccggaagtctattgatcgacggaaatcgattggttgattcaccagattttccgaaagaaatcaaaccgggagccttagcggcggcagattatctggatactatacgaaaagaaaatcagctgacctggaccatgttcagtccagcgatagaaatgaacgcccatgctgggggaacccgcacaggaaaatatcgtacaggcttagacgcgccagtatttgatcaggaaggacgccttatcgctttgggcgtcggggccatcattggagcagggcttttctccctgacagggattgccgctgctgaaaatgcaggtccagctgttatcctatctttcattatcgcagcagtaggctgtg

SEQ ID NO: 30143 - DNA, 285 bp, Glycine max
  Peptide Sequence Number=SeqID_146921
atgacaattgaggaatcaatacatgtttcatttgatgaaactaatattacctctccaagaaaggaatttcttgatgatattgcagattcttttgaagatgagcacaatcaagaaagaaatctaaaaaggaagagaaataaagaaaacaaggatgatcaagatgacaaagctcaagaaaatgatgatcttcccaaagaatggaaaacctcaaagaatcatccacttcacaatatcatcagagatatctcaaaagggaacctaaaaaccttaaggaagccattatag

SEQ ID NO: 30144 - DNA, 933 bp, Glycine max
  Peptide Sequence Number=SeqID_146922
atgaaagataaacacaactttgattatataatcaaaacagtagaaaacaatattcctctagggcaagacataggggaagaattccatttactttcaaaaaattcaatttatgaacatagtcgaaagtataaatatttacacatcggctgtgtacaagtagccatcaagcccttaatagacatgggcatagatgcagcaatgttaatgtgtctaagagatattaggcataataaatttgaagactccttaattggaacagtcgaaaccatcctaggacagggtccagtatattttaattgttatccaaataaaacagtgagtctaatcgacagaaacattcttgactctttgttcttaaacatccactttcatggccttgacatgaaagaaggatcaatcccagcggctctaatctataggatccagtacaaggtcatgaacacttgtgcctctagagtcctgttgcaaccacaaaaaggagaaacaaccttatttattacagatatgaaaaaagccaacgtctctttaaaaagaataataaaatgggatgaagtaactctccccgaaaaatgggtcatggagaaggccacaccgtctgatccccgacccgctccaattattgaggacattaaacaggataactccggaaaggtagaaatagccttcaataggagaaattccttctcatcaaggataaaagcctctaggtctgaatacgagtcagccagaaggtctttttcagttagaacctgttcaataccagtaggactaaccagatctgagttacataaccagttccctactgtatacctccaaggactagataccacttctagcataccaagaatgacctacaaccaacatcaggaggacgaccaaaagtcaatccaatccccaacatactcttctatggaaccttatgatgttatctga

SEQ ID NO: 30145 - DNA, 195 bp, Glycine max
  Peptide Sequence Number=SeqID_146923
atggcttcctatggtgaagcaaatgactccattgatgaagaagatctaaggcctacaagctccacatggagctacatcatgagtaggaggagcctagcggcgagggagggggcatggaaggcgaggaagcgtgggagaggggagaaccctaattcaaagatggtgtcaatgagcagggtgagatggcatgactga

SEQ ID NO: 30146 - DNA, 240 bp, Glycine max
  Peptide Sequence Number=SeqID_146924
atgacccaggctttttatcgaacacctagggtgcagtattttcctgtgaagccagacaagcagatggagcgtcttgtcctccagcaatgccccagacaaaccagtagagtgcctaacaaggtttgcaggctatcatctactggaaataggctaaaaatccaaggccccaagaagagtggaaggagtgtagaaggagaatctctgcctaggcacaggctacggcatgagtgtcctggttag

SEQ ID NO: 30147 - DNA, 2004 bp, Glycine max
  Peptide Sequence Number=SeqID_146925
atggctagaaggtccttgtggattaacctgagcagcattagtgcttctctgaattgcccctggctccttataggagattcaacagtatcctctctcccaatgactgtttcaatagcattgacatcagtgcttatgagatgcaggattttgctgcctgttgttctgagcctgggctggggaaccttaacagtcatgggtccatgtatacctggactaatgtggtgggttttgaatcaatttgaccacactcctttagtggtgaccacagaggtgttgatgcccagagatggctggagtcatcaagtttctggatgttgcatgtttaaagtttgcaagagactgaaaactcttaaagctcctttgaagcttatctttaaacaagaattcagtcacattgcttaccaggtggaacaagctgaagccgaatataatagactgctcaattccctccagagaacctctttagtagtctgcaactcgggtcctaaagttcccattgattgctttgcctctttacttagccccatcaccaagcaagatgtctggaatgttattttagggatgggcaacaataaagcgtcgggtcctgatggctacaatgccttattctttaagaaggcttggaacatcataggggatgacatttttgttgctgtcaatgagttctttatgttagcaaaactactaaaacaaatcaatcatgctcttattgctctcattccaaagtctgaccaagcatcccaacatattattggtgcatcccaatctgcgtttctaaagaattggaaaatgatgaacaacattttccttattcaagagctccttcgcaaatatgctcgcaagagaatttctcctagatgcctcttgaagattgatttacataaggcatacaattccatttcttgggagttcctggattggatgcttaagtctatgggtttcccaactcagttttgttcctggattatggaatgtatcactaccacttcttttagtgtggtggtcaatggatctatctatggtcatttcaaaggtcaacatggattaaggcaaggggatcctcttttcccttacctctttgttctctgtctggaatatttttcctgtgatcttcaaagcctcaaggataacatcaactttaagtttcacccaacttgtgatgttgttcaactttcacacttggccttcgcagatgacattatgctcctgtccagaggagacttgccttcagtttcaactatatttgccaagctccagcacttttgtaatgttttggggctatctatcaacaccaacaagtcatccatttactcagtgggagtggaccaagatgttctttcaaatatccagcagctcactggatttagtttgagctatttcccttttagatacttggatggttggagcagcaaaactctctcctatgcagggaaggtggagctaattagagctgtcattcagggaattgccaacttttggacggatatctttcctttacctcaattcgttctagaccgtatcaatgtttcctaccgcaactttctttggggcaaagctgaggtccaccataattattttaaaggaggcaatgtttgggacttcattagttcagcttcagattcagttttgattaagaagatcatacacattagggacattattaccatcaaagaagataatgtggaggctgccaagcaaactctcaactcttggaatagcaatgagcagttgcttgctgggaaggcttatgactacattagaggggtcaagcctgctgtcaattggaattctgttgtttggaatcctgccattccttccaagatgtcttttatcttatggcttgctaccaagaaccatctgctcactttagaccgagctgctttcttgaacaaggaatctccctccaagtctgggccaatatccgtgattggattcctctccacaggcaaacaatttcattacagtgcactatcaattcccgtatttgtggtagagccacctctg

SEQ ID NO: 30148 - DNA, 750 bp, Glycine max
  Peptide Sequence Number=SeqID_146926
atggaatccccaagctctaggaaaaattctgtccaagattcccccatacgtacagactacctcactgcctctaagggatctatttccttttctagagcactggtggaagttgatgcctccttagatcttatcgaagaggtctgcttcaaacttcccatcggtcagaccttcatccagaagattgaatacaagaataggccatccttttgtactcgctgcaaaatgattgggcatcgattagcaaagtgcaaagttgtttctatagttaagcaagataacaaaacaaccacatcagaagggcctacaacaggttcaccctctgttcaatctcaagatgctgaggtggtagcttttacaaagaccaatcctactaatccctttggaaaacccaaagaagaccagattggactatccactcaaccttgcatgcagcagccacaagcatatgataatattcttgctctccaaactccttttgatatttctggagttgagacttccaaaagttctttgcatcaggactcaactaaagatcctggtgatgggtttgctcggcatcatgcgatgcaaaaattccttcataacaagggagttaatgtgatggctattctggaaacaaagttgaatactatatcagaggagaacaccttgaaaagaaagtttggagattggaatttctctcttaactttgcttctcacaatgttggtcggattctcatcctttggaaatttgataaagttactctttag

SEQ ID NO: 30149 - DNA, 450 bp, Glycine max
  Peptide Sequence Number=SeqID_146927
atgagcagtgccattagaaacacttccgcgtcggagtgcgaaggccgtgaggatgacgtagacgaagatggcagtgacggtggggcgcttccaattgttgtcgctgcggagggctacaaaaatgtcggcggtgtagtagacgaggacaaagatcttgctactgaatgcccatgcgatgccgagaaggccaacgccgttgcatggtccgatctgatttttatggtcaatgacggtggagatggtgacgtagaggaagagaagtgtggcgataaactcagcaatgagggctctgtagaaggactagagcttaatctcgaccaagtcgatgaggggggctggtggagggtctacgtagtcttccctctgctggctcatttccttcgatattctctctctcttgtaggaacaacaaatggaatgagagtggatgaggtgggagagaagggttga

SEQ ID NO: 30150 - DNA, 393 bp, Glycine max
  Peptide Sequence Number=SeqID_146928
atggagcaaccagccgatcagcagaatgaagagatacatctcaggtcccgaagatatagaggcatcacgtggaagaagttgtcgccttttggcgcgagaatgcccatctacaggaaggtcacaagttgcgacagccagaggctaacccacccgagcgaggggagatcgagtcgaccctcaatcgccttacccagagctacaaacttaagtgtatgttcgggcattgttcccccatctctcaacactctgggaagacaactgttacagttcaagaacctctttgtccccaaaattatggaagcgactctcccttctaattggaagaacttaactattgagaaatatgatggtaccacggacctagacgagcacctggatgtgtacatcacttag

SEQ ID NO: 30151 - DNA, 288 bp, Glycine max
  Peptide Sequence Number=SeqID_146929
atgggcctgtcaagtctcccagcaccatctgaaggagtgttatgtgtgcttcttgtaaacactgccttgtctatatccatattcaaaggcattgttaggacaattctacaaattgtcggtatccgcgtttcgtcgttgtctccttcaccagacatctcccgaaacccacctgagccattagaattcaacctcagcccctcggagggtttcattgaagagttcagaagcaggacaccaacacttaggacttccttgatgcctgaagatgatgcatcttgcttttggtaa

SEQ ID NO: 30152 - DNA, 402 bp, Glycine max
  Peptide Sequence Number=SeqID_146930
atgacaatgtgtgtatatatacatgaacagcttgttgcggggcttctaggagtagagtctggacaagatgcagttttaagagaattgttgtatgaacgtaaagaacagttggtgccaccatatggcgtggccgtggaagagttcacaaaccgcatttctatacttaggagcaagttaggaaatagaggtttgaaagatgaaggcattgttgtgcctacagggctgggtgccgagggcaaagttagaggtaacattcttgctggtgacgtaaactcattggcatattcaaggactccagaagaaatattgaggatagtatatggaagtggtgatgaacatgttcgtggtggcttctatcctaaaggagcaagtggtcacatagctcaatcttacttaaagtaa

SEQ ID NO: 30153 - DNA, 159 bp, Glycine max
  Peptide Sequence Number=SeqID_146931
atggggaggaggttgccgcccagctcgccctggcaagctcagctcgaccagacgagcaagggttacgagaattttacggaagcattgcggatgccccaaaagccatttttcaacaaaaggagggaggtgcttgctgcccatctcgcccaggcgaattga

SEQ ID NO: 30154 - DNA, 213 bp, Glycine max
  Peptide Sequence Number=SeqID_146932
atgcagagacaacattatttgactcttgtggctgtgtattgtgcaacagtccctcagaactcggcagctagaaagattgaagcattgcacaacacagataaagatattaatgggcactgcagattcctgtggtttgcaacttgggttggggctttttcaaccccagctgtccctatttgtagcaaagcagttgttgggatgggaccaaattga

SEQ ID NO: 30155 - DNA, 444 bp, Glycine max
  Peptide Sequence Number=SeqID_146933
atggacaatgcatttgggaaacctctggttcctccctttgatccctatgctaattcactcaactttataattgcatcttatgtgattccctatgttggcctcactggttatgttggtgccaatcgactgctaagtgctacttctagggagttggtgccaccatacggagtggccgtggaagagttcacaaaccgcatttctatacttaggagcaagttaggaatcagaggtttgaaagatgaaggcattattgtgcctacagggctgggtgccgagggcagagttaaaggtaacattcttgctggtgacgtaaactcactggcatattcaaggactcctgaagaaagattgaggataatatatggaagtggtgatgaacatgttcgtggtggcttctatcctaaaggagaaagtggtcacatagctcaatcttacttaaagtaa

SEQ ID NO: 30156 - DNA, 462 bp, Glycine max
  Peptide Sequence Number=SeqID_146934
atggcctcttatggtggtgagcttcttctagactcacttttccttgaagtggcgtctcctctctctcttgcttctccattacgttgtcattcatcttccaaaaagcaaaggaatccattgatggagaagatcctaggtctacaagctccaatggagctgacatcaggggcagtggcctacaagatcaagcttccttcgggttcaagcatacatgatgtattccatgtctctcaattgaagaagcatgtaggtgaagcagtaacttcttctagtcttcaaagttcagtagaaggagatcctctaatcaaagaacctgaagctattttggatcgcatgacagtaaagagaaggggtcgagcgattactaaggtcctagtaaagtggaagcatagcttgccagaggatgcaacttgggaattgttctttgatttgaagcaaaggtatcctcacttccaaccttga

SEQ ID NO: 30157 - DNA, 399 bp, Glycine max
  Peptide Sequence Number=SeqID_146935
atgatcgggaattccagggtgaagctggagattgatagaaaaaaatgtgacgccgagagaaaagagagaacggagaatggtaaactcataatcaatgacaatgcaaaagagagaaccaataacagatctgacggaggcacgagagaaaccacggtccacggtgtcaagttcggtggcgccactggtgaggagcatgttgagcggattcgacttgctggcgggcacgagtgcctactgctgcccctccttggccggcacgacggtgtcggggatgtacaacttctttcgaagggccttgcggtgggaaccacctctgtagtcgctggaagagatgagaggatcgtgcaggatcaaggcgctgccgtacatggtggcggcggtcgcggcaacggtgtctag

SEQ ID NO: 30158 - DNA, 105 bp, Glycine max
  Peptide Sequence Number=SeqID_146936
atggagaaaggtacaagtcttcctatggagaaaggtttcaagatcctgttgtttcctataattgatagtctaggaaaccccttaaagttttacatgtggtattag

SEQ ID NO: 30159 - DNA, 513 bp, Glycine max
  Peptide Sequence Number=SeqID_146937
atggaggtcaacattaatgatgtggttgttaaattaactgtattagacgaatatctggtagacctagagcaaccgttcaaaagaatgaggttgcatggcttgaagatgaatcctgaaaaatgtgcttttgggataacggcaggctacttcctaggcttccttgtgcatagcagaggcattgaacaagccttagcattgcctcttgtgttagtaccaccaacagaagaaggccagctgaagcttcatatattgacaacagaggagattatcagttgcttgttagcacaagaagctgaggatggtacaaagcgagttggacgactaatgaaatgggctttgagtttaaatgcttattcacttaattatttgccattgaaggccatcaaagtgcatgctctagccaatcttttggcgcaacatccatgcgtagatcccccatatccatttgataagcaagtctcatatataggggataagccgtggatgatggcatttggtggtgacccgagctga

SEQ ID NO: 30160 - DNA, 894 bp, Glycine max
  Peptide Sequence Number=SeqID_146938
atggcaccttacctttctagagatacagcctctatttttgttttacttgcctcactagtccttcccttgattctcctagactattcttcttctgtgttgtttgcaagtgcaaaattcccaaaatccaaagatgctgatctgttagaatttgctctcaatttggaatacttagaggctgagtttttcttgtttggggctttggggcatggattagatgtagctgctccaaacctaactgggggaggaccccctcccttggtgccgaaaaggttgaacttgacagtcttaccaatgatgtcatcttgcagtttgcttttcaggaaggccataaagagcaaagtgagagggttccctaggccattgctggatctaagctcaaaatcttttgccaaactaatggacaatgcatttgggaaacctctggttcctccctttgatccctatgctaattcactcaactttataattgcatcttatgtgattccctatgttggcctaactggtcatgttggtgccaatcgactgctgcaaagtgctacttctagggagtctggacaagatgcagttttaagagaattgttgtatgaacgtaaagaacagttggtgtcacagtatggagtggccgtggaagagttcacaaaccgcatttctatacttaggagcaagttaggaaatagaggtttgaaagatgaaggcattgttgtgcctacagggctgggtgccgagggcagagttagaggtaacattcttgctggtgacgtaaactcactggcatattcaaggactcctgaagaaatattgaggatagtatatggaagtggtgatgaacatgttcgtggtggtttctatcctaaaggagcaagtggtcacatagctcaatgttacttaaagtaa

SEQ ID NO: 30161 - DNA, 348 bp, Glycine max
  Peptide Sequence Number=SeqID_146939
atgaggctcataagtttcaagttgaagagcatgactatgagtggcccgatgtggcaacataagatgtactcacagctgacaaatatgtggaagcaaagcttccaagcttattttgatgatgccaaagactcaagtcaagaatcaagattaaagcaagtttcaagaatcaaagagtcattcaatcaagaaatcaagattcaagtgaagtttcaagagaagactcaagatatgcaagaacttcaagaaatcaagattcaagtgaagattcaagagaagactcaagatatgcaagaacttcaagaaaagcatcaagaaaattataaaaaaaaaatcaaaagaaaagattga

SEQ ID NO: 30162 - DNA, 444 bp, Glycine max
  Peptide Sequence Number=SeqID_146940
atggagaaagagtcggttaggcttttccaagaacgaaatgcagcagccccagaatcagatgtcgatctgttagaatttcccttaaacttagaatacttggaggctgaatttttcttgtttgggtctttgggtcatggattggatgtggttgctccaaatttaattgagggaggaccccctcccattggtgtcagattggccagacttggcagccttgtcaggaatattatcttgcagtttggtttccaggaagttggacacttgagggccataaagagcacagtgagagggtttcctaggccattgctggatctaagcacaacatcttttgccaaacttgcatcttatgtgattccctatgttggcctcacgggttatgttggtgctaatccactgttgcaaaatgctacttccaagaaggctcgtttcacactcatgaaataa

SEQ ID NO: 30163 - DNA, 438 bp, Glycine max
  Peptide Sequence Number=SeqID_146941
atgtcgatcatcgctctcccagtggtggtggttgccgttcttcgtcacccttcactgttcattgatgcaatcagtgcttttgatgtgggaaataaccttagtactacaccatggaggtactatacctttaccaggaatgaagctgatggaaaattggagtatgttggtggggagttagatgggtattttggtggacaacttttgtcagctgttggccttgacagatgtggaagcaatgtcttccaaggttattttgatgatgtcaaagaatcaaagaatgagttcaagattgaatcaagaacacttcaaggttcaaaaggaaatttgatttcaagaatcaagaatcaagtttcaagattcaagttccaagaatcaagatcaagattcaagactcaagatttaagaatcaagagaagactcaatcaagataagtattaa

SEQ ID NO: 30164 - DNA, 276 bp, Glycine max
  Peptide Sequence Number=SeqID_146942
atgactaagaatattttacaccaacataaatttggcatgcccagtaggatcgcagtaaaatcattaaggtttccaatgttgcctatagatcatccttggtatagtgaaggagaggttccaagcatgatggcacccatgttagaaatggtatttcctattccatccgcaattcgtcaacagatggagataggagtacacgatatcatgctacagatgtccaaaaaactaggcgacattgtgaagccattggtattgaacagaatccaaaaggcttga

SEQ ID NO: 30165 - DNA, 321 bp, Glycine max
  Peptide Sequence Number=SeqID_146943
atgtcagtcgctttcaagcaacctgcttctaatgctttcgtctattcacttgaaccagatccttattccaccattgagactctcaccctcttcgataaccagtgttgtgagtacttcccaggcccttgttacctcaatgagggtgaggatactaacaaaatgactaacaagctattcaatgatgagaaaaccatcttcttgttacttgcaattggtatgggattcacaaaattcccttccaactttcatacatggcctaaaccccttcttgaataccaaacttggttgaaaagggttttggcttccgacaatgaggaatga

SEQ ID NO: 30166 - DNA, 390 bp, Glycine max
  Peptide Sequence Number=SeqID_146944
atgactggatccttaaggattatgggggaggtccatgaagaaatttgtggttcccacagatcagagccaaaaatgagaaggcttattcatagacatggttatttatggccaagtatattagccgactacattaagtatgccaaaaggtgcgaagaatggaaacgacatggacctttgcaaagggatccagctgaggagcttcaaagcattgttaagccatggcccttcaggggttgggctatggatttaataggaaaaatccatcctagttcttctaagcaccatagtttcattattgtggcaatatgttacttcacaaagtgggtggaagcccaaccaatggttacgatgacccagaatgatattattgattcattcaaaatgagataa

SEQ ID NO: 30167 - DNA, 534 bp, Glycine max
  Peptide Sequence Number=SeqID_146945
atgcagataaccagttcactgctaagtaatttgctagatgtggttgaggaggttcaatcagctcagatagagattagaaatttggttggtgcaaagttctattctcattcagttcagcggcttgatttgcagctgtccttcattgatttctgtagtgggagaaaggttaaagtgacctttgatataacatgcttaaaatgtggggtctatcctgctgaggtccttccatctcaaatacttgatccttccagtggggaacaaaagtctctgccttcatcgcttgtagatgaactcagaactgctgcagagagtatgtatttcccaggtagttcaggcttcaacaaaaagcagatgattggtaattatggctcctctgattgctttcgttgttgccatgatagttcattagtttcatcttgtttatcttcgcttcacatcatggtgttgctacaaacgggtgacaatgtcgtgcagtatgcggaaaattcatgttattatccactggataatgctacaatgagtttgagacaatga

SEQ ID NO: 30168 - DNA, 2689 bp, Glycine max
  Peptide Sequence Number=SeqID_146946
atggagccttcaaagaccaacgcccaatcggaagaagacgacaccgtggcgctgaggaagaagagggcgcggcgcgtgagcttcgcggacaacgaaatcacctccgtccacgtcttccgccgcgacgacgactccacttcctctccctccgaacccccttcttcttccgatccctccgtcctagggtttttccacgacctcgcctccgacagcgacgacgacgaacaaccgcaactcgacgacgaagccgaagccgcaaactccttcctccgcccaatcggctccccctcccccggcggcagcaccaccgccgacgacgctgactgggagtccggtgtaatgtttttcaaaagagcagatagaagcaagggagttgatgacgatgatgattttagaggtccggtgtcggcgcatttcattcgaccggatcggttatcggactcaggcgtctcggatgacgtcacgatggactcgacggcattctcgctgcactaccggagtctcgctcgctcggactccggcgacatcaagacgcgccagttcgccgggatcacgacgccgagctctcagggaagctacatggagctcacggaggcaaagaagaggcctggccaagtggtgctggacgcggatagcgctggcagagactccaacgacatgagcatcgacggagaccaccaaatgagttttggatacgacatactctctcccgcgtttgatgctgctgcagttttggtagcagaagaagcacttaaggacttgccacaacacaacttggaaggttcggttgtttcgccagtcactcaccttcaccagatacagccttctgattcttcaatcaaggaaaataaggagttttctgtaggtgcaattgagattgtgccagtttgtagacaactgaactttgagaatgctaatagaggaacaccactgagggtggatgaagacaaaggaacggtgtcggacaccgatcataagtctgatcaagtaaaccaaaatccaatacatgggtctacaccagtgtcactgtctggaagaaaactattagttatgaggtctcctgattcatccaggcatgctggaaatataactcaacctttagtgcaatctggtttgtttgttccagaggttcgtgttgcacatggtgcaacgccatcttctgtacatagaagcattttgaagatgaaaactcttgagactactcctgtcatgtcgggtctcaaagaaggaatggacagattgaaagctagattatcaaaatactctcctggattttctctgtcaaatataaaagatcgtgaatacaagcaagatgaaagtcgccaaacacctttagaggaaaaactgtttagtttaactccagatagtaacgtgcataaaggcttggttgatagcaatgatcatggaattcagtcatttaaaaatatttgcaaatcaagtcaaaatgaagagactgtggatgccaaaatagatgagaaaaacttaagtttgatttcagctcatgtttcttacaatgatgaaaatcctaaggttgtggaaatgggagcttctccctcacagatgactcatttaatgaaggtggtagatgttgaccaggcagatagcatggttgagaaagggaaagatgaaattcctgttccaagtcctcccatccaagaggtaacacctcagttgcgctccctgccagacccacccagtatgcaagacttctcaaccaagggtaacttagatggtcatagtcttgataacagctaccattcaacactccaagtagctcagagccctcttgctcttacgaaagcaggtattaatatttcttctgggaataaactgcaagacccacccagtatgcaagacttgactcccaagggtaacttagatggtcatggtcttgataatagctaccattcagcatgccaagtagctcagagccctcttaccaaatcaggtattaatatttcttctgggaagaaactgcaagacccacccaatatgcaagacttgtctcccaaaggtaacttagatggtcatggtcttgataatagctaccattcagcactccaagtagctcagagccctcttaccaaatcaggtattaatatttcttctgggaagaaaagaaaaggtgtcgagatactaagcaatgaagacaatatagataaaatagggaggattgacagaagtctagaggttcataaaagtgggaatggtgacctactcttactttcggagcaaacaggttatatgagaagtgaaagagaaaagcttggagatcagacttcgaatgatggggatcttattcttaaaaaattcttagccagaacaaatcagttgctacctccttcagttgataagctaaatttgagatcgattggcaggctggaagatattttggttcatctgcagaaagttaagaagaaagagattctttgttcagaaattcaatctcagctcaaaataactgatcctttaaacattcttagagacaagagagttgctgaaacaagaacattgctgtataatatagcatatgagaaggcaaaattacaattattgcacgtgaagcatgacaagttgcagaaaaaggtacaacaggtaagctctgggcttcaggagtgtgagatgataaaattaaattccatcccatcttcatctaaaagtggggcaatggacactcaagccggtgata

SEQ ID NO: 30169 - DNA, 342 bp, Glycine max
  Peptide Sequence Number=SeqID_146947
atgggtgattcttatgaagaatcaaacatgaagtatcttaggactaccaatggcttgaaattttgttctacgaaattcaatgaaatttgtaaagatgaacacattgtgtttggatgtccaacatactatcacataagtgaagataagttggagctcaaaaccaagaaggatgtctttatgggctatagagatggagtcaaagaattcagaatctggtcttcgtcaaaaagaaaggtcattttgagtaaatatgtcctctttgatgaactctttatgttgcactctaaatttgaagaagatttaaggatgttactgaataggtcaagtttgagatccctataa

SEQ ID NO: 30170 - DNA, 432 bp, Glycine max
  Peptide Sequence Number=SeqID_146948
atgacatctgcaaaaccagtttgtactcctttgataacgtccattcgtctcattgaactcaatgccactcagtcagaatcaaaaagggaatacatgtatcgtgttccttatgcgactgttgttggtagtctcatgtatgcaatggtgtgcataagatcagacatggcacaagcagtcaatggagtgagtaggtatatgggtaaaattgggaaggaacacatttggaaggctacacgtcagcccatagttgctttgttcactacagaggttgaatacatgactctggcaaaagcaacaaaggaagaatcaaggtggagattgttggaaggagtgaacgacactgaaagagaagcaagcttcatgatgatgaatcaagttgattcaagtagttttgatgatgacaaagatgatgacaaaaagcccaaagaatga

SEQ ID NO: 30171 - DNA, 192 bp, Glycine max
  Peptide Sequence Number=SeqID_146949
atggggtgtaataattggacccaaccttggcccatgggcttagaaatctaccttaaggttcatgagaaccctagggccttcttcagcagctctaacccaatcctcttagagcctcatgctcatggctctagtgactggtcccttcttaggaaggattgcattagtagacaactcgcaaacccttatttttaa

SEQ ID NO: 30172 - DNA, 2226 bp, Glycine max
  Peptide Sequence Number=SeqID_146950
atgacgagcgctacggacgacgacgaacccttaccccctgaatcccctgacatacttgaacccaacccaactcccccaccaccgcctgaccctgactctgcccaactcaccctttacgctttgtctggccaccccacctcagccacccttcgagtcataggtaccatcaaaggccacgatactgccatcctcatggacggaggcagtacacacaacttcatccacaaccgcctggctcacttccttaatctcaccccacagaccatccctgctttgcccgtcatggttggtaacgacaccgaaatccagtgcgacaaggtctgctgcaatgtctccgtttccattcagggttgcaaatttaccttagacttgcatgtaatggtgttgggcggaaccgatatcgtccttcgtgtggcctggctcaaactcttgggcccagtcaccacggactattcgcacctcacaatgacttttcaccaccagggcgagcccattacaattcagggaggcattgactcaggcccaactgaaatccaccacggccaagtcaggtgcctcatcaacacgaaccgggttgcagccttattccacatccaactccataaccacgacccaccatcccccaacttaccttccacacccccttcccttcgtcccctccttaccaaatacgccagcctttttcaaactccgacaatcctccctcctccccgaccaaccgaccactccatccacctcgagcccaatttgaaaccagtcaacgttcgcccctatagatacccctattatcagaagcacgagattgaacggcaagtcgatgacatgttttgtcgtcaactcatacgccccagtcgtagcccgtattctagcccggtgctccttgttaagaaaaaggacgggacgtggcggttctgtgtggattatcgcgcactgaactcaatcacggtcaaggatagattcccactaccaaccatagatgagctctttgatgatttgggcaattcctcttggttcttgaaaatggacctcgcgcagggcttccatcagattcgcatggaggagcacgacatttccaagaccgctttcagaacacaccagggccactacgaatacatcgtgatgccatttggcctttgcaatgcgccatccattttccaggccacaatgaatgagctctttcgtccattcatacgcaaattcgtgcttgtcttcttcgatgacatactggtttacagtcatgatttccaggcccacatcaatcatctggaatgcgttttcaggaccttgcaacagggacaattccatttgaaaccttccaaatgcattttcggccaaaggcgcattgagtacctcggccatttcgtctcttcacagggagtggaacccgacccatccaagattaacgctatatttttccactgctatgcacaaatagcggagcccttgacccagctcctgcgcaaggatggtttcaaatggacacccgaggcccaggaagccttcgtcaagctcaaagaagccatgaccgccacacccgtgctggcattgccagatttcaccattccttttgttatagagactgatgcctctgggtccggtatgagggctgttctaatgcaaaggggtcatcccattgcttactttagcaagcaattctgccccaagctccttcgctcttccacgtacattcgtgagcttcacaccattaccactgttgtgaaacgccggtgtcaatatctcatgggccatgccttcgtgatactcactgaccataagagtcttcgcgaattgatgactcagccagttcaaaccccagaacaacacgtatacctagccaagcttctcggctacaattactcaatccagtacaaggcaggccgtaataatgtggtggtggatgctttctcgcgtcttcatgagccagagcacacaacagaatacttccaaatcgtctccatgcctcacccaaaattccttgatgagctaaagagggaattatcgggaccagaggaattcaaaactctcatgctccaggtccgcaatgaaccttcgaaaaatccagattttgaaattagagacaaccttttgctttttcaggggcgaatttggattaatcaaggcaatcttttcatttccctcttattagaagaataccacaaatctccacttggtggccacatggggctagctaagactctcggccgtctccagcaaagctttttctga

SEQ ID NO: 30173 - DNA, 631 bp, Glycine max
  Peptide Sequence Number=SeqID_146951
ggcgcgggggagttccggcagaggggacacgtggcgctcgtcttgagccactcgtcgacgcactccgcgtggaagcagtggcggcactccggaacgcaccgtatcgtctccttgggaagatactcgctcaagcaaatcgcgcacgggccctggtcgttgggcctgggcaggcgcttgctctctccgatcacgatcttgggcccgtagcaggcctcgatggcgggcttctccaagcccaggaccacaacaccaggcccatccgacgcgtcacgaaaactgctgttattattgttgttgtttctttggtgagtgttgatgttgtggttgtggcggcgagtgatgatgctgccgttggctttgatacggacgcaggcgtaggaggcgagcatgatggtggagatcaggaccaggatgctcacggcgatggcaatgccgtagccgaggcccccgccagctgtggcggtgggggcggaggccctgtcgcaacctacccttcggcaggagggcgacgcgtgactcgcgagatgcgtgttccacgaaaggaatacgcgcggagtcgccaccaacgtttatttgaggaaaacgtcggaaaaaccggaaaagacgcgatctacgaacttttaagtgaaag

SEQ ID NO: 30174 - DNA, 201 bp, Glycine max
  Peptide Sequence Number=SeqID_146952
atgaataacatatttggtctgcatttccccaaaataaaacgacctcagcctagtcatcagtccctcatttgcgtaaacccttgtcgtcatcgcgctgtggccaccgccgtcaccgtcgcactggttcgtggcctcgtcagcggaacctgtggctggaatcgtttggtatttctggactttgaatcttggtcgtggttgtga

SEQ ID NO: 30175 - DNA, 153 bp, Glycine max
  Peptide Sequence Number=SeqID_146953
atgtccattagaaaggatcttcaaaatgagaacctcagaatggaacctcataatggttttgtctcctatcacatcttgacagctagaaagtgcccctacttactccaaaagcttgtcaggagttcggtcgctatttcggtcactgttgaataa

SEQ ID NO: 30176 - DNA, 276 bp, Glycine max
  Peptide Sequence Number=SeqID_146954
atggtggttgcaaggcatgaggttcttcatagtcatccacctattcatctgctcccccgaacacaaagttcaagatcatcacaggatccaaacacaaacatcaaatcgggaggagaccagacagggtcacagtgttttgcgagaatgctccaaccgtatgggatcaacataggcttaaaggagcactcaaaccgtgtggcccccaaggcctacactccgaagagtccgtcaaggcctctccctcctgattcaggtccaacccagaaaacattttag

SEQ ID NO: 30177 - DNA, 432 bp, Glycine max
  Peptide Sequence Number=SeqID_146955
atggagaaaactaagaaattgaagtcgggagaatgggtcaatgacaagtcccgcgaatttgctgagaaatatcaacatcgtcgagatgaaatcttacaacgtttgacagaggaaggcacatctacacaggattcccctaacactgctacttctgttaatgataatgaaatatatttgaatgttgttggaggtccaaattacaaggggaacatgtacggcctaggtactttgagcaaaaggtttagttgctcaaaatcagctccatcaacttctattactcctgtggaagatcaaatagaggaaatgtgtgagacaattaataaatggaatgctgagcttttggcaaaggcaaataaggagaagatacttgaggaaaagatgttgcagatgatggagaatcatgatcaccaaagtcaggagatgcgacaatag

SEQ ID NO: 30178 - DNA, 870 bp, Glycine max
  Peptide Sequence Number=SeqID_146956
atgtgtgaggttggaaagcgtgtgacttataaccaggctgttggcatctttggtttcgctggggaagatcatattggaaaagttagttttccacctgtgcaggcagttccatcatttcctagttcatttcctcacctattttctggaaaagagaatcttcgttgtttaattccttgtgcaattgaccaggatccatattttagaatgacacgtgatgttgctcctaaaatgggtttccacaagccagccttgattgaatcattattcttcccagcattacagggagaaacaggaaaaatgtctgccagtgatcccaattctgcaatatatgtgaccgattctgcaaaagatataaagaacaaggtaaacaaacatgcattttctggtgggcaagattctatagagaaacataggcaattaggggctaatcttgaggtagatataccagtcaaataccttacttttttcttagaagatgatgatgaacttgaacacataaagaaggaatatggagaaggacgcatgttaactggcgaggtaaagcagcggctagttcaagttttgactgaactagtggagaggcatcgtagggctcgggcttctgtgactgaagagtttgatcctaaatcagactgtggtagtggctatatcttcaaaagatttatggcacccaataggcaaaaggaaaacatgaccgatgcacttgcaatgaccttggctagaatgactagagttattgcagatcttgtggaagtagaagaatggctccaaaagagaaaaaaatttagagtcatgagatgtgatgatgcgcagaaggtggactttaccacttacatgctggagttggatgagcaattgtggaatacttga

SEQ ID NO: 30179 - DNA, 303 bp, Glycine max
  Peptide Sequence Number=SeqID_146957
atgattcataatcactttgcttacaccctcttcccaccagtacccataagcccgttagggttagataaggtgcgaagccaaggctttaggatggagaatgaaaactctcattcggtgccctgcaatgcaggtggtcacaagatgtaccatcccaagatgtgtacactcgtgttggatttaggtgtgactatatcacttcctaagtctttagtctcagatgttggtggcactgagtttgctaagaagtttaggtgtaagaatttaatagtggatttattccggagaaaaaaatgcgcgaaataa

SEQ ID NO: 30180 - DNA, 258 bp, Glycine max
  Peptide Sequence Number=SeqID_146958
atgaggatcaaaaggtcttttaaggttgtaatggggccaaggataaggcttgtagtgagcttcaaaacaaggaaagggaaacaaggatcaaaagggctatcaaaggaattaagtcaaggtaagtccatttggctagaagcttataagaacaaaattgcctcaatcatttccaaatatgcatgtgaattaggaagcatcaacaagaatcaagccaaggctattgtgcaagcaatcaatggggcaaaacacaccaaatga

SEQ ID NO: 30181 - DNA, 213 bp, Glycine max
  Peptide Sequence Number=SeqID_146959
atggatggaacctcagtcccacaaaggttaaaggacctaagagagactgatcaagaagatgaaggcttcgttcaagttgctcttcataacaagaaagttgctgccctggttgcttttgccctaaaaagagtaaagaaagttcaaccagcctcaaaaccaagagaatatgtccttccctatgctataccaagacgcattgatagtgattgttga

SEQ ID NO: 30182 - DNA, 297 bp, Glycine max
  Peptide Sequence Number=SeqID_146960
atggggaccaccacgggggaggagcttgccacccagctagcccaggcgagcaaggttgcttcctccagaagcaacagtcttctggaggaagaatctggaaggcccaactttcgaagaagttacgaaaactcacggattgcgaaaaacacctcctttcgatttccgtcacattacggaattttcacgaatcacgtaagccttttgattttcggcacgtctcgggacttcacatattgtgcaacaaaggctgccaagtacctcgaagcggccaatcaagggttgtatatcatcaaataa

SEQ ID NO: 30183 - DNA, 270 bp, Glycine max
  Peptide Sequence Number=SeqID_146961
atgtctgccagtgatcatgctattctacgtgatagagtgcatcaacccaccaagaagagcttattggagttatcatcacaagacgttgtgttggcacaaaataagtttctttctaagcaacttgagatcttaacagaaacaattgaacaaatgcaggaagctagttacatgggaaatcaacaaaagcaaggatacaaccaaggaggattctcaggtttccagcaaggacaatggagatcacaccctggtaatcaattcaataaggactag

SEQ ID NO: 30184 - DNA, 510 bp, Glycine max
  Peptide Sequence Number=SeqID_146962
atggcggaaccatcgaagaagcgcaagggttcttcaagtagaagccaacggcactccgaggctcatgatactccaattccttcctccatttcctcatcctcattgttctcatcggaagaacaacgtatacggtacacaaacctcttctcctctcgttctatcattgaccctaagttcatagatatggatttcttttctgatgagagttttgaatgcattcaagcatttcaaaactcaaatctcaatccctttatgtctttaaaactggctgtgtattctgaattggtaaaagctttttattataaccttgaaattcaggaaagtgcactggaccatgattggaagtttgatttttctgtgcatgatgcccgccagttggtttgcaccaaccaagaggatatgaccagaaggctgcttgccggttcattggctcttgaaagccacatccttcactatcttattaattcgtatcttactcccaagatcttcaaaccttgcacaggtttctga

SEQ ID NO: 30185 - DNA, 210 bp, Glycine max
  Peptide Sequence Number=SeqID_146963
atgggattcacaaccaagggggctgccctgccaggtcatcgggcgtaccctatcttgaatctgggggaatccgtctcggcatctgtcctactggctgttgaagacctgctctctcgcccaagcctcatagcattcatattccaagcactaagtattccctgcctgctcagatgcgtcaatccgcctatcggtagccttttccccgcatag

SEQ ID NO: 30186 - DNA, 174 bp, Glycine max
  Peptide Sequence Number=SeqID_146964
atggcctcgatcagcggcggtggccagcagcggtggtgcgatttggttaagaaatgtgtgagatacgaagatttgaagtttagggagcaaggagtgccgtcacacgagaaagggcggctctgtaatcgattacaaccttgctattctaatgtaatcgattacagggaatggtaa

SEQ ID NO: 30187 - DNA, 1083 bp, Glycine max
  Peptide Sequence Number=SeqID_146965
atggtcagagagtacgactatggtaggggatatttctatgtcgatcgctcaaaggtgaaaaatctccatggagttaagtctacatggcataatagcatgtgtgatgatgtaaaagcttttcataaatttgaatttgatgataagttatgttgtgatttggttgtgatgattgttactgtcgtgcatgactcatatgttatggatgagcagatgttgaaatgtagtggagtggatcgcaatgaagtgaaagcatttgccccttggttaaggggttgtgaacccatctggtatggatatgttgacacaacaaggttttctaaaggcgttgcatgcaacacaacctaccaatatggacgatgcatattgggaggatttaaaggagaaggttacgatgaccattcaattgtgtttgaaagacgaggtcgtgtatcactttatggacctaacgtctctgaaggagctatggacaaaattggagagttaatatatattaaaggagaagggtctgtatgcgaagaggaatcaagaccgtgggaggacacaaggaaaaaaggggttttgggaggaggaataagggaatctcgctctacaaatatggcaaacactgacgattcagactactacaatgaggaagttgatctttcagtgtcatgcagtcaattgatagaagatatgttgattgctagtaatcatttgtgtgatgtgaatgagttgaaatccatgttgggcaaggagtttgacatgaaagactttggccctacaaaaaagattcttgagatggagattcataggaacgagagggaagtgacattaggaaacaatgaagtggatcttaagggtgatcctttaattttggaatatgtggattctaactatgttggtgatttggatgacaaaaggtctacaaggtatgtctttacccttgcaagtgggaatgcttgttgtatggctcaccggctagtaaaggagctaggcattgagcaagaaccaagcatattcgaaaagaataaggttcacactttagagaatgaaactgatatgttaaccaaggtagtcaaactgacaaattcaaacactgcttag

SEQ ID NO: 30188 - DNA, 369 bp, Glycine max
  Peptide Sequence Number=SeqID_146966
atggcccttgaggtttctaacttaaagaaccaaggtggttatgggctagcagttgatatatggagcttagggtgtacagttttggagatgttgacaaggcagcctccttattctgagttggaaggagtgctgcctcctatagcacaaaagcacgtgattcaactcatactttctcacgaaagaaacttcagggctgatgagctaatggagttctacaaaagttactcccaacaagctgtttccaagggtcacaaagcagtagctatattgttgtgccaactgccaatgctcaccctcaaagttgaggctaaatttcagctagaagttataaatatgcggagaaaaaaatcagttaaagaatgcaagtga

SEQ ID NO: 30189 - DNA, 540 bp, Glycine max
  Peptide Sequence Number=SeqID_146967
atgcccacgctcgctcgcctcatctgcgctcaacatatgggtcgtcacgccggcagtaagggcaaagtcgcgccaacgcgcccatccagcgagctcggcctcgttgtcgctcaggtaaagcagcccgcagcggcgaaagccggtattctcgccgctttcggccgcaaatcgttcccagagcgtaaggctctgcgtcgaaatcggcaattctcttgcgtcgcggttctactgccggcaccaaccccagttccggctggattactccgcgctgataagccctttttcgacaagggcgactttcagggcccactgcgcgaggtaataagcagcgaatacgccgacgatgccgccgccgatgatgcggcgtcagccgtttccggcaggtccggcgatgtcgttatctgttgcagcagggcgggcatggtctggctccttatagtcgtcctaatttaccttggccggcgcgcaaacgttgccagactgggctctctgccggaatttcctgctgttcgcagacctctctgcaactctttctgctga

SEQ ID NO: 30190 - DNA, 546 bp, Glycine max
  Peptide Sequence Number=SeqID_146968
atgaaacttgaccggatcgatatcaagattctctatgaacttcagaaaaacggtcgcatcaccaatgtcgagctggcggaacttgtcaatctttcgccaagcccctgcctgatgcgggtgaagaagctccagtcggaaggttatatcgaggggtattcggcgcagatcaacatcaacaaactcggccagacgctgacggtcttcaccgagatcacactcaagaatcatcgccagatcgatttcgcccgcttcctcggggtcgtcgaaaaaatcgaccaggtggtggaatgccatctcgtttccggcggttacgactacctcctgaaattcgtcacgtcgggcattgtcgaatatcagtcgatcatggaaaggctgaccgatatggacgtgggcatcgacaaatatttcagcttcgtgggggttgcacttacacgccgtcaccccggacttgatccggggtccagcgcgatcaagtctttgatcgcgaaagagtcttgtcacggcgtagacgcgccgtggctgtatgccggatctagtccggcatga

SEQ ID NO: 30191 - DNA, 380 bp, Glycine max
  Peptide Sequence Number=SeqID_146969
gatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggac

SEQ ID NO: 30192 - DNA, 924 bp, Glycine max
  Peptide Sequence Number=SeqID_146970
atggcatccaggaaaaggaagagcactgcttccagacctcaagctcaaaatgtgcagatttatcatactgagtttgacgagtttaaagcggaattggagaggcagaatttacacaaacgcctcgctaatcttcaagatggaagcatagatgtagctatggtgaaggatttttatgctaatttatacaccatagaggatcaatccccaaagcaagtcaaaccatggaagcttcttagaaaagacctgatgacattggcccagacatcgagtgtcttctcttactccaacctagctcccacatcccacacctcaaatttgaatatggatagagctaggttggtctatgacttggtaaccaacatggacatggacattggagcccttatctctggagttacctctgatagtctgacctatgagagcttgagtccggccattaacttggcttacattaagaaaaactgttggaatatggatgatctaacagttaacttcagaggggcaaggaaggcaagggttcgactagttgatgttccttcttcttctactctaccagctccttgcacttctgctactcctacaccagttgtagctcctccaggatccattctgacagtggagcagtttttagagaatgatgcatcattcgaggccaccatccctgagccattcatttttgaagcagatccaccttctccaatggtggatcaatcttctcttcaacagccagtagaccctcctacaccagtgcatgagattccagcagacccgtctacaccattacttgatcttccagaggacccttctacaccagtcttgggattgactaccactcctccggccactcttgtgctacatcttacagatgaggagggcactcaggatgaggacactcaatcacaggacatgtcacaggaattttaa

SEQ ID NO: 30193 - DNA, 195 bp, Glycine max
  Peptide Sequence Number=SeqID_146971
atgccgcttagccgcgatgttcataatgaagatgaacattcaacaacttggttgaactcgcttagcgcatgcatgctggctaagcaagtttgtctggaaatatgctttgtgaaaatagaatgcacaatgcaagatgaactcgaagatgcaatgcatgaatttaagaagacagagaggttgcaggaaagcttttga

SEQ ID NO: 30194 - DNA, 420 bp, Glycine max
  Peptide Sequence Number=SeqID_146972
atggatgaagctagggccaaagctgttgacattggagaaaatgatgatgaagaggatagtgatgttgacagagaggaagagggagaagaagagaagcttagtgattattggagtgtgttgaaaagtactcctgagcttcaccagtcaaaggatgaagttggatattgtgggtactttatttgggttgatcaattgattgaagcacttggagttgatgattcacttgggacattttccatggaacaaagaagacaatttggaagagatgaagataagacaatgtggaaggctcaagttaactcaaagcttgattgtatggggattgaaatgaagatgtttagaacaattgtctatggaatgttcttaatccaattgttgtcaatggtggtgtttgtatgtaactgtcattttagtccctga

SEQ ID NO: 30195 - DNA, 291 bp, Glycine max
  Peptide Sequence Number=SeqID_146973
atgtacaaagataattggacccaaccttggcccatgggctcagaaatctaccttgaggttcatgaaaatcctagggccttcttcaatagctctagcccaatcctcttagagcctcttgctcatagctctagtgactggtcccttcctagggaggattgcattagagagccatcaagaaatgaacaactaggtgaatgtagcccaggagtccatgcagtcgatgaaatgtcacacaatgggaaactcgacactagcactttctccgagatggaacttccgatgacatgttag

SEQ ID NO: 30196 - DNA, 204 bp, Glycine max
  Peptide Sequence Number=SeqID_146974
atgcctttagggtttatgcttcgagaagttgggcaaagcatagacattagagttcagagctacgagttgaaatgcatccaacaactaccagagcaagcgctgcaaaataccttcatggtgacggagttagtcctccatgacaacgagcaaagcaaaaatagttacagacaattaatgaaatttgagcttagttcatgtccttaa

SEQ ID NO: 30197 - DNA, 309 bp, Glycine max
  Peptide Sequence Number=SeqID_146975
atgaagacagtacaagtggaggcttcaatccctgctccgtctctcttacgtttgagaactctatcggagcagtcggaggaaaaactggaggaatctcaggaaaccgctagaaatgccgctgtcactgtcgaaagacatgagggagagaccctgatggactcttcggagtgtagaccttgggggtcactcggtttgagtgctcctttaagcctatgcagaccacatatgattggagcattctcgcaaaacattgtgaccttgactgatctccctatgatattacctagtgagagtgacttgacttgctag

SEQ ID NO: 30198 - DNA, 789 bp, Glycine max
  Peptide Sequence Number=SeqID_146976
atgcctggcacttgtggacatcacttcattttggtcgccattgactacttcatcaaatgggttgaagtggcttcgtacgccagtgtgactaggagcatagtggtaaggttcataaagaaagaaataatctgccggtatggttttcctaggaagattatcaccgacaatgccaccaatctgaacaataaaatgatgaaggaaatgtgtgaggatttcaagatccaacatcacaattcttcaccttacaagcccaagatgaacgaggcagttgaggctgctaataagaacatcaagaaaatagttcagaagatgaccgtgtcatacaaggattggcacaagatgctcccttttgcgctgcacggttatcgaacctcggtacgcacatcaactggggcaacccctttctctttggtatacgggatagaggttgtgcttccatttgaagtagaggttccttcattgaggattctagccaaatcaagattggaggaattggaatgggctcgaactcgctttgatcagttgaatcttatagaaggtaagagattggccgccattagccatgagcaattgtatcaaagccgagtgaagaatgctttcgacaagaaggtacgcccacacaagttcagcgaaggggatcttaacttgaagaaagtatcccaagctcaaaaggaccataggggaaagtgggccccaaattacgagggacctttcattatgaaaatggaattttcaggaggagctttgttgcttgccagatggacgatgaagaattgccttcacccatga

SEQ ID NO: 30199 - DNA, 345 bp, Glycine max
  Peptide Sequence Number=SeqID_146977
atgaacaagaccacctatttaagcttgaaatcagattttgtgaagagagtttgggctgggattcagagctttgcatgttgtcgcaacgtgcccttttgcgggcgagcgagggcgaggctcacgggtgcgctttccaaaggaggaaagatgcgtggagttgccaccaacgaaggtattagcacctctcacgtcgataaaagcggggcttttgctcctacgtaccctcctttggagagaaaatcagacctacgtagttctttcttatgtgtgaatcaagtgattccttttactttgaaaggtgatcattttaaggcgttggaccttaaaaatgatccattttacttg

SEQ ID NO: 30200 - DNA, 276 bp, Glycine max
  Peptide Sequence Number=SeqID_146978
cagcctgtggagtggatactacctacgcctactccatatcgactagttgagcctgttcaattgatagaggtgtcatcctctgaagaggatcttgaagaggacctagaggagttacctcctgaacctgctatggatgcccctgacttaccagaggatggtgaggacccgctccctgatgtagattctccagaggatattatgtcagcatctgaggcagactctacagaggagagtggccctggagggacagcgaatagtgacgactctccatcatag

SEQ ID NO: 30201 - DNA, 204 bp, Glycine max
  Peptide Sequence Number=SeqID_146979
atggcactagtaagggccaatattgaagaggacaccaaagtagtgcatgatggcttcaccaacaagatttctttccaacaccatgaccgtaaaattattcttaaacctctatcccttagagaagaatttgaagatgtctttcccaaggagattcctcatggacttttaaacgaacaaaagttgtttaaggtgttggaccattaa

SEQ ID NO: 30202 - DNA, 479 bp, Glycine max
  Peptide Sequence Number=SeqID_146980
ggtacatcttttgtggtacaagtaaagcgtacatctacttgggttgtaatactgagaacaagagagggtacatctcttgtggatcagttcaagtggagggtacatccacttggttgttcaaagagaacaagggagggtacatcccttgtggatctttgcttgatgcttttgcggcaattgttgataagttgaagaggctactaaaccggaggatcctgaccaatggaacaaaagcctatattgttgctgaagaaggctcaaaaatagaggagaaaacgaacttcgctttctgcatttttttggaaaacgcgatgaattcactaagtgtgcatgttgcgctaagcgagttcgtcaatattgctggaatatatgcgttttcagacgaactcgctaagcacacctactgcgctaagcgagttcatcttttggggatgaacattcatcttcctgatgagatacctgtggctaagcggggctga

SEQ ID NO: 30203 - DNA, 685 bp, Glycine max
  Peptide Sequence Number=SeqID_146981
atggcgacaatccaggtgatgcccgttacccaccatgacgttgagaggagttgtgggtactgctcccatcaaccaagatcactacttggtgatttgcaatacaacccaaaatacgtaatgttttcggggctaagtgacccgaaagggagtataagcttatctgggcttgggtcaggttgctatcataaggcggttgggcaatgggtctataatagggtccgtgcaaaggccacgttcgcgacacagggtatctcctcggaggataatcttttaacaggcactggggttgatggttttaaagggttgagcagcgaggacgagggaaaggaaagggtggacgaagaaggagctgaggcatgtggaaaaaaattgggagcaggaatggcgttgggacgaccacggaagggccgacgacccgaaaatgaagcagctcagaagaaatggtggcgacaacccaatgatacgattcgtgagatcttcaaactccgaaaggaagaagctggtgagtggttgtgtgtctggtttatggagatgatggataagctcatcgagcttatggagttgattttggatcttgaggattctgccatgaaacaagacaatgagagcaccaatttgttaaggccaagggatgaaaaattggctttgagggctagagacctcctcagaaaaagaaaagaaactt

SEQ ID NO: 30204 - DNA, 330 bp, Glycine max
  Peptide Sequence Number=SeqID_146982
atgccttcaaaggttattttgatgatgccaaagaattcaagaatcaagagaaagattcaagagaagtttcaagtttcaagtttaggaataattaattcaacctcccttcttaattattctgaggccactcgatccaacaagtggaagggcttatctcctgatgacaccacttgggaagactgggaccaattgaagtcagcatacaaccttgaggacaaggtacttttcgatgctggcgggaatgataggaaaattgcagaacaaccagcgttaagggagaaatccacaaggaagatgaccacacctagatatttgatggactacatctaa

SEQ ID NO: 30205 - DNA, 981 bp, Glycine max
  Peptide Sequence Number=SeqID_146983
atgaattgtccgtaccgttatccatatttccagaaacaagagattggggctcatgttgattcaatgctacaacgaggggttattcgtcctagtaccaacccgttctcctcaccagtactgcctgttaagaagcatgacggcacttggcgattttgtgtcgactatcgggctttgaaccaaggttaccaccagattttgatgcatgaggatgacatttacaagaccgccttcagaactcatgacggtcactatgagttcaccgtgatgccgtttggcttgtgcaatgcaccttcgtcgtttcagaacgaacctgagaaaaatcaggttgaaggcacaattttggagactgcggaaatgcatataggaacagaaacgtggaagatagaaaatcaggaggcgccacaaacaacgaggtttgataagcctagaggattgccacaagaattgagtgaattcctgataagatcaggccagttcttcattaagctctcgaaatgttccttcgcccaaacccaggtggagtacttgggccacatggtgtcaagcaaaggggccgatttctatcgccaattcatccggggctacgccacgatagctgctccgttaaaaaaattgacaacccaagaccctttcgaatggtcagcaactgctcaaactgcttttgatacattaaagagtgttttgacttcggcaccagtattgcttctccctgacttcactatcccatatacagtggagacggacgcctctgggacgagcataggtgcggttctttcccaaaacggccaccccatcgccttcttcaataaacagtttagccccaaactccttcgtgcctccacctacgtcatggaattgatcaccatcaccgcgacagtaaaaaaatggcgacattaccccttgggtcaccaattcactatcatcaccgactatcgaagtctaaaggagttgttaactcaagtggttcaaactcctgaatag

SEQ ID NO: 30206 - DNA, 405 bp, Glycine max
  Peptide Sequence Number=SeqID_146984
atgaatacagatgctatgcatttgtataatgcagctgcatttatgactcatcaagaagaatataataagagtgatataagcgaactgtcagccattgagattgcgtttgatcgtgggtggagaaagttatggattgaaagtgactccaagctagcggtggaggctgtgaataacacaagcttggtgccttgggagattagaaatcattggaaaaactctttgtatttagcgagatctatgtcttttttgattggtcacatttatcgtgaggggaattctagtgcagaccttctagcctctcagaccaccatcttagatgggtttttttggcgggactcttgtcctagttttattcagagagtttttgtaaatgataggaatgctagacctaacttcagaatttag

SEQ ID NO: 30207 - DNA, 474 bp, Glycine max
  Peptide Sequence Number=SeqID_146985
atggagcaatcaccaggatttgttgctcagggtcctcatcacagggggagtcctctactatggtctgtcggctttgccggtccttatatggacttaaacagtcccctcgagcctagtttggccacttccaaacttgaaacagtacctctcacgccaatttcaaaccaaggaggtaaacttcggtattttctaggtatcgaagttgctcgatccaaggatggtctagttatctcccaaaggaagtatgcccttgacatcctagaagaggctggcctactgaatgctaagccagtgaacactcctatggatcctagtgtcaaatttctactcgatcagggggagcccttatcggatcttgggagatataggaggttggttggaaggttgaactacctcacaatcattcgtccaaacattgcatttgcaataagtgtggtaagccaatccattgggatgcaattatgcggatcctga

SEQ ID NO: 30208 - DNA, 1698 bp, Glycine max
  Peptide Sequence Number=SeqID_146986
gtgatggatgagaggaggttggaacgtgacttggataacaatataatcattgatggattgaagctgtttgtcaacagacccaaattcgataggggtagggtgtttcgagcaaaaccttttgaagaacccctccagaaaatggtgaactgtcaggagaagcataacgggaagcagctgggagataaagttccctgttacgatggccaaccacggtcatacctggacatggtcaaggaagcgacacgtgcaaaaggaagctcttatttgatgaaggaagatccacagggtgatacaataaaaatacagaggtcggtggttctgaactcaactaaggaggaccgtgaatggttggagaaggcttgggtagggagattgaagaatagagggatgtttgaaaagttggaagaggagctaaggctgattaacgcagaactgaagaatggatctacacccataatggagcttcagaaatggtcgccggatattagaccagagtatagactcacatgggtcctgctacggggccttccactgagtgtgtggaaacctgagtacatgaagaaggtgatggaggatatcggtgagatggtggaggtcgatgattacgtcgaggaacgtaaacggatggatgtagctcgaactctcatccggaaaaatcggagattgggcttccacgagactgtatgggtcaccattgacggggaggaacatcaactcactgtcgtggaggacatgagtagtatgggcgccaaaatgaaaagctatcagacccatagctggttccctccatcaccaatgtcgacgccaccaaacacccccttacccctcaccgatggcactcctgggcgcgattccggcaacgacgtcagtagtgacagtgacgctgagcttgatggcgtcgataccggcgatcctaaccactggcaaaatctccgtttgtccaaacgacggccgtccaaactgcatcgcgaccattgggtaaaatcccatggtcgttcccctttggtccggtctgtcagtgatgcggctgacgtggaccactccaaggcggacaatgatgggggcaactcagcttttctgcgtggtttggactccgagctccacaacggtcacattacccagagtggtaatgctttcattaatgagggggaaagacaaaaatggaataacataaatatagtaagttcatctcagaaaaatgaagtaacacaggaggggagggcaggtcagacctatgaggagaaaaaggaaagttcagtcatagatgcagaaggggacagggaggaggttcggcctactgaaggagtctttccacatagggttcacgcccttaataagaaggataactttccttctggtcaacacgctttaaacgaagttataggggaagtgggccagaagttaaaaggcccaattaagtcagcaacaaaagtgtatgttagaagaaaagaggtgcagttaagtcatggaaaggcccaatactctcaaggaccagacgtggagtcagttttggtcccagaagcagattacacgcctgcagttcaaggagataaaattgaacaggagctttctttaataagagacctgggcctcacttacgggggagacgacaaggggatcaaagaaattctgctagatatggataacagagacactatgaaggcagctgagatgggaattaaaaaacagatattatga

SEQ ID NO: 30209 - DNA, 435 bp, Glycine max
  Peptide Sequence Number=SeqID_146987
atggaaaattgggtgcagatcaaaggtgttgttctgggaagacacgagtggaaggatgatgggatctcgttgatggagaagtacccaagattgtacaatatttcacaacagcaaaatcaatatatccagatggggtccacatcagatacagggtgggaatgtcagttccaatggaggagattttttctggagggtaaaatagacatggttgcaaattttatggaggatatagaaggcctgattgtacaaatgcagcgacaagatgtctggagttgggagggagactcaagcgggggatatacagtggggagtgcctactggctgcttgatagggactccgcagatgaaaatcaggatgcagtgttcactacactatggaagttaaaagtcccaaatttggtggatctccctgacatggtgtatttggcaccatag

SEQ ID NO: 30210 - DNA, 4614 bp, Glycine max
  Peptide Sequence Number=SeqID_146988
atgggagaaaggatcgatgcgttggaagataccgtgaatgagatgcagacgacgctgcaagctctggtgcaacagatgcagcaacaaagtctcataatcggtgaaatgagcaagcagttaggcaagaagaagacaccacctgtgagtgagtcttcagctgaagaatcatctcatagtgagtcacgacttgcagggaagaaagtgaagttacctgtattcgagggtgatgatcctgttgcgtggattacgcgcgcagagatctactttgatgtgcagaatacaccaggtgatatgcgtgtgaaactctcgcgattgagcatggagggttcaacgatacattggttcaatctgctgctagaaacagaggacgacctttcctgggaaaagctgaagaaagccttgatcgcacgttatggcggtcggaggttagaaaatccgtttgaagaattgtccacgttacgacagaccagaagtgttgaagagtttgttgaagcatttgagcttttatcgtcgcaagtggggcgattaccagaagagcagtatctggggtatttcatgagtggtttaaaaccacaaatcagaagaagagttcgaacgttgaatccaactaccaggatgcagatgatgaggatggcgaaagacgttgaagatgaattgaaggaggaagatgatgacggggaaagatattacgggaagaagcacactggcgagcgattgggccagaaagattgggccgggctgtctcaaaagaatcgtagtggatccagtattaacccgaaagagatgaatcggacaacaaactcgggttggacaaacccgactcaaaaaacgggttcagtgggttctaaccacaattccacgtcctcgttgctatcgaccgggaagaaaacggagaacgatcgtcgtatgggttcgtctgaacggtggaagggagttcgaagccttcacaatgacgagatggaggaaaggagggcaaaagggttatgtttcaagtgcggcggtaaataccatcccactctgcataagtgtccagaaagatcgatacgggtattgattctgggagaaggagaaagtctaaacgaggagggagagattgtgactatggaagttcagaaggaggatagtgaagatgaagttgaggcagagtgcacacttattggtgtgttgggaagcatgggggaataccacaccatgaaaattgaaggcaaattggagaatgtggatgtagtagtcttggtggacagtggagctagccacaacttcatttccccaaaaatcactgctgccttaggtttgccaattacacctatggctgcgaagaacattaagctgggtgatggacacaaagtggtttcacaaggtgtgtgcaagggggttaggattaatcttggagccatggtggttgtagtggatgcattggtgttggaattgggtggattagatgtggtgctgggaatgtcttggttgtgcactttaggcaaagttatcatggattggaaggccctttcaatgcaattttggcataatgatgaattggtggtgttacaaggacagggagggaaacaagaacaacagtgtgtccttaacaattttctggaagataggagaggtgaagcttggtggtggtctcttcatgagcagaatctggaggctgtagaaggaagccaaaaacagctgaaggctgttttgagtcaattccacactgtatttcaggatcacatcatacttcctccccagaggtctcaagtgcatcagattaagttgttctcagatcagaacccagtcaatgtaaggccatatagatatccacatcaccaaaaagaagagattgaaagacaagtacaggagttactggaggcaggggtaattcgtcctagcatgagtgctttttcaagcccagttatcttggttaagaagaaggatgggagttggaggatgtgtgtggactatagagctcttaacaaggccaccataccagataagtaccctatacctatagttgaggaattgcttgatgagctgtttggagcaacaattttttctaaaattgacttgaaatctggctaccaccagattcgagtagcagatgaagatgttcacaaaactgcttttagaactcacaatgggcactatgagtatttagtgatgccatttgggttgatgaatgctccagctacatttcaggctaccatgaatgacattttcaggccatttttgagaaaatttgtattagttttctttgatgacattttaatatatagcaaaactatggctgatcatgaaaagcatttgcatcaagtattaactgtattgatgtcaaactgttttatagctaatcagtctaagtgcaaatttggctgtctccaagtggattacttgggtcatataatttcgggagcaggggtggaggtagaccctcagaagattaggtgcatagttgactggcctgagcccaagaatgtaaaaggggtacgtggatttttgggtcttactggatattataggaaattcattaaggactatggtaagttggctaagcccttaactgaaatgacaaagaaggacaatttcaagtggggtaaagaaacttctacagcttttactcaattgaaaacagtgatgacaactcctcctgtattggcccttcctaatttttctataccatttgaggtggaatgtgatgcagctgggaggggaattggagcagtgttgatgcaaaatagacaacctgtggcttttttcagtaaggccttatcagatgggaatttgtctaagtctgtgtatgaaaaagaactgatggcattagtgctagctattcaacactggaggcactatcttttggggaagcaattcactgtttacactgaccacaagagtttgaaacatttcctgcagcaacgaatctcttcaccagaccagcaatgttggttagctaaactccttggctatcaatttgaagttaaatacaaacctggatgggagaacaaagcagctgatgctttgtctaggtgctatggggatgtggaaatgaattctattacctcctaccctaagtggctggaaggaccaaagttgttacaagaagtgcagcaagatccagacattcagaagctagttgctgaattgactgatacaccagatgctagacctggttttactgtgaaacagggtgttttgttttatcatggaaggttggtaatttctccaaactcgccatccattcccatgttgttggaagagtttcacagtactcctacaggtggtcattctgggtatctcagaacttatagaagattggcagaaaatttatattgggtaggaatgcagaagaaaatcagagattttgtgcgagcttgtgacacatgccaaaggcagaaatatgcagccacgacccctgggggacttctacaacctctccctatccccaatgctatttgggaggatttgtccttagattttatcactggccttcctaagtctaagggttatgaagctgtgcttgtagtagtggatagactatctaaatacagccatttcatcctgctgaagcatccttacactgccaaatctatagctgaattatttgtgaaagaaattgtaagacttcatggcattcctacctctattatcagtgacagggatcccttgtttgtaagccatttctggatggaactgttcaagttacagggtaccaagttgaagatgagttctgcctaccacccagaaactgatgggcaaactgaggtactgaatagatgcttagagggttacttgaggtgctttgcatctgagcagcccaagacttggtcatactggatcccctgggcagaatattggtataacactactttccatgtttccatagggaaaacaccttttgaggtagtgtatggcagacaaccacccagtttgttgaggtttttaagtaatgagactaaagtggctgctgtagccttagagttaactgaaagggatgaagctttgaatcagcttaaaagtcatttgttacgggctcaacaacagatgaagaagtatgcagacaagaaaagaagagatttgcagtttgagataggggaatgggtgtttttaaagcttagacctcacaggcagcaatcagtggtcaagaggattaatcagaaattagctgctcgtttctatggtccttttaagattctggccaaagtgggtgcagtagcttacagattacaattaccggctcagtctagaattcacccagtattccatgtttcattgcttaagaaggctataggtgattatcatgtacaaggtgatctgccacaagagctagaggtaacaaatgatgacagcttttatcctgagatggttataggatctagagtgaatatgcagggtggtgtttcggttccacaaagtttgattaagtggaagaataaaacacttgatgatgttacatgggaggacaatgcatacttacagggacagtttcctgatttttgccttgaggacaaggctgttgttatggatgggggtgttgatagagatttatctgaagaagttgggcttgattttgggcccaaacctaaagtgtggagagtttatactaggagaggtggtaaaggaataaaagcatga

SEQ ID NO: 30211 - DNA, 1146 bp, Glycine max
  Peptide Sequence Number=SeqID_146989
atgtcattcactgttgctttattcaatatgaggcattttgtaaatacacctaatctgaagtataatggccacgggaaagatgtatacaagaatgtagatgctggcaaatggtcctttcttgaggctttaggcatcgcaaggggaattgtccttgaagatggattgtttgactttgtgggtgacaaagatgcattgttgttaagtgattatgctgtgaaaaataattgtcaagtagagatttatgttgaacaaaaaatgattgaccaagttgaatatgttgatgatgctttaattggacacaaggaagccgaagaaacacctgaaactaacaaggatcaccaaactctaaggagtgcagatgaggggaagcatgtcagagtaaattgtgaagggttggatgttgatagtgaagatgatgacagtgagtttgaagttgatggcaatgacttagaagtcacagacaatgatgttgaacttgaagataatgaactgagtgaagttgaagttgatgacaaggaggttcaatttgatgacagattcatgccaaccaatatggatcagatgcatcatctggaggaaacatacacaagtgaagagcttgatccagactttgattcagaagaatggaattctcctctaaaacagtttaaagatgttgttcttgagcattctcaagtatctcacaagctaccctatgccatcaagactctttatccaaaacacaagtgtggaagggcatttaacaacaagaatgctaaggctaagtgggttgcaaatgcaattgtagatttgttgaaggcaaatcataaactatctgtggttgagattgttgatcatattaggatcaactattcaattgggatcaaagcatgtactgctgaaagggcgagagccatagcaaggtatcttttagcagctattgcaacagacccaaatgatcagtatttgccactggcctttgcagttgttgagtcagagaataaggaatgttggacatggtttatgactttgttcttgaatgacgttgatcatgatcgcagtcaaaaatgggattttatatctgatcagcaaaagggattcgttccaaattttgaagagatgcttagggatagtgaacatcgtttctgcttaaggtttatacaatag

SEQ ID NO: 30212 - DNA, 282 bp, Glycine max
  Peptide Sequence Number=SeqID_146990
atgtccaagactttgttgcttggggaagaacaaggcatctcttcttgggttgctgtaaattatgctcttggaaacttgggacgtgagcctcaagaaacaactggaatagttgaacttggtggggcttctttgcaggttacatcagctaaacttaatgcagatatagctcaatctttgcacactataagattgtctggggttatgtacaacctttacactcggagtttgccacaactgggtcaggtgctctttagctttattctgatgtctgaaaccatttag

SEQ ID NO: 30213 - DNA, 279 bp, Glycine max
  Peptide Sequence Number=SeqID_146991
atggaaattgatgcagtgattaatctgctaacacaagctagccaaacaaatccaaacaagaaaaaatcaaaccttgtctcaaagaaaactggtcctgcatctgcatctacaaataattctggtattgcaaagaaagtgagttgtgcagcaacaaaaaagaaaaaagagaccttgaagaaacctcacctgtctgaacaaagtgcacaatgtggcaacattgtttcagcagcaggagaagacatggacactgatattgtccatagcttgttgaattcttga

SEQ ID NO: 30214 - DNA, 531 bp, Glycine max
  Peptide Sequence Number=SeqID_146992
atgagaattggaaacaagtccctgctaccccagaaggatttgatatggaaggatattcaggttgaatttgatatcgctgaagcatgtgatttgaggacgaaaaagaaaatacttcaaaccgtgggggagcggtggagacaattcaagtttgatttaacgttgagatggacacttgcatccgacaaggacagtgtcgactgtttgcaaaaagatgttcgaatgaaggcacaggccattcaaaaacaaaacactacccctcatgtgttgtctcgtgagggttatgaattactagaaaagaagttaatatatgagaagaaaaagaaacaactagaggaagttgctaaatttggaagcactaacaccttgattgatcctccatcttccatcagacgacacgtgaagtggaagatggcccgcaccaagaaaacttaccaaatgacatgtgaggcaacaaaggaaattggtgacaagattgtaaatcactttcaatcgttaatcgcaattatttatatttattgtgtgattgagtaa

SEQ ID NO: 30215 - DNA, 303 bp, Glycine max
  Peptide Sequence Number=SeqID_146993
ttggtggtaaacgccaccggtgactatgtcagacgcccgatttacagcctgcccgccgattttggctgggcaccacggccgggcatcaccctgattggcgatgccgctcacctgatgccgccggttggcgtcggagtcaacctggcgatgcttgatgcttcagacctggctctggcactgtgcgaggcctcgcacccgcagaacggactgcgctctgcggagatcctgattatggaacgcgcacgcgacatgatgcctgatgcaatagcggggtttcagaactggttcgatgagaaagcctga

SEQ ID NO: 30216 - DNA, 216 bp, Glycine max
  Peptide Sequence Number=SeqID_146994
atgaaaaaacagtggattgcggccctggcagcggcaggccttcttttagtcgttagcgcccaggcagaggcaaaagggtgcctgaaaggcgctgtcgctggcggcgtggcaggtcatctggttcatcatggcgttgccggagcggcagcgggttgcgcggtgggccaccacatggccgccaaaaaacagaaagaggcggaacaaaagcaacagtaa

SEQ ID NO: 30217 - DNA, 611 bp, Glycine max
  Peptide Sequence Number=SeqID_146995
atgaaaatatctacccggcttgcaacgggctttggcctgcttattgtgctttttattatctgtaccggcattgcgctcaacgccctgagtagtgcgaccaaaggcatggacgatgcggtcaacgtcaaaatgaaaaagtatcagctggtgctggatatgcgaggcagcatcagggatatgggcattgcggttcgtaacctggcgctcctgacggatgttcaggcaatgaagcctgaatgggagcgcgtccaaaaacaagaagcgcagtatatagccagccgcaacgctctggctgaggtgatgcaggaggattcaacaccgcaggggcgggaagtcatgagccgcattactgaagctgaggagcctgcactttcgtcgctgaagcaggctggccggctcgggcttgaaaatcgcgctgaggaagccactgcctatctgctgaacgtcacgcgcccggtgcagagtaccttgctcaaagcgcttaatgacatgacgctggttcagatgaaaaatacgcagtccgctgttgaaaccaacagtcaggcgacacgccgggcatcgctgatactgatgttgctcgcggccgcatcagcactgctggcagtgggaac

SEQ ID NO: 30218 - DNA, 282 bp, Glycine max
  Peptide Sequence Number=SeqID_146996
atgaagtcaataccccaacaatcaaaaacttcaacttccataatgttttgcagaggcatctcattccttcgggaaatccccccattctctgacattggtcacactttaagacatgagaaaaaggaatcgcatgaagatagtccaaatagaggcttcaatcccttttacgtttctctgacgtttgggaactctatcggagcagtcggaggagaaactggaggaatcttagggaaccgctcgagatgctgttatcgctgtcggaagacacgtgagtccgcttag

SEQ ID NO: 30219 - DNA, 399 bp, Glycine max
  Peptide Sequence Number=SeqID_146997
atgaaccatgggatgaaaagctcatttcaggacaaagtgagacaagtttcaaagcaattctttcaacttctaaaggaagaaaagcaaaaatgtgctagggaaagggaaccaaacaatattgaaggatatggcaatgatataatatattcaaaaaatcagaggcttgattggactgacagagtatacctgaaagtgcttcctgaagatcagaggaagttcaaattttggcctcaaaaccccaatgatttcagagagagagctgttatgtttctgagattcaactactaccctccatgtccaatgcctaatggtctcagcttgaagccacatgcggatggatccaccattacttttctattgcaagataaactattaaacaagtggcctcagatatcttaa

SEQ ID NO: 30220 - DNA, 171 bp, Glycine max
  Peptide Sequence Number=SeqID_146998
atggctgataagacaaagaaaaaactacagaaagctgctcagtcaggaagcactgaaggtgtcattaaccttctatctcccatcatacgacgcgtgaagtggaagatagcccgcaccaaggaaactgggcagatgacgtctgaggctgcaaaggaaatcattgaagagatt

SEQ ID NO: 30221 - DNA, 99 bp, Glycine max
  Peptide Sequence Number=SeqID_146999
atggatgatggacaaaggaacgaaggactcactcttacaaccaccatttcaaggggaggtcatggagcatctaaggaggatgttcacttggatcaatag

SEQ ID NO: 30222 - DNA, 330 bp, Glycine max
  Peptide Sequence Number=SeqID_147000
atgacggatgacaacgacgtgttccctctccgaaccctttttcgcccttttttggtgtttttcgacccattctctgtgcgttttccgttcaagattggatggagattgcttattcctgctgagattgtcaaggactttctttctaggaagcagaaatcaatgttgcttaaacttgagaatggagatgtttacgaatgttgtttgaagaagaccaatagaagaaggaatgaatgctttctgaccgatggttggtacaattttgtgagggaccacaatctgaaaccgaatgatgttcttcgtttttggatgatccaaaaatacagtatgtga

SEQ ID NO: 30223 - DNA, 135 bp, Glycine max
  Peptide Sequence Number=SeqID_147001
atggcggtgctaataacaataatgttatggcaggcaaggccattgcttgctcctgaaaccagcattcatgagttgctaggatacctgtttgcaccaattcatcagggttgtggaggagcagaagggtttgtttaa

SEQ ID NO: 30224 - DNA, 785 bp, Glycine max
  Peptide Sequence Number=SeqID_147002
gggttgcatcagctacaatcccattcttgcaataagacaacttggctaccctatgagaggggcgccactagaggatgggctcgcgcctgtccgcaaggcatggggggtggtacaaaagaaagacaaagagctcagaggcagtgggcctattggtggctaccgtgagtggttgaaagcccacgtgcaaggtttggattggctcccaagtttgagaaccgctaaaagggaggaagttgaggcaccggaggaagacgaagaggagaatgccgaactaagggatgtaaatgtagctaccaccaaggcattggaacaaaagaccaagagggctcgtagggaagagcacggccggaacaagttccgaggggctctatggggtagtaataacgagcttaaactctggagggaggaaagggaccaatcgcgagtagacagtttgatcttgaaagatgaattgaaggcttgctcgaggtccaaaagaagtttgtctcagcggttatgcgagacagagaccaacatgttagctatcatcaccaagtaccaagaggaactaagtctagccacggcccacgagcatagagtggcggacgagtatgcccaagtgtacgcggaaaaggaggctagaggatgggtgatcgactcgttacatcaagaggcaacaatgtggatggaccgattttctcttactttgaacggaagccaagaactttcccgattgctagccaatgccaaagcagtggcgaacacctactctgtccccgaagagatccacgaacttctcagctatt

SEQ ID NO: 30225 - DNA, 279 bp, Glycine max
  Peptide Sequence Number=SeqID_147003
atgactcaagagctggtagcccgcggagacaccttacggttatccgcacctcgtcattcagtgaccccaagtgtgattgacgagcagagaccaagtttggtcattctgcacccaagatacgcggagataccttacgatacgcggagataccttacggttatctgcacccctttgctaggcagacacagtagtgtccgatggcaagcagagaccaagtttggttattctgcacccaagatacgcggagataccttacggttatctgcacccctttgctag

SEQ ID NO: 30226 - DNA, 1230 bp, Glycine max
  Peptide Sequence Number=SeqID_147004
atgcaagttgtcattgagaaaaagggtggcatatttttcctatacagatatacatctttattactacccagtggaagaacaacacattcaaagtttaggattcctatgccaactttagatgactcagtttgtaatataacccaggggagtgacttagctgagtttcttaaagttacaagtttgattatatggaatgaagcaccaatggcgcacaaattctgtttcgaagcactagacaaaaccttaaatgatatcatgaaaattagtgacaataatgacactgttttcagaggaaaaatagttgttttttgtggggactttagaacaatcttacctatgattccgaggggaacccattcagacatagtacatacaactataaatgcatcttacctttggagtcactgtcatgtgctgaaacttactaagaatttacgcttacaatcaaattcagacactacacatgcaactgaagttacaaactttgcaaaatggattcttcaaattggagatgggactttaggccaagcaaatgatggatatggtacaatagaaatacctaaagaattgtttatcctgaattacactgatccaattgatgctatagttcaatctacataccctaatataaggcaacattacaaggattcaaagtttctacaacccagggctattttagcatcaactaaagaaattgttgaccacatcaacgattatgtattatctttgatcccaagtgaagagagagaatacctaagctcagattcaattgaaaaatctgatacaatagaaagtgaagggtttagcacaataactaccgaatttataaactctttatcaacctctaggcttccaaatcataagattaagcttaaggttgactcacgaataatgttgttaagaaacttagatcaaaatgaaggactatgtaacagtactagactaattatcacaaggtttgccgaccatataattgaagctaaaatcatgtcaggtaaaggccaaggcaacaccgtgtacattcctagattggcaacgtctccatcacaatcaccttggcctttcaaactcattagaaggaaattcccaataattgtctcttatgcaatgaccataaataaatcacaaggacaattattagcaagtgttggactatatctgcctacaccagtatttagtcatggccagttgtatgtagcactttttaggtgcaaaacaaaaatggactaa

SEQ ID NO: 30227 - DNA, 249 bp, Glycine max
  Peptide Sequence Number=SeqID_147005
atggttgtgaatgagtgtgtgattgatatttgtagtgatattacttgtcatgggttggacctgaatcaggaaggtgagccccaaacggattcttcggagtctaggccttggagtgagagtgaccgagtatacccattgtgtggtgtgctttgtcatgtactcctaagcgccccagtgttgtttttcactgacatggtgagccttcatatgatgagtcacatgctagagatggagagacttagtctgtga

SEQ ID NO: 30228 - DNA, 441 bp, Glycine max
  Peptide Sequence Number=SeqID_147006
atgttagctgatttgacaaaacaccatctcctagggaaggttttggcctacatgtacaccattgaattccaaaaaagaggtctaccacatgcacacttgctcctatttttgcatccatcgagcaagtatccaacacctgaagatattgacaacattatatgtgctgagataccaccaaagaatgagcaaaatgaactttaccagcaggtccaagcacacatgatacatggtccacgtggcatagccaaccgatcatcactgtgcatgaaggatggaaagtgttcaagattctatcctaagaaattccagacttgcactgtggttgattctgatggatatccaatctataggcacagggacactggtaacacaatcctaaaaggtggtgttattttagacaaccgcagtgttgttccgtataatccaaacacttctacttag

SEQ ID NO: 30229 - DNA, 1218 bp, Glycine max
  Peptide Sequence Number=SeqID_147007
atggagagtggcggatacctctgggaagaaggccccaacagctttcagccctctgatccaatgctcaccatggtggtggacagtggcttaaaggatcagcttgttttgggggatcctgatgcacctcggtttgtgttgtggaatgggaagttgaggccagtgcctgggaagccgactgatttgcctttctttgacttgatgagcatcggtggcaaaatcagggctggctttggtgtgcttggtattcggcctcctcctccaggtctatgcaggcgatccttcaaaattaagtatgaaagcagcatttgggaaagtttggaggctggaaaaaatggtggtagcataattggtggaactttcaaagcaatacaagagagaaatggagcttcaaaaccacctcgagatccacgtctgccaaaaccaaagggtcagactgttggatcttttcggaagggacttatcatgttgcctgatgcaatttctgcaagattaggcaacaaagtaaagttatcttggaagctttcaagtattagtaaactggatagtggagagtacagtttgacatatgaaacacccgaaggagtggtttctttgcagtgcaaaaccgttgtcctgaccattccttcctatgttgctagtacattgctgcgtcctctgtctgctgctgctgcagatacgctttcaaagttttattaccctccagttgttgcagtttccatatcctatccaaaagaagctattagatcagaatgcttgatagatggagctatatacagctcatcactattctccaatcgagcaccacctggaagggttctactcttgaattacattggaggagctactaatactggaatttatcaaagtttttctgggaaacttcaaggatggtttaaagaactaatcattttcaccagcgggttatttgggtgttttaaacaactcaggcctaatggtcttgtttcgaatacggacagtgaacttgtcgcaacagttgatcgagatttgagaaaaatccttataaacccaaatgcccaggatccatttgtagtgggggtgagactgtggcctcaagctattccacagttcttaattggccatcttgatcttctagatgttgctaaagcttctctcagaaatactgggtttgaagggctgttccttgggggtaactatgtgtctggtgttgccttgggacgatgggttgagggagcctga

SEQ ID NO: 30230 - DNA, 2265 bp, Glycine max
  Peptide Sequence Number=SeqID_147008
atgttgaaagcttccttgtctgggcgcgtgttgctaagaagattaacaacattgacatggtcgtgtccatgtagagcgagcatgctgtttggaactaaagtcaatgctcacgccattgctatgcttataacattcacacgccaacaacactcacttcccattcacttcaccgttacctccttccaccgcctcaagtctccacccaatcttcacgaagccagaacgttgcacgctcttcttctcgttttgggtttctttcaacccacgtgtcctcattcatcatcctttgcttcccaacttgtcaatgtctatgtcaactttggttccctccaacacgcgtttctcaccttccgtgcactgcctcacaaacccatcattgcttggaacgccatactcagaggtctggttgctgttggccacttcaccaaagccattcacttttatcactccatgctccaacatggtgtgacacctgataactacacataccctcttgtcctcaaggcttgttcttccttgcatgcactgcaattaggaagatgggttcatgagaccatgcacggtaaaacaaaggctaatgtttacgttcagtgtgctgtgattgacatgtttgctaagtgtggaagcgttgaggatgcacgtaggatgtttgaggaaatgccggatagagacttggcctcgtggactgccttgatatgtgggaccatgtggaatggtgagtgtcttgaagcacttttgctattcagaaagatgagatcggaaggtctgatgcctgattcggtgattgtggcgtctatcttaccggcatgtggaagattggaggctgtgaaattggggatggcgttgcaggtctgtgccgtgaggagtggctttgagagtgatttgtatgtctccaatgctgtgatagacatgtactgtaaatgcggtgacccacttgaggcccatcgcgtgtttagtcacatggtttatagcgatgtagtttcttggagtaccttgattgctggctactcacaaaactgcctataccaagagagttataaactgtatattggaatgataaatgtgggtttagcaacaaatgcgattgttgccacgagcgttcttcctgctttgggaaaactcgagttgttgaaacaagggaaggagatgcacaactttgttcttaaagaaggactcatgtctgatgttgttgtaggaagtgcattgattgttatgtatgctaattgtgggtctatcaaggaagcagagtcaatatttgagtgcacgtcagataaggatatcatggtgtggaattcaatgatagtagggtataatttagttggtgactttgagtcagcattctttactttcagaagaatttggggagctgaacataggccaaatttcattactgtagtaagtatccttcctatatgcacccaaatgggagctcttagacagggaaaggaaatccatggttatgtgaccaagagcggtctaggattaaatgtttctgtgggaaactctctaatagacatgtacagcaaatgcggatttctagaactcggagagaaggtctttaaacagatgatggtaaggaatgtcacaacatataacactatgatctcggcctgtggatctcatggccagggtgaaaaaggtttggcattttatgagcaaatgaaggaggaaggaaatagaccaaacaaagtcacttttatttcactgttatctgcatgtagtcatgcaggtctccttgatagagggtggttgttgtataattcaatgattaatgattatggaattgagccaaatatggaacactactcgtgcatggtggatctcattggtagagcaggagatcttgatggtgcatacaagttcatcacaaggatgcctatgacaccagatgccaatgtctttgggagcttactaggtgcttgtcgacttcacaacaaagtggaactgactgagcttcttgcagagcgtattttacaattgaaagctgatgattcaggccactatgttcttttgtcaaatttatatgcctctgggaaaagatgggaagacatgtcaaaggtgagaagcatgataaaagataaagggttggagaaaaaaccaggaagtagctggattcaggtgggtcactgcatttatgttttccatgctaccagtgcctttcatcctgcgtttgcaaagattgaggagactctgaatagcttattgttagtgatgaaaagtgaagactatatgttaaccaacgttaatgataaacttttaacgtga

SEQ ID NO: 30231 - DNA, 372 bp, Glycine max
  Peptide Sequence Number=SeqID_147009
atgtgtccagtcgttaattttggtgtccaatcgctaatagcaactgaatatttgtggtctctaatttcgatcgctaaactgcatttttctagtagtgtatacgggtttatgattcttgtattgttcttgtttcactttcatagttcgaagtttatgaatattcttgagtgcgtgcattgtttgttcttgtttcacacagttatggttatggcatcttcttcaaaggtgtgggagggtataatgcaagcagagacaactcgaacattcaaaggcctcgcgtggaatgcttatagggaggcattacccgtgaaatctttgttgtcagaaaaaggagtaattggagatgccatatgtctatgttggggtcactaa

SEQ ID NO: 30232 - DNA, 1452 bp, Glycine max
  Peptide Sequence Number=SeqID_147010
atggaaaaccatcaccaaatattgcaacaaccaaaccgtgaatttaccttactaagatccaccgatttcctccgccagaatctcaatctagatcccccaaccgtcaacaccggaaaacatgtcgatccttccatcaaagaagtggattttttctcatcaagttcatcaccaccaaagaacagtggcacttataactcgagtcaagaagaatcgcgtgatcgtcgtacaaacatggctaaagacgatagatcaccaactcttttcaatgatcagctcgtaaacactgcgctaaatctaagtccgggtgctggggtgtcaagatcagcagcaaatgatgaaaaccttaaaactttgctgaatacacttcaaagggaatcgcttagattacaagaagagaattgcaaactgagaactatgttggaccaaatcaccaaaaacaactaccagttacaattgttcattgctttgcagaagcaaaagcagtgtcaggtggagacaaattcgatgatatgtggccaacatttactggacccacgaccatgcaccaaattagacgctcaagttgcatcatttccagatgataaatctggtcaacagggtgatcccgtagaagatgttcttgaacaaacgtcctcacacagttgggggtcatccaagagccccacctttgaaaaatccaagcctagtgagcttcctttcaaaaaaaccagagtttccgtgcgtgcaaaatcagaagctcctttgattagtgatggatgtcaatggaggaaatatggacaaaaaatagccaagggtaatccttgtccccgtgcctattatcgttgcactatggccgtaggatgcccagttcgtaagcaggtgcaacgatgcatggaggacaagacggtgttgataacaacctatgaaggcaatcataaccatcctcttccaccctcagccacagtcatggccaattctacctcagcagctgcagctatgctcttatcttcttcatgttcaatatctaataccgaagcactaagtaacactgtaggagtattctcttccatgccctacatcccaatggcaaccctctcaacatctgcaccatttcctactatcacccttgacatgaccaccaaccctatgcaactgcatcgggaaacttcctctgccctaacatcccttcttccattgcatgcaacttctattccccagctactaggacaccctgtcatcttcccccacaagatgccacatccactaggccaacaacaacaacctttgtttttgaatgagacgatgagtgcagctattgcttcgaatccgaatttcactatagcattagcagcagctatctcatcaattattggagctcctagaggcactgatggaaacaacaacaatagtagcaatggcggaagtcatgttcttcctcttaatggggcatctatgttgcctggatccacttag

SEQ ID NO: 30233 - DNA, 1419 bp, Glycine max
  Peptide Sequence Number=SeqID_147011
atgaggacacttctaaccgatggtggcacgtttctcttgcagttggtggatgtgtttttggttcttgcattgttcagttgtagcacatggacagtgtggagcagctcatgctgcaatcagataaacttgaatgaagtccggcctcacagtgtcagtattactgaatttggagctgttggcgatgggatcactctcaatacaaaagcatttcagaatgccattttctacctaaattcatttgcagacaaaggtggagccaaactttttgtcccagctggccggtggttaactggaagctttgatctcatcagccatctaactctgtggttggacaacgatgcagtaattcttggatcaacgaactctgatgactggccagttgtggatcctctaccatcatatggtcgtggaagggagttgcctggtggaaggcatagaagcctcatttatgggtgcaatttaactgatgttgtcataacaggtaacaatggaactatagatggtcaagggagtatctggtggaacaatttttggaacaaaacactgaattatacacgtcctcatttggttgagttgatgaattcaactggggttctcatctcaaatgtaactttcttgaattcaccattttggactattcaccctgtatattgcagccatgtaacaattcagaacgtcacaatcattgctcctcttagttcaccaaatactgatggcattaatccagactcttcagacaatgtatgcattgaagactgttatataagcactggtgatgatctgatttccatcaaaagtggatgggatggatatggcatttcatttggccgacccagtacaaatattaacatccgcaggctcattgggaagacaacgagtgcagggattgctatcggaagtgagatgtctggaggagtatcggaagttcatgcagaagatatttacatttttgattcacatagtgcaattagaataaaaacttctcctggaaggggtggttatgtaagaaatgtctatatctctaacatgatcttggctaatgtagatattgctattaggtttactggtttatatggagaacatcctgatgacacttatgacccagatgctctaccggtaatagaaaggattactatcaaggatgtgataggggtaaaagtcaaacatgccggccttatacagggtattaaaggtgacaactttgtcaatatctgcctatcaaacatcacccttaatgtgagctcaaaattgccatggaactgctcttacattaaaggattctctgacttggtttcaccagaagcttgtgagcctctcaaagaaagaatattccctgagcattgttcagactgttactatttaccaaaccacttgaagagtttgagtaatcaaaactggggtgcttggttactgtcttga

SEQ ID NO: 30234 - DNA, 189 bp, Glycine max
  Peptide Sequence Number=SeqID_147012
atggaaccggtggatgtggttggtggtgcggaggaagtggactggttccgttttgggcttgatgcggttgtagtagacgtcaaacaactcggggttttggtcgagaaaggtttgggctttgaccttgaggcgcgggtgtttgcatttctttttgaggtagtgaagagggatgacttgaccctgttctag

SEQ ID NO: 30235 - DNA, 133 bp, Glycine max
  Peptide Sequence Number=SeqID_147013
gggcagaatcctcttgggccatggtcagaagtcaagacgagtttacggcagaagtcaaccaaggtacttagggatggaggcgaatggaggacagggtcacggccgaccgttgtcccttcccggcgctagataa

SEQ ID NO: 30236 - DNA, 444 bp, Glycine max
  Peptide Sequence Number=SeqID_147014
cctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 30237 - DNA, 705 bp, Glycine max
  Peptide Sequence Number=SeqID_147015
atgcagtttgatggcgcagtgaacgcctgctacaacgtgtgtcaggcggccttgccgctgatgcgccgccgcgcgcgcggcagcatcatcaatctggtgagtgatttgatcgcccggccagcggtggcttatcacgactatatcaccgcaaaagccgcgctgacgggctttagccggacgctggcggccgaactgggggcgctgggcattcgggtgaactgcgtggcgccgggactggtgtatcccaccgatgccagtcagcatacgccagaagcggtccgccacgcgctgacggcgcaaacgccgcttgggcgactggcgcgcgccgcggatgtcgccgggccagtgctgaccattaagccaggtcgccagtcgccgcactggcgacctgccaccgccctccaggcaaatttcagcacaggtctgacagtgtggatgctggtgcttctggcactcccagccggccagctgacaggccatcgacgtgatggtacagagctgctcgctcagttcactctgggcagccagcagttgggcggttacgcgacacagcgccgcgcactgctgattcaggctaatgcagacgctcatctcactggcgtcagcgtccagcagacaagccgctgcacagtggtcgcaggcggtcgcgcagcgatagcacagcgcgatacagtcattgagttcagcgttcatgggtttccttag

SEQ ID NO: 30238 - DNA, 204 bp, Glycine max
  Peptide Sequence Number=SeqID_147016
atgaaggatccaaagaagaaacctgaagaggaagaaaaagtgacgcaacgtcgtgggggttcaggcaacttcgcagccgataatgagcgcgcggctgaagcaggccgcaagggtggtcaggtcagtggcggtaactttaataacgatccacagcgtgccattgaagccggcaggaagggaggaaagatcagtcgtcgtaaataa

SEQ ID NO: 30239 - DNA, 207 bp, Glycine max
  Peptide Sequence Number=SeqID_147017
atggaagatgatcctaatacctcacctgaaaaccacatccttctttatggccaccatgacgatcttctctccttcaaccatcgttgtgcccacacctaccacaagccaggattgatatttcctcgtggcaaatcgttggagccaacaccatggtttcagatcaggtggttatcaacgactttgtgggtctcttcatcaccaccataa

SEQ ID NO: 30240 - DNA, 1075 bp, Glycine max
  Peptide Sequence Number=SeqID_147018
atgaggaccggagaagggaagacactggttgctgttttgccagcttatttaaatgcattgagtgggaagggagttcatgttgtaactgtcaatgattatctagctcggagggattgtgagtgggttggtcaggttcctcgctttcttggattgaagagtgtcgaagatcttgtcataaggggtttcaattactgtatcattgatgaggttgattcaatccttattgatgaagctagaacaccgcttattatatctggacctgcagagaaacccagtgatcaatattataaggctgcaaagattgcagaagcctttgaacaagacatacattacactgtagacgaaaaacagaaaacagttctactttctgagcaaggttatgaagatgctgaagaaattttagctgtcaaagatttatatgatcctcgagaacagtgggcttcatatatcctaaatgcaataaaagcaaaagaactatttcttcgagatgtaaactacatcattcgtggaaaagaggtcctaattgttgatgagtttactggtcgagtcatgcaggggagaaggtggagtgatggccttcaccaagcagttgaggcaaaggaagggttgccaattcaaaatgaaactgtaacgctggcttctatcagttaccagaatttctttcttcagttccccaaactttgtggtatgactggcactgcagcaacagaaagtacagaatttgagagcatttacaagcttaaagttacaattgtgccaacaaacaaacctatgataagaaaggatgaatctgatgtagtttttagggcaacttcagggaaatggcgtgcagttgtagtagaaatctctaggatgcacaaaaccggtcgcccggtgcttgttggcaccactagtgttgagcagagtgattctttgtcagagcaattgaaagaagctggaattccgcacgaggtacttaatgcaaaaccagaaaatgttgagagggaagcagaaattgtagcacagagtggtcgtcttggggcagtgacaattgctaccaatatggctggtcgtgggacagatataatccttggtg

SEQ ID NO: 30241 - DNA, 153 bp, Glycine max
  Peptide Sequence Number=SeqID_147019
gggcagaatcgtcttaggccgtggtcggaggtcgagacaaagttaagggcagagaccaatcaagaggctagggtcatgaccgacagatcatcgtcccttccctactctggacaagcggaaaacgccgccgcaaggcagcctagtatcctttaa

SEQ ID NO: 30242 - DNA, 117 bp, Glycine max
  Peptide Sequence Number=SeqID_147020
atggatgaggcatataaaatgatgcagatcaggttggtaatggaaaatgttaaactgttggagccctcttgtaaaaataacctatacgaggttaactttgtatgctgggacttgtaa

SEQ ID NO: 30243 - DNA, 441 bp, Glycine max
  Peptide Sequence Number=SeqID_147021
atggcaactcttgatctgcctatctccttacatctctcaactctcaccaaacccctcttcattggatactcatactacaaagctgggggacttaacccacctcacacacaccctcgtgccactgagattgtgtttgtgttggacggtgaattagatgttggatttatctccacatccaacaaactcatctcaaagtctattaagaacggtgaaatctttgtgttcccaaaaggtttggtgcactatcagaagaacaatggtgataagcctgcttctgtgctttctgccttcgacagccaactccctggcacagtgtccatagctgcagctcttatcacttcaacaccaactgtgcctgataatgttcttgctcaggctttccagattgatactacgaaggttgatgatatcaaggccaagcttgctccaaagaagacttaa

SEQ ID NO: 30244 - DNA, 165 bp, Glycine max
  Peptide Sequence Number=SeqID_147022
gtaaaagctgcagatttaggtggtacaatcatcttgattcttgacttaacaaaaatccctttacaaaagaggaagaagagaagctacttgcagctcacgagctttatggggcaaggtaggcaaccatggcaaagctcttcagtggaagaaccaacaacgctttga

SEQ ID NO: 30245 - DNA, 285 bp, Glycine max
  Peptide Sequence Number=SeqID_147023
atgtcgcagatagggttctatgaatcaggggctcccctaaaggcccccaaacaccccacaatccggtctcccaagaatgtgtgtcatgtttttggttttttggcacgaccacaagtaagagagaggcgcgacgtgcaagagagaggtgtgacacatagaaaggggcggcgtgtgcaagccgtggaggaggaagtgaccttcttgtgcagtgtttggtcgggggtaaagaggttgcgcgctagccaaggaagagaaagtgatgtcgtggacctcccgttggagtga

SEQ ID NO: 30246 - DNA, 714 bp, Glycine max
  Peptide Sequence Number=SeqID_147024
atgaacttaatcattgttatcaaaaggaaagaacacactttacggtgcccttgccgaactcgtgctagagctagagtattgggtgaagtagaggaggtgcaaaagtcgatgaagaccgacatggaggccatgaaagagcaaatggccacaatgatggaggccatgatgagcatgaagaagataatggaagccaatgcggttgtagttgccgctaccagcgttgttgctaaggtgaacccgatgtccccatctggcctcaaccaaatgaatcatccaacctcagttatggtaggcaaagatttgggaagtatgagcggcccctattatgtgcaaattcaaaacaagcacgccttcccaccatatggcttgcctcccaactatacaccacccaatgtggcgtacactcccaatgagaatgtcaataactacactcctatactcattgagagccaacaacctcaatctgatcatgcacatgtctctcaacccatgggggagacacatgaaatgccccaccacaatctagccgacttcgagccttgcctcggatatgccactgaagggcatgtagttggtgatatacccctacaaaacactttggacggccctcagtatcacccacagccacacctcttgcattccacaatggttaaaaaccctcatgctatggcagaaatgggaaagttggatcatctagagggtgggatcctctag

SEQ ID NO: 30247 - DNA, 279 bp, Glycine max
  Peptide Sequence Number=SeqID_147025
atggtaaatcccgagtttcgtcatagccctctgaagatgtcatccagaactagtgacatggatgattttcccaagggtttgtgggggtggagttggaaggagaacaagttgtttgagcaggccttagccgtggtagatgagaaccacccggaacggtgggagattgttgcagccatggttggaggacaaaagagtgcaggggatgttcaagagcattatgtgtttcttttggatgatttaatgttcatagaatctggaaaattggaccataaacttgcg

SEQ ID NO: 30248 - DNA, 171 bp, Glycine max
  Peptide Sequence Number=SeqID_147026
atggcatgtactaaggtagtcatcggagcatcctccaactttgcccggattaagggtggtaaactaagcacatcctcaaggaacacaagtatgaccctcattaagcttgacttccgtctatgggtaaccaggatcatgcatactcggatgtttcctttcgaaacaccttaa

SEQ ID NO: 30249 - DNA, 468 bp, Glycine max
  Peptide Sequence Number=SeqID_147027
atgacaagcaatgactcaaacttgtttcaatttcctagtcttacaaaagggaattatgataattggtgtaattgcatgaaagtttggcaaggttcccaagatgcttgggaggttgtggagaaaggttatagacaacatgaaaatgagggttctttgtcacaaaatgagaaagagactttgttgaagatgaagaagaatgatcaacaagcacttacattcatctatcaaggtttagatgaaggcatgtttgagatggtgtccaatgcctccacctccaaagaagcttgggagattttgaggacatcccttgaaggtgttgacaaggtgaaaaagcattatgggaaaaatatggaagatgttcacgttgtagagaacattcttcattctttagccgtaaaatttgattttttggtttgtgcaattgaagagtcaaaagacatcgagtcaatgatcgtggaccaattatag

SEQ ID NO: 30250 - DNA, 198 bp, Glycine max
  Peptide Sequence Number=SeqID_147028
atggctgagatcttgagattgtatcatattcgctccaccgcagtctcctcctccaccttgacaccaccgcctaaaacttccatggtaatttccgttcggggagtgaggatagacgaggaggacaccattttcgaatcagaagatcttctcctcgcagtggtcacaaatctagtcactaatggcggtgcgagcaagtga

SEQ ID NO: 30251 - DNA, 1006 bp, Glycine max
  Peptide Sequence Number=SeqID_147029
atggtaaacggaaaaatacttgtatctggagtttccctaatccttgtggtgggtgttgccatcggtgtggtggttgttgttaatagaaaggacacatctgatcctgaagtagcagctcagcaaaaatctgtgaaggcaatgtgtgaaggcaccgatgaccctaaactttgtcatgatactcttagtaccgtgaaaagctcgagtgtctcagacccaaaggcatacatagctgctggagtggaagcaacggcgaagagtgtgatccaagcgttgaacatgagtgataggctcaaagtggaacatggagacaaagaccctggcatcaaaatggcccttgatgattgcaaggacttgatcgaattcgcgttggacagcatcgagtcctcggctaatttggttaatgaacacaacattcaagctttgcatgatcaatctcctgacctcaggaactggttgagtgcaattatctcgtaccagcaatcttgcatggacgggtttaacaacgggacaaacggtgaggaagaggttaagaaacaattgcacacagatagtttggaccaaatggggaagctcactggcatagtccttgacattgtcactaatttatccaaaatccttcagagttttgacctcaagttggatttgaacccggcttctcgtcgtcttctcgaggttgatgctgaagggttccctacgtggttctctgctgcagatcgcaggctacttggtaagatgaaccaaggagatgcacccccacccaatgcagtggttgccctagatggtagtggccaatttaaatccgttaagcaagctattgactcctaccctaagaatttcaaaggcagattcattatttatgttaaagctggtgtttataacgagtatatccttattcccaagaagtcagagaatatcatgatttatggtgatggccctaccaagaccattattactggtaacaaaaactttatagatggcgtcaagacaatgcaaactgccaccttcg

SEQ ID NO: 30252 - DNA, 552 bp, Glycine max
  Peptide Sequence Number=SeqID_147030
atggtgaaggggatatctcacatcaaccatcctaatcatttgtgcgaagcatgtcttcttggcaagcatgcaagaaaaagttttcccaaagaagccgaatcaaaagcaaagatacctttccaacttgtgtccaccaatcaaaaatccaaggcttttgtaatttttaaaaattttaaggctcttgtagagaaggaaagtgactatgtaatcaaggctctaagatccaatagaggtggcaaattcacatcaaaaaacttcaatgagttttatgaaaataatggaattcaccaccctataatggttcctagaaccacacaacaaaatggatgtatgttgaaagttaagtctatgcccaagaagttttgggccaaagctattccacatggagtttatttttctaacagctctcctacaaagaatgtcaaaagccaaacacttcaagaagcatggaatggagtgaagccaagagttgatcatctcaagtctttgggagcatttcatatgctcatatgtctgaccaatgaagattcgagcttgacgataggagtgtga

SEQ ID NO: 30253 - DNA, 135 bp, Glycine max
  Peptide Sequence Number=SeqID_147031
atgatgcaagaaaactacacggccgtgaaatcagtatcggcttccactatgtgcaaacaaaaacggatcgaaacactttcagccaatcagagcaaagtgcaactaaagaccaagatatcaatcatagatcagtga

SEQ ID NO: 30254 - DNA, 470 bp, Glycine max
  Peptide Sequence Number=SeqID_147032
atgttattggtgttgtggaggaggttgtctttcggcaagtttcaggaaaaggtagaagggtagttttcaaattaaaggacttgagccaacaattgctatcttgcactttgtgggatgattattgcttgcagtttgtgaacttcttagatgattatgaaggtgatggtccaattacagttctattaagccattgtaggatcaaggaagcgcagggatcttatcccgcatcgatcaacaattctctcaaggcttcaaagttaattattaaccagcccgtgatggagattcaagaattcaatgaacgatattttttgcttgcagagttgggcattgaggcccggttaggttttaaatcccatggtgaagggagtacacaactttcaggttctatccattatcatcaaaagaatcattctttggcaaggctaaggcaaagactattgctgagattaacaccatctctgaagtaa

SEQ ID NO: 30255 - DNA, 1629 bp, Glycine max
  Peptide Sequence Number=SeqID_147033
atgaacggcgtggatctggtgcagccagcaccgtttccgtccacagaacctgttggcaatttgcgtggcgcacttaccgacatccactcgccgccgatctgctatgcttctcacgccaaacctctcacgtaccgtgttggtggtggccatgcggattcgactgaattggaatcatggttgcgtgggtttgctatttttgggactgttggggctaaatttggagctgaggcttatcatttttacggtgtgggtgcttcctcggatttgaggggtgtggggaagaggtcctcagagtgggatttgaatgattggagatgggatggtgatctgttcatcgctagccggctgaatccggtgccggccgatggtgttggagtgggacagcaatttttccctattgggtccgggatcccggtggccggaggcccctccaacagttcttccacctctgaggaagtagatcctagggatcccaaggcgaacaaggaaggggacaagaaaaggagagttattgtgctggaggatgatgggttgaatgaggaagggggtactcttagtttaaagcttggtggccatgcttctgcagtggtggatagggaagttgggagctgggacggtacgaatgggaagaaaagtagagtgtcgggaagtacttcaaatcgagctgtttgtcaggtggaggactgcagtgctgatctgagcaaagctaaggattatcacagacggcataaagtttgtgagatgcactccaaggccagtagggcgcttgtgggaaatgcaatgcagagattctgtcaacaatgtagtttcacctacttcaagagtttgatgaaggaaagagaagctgccgaagacgcttggcagggcataataaacgaagaaggaaaacaaatcatgaagctgttcctaatggaacgccatggtggaacagggacctctgtaatggtgcagttcagtgtcgtggctgtaatggctcaaatagcagctgggatagtggctgtagcagacgaaatagtgtgtcatatggaaaacgggatgggaaaacagtggtcagatcagactacagatcaggatctactaactcatattctgaggagtcttgctagtcagaatggtgaacaagggggcaagaacatagctaaccttttgcgagaaccagagaatttgttgagagaagatggttcatcaaggaagtcagagatgatgtcaactttattctccaatggttctcaaggctctccatccaatataagacaacatgaaactgtatctatggctaaaatgcagcaacaagtgatgcatgcacatgatgctggggcttctgatcagcaaattacatcttctataaagcccagcatgtcaaacagtcctccggcctactcagaagccagagacagtaccgctggacagatcaagatgaataattttgatttgaatgacatatatattgactcagatgatggtatggaagatttagaaagattgcccgtctctacaaatcttgtgactagctctcttgattacccatgggcacaacaagattcccatcaatcaagtccacctcaaacaagtggaaattctgattctgcatctgcccagtctccttccagttccagtggagaagctcag

SEQ ID NO: 30256 - DNA, 384 bp, Glycine max
  Peptide Sequence Number=SeqID_147034
atgaagcttgcttctacaaatagcaatgaattaacaggaagcatgagtctgatcaatgcaacaagtagtaattcatcgaattctaggccttcatgtatctattgtgggaaagatattcatactattgatagatgctataggaagaatgatacacctcagaattatccttcaaaagggggaaaagggaactcaaagcaattccggcaaaggaaacttgggagcaaaaggaaacaaggggtgcaaatagcacccaggcccacttgggccctccagaatattcctccagaaggctgttgcttctggaggaagcaacctggctcgcctgggcgagctgagctcgcctgggcgagctgggcggcaaccacctcccctattttgctataa

SEQ ID NO: 30257 - DNA, 132 bp, Glycine max
  Peptide Sequence Number=SeqID_147035
atggagcaaccagagaaaaaatttaaggaatctcaagacaccattagagatatcactatcattatcggactacacacaccatttgatgttccgatgcgaaatcgctatgaaattgatgtgttcttgtgttaa

SEQ ID NO: 30258 - DNA, 627 bp, Glycine max
  Peptide Sequence Number=SeqID_147036
atgagtcaaaggggcaacaatggaagcataccctttgataaatcttcgataaaacctaacaagcccaaaaatccccgcaaggctctagtgaagcgatgtgtcagccattgtttaatcgcttcgaccttagttgggaccggttccacaccttgttctaagaccaagtccaaattggagaaccaacaagcgccccctaattcatccagcagttcatctatggtgagaattgggaaacgggaggcaaatttatgggttaaggaggtgatttcaagatatggtggtggaggtgtactgataaagtccggtattgttgtcccctttcagcttaatgatctgctcaacatgcataaacttcatggtgaggacatgaaggtcaaccgtgaagacttggccctgcacgtgaacaaaaacatcgacatagaaggggtggcattcaacttcattaccattacccaccatgactcagaggggcacgacactcgcgctgagcgcgcctgtccaactggatcaagtggtcacgtgctaagcgtaggatgcgcgcttaacacgcttgctcgtggcagttgtcttccaaagtggcttcttgtgctaagcgacttgcgtgggttaagcgattctgactcgtga

SEQ ID NO: 30259 - DNA, 546 bp, Glycine max
  Peptide Sequence Number=SeqID_147037
atgattcagtttcaactgggtataatggacttagacctagcattgccaatggatggaagccctccaatcattataaagaccagtattaatgctgacaagtctctccacgaggctcgagagtggtctaatagattgacattgaacttgatgagaatgactatggctgtaaatgtgaagccatctatgcccaaaacaaacaatgcaagtgagttcatgaaattggtcaaggattgctcacaatctgacatcattgacaagttgattgtagggaacctgtcaagtgagttaaccaacaagaaatttgattggtctcaattaattcatgatcatgtgacaaaaatggatactttggtggcaaagttgaattccatgggaatgcaagggagaagaagggggattaaagaaaataaaggacaaatcaattcaactcatgatggagccagcatcagtaagagcaaacctgacaaaaagaacaagggcaaatcccaattaaaggttaaaatgggaggagtccataaagagaagaagtgttacttctgcaagtag

SEQ ID NO: 30260 - DNA, 789 bp, Glycine max
  Peptide Sequence Number=SeqID_147038
atgcatgagctcagcctttcacccctaaacagacggacagaccgaggcacgtccaatatcaaagcagttgatgacttccttgctaatcatgaagatgtgtttgataatttgaagaataagcttattaaggcacaagaaagtatgaagcactttgccgacaagcatcgcaaagacataacctttcaaattggagactgggttttcgtcaagcttcaccctcataggcaaatttcaactactggtgaatcatactctaagttagtcaaacgtttctatggatcgtaccaaatattgtggaagattgtcagtgtagcttacgaactccagttgcttgaaggctcccgcattcacccagtgttccactgttccattctcaaaccatgtcatcaaccatcccgatcagtagacactacagttgacttgccaccaacaacagttgatcatcaaccagttatttcacctcttgcaattctgaacactcgatgggattactctaagtattaccccaaattgatggttctggtccagtggaagggcctatctccttatgatactttgtgggaggaatatggtagtctcaaagttgaccaacaccttgaggacaacgtgttattcgatgagaggagggatgttatgaagggaataatacaactaccgtcaggcactacagacacaagcataatgcaacaaccaggcacgacaccaggcactacaggaacaagcacaagcagaaatcaaaggcccaaacaaaggatcactaaacctcgacacctaagggattttgtctaa

SEQ ID NO: 30261 - DNA, 267 bp, Glycine max
  Peptide Sequence Number=SeqID_147039
atggctgagcccacccgtttgaaatcaaacatggagtgcatcgaggaagccattgctaagctggctttgaaccaacttaacttcaccaccaaacgtgatgagcttttccagcgaatgaccatccttgaacccactgggacccttttcaagctgactcaacatggttcggctggccttaggcatgcactgcaaagtgcaagcactctaaccattaatcctggtccaagcggcagctctggcacaactctaagagaagaagttgcatga

SEQ ID NO: 30262 - DNA, 381 bp, Glycine max
  Peptide Sequence Number=SeqID_147040
atggaaagtgacaatttcaaaaaatggctcaatgctatgaaagaagagttgaaatcaatggatgacaataatgtttgggatctagttgagtttcctaaagcaagactagttgctaaaggtttcattcaaaaagatgacattgactacaaagagaccttttctcctgtttctaagaaggactctttgagtattgtgttggctttggtgactcattatgatttagagcttcaccaaatggatgtaaacaccacctttctgaatggtgatttagaggaagaagtttatatggatcaatctaaagggtttgtttctacaagaagggaaaatctagtgtgtaaattaaagaggtcaatatatggactaaaacaaacttccagataa

SEQ ID NO: 30263 - DNA, 615 bp, Glycine max
  Peptide Sequence Number=SeqID_147041
atgaacacatgccgcaacgttggatttgtctctgatgatgttggtcttgatccagacaaatgcaaggtgttggtcaacattgagcagcagagccctgatattgctcagggagtgcatggccacttcaccaagcgcccagaagaagttggtgccggtgacagggagcatgttatcaagcctgtgattcctgagaagtacttggatgacaagaccatcttccaccttaacccttctggtagatttgtcattggtggccctcatggtgatgctggtcttaccggaagaaagattatcattgatacttattgtggctggggtgcacatggaggtggtgctttctcaggaaaggaccctactaaggttgatagaagtggtgcctatgttgcaaggcagcagcaaagatttggaactggaaagattccagacaaggagattcttcagcttgtgaagaagaattttgactttaggcctgggatgatcaccattaacttggaccttaagaggggtggccataggttcctcaagacagctgcctatggacactttggaagggaggatccagacttcacctgggaagttgttaagccactcaagtgggacaagcctcaagcttaa

SEQ ID NO: 30264 - DNA, 339 bp, Glycine max
  Peptide Sequence Number=SeqID_147042
atggagaaacttactctggctatgcaaatgcttattccgccattgaaggataaggcgattggaagtgctgggaatttgaactctaagggtggttcttttgaggttggagtggaaggaggcaaaagagattggaagaaaattgagggtgaggatgatcaaaaagggaaaattgtgactgtggatgttccaattgctaacataagtgaaaacaaggatgtgtatgcagtagctgaatctgatcctatagcctcaacatccgaaccaacttcagccaaagctctgaacgaaaaagatgaacgaagcagcggaaaaatggagatgaaggctctgataccatga

SEQ ID NO: 30265 - DNA, 1611 bp, Glycine max
  Peptide Sequence Number=SeqID_147043
agtcgcacagatcgaattgtttttaagctcttcggtaaagagccaaatgattttcctcttgtacttagagcacagattcttgactggttatctcacagtcctactgatatggagagctacatacggcctggttgtattgttttgaccatttatctgcgtcaggctgaggcgttgtgggaggaactttgctatgatctgacttccagtttgaataggctgttggatgtctcagatgatactttttggagaaatggatgggttcacatcagggtgcagcatcagatggccttcatttttaatggtcaagttgtcatagatacctccttacctttcagaagtaacaattatagcaagattttgactgttagtccaattgctgtaccagcatcaaagagagctcaattttctgttaaggggaaatatctggtctgtgaagatgatcatatgtcaatggatcaatgctccaaagaacctgatgaacttcagtgcgtccagttttcatgttctgtccctgtgatgaatggaagaggatttattgagattgaggaccagggtttgagtagcagcttttttcctttcattgttgtggaggaggatgtttgctcagaaatctgtacacttgagcctcttctagaattaagtgaaactgatccagatattgaagggacaggaaaaatcaaagccaaaaatcaagccatggattttattcatgaaatgggttggcttcttcacagaagccagttgaaattaaggatggtttctagtgtggatctctttccattgaaacggttcaagtggcttattgagttttccatggatcatgattggtgtgcagcagtgagaaaactgttgaacctactgtttgatggaactgtaaatacaggagatcatccttccttgtatcttgcgctttcagagatgggtctccttcacaaagctgtaaggagaaatagcaagcatttagtggagttgcttttgagatatgttcctgagaatatttctgataaactaggacctgaagagaaggcactggttgatggagagaatcagaccttcttgtttagacctgatgttgatggtactgctggtttgacaccactccatatagcagccgggaaagatggttctgaggatgtacttgatgctttgactaatgatccttgcatggttggaattgaagcgtggaaaaatgctcgtgacagcacaggttcgacacctgaggattatgcccgtttacgtggccattatgcttacattcacttggtgcagaaaaaaattaacaagaaacaaggagcagctcatgtggtggttgagattccaagcaatatgacagagaacaatacaaacaagaagcaaaatgagttatccactatctttgagattggaaagcctgaagtaaggcgtggccaagggcactgtaagctttgtgacaacagaatttcttgcagaactgcagtaggcaggtctatggtatacagacctgcaatgctctcaatggtggcaatagcggcagtctgtgtctgtgtggcccttctgtttaaaagctcacctgaagtcatatgtatgttccgacccttcagatgggaaaatttggactttggaacaagctaa

SEQ ID NO: 30266 - DNA, 255 bp, Glycine max
  Peptide Sequence Number=SeqID_147044
atgtctcacaggcaaccttgctgtcaggatcctgttcaaggcaggcatcgagcactgcatcagagatatggtcgcacgcacagcttgtcagggagtccctcgttgacagattcagagacgccaagtaacgccgcgcgtgaccagctaccggaagctgtgatcatcgaagtactgtcgccgttagatttgacggccaaacgaagggacgcgatttgtcaaggttggtgcgcgagtgagagacaaataattgcgtaa

SEQ ID NO: 30267 - DNA, 960 bp, Glycine max
  Peptide Sequence Number=SeqID_147045
atggttctacacatgcatgtaatgctctgttgctttgttctaattgtctcatctgcctccgcatctttgaaggtggatttctacaaaactacgtgtccatctgcggaggcaatagtgagaagagctgtaaacaaagctgtttctctcaacccgggcatcgctgctggtttgatcagaatgcactttcatgattgttttgtcaggggttgtgatggttctgtactattagaatccacagcgggtaacccatcagagagagagcaccctgccaacaacccaagcttgcgtggcttcgaagtgatcgatgaggccaaggcccaaatagaggcagagtgtcctcacactgtgtcctgttctgacattcttgcttttgctgctagagacagcaccaacagagtcggaggcataaactatgtagtaccagctggacgcagagatggtcgtgtctctatcagagacgaagcgtcacaactgcctcgtccaacattcaacacacaacaactcattagtaactttgaacaaaaagggttgtctgcagatgaaatggtgacactgtctggagcacattctattggtgtctcgcactgttcctccttctccgaccgcttgtactctttcaatgccacgtttcctcaagacccttctatggatcccaagtttgctacgtcgttgaaaaccaagtgtctgcctcggagtgataacacagtggtgcttgatgcttccacgcctaaccgtttggacaacaactactacgcactgctaaagaaccagcgtggtttgttgacctcagatcagacgttgttgaccagcccctcaacgagaccaatggttctaaccaatgctaaacatggttcaaaatgggcacgtaagtttgctaaggcaatggtgcatatgggttccatccaagtgctaactggctcacaaggcgagatcaggacccgctgtagcgtcgttaattaa

SEQ ID NO: 30268 - DNA, 564 bp, Glycine max
  Peptide Sequence Number=SeqID_147046
atgtctattacaacaacacaagctttgacccccttgtcgtcatcacgtaaaagtagaagtagaaccacatttggcgccaattccacctccacaagcttccccgctactccactctcctccaatctcctcctcttcaagctcagtcacacttcttccaaacgaacctcaaccaccttccatgccttcaagcgcttttcccccgtcatggagtggcaggattgcacggttaagatggagattgatgtgcccatctctgtagcctatacttgttattctgatcgcgaagccatcccaaactggatgccctttatttcttctgttaagcatcataaaatatctgggtatattttgggacctaataaatttcaagggatagaatctatccgtcaagctatttcaagcaagcgagcagaatacacctttaggcactttgaagtgaacccattccaaatcagaaaatccactggcgatctatggaaggtcttcaaaacagttcaacattgtgtgaagatatttgagatgtatgacagcaaagaaaagttcagatgcacgtttctttgttga

SEQ ID NO: 30269 - DNA, 264 bp, Glycine max
  Peptide Sequence Number=SeqID_147047
atgactggttcaagtttcataacactggacttgagtgatgtgagaagcctacgttgcaacgttttggatagacgactgatagcatgtcttttgaaaaaattggtgaacgaaaagaaatggtatgatagaggactatccaaggaggaaaagtttggcttaagtgggctcaacatggataaaccaatcaatggagcaaagagtatgtcttctacaagtggagatgctactccatcatctccaaaaaccgtaaggctcatggcatag

SEQ ID NO: 30270 - DNA, 348 bp, Glycine max
  Peptide Sequence Number=SeqID_147048
atgggtgaagtagaggaggtgcaagagcagatgaaagtcgacacagaggccttgaaagagcaaatggccacaatgatggaggccatgatgagcataaaggagataatggaggtcaatatggctgcagttgccactgtctgcacggtttctaggatggacccgactcccccatctggcctcaacctaataaatcgtccaacctcagatacgagcggccctcattttgtgcaagtcctgaacaagcatgttttcctgccatatggtttgcctcctaactatactccacccaatgagaatgtcaataactctactcctatactcgttgagagccaatcatccccaaactga

SEQ ID NO: 30271 - DNA, 8224 bp, Glycine max
  Peptide Sequence Number=SeqID_147049
ccatagccatagccaccgagaacctcacttcgaatgacactctacgacgtcgtttcaagaacccgcagccaagggcgttaatggttgtgactgtgccgaatttgattcgattcgattcggtggatcgccgtggctcgtttttagtgactgcggtggttaccgtggggagcaagaacggggtggatcggaaaatggaccggaacaagaaccgtaccgatctactcgcagctggcaagaaaaggctccaacaatttcgtcagaagaaggatggtaaaggtggtagtagccgtggaaaatcatcaaaacaagctggtaaacctcagctaccggaccctgattctgatgctgcaagtagtgcctcaatttcaacggtatcatctcaaattactgatggaaatgttgaagctgacagccactccaatatggttaatacagaatcatcagagtcacagtctgtgacaaactcattagctcctgacaatactgatccatctgttgattcatcatcagtggtcactacatatgatacaggcaatgaaactgtattggactctaatgctgaggtagcacatcaagttcatggggtctgtgagaatgattctgagttatccgcccaagatcaaggggaaattgctcaagacattggtgctgatgtgctagaggatgtgtctttgagaacttcagatagcctggtttctgaaggtggagcaacacatgatcgtgaatctgtaactgttgccgttttgtccccacctgcttctgttacaactgcagtgggtgagagtgttacagatgaacgagaaggtgaaaagagggaggaattgttgcttttatctgaggatatacccaatacatctgtgatgcaaacaagggaagatcaggaagctgatggtttggacatgaagaaatcttatcaaagcactgatcctgtgattgatggtcaaaaggagctttctttgtctgaggttggtgagagtgaccagtctctttcgggaattgctttggagaagattagagttgaggaggcatctcatgaagctgagcaactacgcaagtcaattgaattactctcctctcagtttctgctcgaggcaagaggagcagtctctgatttggatcctttagccagtagttcagttctatcagacaatgacatttcagaagcatttcagagtctcaaagaagaattgtttcttgcaaatttaatgaaaaatatatttaacactcaactagctgaacaactggagtctgatgatcagcgtcaccagttggttgatgaaatatctcagcttcatgcttctcataataaagtaaatgacaagaatcaacaacttactgaagaacttgctaattgccatgttgaactacatgatatttctagcaagaacgtagaagtacaaaatcaatttaatgctgccatggctgaggtggaagcactttctgtcagagtgattgagctgcagaatagttttgatgtgtcccacaaagattcgttggaattgtccagagagttggctgactgcagaggcttgatctcaagtttacaggtggaaaagaagggcatgaatgaaactcttaatttgatgattgctgagaaaaataaacttgtggaggagaaggaatttcatctatgtgaaagtaagaatctggcaactgaattggctgacttcaagagtttgatggaaggagtaagagttgagaattccaacttaattgacaggatctctttggtgactgaagagaggaataagattgaagcagaaattgagcatctcaaacatgagattgacagactgtcattagatttggttgaaaataaagatttggtggcaagtctagaggcagaaaattccaacttaaatcgtaaccttgcattgtcagctgataagattaaaaatcttgaagatgagaatcaaagacactcttctgaaatcattgccctaaatgagcaattgtctacagaaaaggcggaacgaatgaggtttgaaggtgaccttaaagaagccacagtgcacttggaacaaatttccaaggaaaatgtgtttctcaatgacactttggataagcaaaaggccaagatagaagaaattggaaaggagcacagccaaccactatctcaacctagggaccttggaaatcaagctcatgttgcacgtacacaaagtaagggccttgaaattgctattgctaacgattctctgcatatggatcaggagccagatgaaggggcactaggaggaccacatgtgaatatacttgagcatgaagtctttgatgattctcatgggtttgtttcattgaaagcttgctcggatgaggtagagaaagttctggtgaagcttgaaaaggcaattgatgtgttgcattctcaatcagtatcctccagcagggccggtgaaaaagtttcttcgcctgtggtttcgaaattgatacaggcttttgaatcaaaagtacaagaagatgagcatgagacagaaagtagggattccagtgatgttctgtcatcatcaaactcatttattatgttaactaaagagcaaattggagatttgaaaaaattgctttcaaagtggaagctgaatgttcagattgcaggtacattattcaatggggagcgagatgatcggaaaactggtgatgcaaagtacagtgatctcaaggaccagtttgaacaattgaagcaacattgctcagatttggaagcatccaacattgaacttgcagttcaatatgaaactgcaaagcaacttctgggtgatattcaagaaaagaaatgccttcttgaggaattctatgatgctttaaagcaagaagatacccatctcaaagccaaaaataatgaactttatgagaagcttggctattgtcagtccaaaattagtgaattgcatactgaaatgaatgatgtgaaacaaatttcaaatgatatggcttctactgttggcagtcaactggaaaatttgcagaaggaggtgacagagagggcaatgctacttgagcaaggctggaatatgactattgcccagattgttgagttagttgggaagctgaaagaatcagttggtgaaactttgtgcacaactgtttcttctgatgcttatggcaacttggatatctgtcatcagttagaagtttcagttaatgcagccgctgaaatgatttttgatctgcagaagaaacttgaagctacttattcggaacatgaaataatgtgcacatcatataaagaaatgaattcaaaatgtgatgatctgcttgggaggaatgaattggctgttagtctattgcataagatgtacagtgacctgaggaaacttgtgtttagtaatggtgggactatggatgaagataagatagatttacaaagtgaagtgctgcctgatctgctgaactataatagctatcaacccatcttgaaacatattgggaatatattgaccgagaagctggaacttgagtctgttaccaaggagattaagtcagaattgatgcacagggaaacagaattggaagaattgaagatgaagtgccttggtttagattctgttagtaagctaatagaagatgtcaaaaccagagacactgaaatccagtatcacacgactaaagaaggatatggatctaaggagatggaattggctgaattgaaggaaaaaatgcattttctagacacacttcgtcttgagaatgaaaatgaaatccttgttctgaaggaaagcttacatcaggctgaggaagctcttactgttgctcattctgaattgcacaagaaagcaaatgaacttgagcattcagaacagcgggtgtcctccattcgggaaaaacttagcatagctgttgccaaggggaaagggttggttgtacagcgagatggactcaagcaatccctggcagagacatccagtgaattggagagatgcttgcaagagttacagttgaaagatacaaggcttcatgaggttgaaacgaaagttaagacatatgcagaggctggtgagcgtgttgaagctctggaatctgagctttcttatatccgtaattcatctaatgctttgagagagtcatttcttcttaaagattcaatgcttcagaggatagaagagatattggaagacctagatctgccagagcagtttcattcaagagatataattgaaaagattgattggttggctagttcagtttcagcaaactcattgccaattaatgattgggaacagaaggaagctatgggaggaggctcatactctgatgctggttatgttgtcacggattcatggaaagatgatagtcagctacgaccagattcagatgattttagaaaaaaatttgaggagttgcagagtaagtattatgggttggctgagcaaaatgaaatgctggagcaatcattgatggaaagaaacagcttagttcagagatgggaagagcttgtaaatagggttgaaatgccttcacatttgcagtctatggagacggaggataagattgaatgtataggcagtgcgcttactgaggctaatcatcatatagattctatgcagctgaagattgaaaaatatgatagctactgtggattgctaaatgccgatctggaagagtctcaaaggacagtgtctgctcttcaagaagaccttagtgctcttacatctgaaagagagcatctttctgagaaaatggagtctttggtgtatgagtatgagaaactatcattgcagacaagggaggctgaacttgagaatggaaagctgcatgatgaaataactagtttgaaggataaattggaacacaaaactgcaattgaagaacaaattttcactattgaaggcaagatcagaaagttgcgagacttggttggtgatgccttgtcggaatctgaaacagaaaatatggtttccggtagtgcaaatattgattccttggaagaattgctggaaaagcttgtagaaaagctgaacatggaaaggaaaccatcagcacagacaagagaagctgaacttgagaatgaaaagctgcatactgaaatttctagtttgaaggataaattggaacagaaagctgcaattgaagaacaaattttcaccattgatggtaaaatcagaaaattacaagacttagttggtgatgccttgtcagtacctgaaacagaaaatctggtttcttgtagtgcaaatattgattccttggaagaattgctgagaaagcttatagaaaatcatgcaaagctttcattaatgaaacctgcatatggggttgtaggtgatggactccattctcaaaaggaggatgctacacttctcgaggaaagaagtatggatgtgcatgataaggaggcggcagatattgacatatataaaagagatctggaggagtcttcaaatgaattgatgcatgtgaaggaggagagaaatagatctttggaaaagcaaatatctttatcaggtgaagttgaagctctgacaaaaagaattgaggaattgcaagggcttcttaatcaggaggagcagaaatcagcttcttttagagaggagttagcaagtgaagttgaaactctgacaaaaagaaatgaggaattgcaagggcttcttaatcaggaggagcaaaaatcagcttctgttagggagaagttatcaggtgaagttgaaactctgactaaaagaattgatgaattgctagggcttcttaatcaggaggagcagaaatcagcttcttttagagagaagttaaatgttgcagtaaggaaagggaagtcattggtgcaacaacgagacagtctaaagcaaaccattaaagatatgactgttgagatggagcacttgaaatctgagataaacaaccgggaaaacactcttggagagcaagaacagaagttgagacagttgtcaacctacccagataggttagaagctcttgaatctgagagtttgcttctgaagaaacatttggaagaaactgagcaccatttgcaggaccaagaatattctttgaaactgattttgaacaagttgggtgagattgaggttggcggtgaaggtcatataagtgatccagtgaagaaattggaattggttgggaagttattttctgatctacatagtgctgtggcatctttagaacaagaatccaggaagtctaaaagagcatcagaactcctcttggcagagttaaatgaggttcaagaaaggaatgatagttttcaggaggagctcgcaaaggtgactgctgaacttgtggatctcagaagagaaagggattcagctgaggctgccaaactggaagcggttgcacatcttgaggaggggaaaaagagccatttttctgacatcatggaattaaaatctagtatgaaccaagtctgcaaaagctttggtgaggttcagaatttactgtgtaatgcttttttcatggatttggaatcttatcggaaagtggaggctggtcttgagtcatgtatgaaaggaaacaatgataaaaatgtggtggattcatccatcaccaaagaacatgatggcattttacactgctcatctgctaataagaagagctctgtgtctgcagatccttggtcagattttgacagaattgaccactatgatgataatactatagttgaaatttctcgtctatttgggcatcaactgcaagagctcatggtggaggagacggacaaaactctatctaaactaatagcaagtattcaaagggaaatgacttcccaaaaagaggcgtgtgaaacgatgaagaaagaagtaagtgagcgagatggggaacttgctgtattacgtgggaacgttgcctatctttatgaagcatgcattaattctgtcattgtacttgaaaatggaaaagctgaactggttggaaggaaggttgaatcttcagatctgggaattaacttggaaataccttcatttgatgatggcatatctgaggaatgtattaaaaccctgacagatagattgctgttgagtgcaaaagggtttgctagtttaaaaactgaatttttagatgccaatcaaaaagaaatgaaggctactataacaaatttgcagagagagcttcaggagaaggatgttcaaagagataggatttgctcagaactggtgaaacagatcaaggatgctgaagctgctgcaaacagttactctcaagatcttcaagcttttagtcttcaagaacataatataaagaaagaggtggaagcaattgaggcagaaaggaagatactggaacagagagtgaatgaactgcaggatagacaagaaaccgcagctgaattagaggagaaaatgagatctcaaactggtttactggctgccaaagatcaagaaatcgaagcactaatgcatgcacttgatgaggaagaaacgcagatggaagaattaacaaataagattgtggatcttgaaacggtagttcaacaaaagaatcaagagattgagaaccttggatcttcccgtggtaaggttatgaaaaagctttccataactgttagtaagtttgatgagcttcaccacctgtctgcaagtctcctttctgaggttgaaaagctccaatcccagttgctagaaagagatactgaaatttctttcttgaggcaagaggttactagatgcactaatgatgctcttcttgcatcacaaatgagcaaccagagttctgatgagatctttgagttcttgatgtgggttgacacaattgtgtctcatgatggggtgcatgatatacatcctgatatgaagagcaacagtaaggttcatgaatgcaaagaaatacttcataagaagcttacgtctttattgtcagaattggagaatctaagggaagttgcagaaagcaaggatgcaatgttgcaaatagaaaggagtaaggtagaagaattgaactgcaaaacagaaactcttgagacatccttacatgagaaagaattgcaattgaatttgcttgaaggtgtggaagaaactggaaagggagctggcacaagctcagaaattgtggagatgaatgattggtcgtcatctggtgcttttgtaacaccccaagttcgcagtttgcgcaaaggcaatagtgatcatgttgccattgctgtagatgtagaccctggtagtactagtaggatagaagatgaagaggacgacaaagtccatggtttcaaatccctcacaacatccagaattgtcccaagatttactagaccgttgactgacttgattgatggcttgtg

SEQ ID NO: 30272 - DNA, 219 bp, Glycine max
  Peptide Sequence Number=SeqID_147050
atgctcaagagtgaatcagaaccatggtcatggtgtaaaatgtggtatttatggtgccaattctgcagaatgaattatgagcatgcaggtgttggggctatagagtttattatatgccattcagaggtctcaattgcacttgcggaagagaagaagatacctgagctattcaagacatttccaaatgcaacaaagtatctcaagagtaagttttgttga

SEQ ID NO: 30273 - DNA, 240 bp, Glycine max
  Peptide Sequence Number=SeqID_147051
atggtcttggtggatagagcagatgccacgcccatcactaacgatcaccatcagtattattacattccttggggatttatgtctcaccgaaaattggagaggtttgaagacatcagtttttatctgggtatggaagtcactaaggaccaaggaggtcacatcagcatgatgcccgaggaggaggaagtgtatcgcgagcttctacgagatttagagccttcatttaaggaggatgattga

SEQ ID NO: 30274 - DNA, 318 bp, Glycine max
  Peptide Sequence Number=SeqID_147052
atgagcaagcaggttgaaaccattacgaagtaccctcaacgctttcacgatgttgggccaaacataagaagagaccatctgcgagacaccccatcctttgcccatcatgggaaacaatcagaggaaaagggagggcttcaagaagaagaagaggtcatgaccacctttaggagggtggttttcacaaaggttatttgcgagacagattgtttggaagcagtaaaagcaatccacgaggcgaattctgatatggcagacttgcatactcacagagatattctgagtgcaattcatgttgtgacttacagggaatggtag

SEQ ID NO: 30275 - DNA, 495 bp, Glycine max
  Peptide Sequence Number=SeqID_147053
atgacgaatcacaaggggtgccttacgcatgcagccagagcatggaaaagtgacgtcagaagcgtaacgtcatcaggaattcaatttccagatttaataatcgaaacagcgcatcgttttgctatggataataagaagagaggggcgagggagggtgaagatgaagatgagatgaagatggagaagttttacgcgctgttgaggaacttccgcgacgcccgtgatcgccggcgaagggagttggtggagttggaaaaacacgagagcaacatctggaagaagatgatgaagggcaccgccccaactgcaacgaaggacaataaggcagaagtttctttcgaatttcaggactttaccaccgagattcaattcagaaagccacctttggtttttcctaatccagtttcatcatgtgacactagcaaagacaacaacaaaggtaacaagaagaagaaacagcaggatcttgctctcgatctcaaactcgctctctag

SEQ ID NO: 30276 - DNA, 1423 bp, Glycine max
  Peptide Sequence Number=SeqID_147054
ctccaaccaaaacgacgacgtacagaaagtcttcggcatactcagtagcacctccacaccggaacagctgaaacaatccctcaaatcaagcggcgttttcctctccaacgacgtaatcgaccaagtcctgaaacgcgtccgcttcagccacggtaacccctcccaaaccctcgagtttttccgttacaccggcagaagaaaagggttttaccactcctcgttttccctcgacaccatgctctacatccttggcagaagccgcatgttcggccaagtttgggagctcctaatcgaagcgcgtcggaaggaccaaacggccataacggcgcgcaccgttatggtcgtgttgggcaggatcgccaaagtgtgttccgttaggcaaacggtggagtcgtttaggaagttcaggaagctggtgcaagagttcgatactaactgttttaacgctcttttgagaacgctgtgccaggagaagagcatggccgatgctagaaacgtgtatcatagtttgaagcataggtttcgtccaaatttgcagacttttaacattcttctttccgggtggaagacccctgaggatgctgacttgttctttaaggagatgaaggaaatgggagtgacgcctgatgttgttacgtacaatagtttgatggatgtttattgcaaggggagggaaattgagaaggcctataagatgcttgatgaaatgcgtgaccaggatttttcgccggatgtgatcacgtatacttgtatcatcggtggattggggttgattggacagcctgataaggctaggaatgttttgaaggagatgaaggagtatgggtgttaccctgatgctgcggcttacaatgctgccatcaggaacttttgcattgcaaagaggcttggtgatgctcatgggttggtggaggagatggtgaccaagggtttgagtccgaatgcaacgacttacaatttgttctttagggttttttactggtccaatgatttgcagagctcttggaacatgtaccagaggatgatggttgaggggtgccttccgaacacgcagtcttgtatgttcttgataaggttgtttaggaggcatgagaaggtggagatggcgctgcagttctggggtgacatggtggagaagggttttgggtcatatacattggtttctgatgtgctgtttgatttgctttgtgatatggggaagttggaggaagcagagaagtgtttcttggagatggttgagaaggggcagaagccaagtcatgtgtcgtttaggagaatcaaggttctcatggaactagcgaatagacatgaggcccttcagagcttgatgcagaaaatggccatgtttgggcgaccactccaagtggatcaaagtacggtgaacccagctgagacgtcagattctctctttactaaaagttag

SEQ ID NO: 30277 - DNA, 258 bp, Glycine max
  Peptide Sequence Number=SeqID_147055
atgacaaaaattgtctgcgcggaagatgacgtaaatctctgcgtgtcaataggcttgttggccgcgatcgacaaagggtatctctgcatgtcacgtgactccaatgtcagtatgacagaaattatctgcgtggaagatgacgtaaatctctgcgtgtcaacgggtttgttggccgcgattgacaaaggtgtcagtatgacagaaattgtgggggcggccgacaaaagcgaggctcttgctcctatgtatcctcaatga

SEQ ID NO: 30278 - DNA, 414 bp, Glycine max
  Peptide Sequence Number=SeqID_147056
atgacgaaggagatgtgggacctcattcaagtgcctcttgaatgtactccagaagttagaagagcaatgaaatattctctcattcaagagtccttccttggtgagtctcacttctccaaagactcgtcaaactcaaggtccgcccttggtgagtctcgcatctccaaagacctgttttcgtcaagacgcgaagaccttttacacaaaaccaatctagaatttgagatatgccccactctacacaaaaagcctcccaatgtcaacaatgtcacaaacctaaacaatagcggtgaagaacaaagaagcgaacttgttttcgtcaagatgcaaagagacaaacatgccaagtgtaagggagctaaagttgcagcgatgttagggttcactggaactaagaaagcgagggagttttga

SEQ ID NO: 30279 - DNA, 210 bp, Glycine max
  Peptide Sequence Number=SeqID_147057
atggccggagacgcgacatgcaatcgtaatggagacatcaaatgcgaccatggccgaagacgagaccatggccggaggtgttgcggtggtgacgaatgtggccatggaggagaggaagaagatagagaggaggagagggggaagcttctcgagaaaagaagaagagatgtgctggagacagagagattatcaagaaaagaagaaaactag

SEQ ID NO: 30280 - DNA, 348 bp, Glycine max
  Peptide Sequence Number=SeqID_147058
atggagaagaaagagaggggggaatattatgattcttttcttccattcttactcgaagcttgcaacgatgaatatcccgatgttcgacatgttcattgccccatcttggctgttatttatggtgttggtgtttgtgctgagtttggtggatctgttttcaacccccttgttggagaggcactttcaaggttagatgttgtgataaggcatccaaatgcactacatgctgataacataatagcatatgacaatgtcgtctcagctcttggaaaaatatgccaattccatcgtgatagcataaatgcagcacagagtatggttttgacttttatccagatggaatcctga

SEQ ID NO: 30281 - DNA, 621 bp, Glycine max
  Peptide Sequence Number=SeqID_147059
atgggtatctcattggaagcactaagtgccgcaacctttgaaaaacaaaacctttttcattcttatgttattcgagccttgaatcgttctcacgtttcacttgacggagaacaaaataaatccatgaatgttatatctctatatgtaatgaaacaaagaataattttgtgggaagaggatgctaaatcattgtgtgctaaaacagaacagtgctccgcatgtggttggaaggaggggggaacaagccgtggcgcttcgcatgatcgcatctcaggaaccaaagctggtttctatggaactcaagacactctctatgatcacaaaggccttcattacttcaacaactgctctattcaaggttctgttcttttcatcttcggttccgccaggtccctttacgagaattgctatctaaattccacaaccaagaaggtggcttccatcactgctcaaaaactgcatagcaacaggagagtatattatggagaatacaagtgtagtgggccaggagctaacttggctggaagtgtgccatgggcacgggtactgacggatgaagaggccaagccttttattggaatgcaattcattgaacgggacacttggcttgctagcccctaa

SEQ ID NO: 30282 - DNA, 804 bp, Glycine max
  Peptide Sequence Number=SeqID_147060
atgcctatcatgatgatgggatctgcaacaacatttatagactgtgatgagtgttggaaattgttgctggtaacaagaaacaaatctctttatttatgggatttattcaacaaaacatgtctccttcatgactcattggcttctcttattgcttcaagtcctaactcatctactaaagatgctgacactattaaagttttatatgcaaagctatcaaaatctggttctcctcttgtcgtttatgccacttgtcatgctttcttatttgacatgagtctcaagtgttggctaagggttgcaaatgactacttccctgcatcaagttttgccagctcttggtgtatgagattaattcaaagtggtgaacttgctgctttgcaggttgatgttagaaaatatttggcacgaaagccaggtgatggttgcatgtcattgttgaagaagagacattttggaattaggctgcatgttgttcaaaaaaggactccccaggtccttatttcatattctattggtaaagataatggggataggttttttttcatctaccagctcactgctatcactcaactagttcatcatggaatgatactcattccaatcggttacacattcaatgccgacatgtttgagatggagaaagtgaaaggtggaagtccatatggtgccagaacttacaccggtgacggctcaagacagccaagtgagcttgagttacaacaagtatccaccaagggaagtacattgccggcaacacaaagaagctcaagcaagctgcataatgttgccttgccttcatattag

SEQ ID NO: 30283 - DNA, 645 bp, Glycine max
  Peptide Sequence Number=SeqID_147061
atgaggaagtgcaaggaagagttcaaagagtttgagaggcaggatgtgaagtatcgagaggattttaagcacgtgaatcagaagatcaaaaagcttgaggataaagtagaaaaggtagagggaacccttataaaagagggtgaggaatcaactgttctgataccaaaacttgaggacaatatcccaaaattgcaaaagttgttgcttgatgaggataaggtcttagaagaaatcacagagagttccaaagttgaaactgagaaataccgctcagagcttgctaaagttcgtgctgagcttgaaccttgggaaaaagatttgattgagcacaatggaaaacttgaagttgcatcaaaatatgatgttgcaatatcaacagcatgtcatggacttgattatattgtggtggaaacaactaatgcagctcaagcatgtgttgagttacttcgtagagagaatcttggtgttgctactttcatgatattggagaagcaagttgatcttcttccgaagttgaaaaagaatgtaagcactccagagggggttccacgcttttttgatttagtgaaagttcaagatgaaagaataaagcttgctttctttgcggcacttagaaacactgtggttgctaaagatcttgactag

SEQ ID NO: 30284 - DNA, 339 bp, Glycine max
  Peptide Sequence Number=SeqID_147062
atggcggtagcagcaggaatcggttacagggtcacatgggggtgttttggtgcttgtcgtgagtgtggattcttcatggttaagcttttgcctattgaatttggaaagtgcattgaccttgtctttgtcccagatgcactgacctcgtctgtctttgtcccaaatgcaccggcattgtcccgatcattgactcaattacattcattggggttcaaactggtcaagaaccgtctttttcagcaacggcttactagtcccattcattgttgtcatggacataagtatatcccaactgttttcagcaaccgtctcatcagtttgaatggtaatgtattgtaa

SEQ ID NO: 30285 - DNA, 471 bp, Glycine max
  Peptide Sequence Number=SeqID_147063
atgaaaattgttgagctagagaagcgcctgattagcttgaattctggtgatgagaatgctgaagctgaagcatacaaggaaggaaatggatggatagatgcagttttaaaaggaatgaaaagatcatcaccaactgcattgaaaatagcattaagatcggttcgtgaaggaaggaatcaaacactacctgaatgcttaaaaaaggaattcagattaacaatgaatatactgcgaactacaatatctaaggatatgtatgagggtattagagctctcaccattgacaaggataatactccaaagcttttccatctgaagtgggaaccttcatcgcttgacaaagtagaggatggaaagttggacttgatctttcagccatttgagaagaatttggagctgcaaattccagaaagtgaggaatacaggtgggatggtaaatatgagaattcagcttatgctcttccaaattga

SEQ ID NO: 30286 - DNA, 1986 bp, Glycine max
  Peptide Sequence Number=SeqID_147064
atggcgaacgtgtccgtcgcggcggagtggcagctcctctacaaccgctactaccgcaagccggagctctaccctatgccgtggaagcacgtggacctcgcccgcaccaaggtcgccgccgcgcccttcggcggccccatcgccgtcatccgcgacgactccaagatcgtgcagctccacgctgagtccgccctccgtaagctccgcctcttctcctcctcgggccgccccctcgccgacgccgtctggcgccaccccggcggccgcctcgtcggaatgtcctggaccgacgaccagactctcctatgcgtcgtccaggacggcaccgtctaccgctatgacgtccacgccaacctaatcgaaccgaacctctccctcgggaaagagtgctttgaagataacgttgcggattgcgtgttttgggggaacggtttggtttgcatcaccgaggcgaatcagttgttctgtattgccgatttcaggaaccctagcgcggtgaagctcgcggatcccgagatcgaggaaatgccgcattgtatggccgtgattgagccgcagtacacggtatccgggaatgttgaggttttgctcggcgtggatgatgctgtggtgcttgctgtggaggaagatggcgtgcagaggctcggggagggagtgctgcgggggccgctgcagaagatggtggtttcgcgcgacggcaagtggctcgcgtcgtttactcacgacgggaggctcttggtgacgacttcggacttgactggagttatcatcgagagggagtgtgagtcagctcttcctccgcagcagattgcttggtgtggaatggatgctgtgctgctgtactgggatgatatgcttttaatgatgagtcctgagggagagccagttcactacctttttgatgaaccaataattcttatacctgagtgtgatggagtaaggatattgtccaatactagaatggaatttctacagcgggtgcctgattccaccgtttcaatcttcacaattggaagtacatcacctgctgctttactatatgatgccttggatcattttgatagacgaagtgccaaggcagatgaaaatttgagattgataagatcatcccttcctgaggctgttgaagcatgtgttgatgctgcaggtcatgaatttgatctttcacgccagcaaactctcctaagggcagccagttatgggcaagccttttgtagcaattttcaacgtgatcgtatccaagagatgtgtaaaattctgcgggtcttgaatgcagtgcgcagccctgagattggcgttcctcttagtattcagcaatacaagttgcttacaccatctgttctgattggtcgcctgattaatgctcaccaacatctgcttgcactgaaaatatcagaatatcttggaatgaatcaagaggtggtgataatgcactgggcatgttcaaagataactgcttcactggcaattcctgatgcgactcttctggagattctgctggataagttaaaactgtgcaaaggcatatcctatgcagcagttgctgctcatgcagacaaaaatggccgacgaaagttatctgccttgcttgttgaacatgagcctcgttcatcgaaacaggttcctctcctgttaagcattggagaagaagatatagccttgatgaaggcaaccgaatgtggtgatacagatcttgtttaccttgtactttttcatatttggcaaaagaggcagccattggagttctttggcaccatacaggccagaccattggcacgggacttatttataacttatgcacggtatgtggccttgaaccatattccagaaggcaagacagtgtggctcttcctgaagtttaggaggcaacagaccgggcctaattcactccctaaagctagctcaagggaggaggattgttcaagtcttataacaagtatcctggccatattaatatccacattcggagttataagattggcttag

SEQ ID NO: 30287 - DNA, 696 bp, Glycine max
  Peptide Sequence Number=SeqID_147065
atggtacggtgcctcttgactaagagtggcgtttcaaaaggattttggcttgaagctgttaattggagtgtgcacattctaaatagaagtcctatatttgctgtgaaaaatatgacaccagaggaggcatggagcggaagaaaaccaacaatggacttgttcaagatatttggatgcatttctcattaccagtcctacattagtcgtgatgttgtttttgatgaagaaggattttgggaaaataacatagatgaaacaaagcaaattcttgcaaactttgatgaaaataatgaagatgaagagttgcagacaagggagctagaagaacaacaaattccagcaatcacagttgaagatgaaagacctcaacgagcaagaagaaggcctgcatggatgtctgattatgagattgtgaccctacaacctttgaaagtttcgtcaaagaagaaaaatggagaaaaaaatgatacttgggagttgtatgatcttccaaatggacataataccataggagtgagatggattttcaaaacaaaactgaaagaaaacggtgaagtggataaatataagacacgcttggtggccaagggttacaagcaacattatggggttgattacacagaagtgttttcaccagttgcaagacatgatacaatcaggaacaagtatttatcgatcaaccccctggttatgtga

SEQ ID NO: 30288 - DNA, 255 bp, Glycine max
  Peptide Sequence Number=SeqID_147066
atggcaccaagttctgcagtgccagatgaacagctacctaccaccaatgtagagtttctgcaatttttattcgaacaagataagatggttgttgttggagaggagattgagcatgtaagagtggtcactttgaacaggccaaggcaattgaatgccatctcaccagaactggtttctcagctagcaacatatttggaaaagtgggagaaggatgagaaagcagaactagttattataaaggttgtgtttacttaa

SEQ ID NO: 30289 - DNA, 390 bp, Glycine max
  Peptide Sequence Number=SeqID_147067
atggagttggaatattgggacaagaatccctttaaagccacaacaaaggccttcactcctgaattccatttcaaaccaatagccaacaataaaacaagaaaattttatgagttcattttaatagattcaaactcgagacatgcctttgttaagtggtggaaccaatttgacacaacaaaagcagagccagacaagaagtccaagctagtagccttcctagcaggatctaagtctaaggatcatctaaccaaggacttaaaagaggttctacaattacttcgaagccaagaagaaagagagtcttcgtcaaagaaagtagatgccagctcttcgaactattcagaagatttctaccagctcttcaaactattcagaagatttctaccataa

SEQ ID NO: 30290 - DNA, 288 bp, Glycine max
  Peptide Sequence Number=SeqID_147068
atggaaggttcccaacaaaacactcactatcctaaggaaaaattgcctaaaattattacacacaaatggaagtttggtaacctattggaggctcccaacacacttccaatgaaaggcctttttgttacaaaacttgaaagcaatgaagctcttaaggaggttggtcccttgcttcttgactcaaattcttcaagggatgacatcaatcctcatttccaattccctatatggcaactcacaaacaaggaaacaaagagacaagcaataaccaaagaccaaaaagaatga

SEQ ID NO: 30291 - DNA, 729 bp, Glycine max
  Peptide Sequence Number=SeqID_147069
atggagtggtgcgaaaaattacacgatacaaatgaattaataccttgtgtcgtgaatgattacatagaagcagctaaggaactaacatgtgagcttcttgatctggtggcggagggtttgtgggtccaagacaaattctcactcagcaagctcatcagagacgttcatagtgactcacttctaaggatcaatcaataccctcccgtgagcctaaagggcaccaagaattgggacacgtccaaagttgaggcacgtcaaatccagagccaaaataataacaacaacaacaacaacaacattggctttggagagcattctgaccctcagatcttgaccatcatgcggtccaacaacgttgatggccttcagatttccacccacgatggcttgtggatccctgtcccccctgaccccaatgaattcttcgttatggttggcgatgccttgcaggttttgacaaatggaaggtttgcaagcgtgagacacagggtgttgacgaacacaacaaaggccagaatgtcaatgatgtactttgcagcaccaccgctgaataggtggatcactccactgccaatgatggtgacaccccacaatccaagtctctataagccctttacgtgggcccaatacaagcaagcagcatactctctaagattgggagacgctcgccttgacctcttcaagatccaacgacaacaagatacccatctcgcacctgcttctccctga

SEQ ID NO: 30292 - DNA, 453 bp, Glycine max
  Peptide Sequence Number=SeqID_147070
atggttgccccttgtccaacatccatgatggtaagaaccaagaaaacaaaggccatgggagttccgacgatagacctttccctggaaagatcgaagttggcagaactagtggtgaaagcatgtgaggaatacggtttcttcaaggtggtgaatcacagtgtgccaaaggaggttattgcaagattggaagaggagggaaaggagtttttctccaaaacctcctcggagaagcgccaagctggccctgccaatccttttggctatggctgcagaaatattggccccaatggtgatatgggtcacctcgagtatctcctccttcataccaatcctctttctatatctgagagatccaaaaccatagcaaaagaccctactaagttcagagagagaggtagagcccgggggggatgtagggtagggaacaagcccttatctgtttgtgtttcttaa

SEQ ID NO: 30293 - DNA, 195 bp, Glycine max
  Peptide Sequence Number=SeqID_147071
atgaagattgctcagttacaacattcattatctcaacagcatgagcaattacaacagcagggtgcagaaggcctaaagacatacgggattgacaaattgatccaagttgctgcatctcagttgagtgaccagctcccagaattatataaaatcaatatagaatatagaccatttagtttcagaacatggttttaa

SEQ ID NO: 30294 - DNA, 289 bp, Glycine max
  Peptide Sequence Number=SeqID_147072
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagtt

SEQ ID NO: 30295 - DNA, 906 bp, Glycine max
  Peptide Sequence Number=SeqID_147073
acgcaaagaggggataatatgcaataccttgttgcatctggttcctcttcctttattgagggttattcgtatagtctcctccgccacagttatcctctccccagaattcgcaaattgagtttgcttaagcctcactgttctcagagacagcagagccgaagaagcctgagaacttcatgggcttcagtgtcacttacactttttggcactggcttcttacttggtccccttctcgatggactccattcaagggtcaatctcgttgtgtacgaatctggctccattgatattggtccactccacacaaacatatgggttcctttcttgctggggttattttattcctctgttggtttgcttcaactctacctagacgaaaaggtcttgaacaaggttcaagaagcaagtttagcaaaaacaattgtctcactaatattgttggcgctgtttatagaactgagtgctgacctctacaaagccggaatatcgaacaacattgaagcctacattttatttgctgctgcagaatttatatggtttttcttggataggacatggctaggtttcaccttggcatgcattgttgggcttggttgcccactagctgaggttccaattatgaagttgttccacctttggtactatcctcaagcgaatattgaaatatttggccagaaccagatcggagtcgaggtatataaccctctcgacgcagggttcgaggaggtcagtgaggtaatttttgacggaggtagagatcaagttgcggacgatctttggatcgaagtaataggccttgaagttcaattgcgagaaggtggatttgacgagggattcgaggttggtttcgaaaatgaggaagtggaagaagatgttctccaggcactgggagtgttggaggattga

SEQ ID NO: 30296 - DNA, 147 bp, Glycine max
  Peptide Sequence Number=SeqID_147074
atggctaaggtgtcggtagaaggagcagcaagtttaaagcaagatgtccccacaaaaggaggacaagggtggggtcaagatgcggtttgggagataaatgagggagcgttggctttaaggaaagggaaagggaacatgcccatgtga

SEQ ID NO: 30297 - DNA, 576 bp, Glycine max
  Peptide Sequence Number=SeqID_147075
atgaaaataactccagaagttatcaaagatatatcattcacaatttttgaacgagtcaccaagaatgcagtgtgtggactttgggcatggcgttcaaagcttaatctggttggtggtcatattaatgttttcacaggtgaatggacacaaaaggatgctgggataggaactagtattgactctttttatgagtatctgttgaaggcgtatttattatttggagatgagcagtatttatatatattccaagaagcttatgctgctgccatgcattatctttaccatgacccttgtttgaaactcggatttgtgtttatgcttcaagctggagatatcaatcctgcaattcgcactcatgctgccttcttgagtgtctggagaagatatggttttacccctgagagctttaatcttgctagtctcagtgttcagagagaaaataggaaaatatcctccaatgtcaggatggaaagggaacttcagaaatcaacaacacaacaatgctgcccagtctatatcagaaataacgagtcactcttgaaaaagcacaagcaggactgtgaagagaagcaatga

SEQ ID NO: 30298 - DNA, 456 bp, Glycine max
  Peptide Sequence Number=SeqID_147076
atgggccatacaagtgagtacatattcagcactgaaggtcatttactgcctgctactcctcaaatctccttactgagggaacattgtttatactatggggcttattgtagaagtggtgatttgagacaaacttactttgtgccagagtctaacaaagataagaaagaatccaatgatgctggactaaagctacatattcttcggactactctacttttgagccaagtgccgtttcagggtttctgcccaggattaaatcatggacagaagtttggtatattatatgcgtattcaactgatgaacaacatgattatgaaaccaagcaagtccaacagaaagaattaactactgtgcaactgcaaagccattcagtattggttcttcgtgaccagagttctgcccatttgctaccagaagacaatagcagtgatcataatgatagtcagacacattaa

SEQ ID NO: 30299 - DNA, 759 bp, Glycine max
  Peptide Sequence Number=SeqID_147077
atgttgggtaaattgatgtacttagtgctagctaaatctctcaaaacacaatatgtttttcagggtccacaggctagaagcatgatacaatttatgtcattgtacatcatactcagaatgacccataagcagctgtataatctaatgataaaagttggccaagcagtacttccacatgtgtttcagacttgtagtgcaacaagcttgccttttgcttgtgtttctaatgccttgaataaacctaagcctcttaatttagacgtgtccttgccttctattcatgatattagatggagcttagcacggttgttatacttatttaacatccagcttgaaagaaatgttgccacgttctttgtggtgctccttttagcgtgcttctcatttgttgtcattggtggtctcctgttctttaagttcaggggtaacaaaaattctctggaagattgtttctgggaagcctgggcatgtctttgttcatcgtctactcacttaaaacaagcaacacgtgttgagcgtgttattggctttcttcttgcaatatggggtatattgttttactctcgacttctaagtacgatgactgaacaatttagggcacagctacagctaggtaaatggttcagacaaggtagtttcccattgcccttatcttgtgttctgatttctggcttctgcaatatgctttttcatctctacgcaggaggcagagaatccttcttatgtctgatcttccaagaaaacagattgatagagtag

SEQ ID NO: 30300 - DNA, 462 bp, Glycine max
  Peptide Sequence Number=SeqID_147078
atgagtaatgggagcttgggtgttaaaaacatctctacttttaatgatgcgttgttagctaaatggaggacatgtggtggggatggtgttgtggagtggtttgataatgaaattagttggaagttaggtgaaggagatagagttcggttttggcttgataattggatgggagactcctttgatacacagatttccaagattatatctcatatctttacaagaaaattgtttcttgagttacaacaactgttgtctaattttgttattcacggtggtgtaagggactactactgggtctggggcgaagagaaagtgaaagcacaaccaaaggcaggttatttgatctggagaatggcactgaatagaatgccaatgatggataacctcaagatcataagcattattgagaatccgattgattgtgtcttccattttttgctcctaagtggaagaatcagttag

SEQ ID NO: 30301 - DNA, 1348 bp, Glycine max
  Peptide Sequence Number=SeqID_147079
aatgcttcgttacctgttggtgttcttcttattgggcttgggaacccgggtggagtcacacgaggaatcgggtcattggagctgcgagtccgagtcggagatccgagtcgagactgagttcaaacccggtgtaatcacactggatggtcacgctgatgattggaaggacattgatgggtcctactttcccctccttcccgcccttgacccagatgctgaaaatgaattcaaagggggaaagatgagcgttaaaagtgtccatgatggccgcgatatcttctttctgctgcaagtagatggtgactatgcctactctaaaggtgaaagcaataaatgtccatctgttgctctcatgtttcaaattggagatagtgcctcttatcatgatatgggtggctgtaaagaacattcgacctcatgcactgacaagacctgcaaaggtcatgaagttgacattatgcacttttcgataggaagtgctattccaggacgactttacggtggcaatcccctagacaatagagatgggaatggtggcgataggtttggtcacttggttgatctatatgcttggaatccacattgtagatacttggatggaattggtcctccaggttctggtggtggttgtgtcggcaacgataaccgtgataatagcggtgacaataataataacgatggtggtggcgatgatggtattgatggtggtgataatggtggcaatggcgatagcggcgacaatgaaggcaacaacaatgacggtggtggtggcggcgacgatggtggcgacaatggtaggagtgacaacgccagtgatggtgatggtgatgatggtggtggcgatgatgacagtgatagtgatggggttgctaatgattcaagtgcgcagaatgactggaaaggtgcttggtggcatagcagcttcacagttcactcaggattcgtagaggatgagagtccatatgcagataatggaaaaaagggcacatacttttttgaattctcgaggtctttgaggactatggatcatcttcaacaggacgtgcaatttaacattggtggatccagtaagatgtctgttgcattctggtatccagtagatggtcaaccttggcatggttctgggcactactctgtttactgtgattgggttcccattgacatatctgttggtaaatctttgaatggcaagtcagtagatgcagcatcaaatagctcgtggaatgttgctagtgccttttctgttatactatcagtagcagcactttgtgtgtctgtttttgtgagctatagggtgttcagccccaagagtgtctcttttacaccgatagagaacaacaacctttaa

SEQ ID NO: 30302 - DNA, 306 bp, Glycine max
  Peptide Sequence Number=SeqID_147080
atggtaaaaccattatctgaaacaaccaaaactattaaggttttccctccaggattgatgacccaaactcctgcacaaatccttgaatatgctaagtctcattacttccattttctgcttgaaaccatgagattcaaatacactccagtacaaatacttgtgcctgagataccctttggagtccttactttatggagcaaagacaactctagtctagaaatgaagctcaaatttggggaacttttgaagcatatcccttggaagaaagttatcgcaaccaactggcaagacaagacatctctgtga

SEQ ID NO: 30303 - DNA, 855 bp, Glycine max
  Peptide Sequence Number=SeqID_147081
atggcagaggtctccacagaggccattgcctccctcgcccagtattatgaccagtcgttgaggtgcttcacctttggggacttccagctatcacccatggtggaagaatttgaagagatcctaggatgccctctagggggaaggaagccatacctcttctcaggattctatccctctttagctagaatttctaagatagtccaaatcttggcgcaggaattagaccacagaaaaggcgaatgggccctgttcatagacatcctctcacttttgttcttcggaggagtcctctttccaaatgtggatgggttggtggacctagcggcgatcgacgcttttctcgcctttcatgaccgcaaggaaagcccggttgtcgctatcccagccgatctatatgacaccttcgaccgaatatgtgaaaagatcagtacaaggattgtttgctgtactccggccctctatgtatgcaaagaaggagcgtctgtcaactggttcccccgatggaaagaaggaagaaccgggtttcttatttcgtgtggaggatttccaaatgttcccttgatggggacaaggggttgcatcagttacaatcccgttcttgctataagacagcttggctaccctataagaggggcaccactagaggaagagcttgcacctattattgcacgaggtttcaataacaccgacgtggaggcacttcagaaggtccgcaaggcatgggagatggtgcaaaagaaggacaaggaacttagaggcagtaacaacgggcccatcggtggctacctgtcataccctaatttcgtccggggacctttgcttgatgacatgcgacctttgtttggtccttgtaag

SEQ ID NO: 30304 - DNA, 477 bp, Glycine max
  Peptide Sequence Number=SeqID_147082
atgcaacaatttcttcctggtatggtggtggacaaggaaacattgccaatgccaccacaaggaggtcaaccagtaaagggtttcatcatgttccatcatctttttttggagtttcagatcgtgtatcaacgggtttcaatattgcaagcccatagttcaagtcgatggaacatggttgtacgggaccatctgttaggtgggatgcaaccttcgcttggccgcgtcaaggggtatgcaaatagcaatcaggcccacttggaccttccagggtgttccaacagaaggtggtgccttctggtggaagcaacccagctcgcctgggcgagctgggcggcaaccacctccctcttttcccctataaataggggaaagagggcagagcaaattcgttcaaccctcctggtatttggaattcacttgaaattagtgagaaaaattgtttccgtgaagaaaatccaagccgaggcgcttgcgtaa

SEQ ID NO: 30305 - DNA, 225 bp, Glycine max
  Peptide Sequence Number=SeqID_147083
atggcatatacagttgttccttttctttggaaacaacatcttcatagatctagagaagcaatgccctctctaaatcccaaaattcaacctttgttggttcaagcaagtttttcagattttgcaaagctcgaacaagttaaaatcgatgatgctttagtgactgcttggtcgaaaggtggagacctgagtcacacatatttcatcttcctgttggtgaatgcataa

SEQ ID NO: 30306 - DNA, 795 bp, Glycine max
  Peptide Sequence Number=SeqID_147084
cgagcaaatgagactggggaggatccattgttgttgagcaaccatttttgtgatgaatacaatgttgatatggttgatcttcaattcgagacaccatctaaggaacctcatgtttctgaacaccttaatgagataaagaacatgataacccaaattataaacaatggctatgcgtacaaagttaatgatgatgtattctatattgttgataaaggcccaaattatggcgagcctagttgggacaacccttgggatcctggaagtcctgggtggcacattgaatgcagtgcaatgagtgcttgttatttaactcataaatttgatatccatggtggtggaattgatttaatctttcctcatcatgaaaatgagattgcacagagctgggctgcagaccatgagagtcgtgtcaattattggatgcataatgggcatatctccactaaattactcaatctcacagctagagaactcatcagatgctatttatatttcagactcttcaagattgtaaagatgttaccattacttcaaggggaagctaagaagaatgaaaagatgttgaagaagaaaatgcagaaaatagcacagttgcaattgattcaatcaatattggaagtggagaaagaagttggaaaagttttggacatcttaggattattatcctgtaaatcttatgtcgaattgaatgacacttaccactttgaggacaaggtgttgcctgatgggacagggaatgctaggcaaaggatcatgaggcccaaaaggcaaatcaaaccaccaaggcacttgaag

SEQ ID NO: 30307 - DNA, 192 bp, Glycine max
  Peptide Sequence Number=SeqID_147085
atgtcgcgagggtcaggagaccttggggacgtcaggtggggtgctattgcccaaaaccaagcttggccaatcccgacccaacccgggcatagtcagccaggtctaaaaattgaaacaggacgttcagtagcctctggtaatcgattaccaattgtgtgtaatcgattacacagtgttatatgctactggtaa

SEQ ID NO: 30308 - DNA, 693 bp, Glycine max
  Peptide Sequence Number=SeqID_147086
atggcttccaatagtccttttccctcaaatcttcctattctaaccggcaagaacttcaacagatggagtgtgcaaatgaaagccttgcttggatttcaagatttgaccgatgtgattgagaatggaatagaaattccaaaagaaggagcctcagattcacagaagactgaattcaaggatctgaagaagaaagactgcaaagccttgaaaatcgcaaatgctaaatccgcaaaggaagcatgggacattctgaacaaggcttatgcaggagctgataagatcaagaaggtgagacttcaaactcttcgaaggcaatttgaattgctgcagatggaagagactgagagcattggagattactttggaagattgcaggttcttgcaaattcaatcactagttgtggtgatacaattactaatctgacgttagttgagaaagttctaagaaccctgaatccaagattcgatcacattgtggttgcaattgaggaatcaaaggatttggaatcattatctgttgatgaattacaaggatcacttgaggcacatgaacaaagattgcaagaaagattgcaagaaagagcaaatgataaggctacagaacaagccctgcaagcacaccatcagtcaagaaatggtggttctgataatcatagaggcaagaaaggaagacggagattccaaaacacatga

SEQ ID NO: 30309 - DNA, 120 bp, Glycine max
  Peptide Sequence Number=SeqID_147087
atgatccacggtcagtgcattgatgaagcccatgtttcatacttcatattgcatgaaaatagtataatctttgtcagctatttccttgatgaatggtaccacgttgcatttgagagttga

SEQ ID NO: 30310 - DNA, 375 bp, Glycine max
  Peptide Sequence Number=SeqID_147088
atgagacaattcttcttcccatacaaagagtacccttctctattcccatttccaacaccaactaccatccatccactccctcagatcacttataaaagcatctttatttactacaaggctaaacaacctaggaaatctattgatgcaatcctccctaggaagggaccagtcacaagagccatgagcaagaggctccaagaggattgggctagagttgctgaagaaggccctagggttctcatgaacctcaagacaaccattgcgcttagtgagcggatctcacgcttagcgcacggccttgaaattgatgctctgccagattcttctgtcgcgctaagcgcgctgaagctgcgcttagcgttggatgcgcgctga

SEQ ID NO: 30311 - DNA, 189 bp, Glycine max
  Peptide Sequence Number=SeqID_147089
atggcattagtcgggaacatcaatattttaattgtacaatacgcattcatgtttgtattgaatgctttgaaaggacttgacgatactccacaaagtaaatccaaggttgttgctaggtggactgttgttaaatatttcaatgatgctagaccattggaactagagagattgaaggtgcttcatatctag

SEQ ID NO: 30312 - DNA, 309 bp, Glycine max
  Peptide Sequence Number=SeqID_147090
atggttctttttgtaggtgaaaagatgaagaataaaaaggttgaagcagctggtgtctcgctaagcgtggcatatgcacttagtgagttacatccgctaagcgaggcactcagctcgcttagcgggttgggagaatctggaagagaatctgcaaagcatgcacgcgctcagcgcgccatcagctcgcctagcgagtcatttgtctctttttgcgctcagcgcgcccaactcgctaagccaaaattcactaactcgcgcttagcgcgaaatggtgctaagcgagccttcaggatcaggaagcccttttaa

SEQ ID NO: 30313 - DNA, 432 bp, Glycine max
  Peptide Sequence Number=SeqID_147091
atgcgagcggggaattctgatatctatggattcctcgagcctcagtccattcagaggtctgggcaatcgcagtttgaatctgaaagttacataaagagttggatgcagagttcacaatgcgatgtctatcttggagcctacctaaatgggttccactgcagcggacattggcagatggtggtcatcctgcccaaggaacacttagttgtctggttttgttcattgcataacaggccagacaactaccttaaggggattattaatagtgctatcaagggtcttgatgatgctccacagcctaaatcaaaggctcctgctaggtggattgtcgtcaagtattttaacgaccctagaccattggagcctgagagattaaaagcattgcggatccagtgggcacagttttatctccgaattagagatcaggcctag

SEQ ID NO: 30314 - DNA, 225 bp, Glycine max
  Peptide Sequence Number=SeqID_147092
atggaggttgaggaaccttggctggggttatggccaccattgaattatcgagttgatatgggagtaagtcagcatacgacaccagaattgggggaattctacaagcttcttttctggaaaattccttcctcgattggtgttttggtttgtgttaaggcaggctttgtggctgatttaggggtggcctttgtggttgattgggtggtgggtaatgagaaaggatga

SEQ ID NO: 30315 - DNA, 225 bp, Glycine max
  Peptide Sequence Number=SeqID_147093
atgtggtctctgcatcgcatgttgtcgcgccaccgcaagctacggtggtgcccttttcagagttgtcatgccctacaactactgttcaagcattttaattggttgtgcttgtacatttatggcgaacatcgtattagcatgaaagtttaccaggcattagagaatagcataaatgggtttgattccagacctcaaagcaacatagggaatgcttttaagttttaa

SEQ ID NO: 30316 - DNA, 573 bp, Glycine max
  Peptide Sequence Number=SeqID_147094
atgcacgctgccaaaggcgaattctggccgctctctttttcctttttgttctctctccaagtctgggttgttagggttatggtggtggggtttgtgtcaaggttggggtggcgacacgatggtcgtgcgttgctggtcgtggttaggtcacgcactgccgatggtggtgattccaactccgctgtggtcatcctttggtggtggtggttgaaggttgttatgggtgtaagggtgatatcagttgcgagactaaggatactgctaaaaaaaagcttttttacattggtcaaaagcaatgttcaacgatggtggaggcctgtctttgattatggcattgttgtagacctcgcacctatcttcgacggttgtcaaaacaccgttttagaaagctttgattcctacgtcggtgatgacatcaacacagatgtagaaatacgtggtttctatgtcggaggtggcgtaagcaccgacttagaaatcaagtatttctacgacggggctgacatcatcactgtggtagaaagttcactttcgaagacgttgattacgttagcaacgacgtcgaaacaataa

SEQ ID NO: 30317 - DNA, 243 bp, Glycine max
  Peptide Sequence Number=SeqID_147095
atggtggtgcagtcttgggtggaggatgtctcagatctggggagaagaagtgattctccaagacgtggtggtgcagtcttgagtggaggatgttcgggtttccctagcatgggcattgctcttaaccaactggacgtccttgattcaagaatcgccggtgtagggtccgacggtgatgttggagccgggaaggaccgtggagtcgtcgacctcgttgggctcaatgcttggagggatcaatag

SEQ ID NO: 30318 - DNA, 1080 bp, Glycine max
  Peptide Sequence Number=SeqID_147096
atgtttccccagcgccagctgatgcgctcgctggtgaaggtctcgcacaatctcaaccccaccgatgccctgaataatctgccgcccggtaatgaagcgctgcgaaaaatcctcgcccagcgatatgcgcagcagggcattacgctgtcgccggatgacatcgtcattaccaacggtgcgatggaagcgctgaacctcagcctgcaggcggtgaccgaaccgggcgactgggtggtgatcgaaaacccttcattttacggcgcgttgcaggcgattgaacggcttaagctgaacgcgattgctatcgccagcgatgtggagcagggcatcgatctggatgagctggagcaggctctgcagcgctggccggtgaaagcctgctggctgatgaccaaccggcagaatccgctcggctttacgctcagcgccgagcgcaaacagcagctggtggcactgctgacgcgttatcaggtggcgatgatagaggatgatgtttatagcgacctgtatcacggccacgataagccgttgccggccagagcgttcgaccgcgagggttacgtgctgcactgcggcagcttttcgaaaaatctggtggcgggatttcgcgtgggctgggtcgcggcggggcgctacgcgcagcgcgtgcagcgtattcagatgatgagtacgctctcgaccagcgcgccaatgcagctggcgctggcggattttctcagcacccgcagctacgatacgcatctgaaaaagctacgtcagacgctggcgaagcgcaaacagctggcacagcaggcgctgcgccgcgtgctgcccgccgaggcgcacatcagcgatacgcccggtggctactttttgtggattagcttgccggagcagatcaacgccacgcagctgtatcacctggcgctgcagcagggcatcagtattgcgccaggccagctgttttccagcagcgagagttttagccactgcttccgcttcaacactgcctggccgtgggatgcacgcgctgaggcggcggtagagacgctgggagcgttgattggtcagctggcgcagggtgttgcggtagagaagtga

SEQ ID NO: 30319 - DNA, 2289 bp, Glycine max
  Peptide Sequence Number=SeqID_147097
atggactcagggtgcacataccatatgtgttctgtaaaggattactttgaggatcttgaacaaaaggagcatggaacagtacttcttgggaacaacaaggcttgcaaggtgtatgacattgggactgtcagactgagaatgtttgacaacagggaaatgctactgcaagatgtgaggtatgttccagaactcaagagaaaccttatctctataagcatgtttgaccttatgggatacactacaaaggttgaggatgggatgatgaaggtgtccattggagcctcaatcattgctaagggaaggcgaaggaatgggttgtacatcttggaaggatccacagttattggacaagcatttgttgcaagtcaaacaatggaagataagtctaaattatggcacttacggctaggccacatcagtgagaaaggcttgatagaacttgaaaaacaacacctgctgatgggtgataaactccacaaattggagttttgtgaccagtgtgtcttggggaaatctcacagggtgaaatttgggacagatcaattcaatactttctacacacatcatggaatcaagaggcacaaaatagttgctggtacccctcaacaaaatggccttgcagaaaggatgaatagaaccatcctggaaagagtgagatgcatgcttcttggagtaggtttgcccaaggttttatggggagaagctgcaaacacaactgtgtatttgatcaacaggagtccctcatctgcccttgaatacaaaacaccaatggaggtttggagtggaagtccagcagactactctaacctaagggtgtttggagccttggcatatgcgcatgtcaagaaggacaagttggatgctcgagttgtaaaatgtctatttcttgggtatgctgaaggagtcaagggatacagactgtggaggttggatccaaaaccttttaagctcatcatcagcagagatgtgacatttgatgagacaagaatgggaatgtattctgaaaactcagaatgtggaaaggagaaaactcacattgaggtggagcctcttactaataaggtgcaggaaaacacccagataaatccaactactaacctagacagtacaacagaggaaactggacactcagcttcaaatttaaggagatcagatcacgacattaatgattaccaactggttcgtgatacggaaaggagaattcctaaaccaaacagaaagcttggtcaagctgatctcatctgctatgctttaacagcagcagaggaaattgaaagatcaacagaaccaaggaatttcaaggatgcacatgaaagtgaggagagacagctttggcttcatgcaatggaagaagaacttgaggcacttaggaagaacaatacctggaggcttgtggaactacctaagggacaaaaggtagttggctgcaagtggatcttcaaaaggaaaggtgaaattccaggggttcagaagacaagatacaaagcaaggttggtggctaaaggatttactcaagttaagggtgtgaattacaatgagatatttgcacctatggtaaagcattgctctatcataatcttgatgtcaattgccaaccaattcaagctacacttggaacaattggatgtcaagacagccttcttacatggaaacttggaggaaaccatttacatgaggcaaccagaaggttttgctgtggatgatagggtatgcttcctgcaaaaatccttatatggcctgaaacaaagcccaaggcaatggtacaagaaatttgatgatttcttgataaagatggagttcaagagatgtagctatgataactgtgtttatgttctgcaccaagaggattatctatatctcctgttgtatgtagatgacatcttggtggctagctgcaacaaatgtatgatcgatgacctaaagtcaaggctgaactcagaattcgagatgaaggatcttggggaatctaggcgaatccttggtgttgatattaaaagagatcagctgaaaggaactttgctattatcccaacaagcctatatgcataaggtagtggagaggtttaggatgcatcagtccaaacttgtgagcacacctatggggcaacacatgaagctctcgaaaagccaaggtccaatatcagatgatgataggaagaagatggatgtagttccctacactagtggggttggaagcatcatgtatggaatggtctgtacaagaccagacttggctcatgctatgagtgttgttagtaggttcatggtggaatctggtcaagcacactag

SEQ ID NO: 30320 - DNA, 522 bp, Glycine max
  Peptide Sequence Number=SeqID_147098
atggcagacgaggttgttctattgggtacatgggctagcatgtttgggatgagggttaggattgcattggctgaaaaggtgcagtacattgatgaggtctggaatgacaaagctcccatcttgccctctgacccttatgagagagctcaagccagattctgggtagattacatcgacaaaaaggtgaatgatacttggaggaaaatgtggctttctactggagaggagcatgagacatggaagaaggagtttatctctgtctttaagcaattagaagaggcactaggtgacaaacctttctatgggggtgacacgtttgggtttgttgatcttggtcttatccctttttatacttggttttatacttttgagacatatggtaacttcaaaatggaagctgagtgtcctaaacttgtcgcttgggctaagagatgcttgcagagagaggctgtgtccaaaactcttcctgatgaaaagaaggtctatgatcatgtgggattgaaaaaggcatttgaatcataa

SEQ ID NO: 30321 - DNA, 261 bp, Glycine max
  Peptide Sequence Number=SeqID_147099
atgacgctatctcactctacgaacacgttttctttgtcgattgttctatatctctcgatctctctcattgcactgttgatccctcgactcagtgcttggtgccactttctgagactatactttttggagttgagagcttggggatcgatatacattgtactcgagcgaaggactcacctctacaaccaacaactttcaggtaccaacgtcaaaggagaccacgatggtctcatgcttgtggagatagaggagtacatatag

SEQ ID NO: 30322 - DNA, 660 bp, Glycine max
  Peptide Sequence Number=SeqID_147100
atgggagatgaggtgattctgctgaatttctggttaagcccttatgggatgagggtccggattgcattagaagaaaagggcatcaagtatgaaagtagagaagaggacttaagcaacaagagctctttactcctccaaatgaacgcagttcataagaaaataccagttctcatccacaatggcaaacctgtctgtgagtcactcattattgttgagtatattgatgaggtttggaatgatcaatctcccttgttgccatctgatccttaccagagaaaccaagctagattctgggctaactatgttgacactaagatgtatgaaattgccttgaagttttggagaactgaaggggaagagaaagaagctgcgaaggaagaattttcggagtgtctggagttatttgaagaacaactgggggacaaaccttattttggtggagacaaccttggtcttgtggatgttgtacttgttccattgatctgttatttttacgtgtataatttatatggcaatttcatcaacgagaacaagtgcccgaaaatcattgcttgggctaagaggtgcactcaaaaagagagtgtttcaaagtgttttcctgaggtgcagagggtcaaagagtttatttcgcagaagaaaaagaatttgaacagtgagtag

SEQ ID NO: 30323 - DNA, 231 bp, Glycine max
  Peptide Sequence Number=SeqID_147101
gccaagtcggaagatgccaccatcgtctccgccatcgtcgcgctggcgcaatcgctggatctcaaagtggtggccgaaggcgtggaaacccaggatcagcaggcgttcctcaccgggctcggctgcgacaccctgcagggtttcctgctgggcaaaccgctgccgccagagcgcatcagcgagctaccggactttgttaaggacaaacccgcggcgctgacggcggagtag

SEQ ID NO: 30324 - DNA, 1107 bp, Glycine max
  Peptide Sequence Number=SeqID_147102
atgagcacagcactcaccaacgcaaaacaactctggactaccgatccgcaacgcacttttagcggctcagcgccaaccgaagcaggcggcatcatggaaattgtgatggacagtaccgtctataccgtctccattgccgctaatggcagctggagctggcagccgccgtttccactggctgaaggcccgcataatctctccgtacgcaccattgaccgcgctggcaacgtcggagccccttcgctgtttatcgttaatgtcgaccttaccgcgccggaccagccgctgattattggtgtcgatgacaatgcggggaataaaaccggtccggtgagttccggtcagcagaccgatgaccgcacgccgaccctgaaaggcgtggccgagccggacagcatcgttcgcctgtacaatgcgcagaaccagttgattggcagcgttaaagccagcagcaacggatactgggaaattaccccgacgctggctgacggtgagcattcgttgtatgtgacggctaccgatgggcgtggctacgagagcgaggcgtcaaataaatttattcttaacattgccgatgagtaccgagctccagataaagttgaaattattcaggctgtggatgatgcaggtaattcaaaaggggagcttaaatctggcgatgtgaccgacgatacaactccaatattacgcggtaccggaatacccggcgcgattattgagattcagtaccgcacatctggtgggaattggaaagcagcgggtaacgccacagttgacgccaacggtcaatggcagattgaatctcctcagttagaaagcaatataaccatatcctatcaagcgcgcgagattaatagtatcgaacacggtgaatggtctgaagtttttacgttaaacattcaacctgaagtaccggtaattgtgggtgcacttgatgatttatccccctctggcggtctgatacaacacggtggttttacagatgatttaacgccgatattgaaaggtacgggttcaccgggacaaattattactattgagtatggccagtttggtgatccatggatagcaggcggcacagcggttgtagataaagatggtaactga

SEQ ID NO: 30325 - DNA, 759 bp, Glycine max
  Peptide Sequence Number=SeqID_147103
atggagtggcaacgcaccaatcagttgggtagtatgacgaatggtatccacaacgaatacaatggagaagtcgcttaccgtactatcattgtggaaaaagggaaaacttatgaggtttcttttgatgcccttcaacatacatcaggaggtaattacaaatcaaaactgggaatgagcattgatggaaaatcggtcattccggaaacacttcaaaaaacaagctggacacattacacaggctattacacggcaaccgaaacaacaaaagtcaaggtggctattaccaatggtaccgcgagtacaaatggtaacgatttcgcgatagacaacatcggcattaaacctgtcgaagaaaaaacagacaatcaccttactgatatgaaaaccagtaacgaggtaattagcttgggtgatgaacaaagtagtttcgatttagctaacctgctgacagaaaaagggtcagttaataccagtaacatgtctgacaaaatcgataacgatttgctggtcgatgtaaaaactattcttcagcatggcgagatgaatttatttatagaaaacggtaatacccagatgaaagtcaatggtgatatcggggatgtcgttaagctaaaagatctaatgcccgattcacaagatagcgttagctggatacaacaaaatggtaacgtcacccttgctggcattcattacagcgtctataaccacggcgatgctgagctactggtgcaggaaggggtgaaagtcgagctggtgtaa

SEQ ID NO: 30326 - DNA, 1273 bp, Glycine max
  Peptide Sequence Number=SeqID_147104
atggccaaataccagcagctggtagatcagctacgtacgcaaatcgaagcacgcatctggccgccgggggaaaagctgccgtcgctgcgccagcaggcggagcagagcgggttcagcctgatgacggtgatgcacgcttacgaagtgctggagagccagggctggattgtgtcgaagccgcagtcgggctactatgtggcaccgcgcgcggcggagagccgtccgcgtttgccaacccaggcgattgctaaaaccgaccaggccgataccaacagtttcgtgtttgatgtgctgcaggcgacgcgcgatccggccatcatgccgtttggttctgccttccccgatccggaactgtttccccagcgccagctgatgcgctcgctggtgaaggtctcgcacaatcttaaacccaccgatgccctgaataatctgccgcccggtaatgaagcgctgcgaaaaatcctcgcccagcgttatgcgcagcagggcattacgctgtcgccggatgacatcgttattaccaacggtgcgatggaagcgctgaacctcagtctgcaggcggtgaccgaaccgggcgactgggtggtgattgagaacccttccttctatggcgcgttgcaggcgattgaacggcttaagctgaacgcgattgctatcgccagcgatgtggagcagggcatcgatctggatgagctggagcaggcgctgcagcgctggccggtgaaagcctgctggcttatgaccaaccggcagaatccgctcggcttcacgcttagcgccgagcgcaaacagcagctggtggcactgctgacgcgttatcaggtggcgatgatagaggacgacgtctacagcgacctgtatcacggccacgataagccgttgccggccagagcgttcgaccgcgagggttacgtgctgcactgcggcagcttttcgaaaaatctggtggcgggatttcgcgtgggctgggtcgcggcggggcgctatgcgcagcgcgtgcagcgtattcagatgatgagtacgctctcgaccagcgcgccgatgcagctggcgctggcggattttctcagcacccgcagctatgacacgcatctgaaaaagctgcgtcagacgctggcgaagcgcaaacagctggcacagcaggcgctgcgccgcgtgctgcccgccgaagcgcacatcagcgatacgcctggaggctactttttgtggattaccttgccggagcagattaacgccacgcagctgtatcatctggcgctacagcagggcatca

SEQ ID NO: 30327 - DNA, 685 bp, Glycine max
  Peptide Sequence Number=SeqID_147105
atgtctgctttgattcgatttgatttgcacccactggccgacgccgactggcgtcggcactgtcgccagcagctggagcaacacggcgcgctggtgctgcgtcagtttttgcaaccggcggcgctgcaggcgatcgtggctgacgggctggcccagcgccatctggcttaccacaccgtcagcaagcacaacgtctatctgctgaagccggacgaggcgtaccgtgccgatcatccgcgcaatcgtgacgtaatcagcaccaaaggctgcattaccgacgatgtgattgcagcggaatcgccgctgcgtcagctgtacaatgacgaactgtttaaacgctttctgtgtgatgtgctggacgaagacgcactgtatccgtatgccgacccgctgtcgtccatcaatctgcattacgcgcctgacggccaggaactcggctggcattttgacaactcctctttcgccatcacgctgctggtgcaaaaaccgcgcggcggcggtgtatttgagtatgtgaaagatatgcgcgatgccgatgccggcgagatgaattacgacggcgtcgccgccgtgctcgatcagcgccagccggtcgaggcgctggagattgatgccggtgaactggtgctgtttcgcgggcgtaattcgctgcaccgcgtgacgcccaacgaaggcgatgtcacgc

SEQ ID NO: 30328 - DNA, 240 bp, Glycine max
  Peptide Sequence Number=SeqID_147106
atgagctcaaagaaaactaggaaaggaaagagtcccggaaagggtgggaatcgattttggaagtccattatggttggctttaagactcccagggaagccatgaaaggtgatttcttcgtcttctttagtcgctatcaaggttcattgttgattgtgttctgtgtgctgttgctctttacctcatggaaaggtgatggtttgagtgttcaccatttgtttgattcgtggtttatttactag

SEQ ID NO: 30329 - DNA, 231 bp, Glycine max
  Peptide Sequence Number=SeqID_147107
atggcccttacagagcttctctatcaagagctgctagttggtggcacctatccagtacttccgaactcgtctttcatctacagacattgggtcgctaaagccaatagttcggtgtccgggcaacagccaagccactcatctttggttgcagcttcggcggaagcctatgctttcagttcagttccattccttggttctccggttgattgccctgcccgcgtcacaccttaa

SEQ ID NO: 30330 - DNA, 411 bp, Glycine max
  Peptide Sequence Number=SeqID_147108
atgctaggtgcacccagcaatattgctggtgcacccagcaatttattgaaaggacaattttgcccttcatttaaaaacataaaaagctttttccctctttcggaagcattttgtcttcttcattttctctcttccgcgaaagcttccttcctcttctctcttccgcaaaagcttcattggtggtcttcttctccgcgagacttctccgccagcccttggacccatttgcattcgagcttaggggttcttccggaacttccggaagaaggtattcaggaagatttccggaagaggggatcttccgaaagtaataaacgtattccggaagaagacgtcttccagaaagctcccggaacacctcttccggaatgtttctggaagaactacttcttccggaagtttttcttataa

SEQ ID NO: 30331 - DNA, 339 bp, Glycine max
  Peptide Sequence Number=SeqID_147109
atgatgactaatttggcttggctcgagaggcttaaggagtcatttgcgtcaactggtctgaactatgaagatctatacgaattgataaaggcctctatcgcgaggggcagggccagttttccagcgcttatatatgacgcttcgagggggatcggtttctctgtgagtgaagggtttttttactctcttgatcaagactgggatgatcccaaggatttcaatgaggcaacgaatacctttgccgtaaaagctgcggatgttggccctagaacaatgttccgccccgatcctacgcagcatggttatccaaccaatcaggattatttcaatgctcaatga

SEQ ID NO: 30332 - DNA, 289 bp, Glycine max
  Peptide Sequence Number=SeqID_147110
cgagcattcgctaagcgcgacactcagtggctaggcatgaggaagaatccagaagaagatgagctattaggttcactaagcgcaccgctccaggtcatcaagcgcactgcttcagctcatctgctaagcgagataagcgcgctgagccaaaaatcactaacatgcgctaagcggaggtttctggactatggaaagataaatcctctgttggaacttccctggaactggtctgattctaaagtccttggtagtacgggactaaattgtagtgctatcacgggggatcggg

SEQ ID NO: 30333 - DNA, 237 bp, Glycine max
  Peptide Sequence Number=SeqID_147111
atgtaccagcgactacatagaatggttcttccgcatttcgcatcctttcatgacaccaggccaggcatcagatcctctgccagatggtcatgctccgtagccccgagtggtccctcagtttgctatgggattgttgagaggttggagcgccatctaagcctaggggtggtcacactaggctcatcaatacatgaggtgatcgaagaatgcctcaggatggctaggagtgtcacatag

SEQ ID NO: 30334 - DNA, 321 bp, Glycine max
  misc_feature (107)..(107): n is a, c, g, or t
  Peptide Sequence Number=SeqID_147112
atggacgaagatcaatggatgtatgataatataatgtctgaaaaagtttatatgaataaacaaaatgaagatgaagttggtgtgaatgaagaacatgttgattgttntgatgcgttcaatacttttcaagtgtttgctactcgagatgatgttctacattgggctcgatctgttgcttatgaaattggatttgtggcagtgattatgaggagtggtcagtataggtctacgaaaaaagattttgtaaaaatagatgctgacaataggaaatgtggatgttcctttaagcttcgtgagaaaccagtggttggaggtcaatga

SEQ ID NO: 30335 - DNA, 366 bp, Glycine max
  Peptide Sequence Number=SeqID_147113
gccgccggagccgtacttcttgccggcgtcggagcgggtgcggccatcgctggcgtacaggctgccgtggccggcggtgaacacttcgtcgatgtattttttcaggatccacggctcgcccatccaccaacccggcatctgatagatgaccgcgtcggcccacaggtatttctgcacttcggcttcgatatcatagccgtcgtcgaccaccgtgacctgcacctcgtgctgcagatcgcgcaagaagctttccgccacgtcgctcagggtttggttgagttcgccgttggaatggccgaattgctttttagcgttgataatcaggatattgctcatcttttgcgtctcccgtcagagttaagatag

SEQ ID NO: 30336 - DNA, 1036 bp, Glycine max
  Peptide Sequence Number=SeqID_147114
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccacttgatgacgctttctcccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacg

SEQ ID NO: 30337 - DNA, 1122 bp, Glycine max
  Peptide Sequence Number=SeqID_147115
atggaggaacttgaaagagttcagtttgtagtggagcatgcaactgaacttatgtctctttatgctgcaaagagacttgcagagatggaagttgtcactatgtctaaagacatggatcttgcaaagcaggaagttcttaagaaggccaagcttcaatctgttattaaagtatttcttgtagaagtagaagatgatatagtggtagcagaccttggagcggaacaagtgtacccaaggccaatgactgaagttgatgagcagatcattgatgttgcacagtttgatacaatggatgaggacaaacataagcgcatagaagaagcatatggagtgctagagtatatatctatagatgttatgactgcaagactggaactcaaccagatgcgtaagttcatcctaacctcaacaacaggctatatcatgtcttcagaggatataaagtcttggaaaggcctccctaatatagatcctttccactatccctacaactatacaagggatatccatcctaatgaagaagtagatgttattgggagatatgggcaaagggaaccagtttttcaagagttccccatcagagagattgtttctcccaatccaaatagtcttatctttgagcataggccaacaacaagaaaaatgtattctcctggtgccacagtctggaaaagcagggaagtaaaaccctttgagatgcctttctctactcccctggatcttcaactatttatgggtcttatttgtgccctttatgttgttcttccttgggattgtactaagtttgataaagatgctctaccaaccagatatgtgaaggctcacccaagaaggctctttaagcatgagcttgaggctctgaagaaaaatactaagcttacaatgcagcctatcattgaagaagttgattatgatgttgaagtagtagttgatcctgatgctttggccataaaagtctatgaccctccacctttaatggaggccattggttatgaatctcatagatctctcacccctcttggcagtccaattgatctatcatcagattcttattcatctagtgatgagtttctaaggaagattgatgaggaatttgccaaacaaaagagggagaataagtaa

SEQ ID NO: 30338 - DNA, 234 bp, Glycine max
  Peptide Sequence Number=SeqID_147116
atgtacagaggagttcaacgcaggaaatgggggaaatatgtagcagaaattaaagaccctaaggagattcgtaaacttactgctacacttctgggagatgccacacaggtcacaggcacgggctctctcacgtactcacagcatgagctccactgcacacaatgggcacagcagggagaagggttagagttagggcacaccagagagaggggagagagcgaggttcagctttaa

SEQ ID NO: 30339 - DNA, 216 bp, Glycine max
  Peptide Sequence Number=SeqID_147117
atggcaatgtgcacaaatcttttgcagggtcaagcctctgaaagggcattgctaagacgtcattcatctgaagatttatttggtgtacaacgattaaactggcgtccaccatcttattatgggcatgatgagcttgagacactaatggcctcagactctactgccgattgggatgcagacgatagagaaatgtctcttgtgaaagatgaagattaa

SEQ ID NO: 30340 - DNA, 222 bp, Glycine max
  Peptide Sequence Number=SeqID_147118
atggctgagtatgatggttcagacaataattctaaagaatccacaactgatgaagtggatgtcatgtccagaaatttcaagtgtatgttcctcaacctaaatccatttgaaggaggaattattgcctttggaggcacgagcaaaggaaagatcaccgatataggtataattggtattccttctctagcctctatagacaatgtttatatgttgaatgactga

SEQ ID NO: 30341 - DNA, 369 bp, Glycine max
  Peptide Sequence Number=SeqID_147119
atgatgtatggacacttgttcccaaacttgaaacaagaacatcattggaacaagatgggtgttcagaataaactagatgaacaagatgacattatttttagagctactaatgaatctttgtgcaaagatttctctgatccgatgaagaatgagttcaaaatgagcataatggaagaacttcagttccttttagggtttcagatcacacaagatagcaaagggaaatacactagagaacatctaaagcagttcgagatggaaggtgttagacctattaaaacacctaagcctgcttccaatccttttagcaaaggcgaatcaggcaagaaagaagtagaactccattgctctgtctacaacaaaagttga

SEQ ID NO: 30342 - DNA, 177 bp, Glycine max
  Peptide Sequence Number=SeqID_147120
tggagtctcgcacagcaaagccctactccatatgtagggcgacgtgatgctatcacgatcgcgaaagaagagcatacggctgacatcatgatggcagactacaggtggcgtggtggcaaactgcaggcggcacagtggcgaacatcaagctcaaggcctgggcggacggattgttga

SEQ ID NO: 30343 - DNA, 531 bp, Glycine max
  Peptide Sequence Number=SeqID_147121
atgattccaaagttcccagaagctgataaaggggagaactttcggccaattgccttagccaacttccaatttaagatcttcgctgatagagtttccaacatcgctcctaatatcatttctgagaaccaaagaggattcatcaaagggagatcaattttcgattgcatcaacactacttcagagtggattagaaactttctctggagtggtgatgtggatattaggaagcatgttattgtcgcttggagttcgatttgtaagccttttgaggaaggggggcttggtttgcgctcgatggctaccattaacaaagcaacaatgctaaagctgggttgggatatgctctcaactgatttgcagtgggctaaaattttaaaagctcatgtttttagaagccgcgagattacttctagccacattgggtcttccatttggtgtggcatcaaaaaacccaattgcataatgtctttgacagcacctcttggactattggttttgttaagatcagtttttggtaagatcggtggttag

SEQ ID NO: 30344 - DNA, 826 bp, Glycine max
  Peptide Sequence Number=SeqID_147122
agaactagacgtcctcacgttcagaggactacatgtcctcgcctttagagggcgacacgcccccaccattagagggccgcacgccctcaccttcagaggactgtacgtcctcacctttagagtactgcacgccctcgccttcagaggactacttgtccttgccttcagaggactacttgtcctcgccatcagaggactacacgtcctcaccttcagaggactgcacgtcctcaccttcagaggactagacgccttcaccttcagaggactagaagtcctcgccttcagagggatgcacgccctcggctttagaggactagacgtcctcgccttcagagggctgcacgcctttgccttcagaggactagatgtccttgtctttagaggactagatgtcctcgccttcaaagggctacacgtcttcaccttcagggtgctatacgttctcaccttcagaggactagacgtcctcgccttcagagggctacacgcccttgcctttaaaggactacgcgcccccacctttagagggcttcgcgccctcacctttagaggacttcatgttctcacctttagaggattgcatgtcctcacctttagagggctacatgccctcgccttcagaggactacacgtcctcgccatcagaggacaacacgtcctcgccttcagaggactgcacatcctcaccttcataggactacacgtcctcacctttagagagttgctcgtcctcaccttcagagggctacgcgccctcacctttaaagggctgcacgtgctcgccttaagagggttgcacgccttcaccttcaaagggcgatac

SEQ ID NO: 30345 - DNA, 771 bp, Glycine max
  Peptide Sequence Number=SeqID_147123
atggacgatagaggtagctcattcatcactgttaggagaattccccacggagaaacctgccattcaaattctgggatcttgtggcatgtgggtccacatccagctgaggttgtggtagggtcagccgcatggcttgggcgaggtctgtcttgtgtctgtgtacaaagaagagatagtgatgcttctaacactttcgatttaaccctagcccaggaggaatgcttgcagaggatacagagacgtatagatgttccatatgatagttctataattgagcaccaggatgcccttagggctttgtggaatgctgcatttcctgaagaagaacttcatggcttgatatctgagcagtggaaggaaatgggttggcaagggaaagatccatcaacagattttaggggtggtggttttatatcattggagaattttctcttctttgctaggaatttcccgaaatccttccaggatcttttacgcaagcaagaaggagatcgatcagtgtgggaatacccatttgcagttgctggtgttaacatcacatacatgctgatacaaatgcttgatcttgaagcagaaaatgagtcagcttttgatcttctctattgcataactttcaagctaatggatcatcaatggctttctatgcatgcctcatacatggattttaatgcagtgatgaaagaaacacgacgccagctagagaaagaacttctcgttgaagacatagcccagcttgaagatttaccctcatacaaattactttcccgatag

SEQ ID NO: 30346 - DNA, 276 bp, Glycine max
  Peptide Sequence Number=SeqID_147124
atgggaaaaatgattttttggcatctgctgattttcttcattcccaaagggattacacaacccaaaattgactcttcattcccaaactacatttttagaaacttcaagagaagttcttcatctcccacacttccacagtctcattacgctggcaaatctcccaaccacagtgacgcacagcaacacacgacaacacacaacgacacatggcgacgcacactcatacaatcgttcccgtcgacaatgaccacaacgatgcacacccaggatgtttga

SEQ ID NO: 30347 - DNA, 311 bp, Glycine max
  Peptide Sequence Number=SeqID_147125
cctacactgccatcttcagaactgtggctgcatggcgtgaaggtgtctcgcaggaagaaatggcggcattgcttatgtggaaggcttctcgtcattgggagcagcgagacagcatgcttctcgccagtgggagcagcgagacaacgtccatgtcagctttctcgccaagcacaatggcggcaccctcttctctcagccaggtcagcatgcttctcgccattgacaatggtggcaccctccacgtcaccaagcttctcgccattgacaatggcggcacgcatttttcgccactactgttggcggcatccatg

SEQ ID NO: 30348 - DNA, 2847 bp, Glycine max
  Peptide Sequence Number=SeqID_147126
atggcggagtccgaattcgaaccaaacgttgacctcgaagagaaatcgtggcacctcctcgcgctcctcctccgaattggccacgccgtttacccgcaacgcctcgccgcgcagtgtcgtttgttcgctgcctcgccgaacttcgtctgccacgtcggcactctccccggctcgccgatctccgtcaccgacaacggactggtcacgccctccgtcggcaccgtcttcgccctcggaagcttcttctccctccacttctcgccgccgcagccacaaacgtaccgtttcaggaaacgcaaatcgcttttcgattacggcgaagatggaagggagcacaagaagttggcgattcgtgatggacttcgagaattttcgttccagagttttgctgataccacagagactctgatgagaagaaatttccctgtaataaaatttgaatcacagaatataggtagcaggagttttgtattccccttgcgtattgataaaaatgaagagtgttcaggttgtccaatgccaaattttgaacatcgggaagccaataatgatgccaggacaaccatgtctaatggagaggtttctgaatctattatcaaagcactgacaaaaaaaaaatcaattatcaaagcaagttacttgaactgtctgaagctagtggatagaaatagattcatggactgtaatctctttgttgaccgtgctctcttggatccctcattatgcaaagacggaattgttaacagccttggatttgggaagaaaatggattcttttggcacatttatgcatgactatgccgaacaaaacagtattcgtcatgtggatgaagatggtattggtaaaagtaatacttgcaaagatcaaccgagagaacctaatgaagatgatgaggtggaaagtggttcacagaaagggctgattgattctgtcacaaatagagacaaggaagatgttgctcagagggtcaatgctgcactatgtagagaagaattgactaatggtttggaacaaaagaaccgtgtccatgcaatgaatttggaaaaggagagtgagagaaacacaggcactaagtctacaaataaaatagcaaattcctcttcaataccaaagcggcttttgaaatcttctagcatattaaagggaggacagaagaatgatctccaccctaagtcacaaattctcaaagagtcactagccagtaataaatttggtaatgttccaaaaaatgttgatcaatgtagaaatgatcagaaacttacagcgaggaagcaaaatcgtaatgagaacatggcaggaattattgccactactactaaggtggagaaaagagcatatccatcatttgaagcttttacaatagaggaagaagaaggttcaggtggttatggcaccgtttaccgtgctcaaagaactactgatggaaaacgggttgcaataaaatgtcctcatagtaatgctcataaaaaccatgtaaataatgaaaggaatatgctcgagcgttttggtggtaaaaactatataataaggtacgagggctctttaaaaaatggaaatagcgattgctttgttttagaacatgttgaccatgatagacctgaggttttgaaaaaagaaattgatatagttcagcttcaatggtacgggtattgcatgttcagggcgctttattgcttacacaaagagggagttgttcacagagacgttaaacctggaaacttcctttactctcgaaagttaagcaaaggctatcttattgattttaaccttgccatggatttaaagcagaagcacaacgttggaagtaaatcaaaaccaagccttgatgcatcatccaatgttatttctttctcttctggttctgcccctttggtccgagacaagaaccttggaggcagcaagtctttaccatccaataaaagggctttggcagattataagaattattctgaacttaataggaatgcaaaggaaaaggcttatactgttcatctgaaaaattgtcctgataaggctggtgggagttttcttagagcacaaggaacagatggctctggtataacttctgccaaagatgctagcactaggactgcttctgcagaaaggctcagggaacctttaccttcccatggaagaaaggagcttatcagccttgtgaatactatgaaatgtgcaaacagttcaacaataggtccttcttctcaaaggaaaagggttactgctccctcaagcaaggcagatgacaacattttttatattaccccgatgcctttgcattcatctactgttggtgggggattattgagaagcaaaggtgatggaaagaaaaaagaaggttcatgtgttggaaccaaaggatttcgtgctccggaggttttgttaaggtctcagcatcagggacataagattgatatttggtcagctggagtcactctactctacttggtgatcgggaagactcctttcactggcgacccagaacagaatataaaagaaattgttaaattgcggggcagtgaagagttttgggaagtggctaagctacatgaccgtgaattatcttttcctgtggagttacttaatgaccgatacttacagtcatgggatttagaaggctggtgcaaggttcacacaaagagacctgagtttcttgagcagatccccaaatcgttatttgatttgatagacaagtgtctaacagttaacccaagaaataggctcagtgctgaagatgttctaagacatgaattctttgactcagttaatgagtccctgaggaagaaaaggatgattcatcgtcatcgagctcttgggtcggatgacactgcagcttccagagcaatctga

SEQ ID NO: 30349 - DNA, 420 bp, Glycine max
  Peptide Sequence Number=SeqID_147127
atggggagcgaagaggagaacggcgaattctacctgcgatactacgtcgggcacaagggcaagttcggtcacgagttcttggagttcgagttccgccccgacgggaagctccgctacgccaacaactccaactacaaaaacgacaccatcatccgcaaggaggtttacctcacccccgccgttctccgcgagtgccgtcgcatcatctccgagagcgagattatgaaggaagatgataacaactggccggaacctgatcgggtggggcggcaggagctggagattgttatggggaacgagcacatttcgtttacgacttcaaagattgggtctcttgttgatgttcagagcagtgctgacccagagggtcttcgcatcttttactatcttgttcagtggtggttttgtcgtgatccatga

SEQ ID NO: 30350 - DNA, 438 bp, Glycine max
  Peptide Sequence Number=SeqID_147128
atggcttataaacacatcctgattgcagtagacctttccccggaaagccagttactggttgataaagcggtatcactggcccgtccttatgatgcaaaaatctcgctgattcacgttgatgtgaactattcagatctctacaccgggctgattgacgtcaacctcggcgacatgcagaagcgtatttcggaagagacacacaccgcgctgcgcgagctctccaccaacgccggttatccgattagcgaaaccctgagcggcagtggcgatctcggccaggtgctggtggacgcgattaaaaaatacgatgtcgatttggtggtgtgcggccatcatcaggatttctggagcaagctgatgtcgtcggcgcgccagctgatcaataccgtgcatatcgatatgctgattgtgccgctgcgcgatgaggaagaggaataa

SEQ ID NO: 30351 - DNA, 123 bp, Glycine max
  Peptide Sequence Number=SeqID_147129
gagctcgcctgcttagagtacgtcacaggttctcactggctaactatgcccgggttgggtcaggattggccaagtttggttctgggcaataacactccacctgacgtccccaaggtatcgtga

SEQ ID NO: 30352 - DNA, 891 bp, Glycine max
  Peptide Sequence Number=SeqID_147130
atgaaaactttcagccttaccctgctggccgcactgctggccggttcagtcaccctcagccacagcgcgctggcggcaaaaccgttcggcgaactgtatcagccggtaagcggcgtaccggcatcgcagactcaggtggtttattaccgcacactggcgcagtcgggcaacgatgcggcgcacgtctatgtcgacggcgaattccagaccgcgctgctgccgggcggtttcagcgtcttctgcctcaaaccgggcagccactcgctggataactacatgaaagacgcgccgcgctacagcggtaagcgcgcccaggcgtggcgcgacaactttgccggcggcaccacctactttgtgcgcctcggcaacgtcactactggccagccgcaggtggtcagtcgccagcaggcggagcgggaactcaacggggcgcagcagcagatccacgcgctgtcacgtgcgtcagcggtggtgaagtgtgacaacctcgcgccgcgtagctacaaagactacgtgctggccggtgacgtgctgtttaactttggcaaatcgtcgattggcgatatctccgccgccggccgccgcgcggtcggtgcgctgattgccgagctgcagcgcgatcgcgccgggctgaaaagcctcgaagtgattggtcacaccgacccgattggtaacgccagcgccaaccgccagctcggccagcagcgcgctgctacggtacgccagatgctgattgacggcggcctgccggccacggtgatccgtgccagcagtgcgggcagcagtgaaccggtggtggagtattgtgaaggatcgcgcgccgcacagattgcctgtaacgcgccgaatcgccgggtggtggtgcgggtggcgctgaaccaacagccgtaa

SEQ ID NO: 30353 - DNA, 390 bp, Glycine max
  Peptide Sequence Number=SeqID_147131
atgtcagccacgcaggcgaataattgttatatcccgagtatagccagagtgggtagcaaatgctgcaaaccgaagcccggctgtgagtcagatcatgggttatcgcttttttcgctcgcgctgaacgaaaatcatcgctggaaaaaatttaaacagatctcctacactgaaaatgagggccactcccgtccgggtagcgcgctcagcttttccccgctgcaggtaacgtcattgcggctccagccgggaggggaacatgatcagcactatcgcgcttttttgggctctgtgtgtggtttgtctggtgaatatggcgcgttacttctcatcgttgcgctcactgctggcggtgctgcgcgggtgcgatccgttgctgtatcagtatgttga

SEQ ID NO: 30354 - DNA, 2310 bp, Glycine max
  Peptide Sequence Number=SeqID_147132
atggtaacggctgacgccaacggtaactggagctatacgccagccagcgatctgcgtgatggcgtgcataacatcagcgcgacttccaccaatgctgccggcaacgtcagcccggaaaccggcgtctatccgattgaagtggataccacggcgccaggcaacatcatcaatccggtactgaccgatgatgtcggccaggtacaggggccgattcgcagcggcgagaccaccgacgatgccacgccgacctttagcggtaaaactgagccgggcgctacggtaatcgtgcgcgacaatggcaaagagctgggcagagcggtcgccgatgacagcggtaactggacgtttaccccgggcacgccgctggcggatggcaagcacagcttcaccgcgcagccggtcgatctcgccggtaaccagggcccgattggcggggcgattgactttaccgtcgacacttctgcggtggtggtagcgctgacccgcgtggaagacaacgctggcagtgtcacaggcgatctgagttccggtcaggccaccgatgacaccacgccaacgctgtacggcaccgcgacgccgaacgcgctggtgaaaatttatgacaacggcaagctgattggtcaggtaagcgctaacgcgcagggccagtggaacttcacgccgggcacagcgctcagcgaaggttcgcacgccctgaccgtgacggcgaccactgaagcacacggcgaaagtgagccaaccagtcagttcgatctgctgattgacctcaccgcgccgaacaagggcgtgattgattccgtcagtgacgacgtcggcacggttcagggaccaattggcaaaggcggctacaccgatgacaccacgccaaccctgtccggccgcggtacgccaggtgataaggtcaccatcatcgataacggtacgccgattggtgaagccaccgttggcaacgacgggcgctggagctttaccccgactacgccgcttaacgatggtacgcacaacttcaccgtggtgatgaccgatccggtgggcaacagctcggcaccgtctgagatctggccggtgattgtcgatacccaggcgccgaatccggtggtgatcaccagcatcattgataacgtcggcagcgtgaccggtgagattaagcgcgacggcgtgaccgacgacaagcggccaacgctgaatggtactgccgaggccaatagcatagtaacgatttacgttagcggcgtgctgatgggctcggtgaaggctgacgccagcggtaactggcaacacacgctgacgcgcgatctggctgacggcaggcacgagatcagcgccaccgccaccgacgcggccggtaacatcagcgcgccgacgccagtgtggtcgatcactgtcgacaccgtggcaccgaacctgccagcgattgttcgcgtctacgatgacgccggcagcatcaccggtgatgtgctgaacaatggtattaccgatgataagcggccgaccatcagcggcaccgccgaggtcaacagtatcgttaccgtatacatcgacggcacgcctgccggtaccgtacgcaccgatggcagcggcaactggagctttaccccgggcagcgatctggccgacggcctgcaccgcatcaccgccaccgccaccgataccgcgggcaacaccagcggccagaccgcggcgtggaacattaccgtagacaccgtggcaccaaacgcaccggtcattgtcaccattgaagatgatgtcggcagcattaagggcaacatcgacaaaaatggcgttactgacgacaaacgcccgaccctcaacggtaccgccgaggccaacagtctggtgacggtgtacattgatggcattgccatgggcagcacccgcgccaatggcagcggcaactggagcttcatcccagccagtgacctgacggacggactgcaccacatcagcgccaaagccagcgatagcgccggcaacagcagcggtgaggctcagacgtgggatatcaccgtcgatacggtgatcagcaccccgaccatcgatacagtgtatgacaacgccggcagcaaaaccggtaacgtggctaacggcggcaaaaccgacgataccacgccgacgctgtcaggcaaggcggaagccaacagtgtggtgaccatttatgatggcagcacgaagctgggttcggtgaccgcgggggcagatggcaagtggacgtttacgccgtcaccggcgctgagcaatggtgatcatcatttcaatgttcaggcgagcgatagagcaggaaatataagtgccaaatccagtaattggatg

SEQ ID NO: 30355 - DNA, 120 bp, Glycine max
  Peptide Sequence Number=SeqID_147133
atgactccattgattaaaaagatcaaaggcctacaagggccacatgaagctacatcatgtggtattagagcaaaggtgttgaggaaaaaagtccagagtttctacaacctcgagatttga

SEQ ID NO: 30356 - DNA, 432 bp, Glycine max
  Peptide Sequence Number=SeqID_147134
atgccgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatgtgaacggcacttgcacatgg

SEQ ID NO: 30357 - DNA, 363 bp, Glycine max
  Peptide Sequence Number=SeqID_147135
atgggatcgttacagtccattgatttttcgaggaatcaactttctggtgaaatccctccaaccattgcaaatttgagctttctgagcatgctagacttgtcttacaatcatttgaagggaaatattccaacaggaactcaattgcaaacctttgatgcctccagctttattggcaacaatctatgtggtccaccactgcccataaactgcagctccaatgggaaaactcatagttatgaaggaagtgatgggcatggagtgaattggttttttgtcagtatggcaattggatttattgtgggattctggatagtgattgctcctttacttatttgtagatcatggaggttgatcaatttgtag

SEQ ID NO: 30358 - DNA, 1053 bp, Glycine max
  Peptide Sequence Number=SeqID_147136
atggaggaggtggtggtgttgggccaatggttggtggtggagattcaagaagttgaggtgcaattagaggttgaggaaaacgacaccaagattggagaactgagtggtgatggaattctacatggagagccaaaattgctcattttcttgtttaaaggagtaggtcctgagacggtggagtacacgatgatgacatctagttctcccttgtctctagaagtagcctcatttaaagttattgattgcttggatgtgggctctagagtgtcatgctcaacttcatccgctatggctgcattgcatgcctcaagagtttcatctaggacactagtcttggcgaactcattgttgagtgccaagtgcaagccaatatggtggcatcttgataacatttggctacattggacaagtccattgtgggagtggaagatgaactatgacatttgttggtataaccttaaaggcctcaggaggcgtgtgctcatagtcatacttcatctatgtaggtgcttggacattgatggtttccttttaaaaaggttcaacaaagatgaattcagaggttcccttggattagcttttcaaaacctctctagatggatgaaggatgaaggtggagtcgattgtgagattgcccaccccttctcaccaatcttgggattgactttcgtggtctttgtcttaatgcgtctcggtatcaaagaaggaatgatagattctcttggttctgggggtgtgcttggaatcaccgtctatcttgttgaagacatgatacatgtcttgatcccacaacatcttgtttatgagaggaacataatagatgttgtccagaccacccgatcctttcaagtttctcaagatgttgatgtagatggtgtgtggcagaacactcttgttcaaaatgttggaccaaattttgtccttcttgcacatgagtgttcaacatggatggatggttcattgtcagtgtggatggtagtgatttctagggttggaattgtctcagtaacaggggagttggagctgaccattgtagagagtttgagagttagg

SEQ ID NO: 30359 - DNA, 213 bp, Glycine max
  Peptide Sequence Number=SeqID_147137
atggacgcaagggctcaatttgccgccttgaagaaagggaaggttggaaaaggcaagactgaccaaggcaaggctgataaaaagagaaaagctcttatatcgaagacaactctaggggaagaaaaggacactaaggaccacacaaagaaggttcaagttgagattacttatccttttgagaatgtcgatgatgtgaatgctcaaaaggtttga

SEQ ID NO: 30360 - DNA, 156 bp, Glycine max
  Peptide Sequence Number=SeqID_147138
ctgaagacagttcctagctttgatgcgaagctgtcagatatatgcattgggacctcagcagcaccaacttatcttccaccctattactttgagaatgatggcactgaattcaatttggttgatggtggcgttgcagcaactaatccggtaaactaa

SEQ ID NO: 30361 - DNA, 354 bp, Glycine max
  Peptide Sequence Number=SeqID_147139
atggctgctgtcaatgaagtgataaagcaacagaagctggaaaagaatctcgacatcagttataaaaagtcaaatgaatataccaaaatcctgttattgtctataggctgtggaactgcgaaggctgtgggttatgatgcccaagttgcagatcagttctcagcaactgtatgggcggggtcaggccttgcaactaatgcttatgattatgcttctaaagatatgactgagttttaccttaccacagtctacccaggcctccaatcttctgactactaccttcgaattcagattattgttattcgtatatttatagactttctgacaattaatctgggtttgagaattgattga

SEQ ID NO: 30362 - DNA, 498 bp, Glycine max
  Peptide Sequence Number=SeqID_147140
atgacgacctactatgacattggcctagggacctcgatttggagccaaggagaagagaaaaaggaaagggatgttccatcaggggtgggggcacagttaggaacttgcaaaagccaatcaaaactacaatggggttcactattcaatggacatcctgaaaaaccgatgacactccatacttctatgctttgtgaggaaaactcggaagttaaacacccaaaagttggggttgctccactgtgtcagaatcctattcccaccgtctctattgaacagcctcatatcgactctctctctctcaactcccctcaaggcttgaaaaaagaagatgttcaatggtgcctctaccacactctatatgtcttggataaagtcgtgttgtttctaggtctcaagactaaacccattattgctcccgcaaattcatgggtaattggaaagaaccaaattgcaaaagtgcctgaattggtatgcaagtaccaattcaaggtttgctag

SEQ ID NO: 30363 - DNA, 309 bp, Glycine max
  Peptide Sequence Number=SeqID_147141
atgaggaatcttaatgcacaggaatataacttggatccatccatggatgccctcgataatgccactgctatgaacttggaaaatcttgaaaaggttggacagaacttgctgaaacaaccagtttatagcatgaatgtgactacttttcaaccagaggaagaaaaagaatggggaacaaatgctaaagctcttaaaaggctggctgaggttctgtacactgagaagcagctgcgtttgaggaataaatcgaaggaaaaaaggggacgaccatttattaaagctgttacagacctgtttgaccgttcttag

SEQ ID NO: 30364 - DNA, 813 bp, Glycine max
  Peptide Sequence Number=SeqID_147142
atgactacctaccatcacccacactactcgtcgtacggaacctccatggctgctctccacagctgcaagaccaccctctactaccccccacaacaccaccttaaattttcatccgccaccgaggattgccttgaggctgccttagccaaacttaccctcagccaacacaacctcgccgcttccatcgacaccttggccaccaccatcgacaaccttcttcagcgactgcctcgcaatcccactccacatttttcttcttccattctggcgcaagcaccgacaccagccgcaattatattgactccgctcatgtcatctccatggctcatgccaactccgtctcagacttcgtcgtcgcctccgccaccgcctccgctgctcaagctaactccatcacccacgctcaccgcattcacgaccgagccacctccgccagccacgacgcctccgccagccacaacgcctccgctgccacattcgccaccacttttgtctttggtacccatacagccatggcccacaacttggtcgggctcgcttcctatgtttgttcttcatctgtccgatctcgtttgcaccatcattcccttcatcaagctcttcagcattgttcctccttgtgggactgccatggccgcatacacgcttccaacaatgaccgttgcattttgcacaactactaaaccaggtgcaattccccggaataaaccttgggatcccggtatcacgtttggaagcgatgtgttgatcccccaacaccttgaggacaaggtgtttttgatgagggcgggaatgatagggataatactatag

SEQ ID NO: 30365 - DNA, 102 bp, Glycine max
  Peptide Sequence Number=SeqID_147143
atggcgcggctgcaacaaggcctcaaaggtgtgtcgctccttagtaggaattgccatgcgctcttgctggatgacttctgcgtgcaggcttcatacttttaa

SEQ ID NO: 30366 - DNA, 125 bp, Glycine max
  Peptide Sequence Number=SeqID_147144
gtttcggtacaagattgactattgaggattcaaggattgagaatttcttcaacatgactcttgtagatgttgagatgcttgaacatgaggaagtgatgagggaggagtgcgcatttactagttag

SEQ ID NO: 30367 - DNA, 162 bp, Glycine max
  Peptide Sequence Number=SeqID_147145
atggaggcattgaagatgaagcttttctttgttgtcatggccatgttgatcatggcagcatcagctgcagattcaccagctccaagtcctacatcggatgctaccaccttgttcgtgccaacagcgttatttcttaggctcatatcaatcaagtttgcataa

SEQ ID NO: 30368 - DNA, 1335 bp, Glycine max
  Peptide Sequence Number=SeqID_147146
atgagagaaataataagcattcatattgggcaagctggaattcaggttggtaattcatgttgggagctatattgccttgaacatggcattcaacctgatggaacaatgcccagtgatggttcaaatgatgcacatgatgctttcaacaccttcttcagtgaaattggaactggccaatatgtcccaagggcattatttgttgatctggagcctagtgtaattgatgaaataagatgtggtccttacaaacaactctttcatccagagcaattaatgtctggcaaggaagatgctgctaataactttgcaaggggacattacacagttggaaaagaaattgaagagctgtgccttgaccgtatcaggaagttagccgacaattgcactggcttgcaaggattcttggttttcaatgctgttggtggtggcactggttctggcttggggtcattgcttttggaacgtttgtctgtagattatgggaagaagtcaaagcttggcttcatcatttatccttctcctcaggtatctactgcagttgttgaaccatacaatactgttctttccaatcactctcttattgaacacagtgatgtagttgtgctcttggacaatgaagcaatatatgacatctgcagaagatcactagaattagaaaggccaaattacaccaacttgaaccgcttgatatctcaaatcatctcttctttaaccacttccttgagatttgatggtgcaatcaatgtggacatttctgagttccaaaccaaccttgtgccatatccgcgcatccatttcatgctttcttcttatgcccctgtgatatctgctgcgaaggcctaccatgagcagctgtcagtgcctgagatcaccagagctgtgtttgagccatcaagcatgatggtcaagtgtgatccaagacatggcaagtacatggcatgctgcctcatgtatcgtggggatgtttttccaaaagatgtaaaccttgctgtctcaaatatcaagacaaagagacaagttcaatttgttgactggtgccctactggtttcaagtgtggtatcaactaccaggctccaacagtggtaccagaaggtgatcttgccaaggtgcaaagagcagtttgtatgataagcaacaacacagctgtggcagaggttttctctcgcattgaccacaaatttgacctcatgtttgccaaaagggcctttgtgcactggtatgtgagtgaaggaatggaagaaggtgaattctcagaagccagagaggatctggcagcccttgaaaaggactatgaagaggttggggatgaaggtgtagatgaagatgatgtttaa

SEQ ID NO: 30369 - DNA, 1040 bp, Glycine max
  Peptide Sequence Number=SeqID_147147
agctaaggaagtttttctgctactttgtgatggaaattcaattccagcatccaaagcagcacttgagagcaaacacatcaaaaggaggcaaagtattcaaagggagaaacaacaacaaaacaaaaagcaagtatgttggggtgaggcaaagagcatcagggaaatgggttgctgagatcaaagacacaacacaaaagataagaatgtggcttggcacatatgagactgcagaggaagcagccagggcttatgatgaagctgcatgcctccttcgtggatccaacactcgcaccaacttcatcacacgtgtgtccctcgattcccctctcgcttccaggattcagaatcttctcaacagcagaaatggtaccaaaaccaaacatcaagaacaagatgtggaaacttgtcacacaaggatcaagagcaaccgacaagagtcgtcggttgctctagcagaaggaacttgtcctccacaacatgatgaattaagatttgaatcttcgttggaagacatgtccacgtttagtatccaaccgtatattgatcaggattgtctccaaaagaaaatacttgtggaaaacgagaaaaaaagaagggtcaacagcaccactagtactgcaagtgctagtactagtaatagtactaattcaagcaataatagtgacacatgtgagaactcactttctagtgagacaacacaaaacacccaacaatttgatgatgatgatgatgcttataggcctgatttgagcaatttcatagggtctgagtcaggttctcagaacaatccttcatggggatttgaaccttcttcttttgttcattttccatttagccaagtaatggatgtggcaaacctgcctgatatagctggcttggagcttccagattttgaaaggatgaaagttgaaaggcaaatatcagcttcactttatgcaattaatggtgtgcaagagtacatggacactgtcactgttcaagactctaataataatgtagctatctgggattttccacccttgtgctcatttttgtgttaa

SEQ ID NO: 30370 - DNA, 983 bp, Glycine max
  Peptide Sequence Number=SeqID_147148
cagaagctcctggctgagaagacgaagaagaagctggaggaagctgcacagtcaggaagcgttgatggcgtcatcgaccctccatccccggtcagatgccatgtgaagtggaagatgaccagcacgaagaaaacaggggagatgatgactgaggccgcaaaggaaatcgctgagaagatcgattcctttgaggagcaggcgacacagggatccttcgtcccccatggatgtcaggatgttctcaccgctgctattggacatccagagcaccctggacgtgtacgtgctgctggagccggtgtcaccatcaagcaatactttggatcggctccacagacaaaaagtgacgcggcagctcatggtatcattcagccagatgcagtcccagatttagtcccagatgcaatctcagggacttgcactgcctcccgagcctctggttggtccctcagatcctgcccgctggttgccatggggagagtttatgagggatccactgttgttcataacactcctttgttgcctggccaagtaaaggtgagtgtggaggaagttacagatacagatgctccagttcctgtacccactgatgaggtttccttagtggggcaggcacttcacagattccttgcttggccgacacatctggtcaagtctttatcacagcaggtagctgtgtctccgacaaaactacctccgaagcccgatccggaggtcgatgatccgctttatctgatgacattgaccatcccagagattttcttgaggccttatcaggttagatgggatgccaccgtgttcggggtctttaatccagatttccccctctacataaagcacaaagacctctccgaaatctcacacagtggtcaatgtctcagcatatcagtgttacagttgtggattctgcatctcactgaaacatgtatgcgagtggggaattctgatatttatggattcctcgagccacagtccattcagag

SEQ ID NO: 30371 - DNA, 429 bp, Glycine max
  Peptide Sequence Number=SeqID_147149
atgcatctaagatcagaatcatttgaaattccacgtggccaaggtcacggaggtggtggtgacattgagttaggagaatatgcaaggaattcaggagacctgggcttggatagtttcttcaagaaggttcaagagcttgataaacaatatgctaagctggataagcttttgaaaaagctccaggatgcccatgaggaatccaaagctgtgaccaaagctccttccatgaaggctataaagcagagaatggagaaagatgttgatgaagttaagaaaactgcacattacttaaagaccaaaattgaagaactggacaaagagaatttggcaaacaggcagaagcctgggtgtggaaaaggatcaggtgttgaccggtcaagaacagcgacaaccatgtcagtgataatccagctttttaattcattataa

SEQ ID NO: 30372 - DNA, 561 bp, Glycine max
  Peptide Sequence Number=SeqID_147150
atggagaaggtaagcccatgccacaccaacactcctctcccacttcctaatcgcccttccaattttcttcaattcaagcaccaaactttcttcttcaagttcccgaacccgaacccgaacccgaacccgaacccgaacccgaacctcgttcgattgcgcaggctcaattgctcagtatcagacggcaccgttccgtcttcggttggtgccacggactcttcttctcttgcggtgaagaagaaagcagcagaggtgtcttctgagctcaaagggacctccatatttctggttggtttgaagagctcttttaaaactagtttggggaagctgctggcggatgcattgcggtattattatttcgacagtgataatttggtggaagaagctgtaggtggtgcactggctgcaaaatcattcagagagagtgatgaaaaaggcttctatgagtgtgagactgaagtactgaagcaattatcatccatgggtcgactagtggtttgtgccggaaatggcgctgttacaagctcaactaatctgtatggctttataactgctagctaa

SEQ ID NO: 30373 - DNA, 1923 bp, Glycine max
  Peptide Sequence Number=SeqID_147151
atggatgaagatcaagagatggagagatttggaatggagaatgattatgagggtggccaatggattggcggcgagttttactataagaatcgtaaagaaaaacgcactcagaccaaggatgatgttctttatggagtttttgcagattctgatgacaatgacgacgatgattatccgagtagaaaacggaggaaagatttttcgaagaagccagacctcaccaagcctgtgaattttgtgtctacaggcacttttatgcctaatcaggaaattgataacaagtccaaagagcaggatgagaaagacggttatgttagtgaggataggccagggttaggtttaggttttggtatggggtctggtttaggttttaattctggtaatgctgcgaatggttctaatagaaatgatgattctgatgagaatgatgataatagtttcttgcctacagcgtttgggaagaagattaaggagggggcgatgagaagggaaagggaacgggagagggagaggttggagaagaagagggggaagcatcagagtgcaggtcaagatgtgtctggtgatgttggaaaattcgagaagcatacgaaagggataggattgaagctgttggaaaagatgggttataaaggaggcgggcttggaaagaatgagcaaggtattctggctcctattgaggcgaaattgagggccaagaattctggcattgggtttaatgagtctaaggagactatgccgctgcctgttttgcagcaagagaaaaagaatgtgccggaaatcacccaacctgtggttggcagaatgaaggagaggttatggtcaaagcaagcaaggtcgaagaagaaaaaggaggaacaatatataactgcagaggagttgttggccagcaagcaagaacaagagttggaggttgttcagaaggtttatgatatgagggggccacaggttcgagtattaacaaatttgtctgatttaaatgccgaggagaaagcaaaagaaaatgatgtcccgatgccagaacttcagcataatgttgcgttaatagttcggttggctgaggctgacatccaagagattgatagagatttgaggagagagagggagacagcacttagcttgaaaaatgaaaaagagaagttagaaacagagacagtgtttcaaaagaagcagctggataatatggaggaaataatgagtgtgttggaccgtgttggagaagaaaacactttgggaacattaacattggattctctggctcaatactttagggacttactcaaaagatctgctgataactacaagttgtgtaacttgtcatgcattgcttgctcatatgctctacctctatttatcagagtgttccaaggatgggatcctcttcgaaatccttctcatgggttggagttggtgtcacagtggaaggcattgcttgaaggagaagattattttgatatatgggatgtatcatcaccttatactcaattggtttcagaggttgtattgccagctgtcagaatatctggtattaatacctggcaggcacgggatcctgagccaatgttatggtttctggaatcgtgggaaaagttacttccttcttcagtccttgctaccatattagacaatatagtcatgccaaaattatctagtgctgtagatacttgggaaccacaccgtgagaccattcctattcacacttgggtgcatccatggctacctttgctggggaacaagttggagggtatttaccaggtgattcgttttaaattgagtactgttcttggtgcctggcacccaagtgatggttctgcttatgctatattgtctccttggaagactgtatttgattctgcaagttgggaacaacttatgcttcgttttattgtaccgaagctgcagcttgtcttgcaagagttccag

SEQ ID NO: 30374 - DNA, 1449 bp, Glycine max
  Peptide Sequence Number=SeqID_147152
atggaggaaataatgagtgtgttagacaatgttggagaggaaaacactttgggaacattaacattggattccctggctcaatactttagggacttgcgcaaaagatctgctgataactacaagttgtgtaacttgtcatgcattgcttgctcatatgctctacctctacttatcagagtgttccaaggatgggatcctcttcgaaatccatctcatgggttggagttggtgtcacagtggaaggcattgcttgaaggagaagattatgttgatatatgggatgtatcatcaccttatactcaattggtttcagaggttgtattgccagctgtcagaatatctggtatcaatacctggcaggcacgggatcctgagccaatgttatggtttctggaatcatgggaaaagttacttccttcttcagtccttgctaccatattagacaatatagtcatgccaaaactatcaagtgctgtagatacttgggaacctcaccgtgagaccattcctattcacacttgggtgcatccatggctacctttgctggggcacaagttggagggtatttaccaggtgattcgttttaaattgagtactgttcttggtgcctggcacccaagtgatggttctgcttatgctatattgtctccttggaagactgtatttgattctgcaagttgggaacagcttatgcttcgttttatagtaccaaagctgcagcttgtcttgcaagagttccaggtgaacccggcaagtcagaatcttgatcagttttattgggttacaaactgggcttctgctattcctattcacctgatggttgatatgatggataaattcttctttgccaaatggcttcaggttttgtatcattggttgtgctcaaatcctaatttcgaagaagttacaaaatggtatttgggatggaaagaactcattccaaaagaactgttggcaaatgaaagtatcagataccagcttaatcgcggtcttgatatgatgaaccaggctgttgaaggtatggaggtggtccaacctggtttaaaagagaatataagctatcttagggtacttgagcaaaggcaatttgaggctcaacagaaagcagcagcctatactcaacagcaagctgctgctagcttgggtggtgcggtcaacgcagatggtgctcatgaattgagcttgaaagaagtcattgaggctcatgctcagcaacatggtttgctattcaagattaaacctggtagaatgcacaatggtcatcaaatatatgggtttggtaatgtcagcataataatagattccctaaatcaaaaggtatatgcccaaaatgaagaaatgtggtctttggaatctcttcatggtgtttataaaccatggtacttcagctgctgcataaatgagtcattctcacagtcagatgatggccctgccaattattccaagtag

SEQ ID NO: 30375 - DNA, 144 bp, Glycine max
  Peptide Sequence Number=SeqID_147153
ttccccgaggatgcttgcaaaggttctaagggaagtgaatgttccatgggtcaagcttttctgttacaaattttataccctgagcttcctggtggaaggagttgtggctctcatgtgtcattgatatttgtcctgaatccatga

SEQ ID NO: 30376 - DNA, 1350 bp, Glycine max
  Peptide Sequence Number=SeqID_147154
atgacgttctcagatttttacactatccctatcactcgttactttcctccctttaaggtgttgtctaccattcatttcacatttttcactttgcactccgaagagaggatgagagttcccaattgttcatcattcttcactctacccctacgtcatttcattaccttagcaaacacattgggtttcattctcttgatcttgttcatatctgggatcattgagttcccctctttttctttattatcacaattctcaacccaaccaatcaaagaccaatcaaaggctttcaccgacgtggttggtgcattcaaaaagtgggactccgaagtggggtgtgcccgattcaagaaagagataaaccaacaaagaaatggttcaaattatggtttttctacttctttgcaagatcaatttggtggccaattggaatgtggggtgctgaaaatgaaacatgtgagcatcttggtgaaagggtggacatggattcctgacaatttaaataacatgtacatttgcccatgtggattgagttgcttgtggacaaaatcactggttcttgctgacaaccctgatgccttcttgtttgaaacgactaaacctccggcacaaagaagcattggacaaccacttcgtgtatacatggaccttgaacctaaaagaaagcgatcaggtcgtgaagaaatatttattagttatcatgctaaagatgatttgcaatcaacctatgccagttccctattccataatggtcgaaattaccatatttcttcccataagaacaatgtcccacttgtttattggtcttctttcccttgtacaactcaaaggaacaaacttgcccacaaaatccttagtttattgcctcaccattcacttggcaaatgcctaaataatgttggaggaaaaaataaggcaccacgtttatatcctgaatgtgtagataatgctgcaaaacttaccaaatggtggaatcatttacactgtgtgatgtctcactacaagtttgtccttgtaattgagggcacttggactgagagttatattacagaaaagatattttatgccttagactctggtgcaattccaatctattttggtgctccaaatatcatggattttgtccctcctcattcaataatagaaggggtgaaattcaagtcaatggaagaattggcttcgtatgtgaaggccatagcagatgatccaatagcctatggagaattccatgcatggagaagatgtggtgtgttgggtaactatgcaaaaactagagcactgagccttgacaccttaccttgtcggttatgtcatgctattagcaaaaaagggggaagaaatgcagatgcctag

SEQ ID NO: 30377 - DNA, 873 bp, Glycine max
  Peptide Sequence Number=SeqID_147155
atgaggaacaaaggaaagaaacaggaagacaatgagttggatgtcatttctatcagaaccatggcccaagaaacacttggggactggggtggaacaatagctactattgcctatgttttcttgggatatagttccatggttgcatatagttccaaatctggggagatccttttccaactcatcaatctcccagcaccagtttcaggctctctattcactgctctctttacaatgcttgtctcaatttggggaactcgcgccactgatcgagtcaaccagtatctaactgcttccatgattggtttattgttggctattgaggtgctagctgttgtgtttgggggatggtcaggagttgggggcattagtgactggacaaaaattccaccaacaatacctgtgattattttttccctagtgtttcatgatctaacaccatttatatgctcttatttggaaggtgacattcgtcgtataaaaacttctgtttttcttggtgctcttgtgccactggtggcagtgcttgtctgggatgcagttgcacttggtcttgcagctgaagcagaacaagtggttgatccggttcagttgttatataggttgagatggaatggtgtttctattatggttgctgccttctcacttttggcagtaggtacatcacttattggcaccctcctagccttctcagagttcttcaaggagcaacttaaaaatggaacctggcattcccttcccactaaaaaggaaaattggtggggcaggaataaaataaatgtcatagctgcaacaatggtagttgctccctctctctttgtctcaacaacatttccggatgcattctctgctgccacagatattgctgtaagctga

SEQ ID NO: 30378 - DNA, 273 bp, Glycine max
  Peptide Sequence Number=SeqID_147156
atggattcaagatgcattacttcatctccctctttacatttgcgtctcaaaatccagagaaatgcaaaacaaaagccagtgattagaaggaagcattttgctagaaaggcccagaaattctccactggattgagcaagagaactagcaaagtagctgagaagaaagagggtactgttgctggtgcagttgctcttatcattggtactagtattggtactggaattcttgcacttccagagaaagccttccctgctgtactcccttttctctga

SEQ ID NO: 30379 - DNA, 116 bp, Glycine max
  Peptide Sequence Number=SeqID_147157
atgaccgagagcgagagtgagaccgtgagcgacactgaggacagtggtttcaacgccacaaaagtgagagtgacaacgggtttaagggagacgattcatgaaggagacgaagagtc

SEQ ID NO: 30380 - DNA, 387 bp, Glycine max
  Peptide Sequence Number=SeqID_147158
atgggtaaagtagaggaggcgcaagagcaggtgaaggccgacatggaggccatgaaagagcaaatggccacaataatggaggccatgatgagcatgaagaagataatggaagccaatgcggttacagttgccgctaccaacgctattgctaaggtgaacccgatgcccccatctggccttaaccaaatgaatcatccaacctcagatatggtaggcaaagatttgggaagtacggcgcaaattcaaaacaagcatgccttcccaccatatggcttgcctcccaactatacaccacccaatgtggcatacattcccaatgaggatgtcaataactccgctcccatactcattgaaagccgacaacctcatcatgcacatgtctcttaa

SEQ ID NO: 30381 - DNA, 1414 bp, Glycine max
  Peptide Sequence Number=SeqID_147159
atgctggatctgggcacggctgcggattacctgcgcggtgtgcagcagtacatcgaagccgagctgatcggtcgccagcgcgtgcccagtggccgtcagctggacaccctggccgatgccatggccagcctggagtactacctcgaagcactgcgcgaccgccgcccgggccgcgaggacattctcgacatcacccgcagcagccttgaagcgctgcgctactggccgttgccggaccgcaacgcggtggaacctgttgccgccgcgccgattccattcgcatcgctgctgatcgaacgcgagccggtcgcgctgcaggccgagccgttgcagccggagcgcatcgagattccggtgcagccggccgcgcccgccgctggcactgtgccggtgccgctgccggacttcacctttgatccgccacctgccacgcctgcaccggaggtggtggacaacagcctgatgttcggtgcgctggggagcgctgcatccgcaccgctgtcgttgcaggacgacgcagatgcgcccttggtcttcgccgcctccagcgcgcctgcacccgacgtgccgcaatgggatctcgcaccgttccattccgactccgatccggccgcgagtgccgaagacgagcgcagtccgaccttcgccagcttcgacccggtcagtttcgaacgggccgaaaccggagtgggatcggcgccgcagtggacactgtcggaggcaacgccgccggcagtggccgatgtggccgtgatggctgtcgaggacgacgtcgaagcgtcggtgcccttcgacaccgctgactttgccgcgccggtgttcgacccggtcgctgccgagcacgatgcggttgccgccggtgaggacgtggtattccgcttcgacgccgatgcgctggacaatgccgacgacgtgctgtcgctgcacgcgatggagacgctgtcgctggacgacgacgccggattgcatccgtcgctggagatcgtcgatgccgccacgcccctgcgggtagacgaaagccctgtggttgccggagtggacgccgttccggcggatgtgccggaggacgtgcccgcgccgatggccgaggtgctggcgccggcctccgatgcaccggcaccggcggtgtcggtgtcggtgtcggtgattgatatcgacaccatcgcacccatcgatttcagcgaagccgacgcgcagttctttgccgagctgagcgccgcggcggccgacttcaatccgcaggccatggcggctccgcccgctgcggacatcccggtcgtggctgggaccgaggccggcttcgaggcgggcttcgacgacgatgccgagaacatcgacgaggacatccgagaggtgttcctggaagagttcgacgacgagctggccaaccttggcacgctgctgccggcatggc

SEQ ID NO: 30382 - DNA, 327 bp, Glycine max
  Peptide Sequence Number=SeqID_147160
atgggtgaaaggatgaatggaaagggtggatcatcatcgtcatcctcatcgcctagtgtgaaccatccagggagaaggttttggaaatgcccacactggaacgaatcaagttctagcaaaaaatttgaatggattggtgatattgagactggcaaaaatgtttttgtaaaagggagtgagttggtccggtatgttcaggaaaatgaagagtcaaagttgaaacttgcttcattaagggaggaagctacaacaaatgcagaagaaataacatatttgaggaaaaaaaattgttgcacaagaggaataatgttgtgcatcctcaactga

SEQ ID NO: 30383 - DNA, 649 bp, Glycine max
  Peptide Sequence Number=SeqID_147161
gcttaagttcaacgacgatgcttacgtaagcattgtctttgaaagtaagccttctaagacggtgttgacgattaatttcaaagacggtgcttacgttaacaccgtccttgaaggttggcggttttctaaaatggtagcttttgacccgtcgttgaaagggttagcttttgacaacgtgggattctacgacggtcaacgaccatcgttggctttgcttggtatgaggagctttcgggtagattggatacccgttgtactcaacattgaaggttggagacaactgaaggcgagactcctaagattgtggaaccctaatagtggtatgaaagtcgtggatggtgatgggccattacctagctattcaaaggtggcatcctggattcaaccctcaaagaatgaacttaagaaagtcccagtttggattagggtcttcccaatggagtatgagggtttgaatctagtgtgctttgggtgtggccaattcgagcataaaaaggaacaatgcaaagcttttgataagggaccagagattgtgggagtggggctactattgatgcaatcctaccctgcaagggcattggatagaagactccaagaagattgggccaaagatgcaagagaaggccctagggttctcatgagccttagg

SEQ ID NO: 30384 - DNA, 447 bp, Glycine max
  Peptide Sequence Number=SeqID_147162
atggaggtcattcaagattgtttggaggaattctctaatgcctcggggcaatacctgggctttcctttgctccataggaaggagaaaaatgagcaataccatcatattctgcagaaggcaaaccaaagattggcgtcatggaaggctaaatacttagcttttgtaaggaggattacacttgctcaatcagttattcaagtcattcatgcatatactatgcaatctatcactattcctaacacaacttgtgatgagttggagaaggtccaaagtaaatttattcggaatgatggtgaagcagggaaaggatggcacactatttcttggaaagtgtttggtaaatctaaaaaagatagtggtatgggctttaagaagcttcactcattcaataaggcgtttatgatgaagttggcttgggagattattgataagccgaatgatctctag

SEQ ID NO: 30385 - DNA, 312 bp, Glycine max
  Peptide Sequence Number=SeqID_147163
atgtctgttgtttatggggctcctaaacaaactaatagggatgactctttcaaaaacatcgttcagggtgtgtgggaaggagacaggcagtgggatcaagctacttcaaattttaaggaacaagcaggacactggaaccaacaccattttggaagtattttccatttgaagggaaggccggtggctagaatggaggaggtggacaagagtatgatgttgaggacctcccaaggtttggtaaagttaaaggagtatctttggaagaagtatcaaaagattttgcaccatgaagatgctttttggtatcaatga

SEQ ID NO: 30386 - DNA, 427 bp, Glycine max
  Peptide Sequence Number=SeqID_147164
gaagcctgaggttggtccttcagctgctcgtgtcagcataaaggggagttgtgttgatccctcatcgaccgatccagacacgggtgactcagacaaatgcaggttgtacatcaaggaaaatccttctcacctggttgccctaggaagagttttgaaggttggtgttgaggaggttaaagatgcagaggctctcattcctgtacccactgacgatgttattttagtagggcaggcaattaacaccttccttgcttggccgacacatctcgtgaagcgtttatcagaacaactgtgtctccagcaaaacctccagataggctggatcatgaggtcgaggatcccctatatttgtgacattgaccatcccatagctttttttgaagcctctctaggttatgtgggatgctaccgtgttcatggtgtttaa

SEQ ID NO: 30387 - DNA, 330 bp, Glycine max
  Peptide Sequence Number=SeqID_147165
atgtgtcctcccaccatcgagtctggagccccgcgaatttattgcctagcgctgttcgccaattctccattctccacttttatccggagccccatgaatttattgcctagcgctgttcatgtgtcctccaccatcgagtctggagccccgcgaatttattgccaagcgctgttcgccaattcaccattctccactttttttcgaagacccatgaattcattgcctagcgctgttcatgtgtcctccaccatcgagtctggagccccgcgaatttattgcctagcgctgttcgccaattctccattctccacttttttcggagccccatga

SEQ ID NO: 30388 - DNA, 411 bp, Glycine max
  Peptide Sequence Number=SeqID_147166
atggcatgcaaccttcgcttgaccgcttcgaggaacttgacacccatcgttaagcaatctgtgaagttccgcgacatgtcgggagtcgaaaggaaacattattacgcaatccataaacaatttgagtctaggcccttctcgaacattttggaagttgggttgcttaagggaggaagcaactgggcggcaagctcctccacgtttttgaaaaatggtttccggggcttccgtggcttccgtaatgattccgtaaaattttccgaaaacctgggaaaaatcgagtcgaagtacttccgtaacgcttccgtaagcgattatgtgggaaatttttcatcgttcttcgtcgttcttcaccgttcttcatccgttctttgttcgttcttcgttcttcaacggttttcttttctttag

SEQ ID NO: 30389 - DNA, 738 bp, Glycine max
  Peptide Sequence Number=SeqID_147167
gtgtggagtgttctctcatactccaacctggctcctacttcccacacctcgaacttgacagcagatcgagctaggctgatctttggcttagtctctcagatggacatgaatgtgagagctctcatctctggtcagattacatctatggcccagtctaactctactagacttgggttccctgctcttatcaccgctttatgtaagtccagaggggttgcttctgatagcctggtcttcgaacgcctaagcccggtcattaacttggcatatatctggaaaaactgttggaaccctgatgatctgacagttactatcagaggggccaggagagcgaggacaaggctagctgaggccccttccacatctacaactcctcctctagcaccctggcccgggactcagttttctcttcacaaggaagatgaaggtcccacagcccaggtaccacagcagatggaggttgagtcatccaagactaccattccaaagcccttggtcagaaggaagaaggcagatgaaacacaagaagctgcagccacttctgagaaatctcttgaggccacttctgagccttcagaaccagtggcagatacaacttcacctcaacaggcagcagaatcttccactcctgaggatcagactacaccagtcctttctctgaacacctctcctacagctatccctgtgctttacttaacagacgaggaggatgttcagacacaggatactcacgactaa

SEQ ID NO: 30390 - DNA, 267 bp, Glycine max
  Peptide Sequence Number=SeqID_147168
actagtgctttgaaaggacttgatgatactccacagccgaaatccaaggctgctgctaggtggattgttattaagtgtaatagacaaaaaggaatcactgaatgtggctactacgtgatgcgctggatgtccacgataatcttaggatctttcaggaataattgggagacgtattttaatgaagttagaccattggaagcagagagattcaaggcacttcgcatacagtgggtacattattatctaaaagttagaaatcaaacatag

SEQ ID NO: 30391 - DNA, 381 bp, Glycine max
  Peptide Sequence Number=SeqID_147169
atggcttaccgagtgaagatccgtacgcacaccttggcacatacaccgagatctgcaacacgtcagaagaaggaggatgctgaagctgacagagtattgcaagatgctagcaaagaggaaggagaggatacaaagagggaagaagatgatgaggggaagaagaagaatgatgaggtcttaatccctaagaccaagagtcagttagctcgggaggccaaaagagagatacccccagcctcaccaaaggaagcaccattgatggcagcttgcttgagaagcttctatggaggttggatctttgagcttcaatggggtccttcaatggtgattttccaccatggagatacaatggatgataaaggagaagaggtgagaggatga

SEQ ID NO: 30392 - DNA, 123 bp, Glycine max
  Peptide Sequence Number=SeqID_147170
atggaggaggcacgaggagaagccttggctgcgcagcaacactggtttcataggagtaataagccttctggtaatcgattacaggatgttgtaatcgattacaggctgcctgttcttgtgtaa

SEQ ID NO: 30393 - DNA, 285 bp, Glycine max
  Peptide Sequence Number=SeqID_147171
atgactatgcccaggttgggtcgggattggtcaagcttggttttgggcaatagcaccccacctggcatccccaaggtctcctggcccccacgacatatctccaggaagactgactcttccacactttctcacttcaagcttgtaggattatggggtactcatcatatgtggtactatgtggcgatcgggcgatggtgcaagtcgactctccacatccacaaatcacacataaatccaccatccccagttgcccaccttcaactgagctcacgtacttccacgtag

SEQ ID NO: 30394 - DNA, 354 bp, Glycine max
  Peptide Sequence Number=SeqID_147172
atggagatgggtgttaagccttccgaagtgatcaacaacggtccccagatgaaattacggattccatggcgatgggtgttacacccccactttgctaaatacactcccactttcgtgttcttggccgatttctctctgaaacatcctggaactttacggattccacgaaaaattgtcatgccgcctaaggcatctggtgcctccttacaaggaggaagaagtaacaggaaagatttcaaattggctctaccagagccatccccaaaaagggttttaccctccaaaatcgggtcatcaacccaagctgggtcatctacccagaaatcaaaacagcaagatgggtcatttacctaa

SEQ ID NO: 30395 - DNA, 717 bp, Glycine max
  Peptide Sequence Number=SeqID_147173
atggtagccacagcataccaaacgtcccatgagtgtccagaagaaacaattgtagacattcttgtggcaggattttctggtcaattaaaaggatggtgggataattatctcactaatgatggaaagtcaaaaatctacagtgctattaaaatggatctcaatggaaaagtcattacaaatgacgataatgaagagatccctgacgctgttaataccctcatttttacaatagccaaacattttattggtgacccatcactttggaaagataggtcagcagaattactatccaaccttaagtgtgggactttagtagcagactttagatggtatagagacaccttcctaactagagtttacactagagaggatagccaacattctttctggaaagagaaatttctatctggtcttccaagatcattaggagataaggttggagacaaaatttgtagccaatccactaatgaagatattccatatgatagcgatgacaaaatccagaggcaattggccaaggaaaaagcccaaaataagagagacttaggatctttctgtgaacaatttgggttatcggcctgtccaaagcaaaagaaaaaacaaaaccccaaaacaaagtttcaaaagaaatatgcccctaaaagaagattttcaaaagaagaaactggggaagtatccttagaggaaaatctcaaccaaatccagcaggatgattag

SEQ ID NO: 30396 - DNA, 189 bp, Glycine max
  Peptide Sequence Number=SeqID_147174
atggtgaatcaaaaggttcttaaagggtgttcatgtttgaaggttatttttcataagagtgtggtggcatgggttaatgtggagaaggtgggtagtttaccttttaaatatcttgggttgcctactgaggaaaatcctagaaagaaggataccttgaagcctacgtcaaaggttatcagaaaaagatga

SEQ ID NO: 30397 - DNA, 747 bp, Glycine max
  Peptide Sequence Number=SeqID_147175
atgtcccatgagcttgtcaatgatactaacatttttttcaagaaatatgttgaggcaagatattatgctagccttaagagggaggtctatatagagaaaaaagtagagctcgaggaagaggagttcactgttattcaagatacatttgaagaaagaaggtggaacaagttgaaggaaccatgtgtttgtagtgaaacccttaccaggcttgtaccccttcctcctaaaccattgattctcaatgagatattagaaaagatgcatgaggagatgactttgaagatgggtgtaaaccaaacatcaaatctccttctctttgaggatttgagagagcttatggtcaaagataccattggtggagctaagggtgatgttgttactaatgaggagcccgctgtcagaattgatgaggatgttactgagcatatggagcctattgttaaggttttcattaaggctatgacagatgtagatgtggagcctattaatggtgaacttaatgattctggtgctatggaaggtgatgttgtgatggaggagactagtgctagagatgtcattgctgaagacgatgaagctacttctaaggagactaatgaactggctaacatcattggaggtgtcatctttgtcattgctgaagaaaccactattgagatggaagctgaaaaagatgttgaagtagttggtgacaccactgagggtgttactaatgcagaagagatggaggaggagattgttccttga

SEQ ID NO: 30398 - DNA, 588 bp, Glycine max
  Peptide Sequence Number=SeqID_147176
atggttgtcttcaatagccaaagtgccattctacttcacttgctccaaggaatttcccctgagtttgcttcctacatagaagttaaaaaggagattagcgatgagaaacccttcaaggttttgaagaaaaattctgatgcctttgcaattcccatgaaggagcttaaagtccttcaatcatataaggccaattggatttatagggagaatgtcaaaatacaaacgaccctagaggatttgaagcttcctcatgaaagtctccattctttgaatgacaagtgtttttcaggcttggtcctatgcgaacctcttattccattgttgatggcaaattttgtaagttcgagagggggaaaacgggtcgaggttgaaccaaaaaccgacgaagactcgagcgaggaggaagaagaatttcaacaaattgagaagcgactcgagaatgaatcttatctttctcctgataagcatgccgaaaaggaaaatggtgggaatgatcttatcaaggagaaatctatgaatgaaaatgcaccacagaaagatggagcatcagacttggctcttacaagaggcattatccttgttgaatga

SEQ ID NO: 30399 - DNA, 304 bp, Glycine max
  Peptide Sequence Number=SeqID_147177
atggcaaagaatgagatgaaaattactggacttatgattatgttcatgattgtgttgggattttcacaagctaattacaatccttcatttgtgaaaattggctcaaatcgtgtgtatgatggagtctattgtcaggataaatgtagttcagcatgcgcaaaatttctactacttccaggtggtgtccttgcatatgtaatatgtctttatgcatgtactgcaaaatgtcatgacaatcccatcgatgttgcccatgattgtatcactggttgtgccttgaaaaactccgttgatgccaacatcg

SEQ ID NO: 30400 - DNA, 315 bp, Glycine max
  Peptide Sequence Number=SeqID_147178
atgcctagaagctttcaactaaaagaagtatctcaaaggatgtggatacaagttattaacaactatttcgaaagacacaagaaatacctccattattatcagttaatggtacaagagtcttcaagtgcacatgcagtgcatacaataatcaaaatcaagccaagcacaaaacatgcaaaaagtgcacaaacatatacaatgaaaaacaaaaacattaaaaaacccaaaaacagcctgtaccgtgaacaggtgttctcgctctccaaacctccaaacagcgattcaagcaagcaattgattggtagtggcggatga

SEQ ID NO: 30401 - DNA, 537 bp, Glycine max
  Peptide Sequence Number=SeqID_147179
acacttgtgcatacagcccttacccctaactatgttttgaagagtttgattgctttgtggtgtgaaagcaatggtattgagctaccaaagaggcaagggaactgtagaacaaagaaatgtggtggcagcagtctttcagaggatgttgctactgctctaataaagttactttgtgaaggtactcctacaggtaagaaggatgttgctactactatcttcaacctatctatttatcagggaaataaagcaagagctgtaaaagctggtatagtagccccactgatacaatttttgaaggatgctgggggtggaatggtagatgaagcactagctattatggcaatccttgcaagccaccatgaaggcaggaatgctactgctgtcttgtggtcactatgcaccgaagatccactgcaattaaaactagcgaaagaacatggtgcagaagcagcactgcaggagttgtcagaaaatggaagtgatagagctaagataaaagctggaagcatattggaactcttgcagcaaatggaaggg

SEQ ID NO: 30402 - DNA, 390 bp, Glycine max
  Peptide Sequence Number=SeqID_147180
atggcctcctatggtggtgagcttcctctctctcttccttctccattccgctgccattcatcttccaagaagcaaaggaatccattgatgaagaagatcctaggccttcaagctccaatggagcttacatcacctagggggtggacatactctttcgaatttgactctatggctccacctagagtgcctttggaaggatggatttctagaggcactctaggtggagccataatgtcaaattttaaagagtatttgtcctcccctaggtttagagggaaagaacttagaagggtagttaggggactgctgcttctgaagttctatgggagcacaatatgtggttgtatgtgtccagtagcaagtgttcctgaagagaacttagaagagtag

SEQ ID NO: 30403 - DNA, 114 bp, Glycine max
  Peptide Sequence Number=SeqID_147181
atgaatcgaggtactgggggacgggcacgaatggatgctaggcccatgatcaacagatcgttgtcccgcgtccagctccggacaatcgagaagcactactgggaggcagcctag

SEQ ID NO: 30404 - DNA, 569 bp, Glycine max
  Peptide Sequence Number=SeqID_147182
gtactgccaaggagtttcaagagacctggcgggcgcggacggccgccaggccggatccggacctcaatccattcgggccggcttgtcgcgatcatttcgtcacgcttggccatgtgccgcatgatgaagaccgccaccggaatggtgagcaggaaccagaagttcgtgtacatgctgagcagcaacaacccacctgccaccatgaaaaatggcaggtaggaggtgctggtgccaccaccgcacttgccgtcgctgccatcacccagcagcatgcgcgcgatctggccggcggcgccgatcagcacgccaccgatcaggatcggggcgacgtcagcgatgcgcttgtgcgcgaaggcgatctgataaccggcgaagatcaccgcgatggtgaccacggcaatcgaggcgatgttcagcaggccgttgatgttgttgaagaagccgcagaccttcttgtcggtgccgccgaagtcggtagcaccgttggcgaagacctgcggggcgaacagtgcgccaacgaagagcgtggccatcagcagggttttcagcgtgcgctgggcctggacgag

SEQ ID NO: 30405 - DNA, 588 bp, Glycine max
  Peptide Sequence Number=SeqID_147183
atgcaggtggcgctgtccagcattgatggcatcaagattccgaatgaccctggattgcaggaagacaagacccgggccatgtggttcattggcctcggcactggtggtccagcggtgactgcggaccaagcagttgttccaacgatggttgttctatggcatcggaaccatgttctcgatggcggtgctggcggccatggtcttgattgcgctggacatggtgatccgcttgtctgcgtcgttgtgggtgacggcgctggtgaacaagttcccgctgatgggcgcatccagcgacggcatgtccagtcaggcgatgcagcagggccgcatgggattgatcctgacgcccctgattctgactgcgccccaatagcggctatgttcttccagggcaacttgggtagctacatggcatattcgcagattggtggctcgccggccgcgcaaccaggaccacagggccaaccgcccggatctacgggaggctcatcctacaagcccagtgctccaagtaacaatcacgcattcgaagcgcccgctcagagctcgatgcccaggtttggcagtgccgttgatgcgcccgtgtag

SEQ ID NO: 30406 - DNA, 222 bp, Glycine max
  Peptide Sequence Number=SeqID_147184
atgtcctttcaagttggaacaactaaccagaaagtgcttcatatcatgtatagaaaaagtgctttggtatattggatgcaaagcttctacaaagagaggccaagaaaaagccagcacagggaagtattggtgcaagggttgcactctctcaaggaattagtaattgaggggggtggttttaatcctttgcaaaccgtatcaaggtgtacccaccctaattag

SEQ ID NO: 30407 - DNA, 135 bp, Glycine max
  Peptide Sequence Number=SeqID_147185
atgaagacggtgccttcgaagtatgtcgtggaaaaaggagaaaacagccttcaaaaatgttattacaaaaatgtcaccgataaagcaacaagaatgggtgttcctcaccgatgtagaagctacgttgttaattaa

SEQ ID NO: 30408 - DNA, 225 bp, Glycine max
  Peptide Sequence Number=SeqID_147186
atgggtgccaagtaccttgaagtggtcaaacgagggtcgcatcccaacaacggatggtccccggacgaaattaggtttggggctgaggtcgcatggcccagagactggctcgaggcccaggtaggggaggagcctgcagaatcccccggtgagacagaggaggcccgtatggatgaagatattactgacttgctcggtttcttgggaggaagcggagccacgtga

SEQ ID NO: 30409 - DNA, 201 bp, Glycine max
  Peptide Sequence Number=SeqID_147187
atgtatattgaggtcttcaaggatacgagagatcttgtcgatgatgaggatcttatgccatttgagatcacattctacctggggatctgcagtgaagggatatccggggaagacatagttttgtccaacgaggagtgtgaatcctcagaagacgagagtgacccttctgagggcggaaagattctatactcagtgtcgtga

SEQ ID NO: 30410 - DNA, 267 bp, Glycine max
  Peptide Sequence Number=SeqID_147188
atgggcttagaaatctaccttgaggttcatgagaatcctagggccttcttcagcagctctagtccaatcctcttggagcctcttgcttatggctctggtgagattgtctttgagcttctccaacatctaaaaggaaatggagcaagaagcttgttagagggaataaaaaagagcacaagagaaatgattgaggagcaagaaccttatgcttgtgatccttctagtcttccaaaagatccctcaatcaaggaaatggatgctaaatga

SEQ ID NO: 30411 - DNA, 234 bp, Glycine max
  Peptide Sequence Number=SeqID_147189
atgggtgcgaataaccataaggtatctccgcgtatcatgggtatctccgcgtatcatgggtgcagaatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaag

SEQ ID NO: 30412 - DNA, 1031 bp, Glycine max
  Peptide Sequence Number=SeqID_147190
cgggagcgcgcagttgccgaggcacgccgagggcgcgcgctgtccgccacgatcggggcgacggcattccacgggcatatcaactgctcgggctttggccgccgcctcaatccgcactggtccgcgcctcgagtcgatcggcggaccggcattcaccgttccacatccgaccgaggcgcatcgccggcccccatccgcttccctcccgacaatttcaagcactctttgactctcttttcaaagtccttttcatctttccctcgcggtacttgttcgctatcggtctctcgcccgtatttagccttggacggaatttaccgcccgattggggctgcattcccaaacaacccgactcgccgacagcgcctcgtggtgcgacagggtccgggcacaacggggctctcaccctctccggcgcccctttccaggggacttgggcccggtccgccgctgaggacgcttctccagactacaattcggacgacggggccgtccgattctcaagttgggctattcccggttcgctcgccgttactaggggaatccttcgggtgatcccgcctgacctggggtcgcaatcgaaggcgccgatgtggcgccgttgggtcgttgttgatgcccgagcggacgatgccgtcaagcaccgcagcaagcgagtcgagaattcaaccaccactgctcgtgacgtgcatcgccgagggatctcatttgggccagccgcgcgcgagcgcacgggagaccaatatccgccccccgatcccgccccgacggagcgagaggggggggcgacgcaatgcgtgacgcccaggcagacgtgccctcggcctagtggcttcgggcgcaacttgcgttcaaagactcgatggttcacgggattctgcaattcacaccaagtatcgcatttcgctacgttcttcatcgatgcgagagccgagatatccgttgccgagagtcgttttgacattcaagacacgtctcgcacccccgcgcacgtcgcgtacgaggcaacgggggggcgggcgcttcgttga

SEQ ID NO: 30413 - DNA, 936 bp, Glycine max
  Peptide Sequence Number=SeqID_147191
atggttgctgctgaagtaatgcctgagaaaccccttcatggagttccaatcctttcaagagagagcagtttttcatcttcacctagaaggttggaaggcaaggtagccattgtaaccggtggagcaagagggataggcgaagcaacagtgcgagttttcgcgaagaacggtgcgagggtggtcatcgccgacgttgaggacgcactaggcacaatgctggccgagaccttggccccatcagccacctacgtgcactgtgacgttagcaaagaggaagaggtcgaaaacttggttcgttccacggtttctcgctacggccaacttgacataatgttcaacaatgcaggggtgttggggaaccagtccaagaataagagcatcatcaacttcgacccagaagaattcgacaaagtgatgagtgtgaacgtgaagggaatggcgttggggatcaagcacgctgcgagggtgatgattcccaagggaattggatgcatcatttccactgctagtgttgctggagtcatgggggggcttggcccacatgcttatactgcttctaagcatgccattgtggggttaaccaagaacactgcttgtgagttggggaggtatggaattagggttaattgcatttcaccctttggggtggccaccaacatgcttgtgaatgcttggaagagtggtggtggtgatgacgacgatgacgatcagggtgatgagggtatcatcaattttggattgccctatcaagaggaagtggagaaaatggaggggtttgtgagagggcttgctaatttgcaaggagctactcttagggctaaagatattgctgaggctgctctctatcttgctagtgatgagtccaagtatgttagtggtcataatcttgttgtggatggtggagtcacctcctcaagaaattgcattggtttgtaa

SEQ ID NO: 30414 - DNA, 369 bp, Glycine max
  Peptide Sequence Number=SeqID_147192
atgactagaggagtttttagagttcatggaggtaacgtaatttttcccttttcttccaacattggatcgtgtgtaatgtcgatcccgcaagcagaattatggggtatcttacttggtatgtgtattgcttggagtaggggttttcgtatttttgaggttgagacagattcaaagcttgatgttaatttgctccataatgggtgtgccagatctcatccttgctatgttatgcttcaaaatattatgatgatggttaatcttggaggtagcttctcttggttgcatttgcatattctgcgtgaagtcaaccaggatttgtctccaatccttacacctaagcgtcttgatggtacaaattatactgaatga

SEQ ID NO: 30415 - DNA, 468 bp, Glycine max
  Peptide Sequence Number=SeqID_147193
atgagttccttccccaaagaggtctcaagtaaaggggaccccattatcccattcttgtttaatatcgtggctgagagtttatcgggtttgatgagggaggctcaaaagaagaatttgtatgacgcttttgaggtgggaagcgataaagttgaagtcagtatcctgcagtacgtagatgatactatctttttgggtgacgcctccatggctaatgtggctgccatcaaggctattctatggagctttgagctagtttcaggtctcaagattaacttttccaagagctgctttggggccttcggagtgtctgaggagtgggtgaaaattgctgccaacatgttgaattttagattgttgttgttgcccttttcttacttgggaatccccattggggctatcccaaggcagagcgaaacatgggacccaatcattgtgaagtgtgaaaagagattaaataagtggagatag

SEQ ID NO: 30416 - DNA, 408 bp, Glycine max
  Peptide Sequence Number=SeqID_147194
atgccaagacctctccaccctatcgtcgtcgtgtaccacacttctctcattcaccctcctcttcctcctcattctcctcacggtggtgggcccggtttcggcatggtagtcgtggtcccagagcaacaaaatgaacatcaacgattacgcctttggggactccaagaaatgcgaggggtactcaaagttcgtgaagctgagggttcctccatagcaggtgcaaccttcatctgtcatgttccaccaatcggcatcggtgaaagtctcaatcctgtcgattcttctttagtcttatttcctctattttataaagtgaagttgtcgtccccgtctagatcaactgtacccaataagtcaacaacgtctcttggccttaccatctctgtccctgtccccgtgcaatactag

SEQ ID NO: 30417 - DNA, 210 bp, Glycine max
  Peptide Sequence Number=SeqID_147195
atgagaggcaccctgcataagcctcaagcgaacctagggatagatcagaagttctcacctgcgggattgacagacagacccttggcatcactctatgaccttaaatcaggaaagtttcacttggtcacataccaaagtgcaacagtccattgccatccttcaatagggcacacgatcgatcccaaagccttatgtttccgtgttgtgtag

SEQ ID NO: 30418 - DNA, 240 bp, Glycine max
  Peptide Sequence Number=SeqID_147196
atgcatttaaaccttatctcaacaggaaagctagctaatgttgggatgataaaccagttcggtgttggcaaatggaagcttagtagaggaagcatagtcgttactcgaggcctaggatcttcttcatcaatggattcctttgcttcttggaagatgaatggcagcggagtaaagaaggaagagagagaggagacgccacttcaaggagaagatgagtctagaagaagctcaccaccatag

SEQ ID NO: 30419 - DNA, 703 bp, Glycine max
  Peptide Sequence Number=SeqID_147197
atgcaagcactgccttcccatgtgatgcaaacatcttttcatcatagggctgtttgtgataaggtggacaagaagggtctgggatttcgatcttcaaggcttgttagtacaagttacatgatgaaagttgactggctcttcccacaaagagagatgatctatgggaattttcaagaaaaccttggtttgaatattggtgatggtgctaaagtggaattttggaatgataggtgggttcctggagttccacctctaaacagctcgaagggtgatgatcaactgtcatgtattggatcggaggatgatgcagaggtcctgagaggatacgtgttttgctttggaagatcatggtgtcttatttctaaagctatatggtatatgcttttgcctcaaactatgcattcagaattcttggtccaggattcgaatttgtggatgctcagtaatttgaagaatgaggagagtgtaaatggtaagcagtggtaccatatttttgctcttgctgtggttcaacctactggtatggtttctcagatatggagagaagcggatcaccctccaaatggtcatttcaaattaaattgtgatggctcagttaattcaagtatgaagaacgtggctgttggagccattaagattggtttgcaaatagcttggagtcgtggcttcaaggatttcactgtgaaatcagattctctgatct

SEQ ID NO: 30420 - DNA, 690 bp, Glycine max
  Peptide Sequence Number=SeqID_147198
atgtcatcttcaccacctctgagaaaatttcttcaaaatccatgtctttcttctggttacatcctttcccataatgcgagctttgtaccttgggtttgggttgttctcatcattcttgaggactgcatttcttcttcatggattgcatcaatttctccttatcatctatctcaatggcttcctggaaactttgagtctccattattgaatcttccatcatctaagttggatgctccgtctaactcttctctatctggtcaggttattctatctgaggaggtttctctatctgattggtttctatcatttgagtgggttgtgcctcttttagaagagtctccccccttgagtttctcactttgggctttggcttctcagatcactggatatcatgtatatgcattccttcgccttagcatcaagctttgctctttcatctttcgaaatatggacaaaagccttgcacccaaagactctcaatatgcctcgaataggcctctgtattctccaccattgtttgatctcaagcattttagctttcttctagtctcccgttctactgagtggctacccctttatgatgcaatcctccctaggaagggaccagtcactaaagccataagtaagaggctccaagaagattgggctagagctgctgaagaaggccctagggttctcatgaacctcagg

SEQ ID NO: 30421 - DNA, 330 bp, Glycine max
  Peptide Sequence Number=SeqID_147199
atgaagaaattcttaaatgagttgggacatgatcaagacgattatgtggtaaactgtgataatcaaagtgttatccacttagccaagaaccccatgttccattcacactctaaacacattgacattcgttatcatttgatacgagagatgttggatgaaaagaaacaaaagttagagaaaatccatacaaactttaattggtctgatatgatgaccaagacaataccgaccaagaaggttgaaggctgttgtcaaggatcccaaattggtagtccaagagatccttcttcaatagcacaaagcatgactagatttggccatcaccattga

SEQ ID NO: 30422 - DNA, 243 bp, Glycine max
  Peptide Sequence Number=SeqID_147200
atgatgattggatgtggaatttcctggatgttgtggaagcttgggaggattgatggggacccggtgttgagaggaacgaggataagggctacgtgggagtacgtgagctcagttggaggtgggcaacaggggatgactggtacctggagatatgtcgcgggggtcaggagaccttggggacgtcaggtggggtgctattgcccacaaccaagcttgaccaatcccgacccaacccgggcatag

SEQ ID NO: 30423 - DNA, 382 bp, Glycine max
  Peptide Sequence Number=SeqID_147201
atgaccataaggtatctccgcatgtcatcgggctcgctgcctctggatgacaaaggtgcagaagacgatgactcgatcgtctccggatggcaaaaaggtgtgcagatgaccataatttgtctccgcatgtcatcgggctcaccgcctctggatgacaaaaggtacaaaatgaccataatttgtctctgcgtgccatcggactcgatcgtctctggatggcgaaaagactcgatcatctctagatggcgaaaaggtgtgcggatgaccataatttgtctccgcatgtcatcgggcttgccgcctctggatgacaaaaggtacaaaatgaccataatttgtctctgcgtgccatcagactcgatcatctctggatggccaaaag

SEQ ID NO: 30424 - DNA, 453 bp, Glycine max
  Peptide Sequence Number=SeqID_147202
atggcggtagggactaccagcaacagcacatcacccaaaagaataaaactttatatgaggcttcactattataaagtgagtcgaagacccaacatgaccacagatcgacctccattccctacggctcacacagacccaggtttcatgtgtgcacggagcaacctaagaattaacccaccctaccgaccaagcaaacagaaaattcccaggtgtcgcaacctaccctttggtgggatggcgacacgagggctcgcgggtgcatcttccatggaaggaaaacgcgcgttgtcgccaccaacatttattcgaggaaaacgtcggaaaaactggaaaaggcgtggtctacgaactttaagtgtgaaaggttcgggagttgtatttacgcacggggaagggggtttcccttgctcctacatattcctcaattgtgataaggaaatcagacctatgtag

SEQ ID NO: 30425 - DNA, 198 bp, Glycine max
  Peptide Sequence Number=SeqID_147203
atgaccctccagttagttgatcactccatcgcaagaccatatggagtgattgaggatgttttggaaattgataaagttgccacaaccatggcactacactctcctttggaaaaaacattgattaatcaaatggagtatctgactaaagaagaagagcatgaagtgcagacttgccttaaagagttatatggtgcatga

SEQ ID NO: 30426 - DNA, 1014 bp, Glycine max
  Peptide Sequence Number=SeqID_147204
atggaggagaccatgccccttcaagtgatggtaggaaacggttcagtcctggaatgccggcaactgtgccccgccaccaccttgcttatacaggatcactcgttcatggtgacgctgcgtgttttgccgttaagtggagccgacatcatttttggcattgagtggttacacactttgggccccattattaccaattacacctcctttaccatgcaattcacccatttaggacagcccattagtctccacgcagatgttcacacaaacactgacccaacctcagcccaccaacataaacacatcatccacactcattcagtctcaggtctgttccacctgtccctcctacccgtcaacttacctgaaccaaacactgacccgccccaccccattccatccattaacgagcttttgctcaagttccaaactatttttcagcagcctaccaccttaccctcccctcaacaacatgaccaccatatcaacctcatcccctcagcccacccagtcaacgttaggccctataggtacccccattttcagaagaccgagattgaaaagcaggtagcagcgttactcgattctggcctgatccagccaagtcgtagcccattctcctcaccggtgttattggtgaagaagaaggatggcatgtgcacggcgtatgtgcgagatcgtttcccgattccaacaatcgaagaacttcttgatgagcttggtcgtgcttcatggttttcgaagattgacttacgacaaggctttcgttatattttaatgacggatgacgacatttcgaaaaccgcatttcatacccatcacggtcactacgaatatagggtcatgcccttcggcttgtgcaacgcaccctcgacctttcaggcggccatgaactccctgctcagtcttttcttgcagaaatttgtagcagttttctttgatgacatattgatctatagtgggtcccttcctgatcatcttcatcatctggagtgcatttttcatgctttatcgtag

SEQ ID NO: 30427 - DNA, 405 bp, Glycine max
  Peptide Sequence Number=SeqID_147205
atggatcatgcccgattgattcatgggcttgttatgaagatgtacatggacccgggtagcatgatctcctcccaaatcactcagatcgcccaatccaactcttctaggttgggcttccctgctttgatcacgaccctctgcgacgctaaaaggggctcgagccactctagatgctccaccagtcattcctccgccaacagttcctcttccggtctctgccccgccttctcttctctctactcaccaagccagtatcttctcatacagagtcttcatcatctctccctccatcggttggttatgtcgccaaaggctttcttggagagtgtagcttggcctggggaccaagcttcctctgtcgggggaggtgacacctctgaagctggtgatcatgatatgctgtag

SEQ ID NO: 30428 - DNA, 681 bp, Glycine max
  Peptide Sequence Number=SeqID_147206
atgaacgcgttaagtgtgcctatatgcttagtctgttcatcgcagctgtcaaaatttttggattttcagatgaacgcactaagtggaccatgtcgtgctaataaggcaaagcgcgccctatgtgctaatcctgagtgttatttgattaaggttgagctaagtgccagcatgatggcatttaagaaaaggaaagctccttctacacctacccaggccatatttgaaagatctaggttcacatcccaagaggcttgggagagatacactgacattgtgtttgatgagttcaaggaggaactcgagaggagacattgggatgagaagctaactgatttttctgacagtagcatagacattgctattgtaaaggaattttatgcccacctctatggccccaaggataaatcacctaagcaggtgagggtgagaggtcactttgtgaagtttgatgaagataacttgaacacattcttaaaggcacctgtagtgttggaagagggggagaatttgtgtacttattctcgatttgcactcttgaggcctgatcctcaagagttggttgctaagctttgtatcctagggaggggattcaagcttaatgttgatgggcagcctttgaagattctgaggaagaacatgaccactctagctcaaacatggagtgttctctcctttttctaa

SEQ ID NO: 30429 - DNA, 1167 bp, Glycine max
  Peptide Sequence Number=SeqID_147207
gtcgactctagaggatcccacaccatcagaggggggcacgtcctcgccatcagagggctgcatgccctaaccttcagagcgctctacgtcctcaccatcagagggctgcacgccctcacctgcagagggatgcacgtcctaactttcagagggctgcacgctctcaccttcagaggaccatacgtcctcgacatcagagggctggacgccctcacctttagaggactacacgtcctcgccatcagagggctgcacgccctaacctgtagaggactgcacgtcctcaccatcagagggcttcacgccctcaccattagaggactacacgtcctcgccatcaaagggctgcacgccctatcctttggaggactacatgtcctcgcaatcagagggctgcacaccctcacctttagaggactacatgtcctagccatcagagggacgcacgccctcacctttagaggactacatgccctcacctccagaggactagacattcacgccttaagagcactacacgtcttcgccatcggagggctgcacgcctccacctttagaggacaacacgtccttgccatcaaagggttgcacgccctcaccttcagaggactacacatcttcgccatcaaagggttgcacgccctcactttcagagtactacacatccttgccatcagagggctgcacgtcctcgccatcagagggttgtactccctcaccttcagaagactacacgtccttgccatcagagggctccatgccctcatcttcagaggactccacgtccttgccatcagagggctccacgccctcatcttcagaggactacacgtccttgccatcagagggctgcacgccctcactttcagaggactagacatcctcgcctttagaggactacacgtcctcgccatgagagggttgcacgccctaacctttagtggaatacaggtccttgccagcagagggctggacgccctcaccttcagaggactacacatcttcaccatcaaagggttgcacgccctcatcttcagaggactccatgtccctgccatcagagggctgcacgccctcactttcagaggactacacatcctcgcctttagaggactacacgtcctcgccatgagagggctgaacatcctcacctttagtggaatacag

SEQ ID NO: 30430 - DNA, 228 bp, Glycine max
  Peptide Sequence Number=SeqID_147208
atggctggtatattcttccttttgaaacagcgaaataatttagagaattatgagcgggacgccacagcttctctgaaaagcattctgcatcttgtgactgtgaagaaaacagcagattgccctctcctggtggaagttggaccactgcttcagacacttctcttagcaggaccagtcccacagtggcaacaccctcctccacaactcaaacggcttagttttaattaa

SEQ ID NO: 30431 - DNA, 1110 bp, Glycine max
  Peptide Sequence Number=SeqID_147209
cgttcgctattatcggcgagccaaagtatgccgttgactttcatcacttcgattacgtcaatccggacgcacctaaaggcggcagtataacgcttgccgccattggcacctttgacaattttaaccgctacgccctgcgcggtaaccccggcgtacgcaccgatgcgctgtatgacaccctgtttaccacctcggacgatgaaccgggcagctactacccgctgatagccgatcgcgcgcgctttgccgatgatttctcgtggatggatattaccatcaacccgcgtgcccgctttcatgacggtagcccgattaccgccagcgacgttgctttcaccttccacaaatttatgaccgaaggggtaccgcagttccgtcttatctataaagggacgaccgtcaaagccatcgccccgctgacggtgcgcatcgaactggccaagccgggcaaagaaaatatgctcagcctgctgtcgctgccggtaatgcctgagtcattctggcgccatcataaattgagtgacccgctttcaacgccgccgctcgccagtggcccctatcgtatcagccgctggcggatggggcagtatattgtctattcgcgagtcgagaactactgggccgccgacctgccggtaaaccgcgggcgctggaacttcgacacgattcgctacgactactatcttgacgataacgtcgctttcgaagccttcaaggccggagcggtagatatgcgcgaggagagttcaacaaaaaactgggccacgcgctatatcgggcgcaactttagcaacggttatattgtgaaagacgatcgaacgaatacctcggcaaaggatacccgctggctggcttttaatattcagcgcccggtctttgccgaccgtcaggtacgtgaggccatcacccttgcatttgatttcgaatggatgaataaggcgctgttttacggcgcctacagtcggccaaacagctactttcagaacacagaatatgccgctcgtgattacccgaaggccgatgagctcgccctgctggcgccgatgaaaaaagaattgccgcctgaggtctttacccggatttatcagccgccagtttccagcggcgatg

SEQ ID NO: 30432 - DNA, 1531 bp, Glycine max
  Peptide Sequence Number=SeqID_147210
acacgtcctcaccatcagagggctgtatgccttcgccctcagagggctacactccctcaccttcagaggactacacgtcctcgccttgagagggctacacgccttcaccttcagagggctgcacacccttaccttcagaggactacacgtccttgccttcaaagggttgcatgccctcacctttagaggactacatgtcctcaccatcagagggttgtatgccctcgcctttagagggctacacgccttcacctttagaggactacacgtcctcaccatcagagggctgtatgccctctccttcagagggctacgcgccctcgccttcagaggactacatgtcctcgccttgagcgggctacacgccttcgccttgggtactagtaccctcaccttcagaggactacacgacctcgccttcagagggttgcaccccctcaccttcagagggctgcacacgctcaccttcagagggctacatgccttcacattcagaggactacatgtcctcaccttcagaggactacacgtcctcggcttcagaggacttcatgtcctcaccttcagaggactagacgtcctcgccttcagaggactagacgccctcacctttagagggctgcacgccctcgccttcagagggctacacgccttcgcctttaaagggctacacgccctcactttcagaggactactcgtcctcgcctttagaggactagacgtcctcgccatcagagggctgcacatcctcgcctttagaggactagacgtcctcgccttcagagggctgcacgccctcgtcttcaaaggactagatatcctcgccttcggaggactagacgtcctcaccttaagcgggctgcacgcccgcgccttgggtactagtaccctcaccttcagagggctgcacacccttaccttcagaggactacacgtccttgccttcaaagggctacacgccctcgcctttagaggactacacgtcttcaccatcagagggatgtatgccctcgccttcagagggctacacgcccttgcctttagaggactacacgtcctcaccatcagagggctgtatgccttcgccttcagagggctacacaccctcgcctttagaggactacacgtcctcgccttgagagggctacacgccctcgccttgggtactagtgccctcaccttcagagggctgcacgccctcaccttcagaggactacacgtcctcgccttcagagggttgcacgccctcaccttcagagggttgcacaccttcaccttcagaggactacatgtcctcaccttcagaggactacacgtcctcggcttcagaggacttcatgtcctcaccttcagaggactagacgtcctcgccttcagagaactagacgtcctcgccttcaaaggactaaacgtcctcaccttcagaggactagacgtccttgccttcagagggttgcacgccctcgccttcatagggctacatgccctcaccttcagaggactacacgtcctcgcctttagaggactagac

SEQ ID NO: 30433 - DNA, 1269 bp, Glycine max
  Peptide Sequence Number=SeqID_147211
atgcttgacctgctgaatctgccaggcatcaagcctgtcgatatgcgccacgaaggcaagtgccttgtgatagttgctgagccggtaacggtcgaggtgccattatgtggggactgcaacacccctatgcacagacacggtacgcgcaaaaacaagttcatggacacgccgttgtacatggagcccgtccgccttgaagttcagcgcccgcgctttcgctgtgagtcgtgcggaaaaatgtccatgccggagttgagttttctggatgacaaacgccgagctaccaaacgcctggtcgatgttattcggcaacagtgcctgggaaccaccttccatgctttagccgagcaaaccggtgtggcggtgaacaccgtcaagaacatcgctcacgatctcattgaggaactctcccaaaccgttcgttatgaaaccccggtcatcatgggtatcgacgaagtgaaccttgccggcgggtatcgctgtgtaatcaccaatctggcaaccaacaacgtctttgatatgttggagcatcgtactcaagagcacctgaagcccttcttcaaggatttgccggatgctgacaaggttgaatgggtctgtacggatatgtggcgacccttcaaacgttcctttgctcagcatctgcccaacgccaaactggtgatcgacaagttccatgtcgtcaagatggcctctgaagccctggaagcggagcgcaagaactatcaggcacagttaagcaaagaagatcggatttatgtcaaaaagtccattcgctggctaaccctgaagcggcccggcaacctgacgcccgctgagcaaaaggcgctggaggttgtaaagcaggcaatcccggaacttgccgtggcctatgacttcaaggaagccttcttctgcatctacgacgaacccgacaagcagagcgctcagaacgcctttgaggcttgggagaacagcctgccgccttatggcatggagcctttcaaaaaactggtgaaaacggtatacaaccattacgacgacatctttgcctactgggatgcgccgttctcaatcaccaatgggtataccgaagggctcaacggcttgatcaagatgtccaaccggttaggtcggggttacagctatgacatcatccgtgcaaagacgttgtactccaaagaagcacgcaaggttggcagtggtattcgagcaggacgaggcaaggtcgagtatgggccgcacattccgacattgttgaagcaggcagaaggtggagagttggattaa

SEQ ID NO: 30434 - DNA, 378 bp, Glycine max
  Peptide Sequence Number=SeqID_147212
atggtggttcacaaggtggagaagaagaacacgatccctctacttctgcttccatcaaagtcgacacctcgtagatctcgcatcaccagatcttacgaattggagcaacaccactttgggttgttggtggtgctagattggttcgttgctttgacgagaaggcaattcggaattgacgctagccatatatataccaataaaagttgtttaggaaaccttggaaaagcaaagtgtataggactcgtgacattcatggtaattggaaagattgctgggttcattaacttcatagacaaccttgaagcagaactttatgcaatatccgttgtcttaagctggcctgcttggaataaaggtgctccaaaggtgtggtattag

SEQ ID NO: 30435 - DNA, 258 bp, Glycine max
  Peptide Sequence Number=SeqID_147213
atgatttttcactctcctcttctccaaaacgctacccaaaccctaacacctcctcctccaccacccacgactaccggtggccgccgccagccgccgttgcttgccaccgaacccccacaccaagagggacactttaatcagagaagaatcctcctcaaggatttggtggagaaaattcccccaatcatccatttcatagcctctatgagtgtgtttttacacttcctttcaaaaacgcttgaaaatgagacattttaa

SEQ ID NO: 30436 - DNA, 276 bp, Glycine max
  Peptide Sequence Number=SeqID_147214
atggctaagcctagcaccaatgcgcttagcgagcttagagcgagattggcgctaagctcaaattcacttactcgcgctaagcgcgacgtcgagatcaggaagccccttttaagcctgatttgcacaaaattaaaagaggagagcctgaagagtgtgaatttcagagagcatagagcagagcaatgggccaagttttcatcttttagggagattagtgagtttttgagagattgtgagattcctagaggtggaggagacatccccactcctttgtaa

SEQ ID NO: 30437 - DNA, 306 bp, Glycine max
  Peptide Sequence Number=SeqID_147215
atgttgttcaccatgatgtcattcaagtgttacgtccagttaggaatcaactacctcaatgaagctacatcaaaggagaaggttgaacttggggttgtcatcatctactccacaatctcgggacctatccccttaaactatgcaccacccaatgttgtgattagagatcaaaatgttcaacaggatcagatggctacacttgtactcgtgcctacacctataccctcaacacttgcgcccacaccatcgtccattgaaccaacaccaacacctactcaacctccactacctcaagttcaagactaa

SEQ ID NO: 30438 - DNA, 564 bp, Glycine max
  Peptide Sequence Number=SeqID_147216
atgaacaagaagataaggcataggcttcaaggtgacaaggcttatagtcacttgaatgacccttggctggccattttggacatgctacaaatgggtagttttgcttttttcaaaactaccaaaatgaaagggataggatttgccaaaaatggggaagcacttactaagaagggtgggagaactatgactgccatgtgtcaagggtcctattcaaggaaaatgttgataaagctagcaaggtcaaagtcgtctctatcaaatctccacaagtttgtgcccttccacttgatggagaatcttccatttgacttgcctcacaccatatacataaatatcctcagaatcctgaaggaagtttatcatgtttttgacaagatggatgatgactctaacaacaccatcatagctaaaagttttgttgtttctaaacaacaaaagtttagcaaaactaaactaaaggctatgaaggttgcaatagaacaaagcctgaaggaagctccacaggtggacttggatgccatcaacaagaggatgcataatagtctagccaaggccatcacctga

SEQ ID NO: 30439 - DNA, 366 bp, Glycine max
  Peptide Sequence Number=SeqID_147217
atggccagccaaggtttgtggcatttgaggataaggggaatcacccttgtaaccatcaattttagggggagggcatggagcatccatgaaggatgcatatgtggatcagtagctactactacaactacacggtggagaaagaggcacgcctctattcacactttagatacatcctatcgcaacctacccttcggcaagagggcgacgcaagggctcacgggtacgtcttccataggaggaagatgcgcagagtcgccaccaacgtttattcgaggaaaacgtcggaaaaaccggaaaaggatgtggtctacaaactttaagtgtgaaaggttcgggagttgtatttacgcacggggaaggtattag

SEQ ID NO: 30440 - DNA, 444 bp, Glycine max
  Peptide Sequence Number=SeqID_147218
atggccctagctgctcatgccctaaagagagcaatggttgccaaatcaacacctacacccagagaagttgtcattctattgatcattccaagacgcatcaagacaaaggccactaaagtcaatcctaagattgaagtggagccacctaagagtgaatttgagaagaaagtcaatctttggatgccctttacaaagcttttatctgtacatgcaccagatcttgacctctctttagaagattactcttctcttggtaaacttcatgcacggatgtatgttagagatcaagcaacaacctatccacctggactgcacatctcaaaggccatcgatatcaagatcattgcaaataagatgtgtcctcatccactcctttgggatgctgctaagaaaatgggtttcaagttgtactacaatgaagagatgccctcaaggcagatataa

SEQ ID NO: 30441 - DNA, 282 bp, Glycine max
  Peptide Sequence Number=SeqID_147219
atgtgtcctcgtaggaaatggccccaaagaagcttccagccaagaggtctaggaaagatgtcactggagagcattccagtgcggccacacaggcagatgtggactttgacggacacaggttctaaagtgaggaacaccaacgatgatttgaggccattaaagtcttggaagaaggccagtgctacgagtttagccagaggaggatttaggcctccggcttttacgaggaggctatcagccagctgctatgcatttcgggacaagactttgcctatagcgtag

SEQ ID NO: 30442 - DNA, 501 bp, Glycine max
  Peptide Sequence Number=SeqID_147220
atgactcaggtgagtgtacgtattgcccagctaatttcagatgctatctaccagtttgcaaggattacacctccgaggcacccagtggacccagagaagtccaatagggcccttgggtttcctgctctaatcataggcctctaccagtctatggagtgtcgatcacccccacccagctcatccggcctcccattagtagggccttcaaagagaagtactgcatgcccagacaggtgcaggcatgtgactagccagcatgcggctaatcttagaggccaggtgcagcttaacgagagcttctattggcacacccagcaccaacagagccaggaccccagtcctttcccttggcctaccccagagcaatttggggccatggtggcttggcctggggattgggtcgattttgagacgaggtcgggacccacaagggcctttggggacgacaaaagagctcaagaggatggtgatatggctgacttgatggatttcttcacttga

SEQ ID NO: 30443 - DNA, 528 bp, Glycine max
  Peptide Sequence Number=SeqID_147221
atggtgaaccctgatgctcctagcccaagtgacccacatatgaaggaatatttgcattggacatccatcccttcttctccggtgtcaaatacaaacccagaacatctaacctcctcggaactccacccaaatttcctcaaaaaggcattgaaaattgcaggaaaaacagagaaacttatagattcatcgttcgatgtgcaggaaaatttggatgatggagattgcttttcattggattgggtgacatctccgtcacgagcttcttcaccaagaggtacggttgaaattgtgcgatggtgggatgagcaattgtgtttgttgtgtgcagagggtagtaaaaatgttgacatggttggtgatggatgggttggaaggttggggttgcggaatatttgcagattgttgctgtggttgatattggaagttgttaggtttttgtggctagcgatgattgtgatgccagaagcgattgcgaatgtgaagaggatcgaaagggtggccatgagtaggagcagattgcgggtttag

SEQ ID NO: 30444 - DNA, 267 bp, Glycine max
  Peptide Sequence Number=SeqID_147222
atgcctagatcaacggaccctcttgttattggaggtgtaataggagatgttttggagcctttcacaagtagcgtttctatggggatagtctataataattgccctcaagttatcaactgctgtgagctcaaaccctccaaaatcctcaatcgaccaagaattgaaattggtggagatgacctcaggaccttttacaccctggttatggtggatcctgatgcacctagcccaggcaatccaacccagagagaatatttgcactggtaa

SEQ ID NO: 30445 - DNA, 300 bp, Glycine max
  Peptide Sequence Number=SeqID_147223
atgcagcttgagtggaatctggtgttccaacacacattcagagaagctaatcagattgcagattaccttgctgggaaattaatggctcgtctgaagatcttcagtttggcagtttgctttctattatcttcttcttccactgctttgatcattttctcgtttacagttgaagtacatggccgctactgcctggaggttgcagagttagtctacgcagctgacgaaataacacaaaaactattcgatgaatccctactattggacgtggactttcataggagacaatctcttctcctgtaa

SEQ ID NO: 30446 - DNA, 208 bp, Glycine max
  Peptide Sequence Number=SeqID_147224
atgttgtatgcagagaggtgggaaaacacattaaggttgcaattttatctcaaaaacttcatgggttcagagaaggtggaaaaacacattaaagttacgatttttatctctaaaacttcatgggttcagagaaggtggaagaagacactgaagctgccattttttactccaaaaagcttccatttttatctgatttttatgtcaaaag

SEQ ID NO: 30447 - DNA, 348 bp, Glycine max
  Peptide Sequence Number=SeqID_147225
atggatgagctcatgagggtgcataaggaggactacactgagcttaaggagttctttgagactatctctaaaaggtccaatgagatgaccaaagcaagactgcaaagaactaggaagcctttccaaagcatagtcatgcaagtgctcaaaccaagaattgtctcatttgtacaacttatagataagttcaacaaccttaaatacaataatttgaagagcacaatgtggatgatattgaatgttgtgcatgagatgtgtggttgtccagacctcacgagttcgattcccagcggggcaattgctaagagggagattgttttccaggttgtggaatcaattgtcccataa

SEQ ID NO: 30448 - DNA, 766 bp, Glycine max
  Peptide Sequence Number=SeqID_147226
gaagctatcaatgtgaagtttgatgacatcaagcctaatacaaaaatatcagagttgaatgattttattacggatctcagagtagatgatgggattggatcctcaaccattggtgactccttaaccaaggtccaaacaagggcatcccccagacaacaaggaaagaggataggaggttctaaatgggtattcgaaaacaagttggacgaggcaagtaaggttgtgagaagcaaggcaaggcaactagatgtctcagagaaggtaggacctactgtgagaggtgggaaaaggcttatgactcccaagcttctagagctctctaccaagaaaatgcaacaacaacttgtaatcatgaatcaatcccatacaacaacatgtgtgatagatagggcaaagattttggccaacattctcaacaaaagcatccttcacaaggactctcagaaagcattatcctctagttatgatggaagcgacaatgttgatcacaaggacttagtccaaggtgcgtcttccatcaaagggaaacgcgtggagtcaccgccaacgtttattcgaggaaaacattggaaaaaccagaaagtcgatggtattagcaccctacgtgtccgtcacaagggacgacagcctctaatcaagtgtgcaaatcatgatgatggaagcttgcttgtggggcttctatggaggctggatcttttagcttcaatgaggtccttcaatggttattttccaccatggagatgcagcggaagacaaaggagaatag

SEQ ID NO: 30449 - DNA, 525 bp, Glycine max
  Peptide Sequence Number=SeqID_147227
atgcattttctgtggaatttgcgggaatcagaactggcgaataagtgcttataccatcttccccaaaactactcatctgggtattcaaaggacttggctacatatctcaaatactgtagggatgttgtctttgctggatcagaaccatcttatgggaatcacgaggaagaaaaaatgatagaatacctatggagattttatcagaatgaagagttggtttcaacaatcaaaattatgacatacctgtttatgattcctgatacaaaaccatcagaaaatgtagagcagtcaaatacttcttttaaccaaccgaggtcgagggataaaggatgcattggcaggacatccaaggaggaaaagattagaaaaaaaggttttaaaaaactctttcctgatgatgacaccagccttgaagatgacttgcctggaagggtgagcaataacaaatcccatgagaggttgtcagacagtcccaagagcacagttcaggaaaatctcatgtcaaggaagccattagacagatga

SEQ ID NO: 30450 - DNA, 159 bp, Glycine max
  Peptide Sequence Number=SeqID_147228
atggtggcaacgacggtgtggtggtggtgtggtgatggttacaacaacggtgtgatgattgtaatgatagaggcgacaacaacaaagtgtggtggtgatagtagtagaatagtagcaacagtgacaacgacgattgtgacaatgacaatggtgatatga

SEQ ID NO: 30451 - DNA, 213 bp, Glycine max
  Peptide Sequence Number=SeqID_147229
atgggatgcgatgaggttaatgatgttatagttgtgaccaatttagaggtgactgatcatatcagtgaactgagactgattaacgaagcaccgcagggtgggagtggtaacgatgacagtagtagcgatagtggtggtgtcgatagcagtgacgacgatggtgagagtggaatggtgatagcgacgatggtggtagtgggggtggaatgttaa

SEQ ID NO: 30452 - DNA, 375 bp, Glycine max
  Peptide Sequence Number=SeqID_147230
atggcaagtgctttgggtagcagagttgaatctgttcgaaactctcccttggtaagattttcgatcaactttatcagatcctttggctcttcttcttcttcatctgccgtttcttctgctcagaaccctaagaaatcaaagcgaagaaagaagaacttattggatgtggctgagttcttatctaactggggaatcggctaccacatggccaagactcactggaacgaagtttctgacgaaatcactaaaatcaatctttacaagattctggttgttgaaggcactggtaatcatgctgcactgctattcttcaatgatagtgtaggctacgctaagaatgcctttatgaattcttacattggccatataggataa

SEQ ID NO: 30453 - DNA, 654 bp, Glycine max
  Peptide Sequence Number=SeqID_147231
atggaaatggttccttcccctccacactgtacggtaacagagatcggaacgtggaactgcggaaaccggaatatctcacttctcagatcagatcaatccgacgtcgttgcagttataatggctccattcagcggcgatgagacggcaccgtttttcggcttccttggagccgcagctgccctcgtcttctcctgtaattcaatccctaatttctcaattagatctatgctcgaaggtatgggagctgcctatggcacagcgaagagtggcgtgggcgtggcttcgatgggtgtgatgagaccggagctggtgatgaagtctattgtccctgttgttatggctggagttttgggtatttatggccttattattgctgttattatcagtactggcattaatcccaaggccaaatcttattacctctttgatggttatgcacatctctcctctggtcttgcctgtgggctggctggtctctctgctggcatggctattggtattgttggtgatgctggtgttagagccaatgcacagcagccaaagctttttgttggaatgattctcattctcatctttgctgaggctcttgccctgtatggactcattgttggtattatcctgtcttctcgtgctggtcagtctagagctgattaa

SEQ ID NO: 30454 - DNA, 2778 bp, Glycine max
  Peptide Sequence Number=SeqID_147232
atgggagctattgctggagaagagctgctgaaatgggagaagatgcaaggagtgagcagtcgcgaagagaagattctggtgtcaataagactgaggcctttgaatgagaaggaaattgctgctaatgaatcagcagactgggaatgcattaatgatactaccatcttgtaccggaacacgctgcgtgagggttccacatttccaagcgcctacacatttgacagagtatttcggggtgattgtgtcacaaggcaggtatatgaggaaggagccaaagaagttgctctttcagttgtcagtggaattaactcaagtatttttgcatatgggcaaacaagtagtggaaagacatacacgatggttggaataactgaatacgctgttgcagatatttttgactatataaagaggcatgaagaaagagcatttatattgaagttctcagcaattgaaatttacaatgaaattgttagagacctcctcagcacggacaacactccacttagactacgtgatgatcctgagaaagggcccattttagagaaactcacagaggagactctacgggactgggagcatttaaaagagcttctagcctacagtgaagctcagagacaggtgggagagacatacctaaatgaaaagagttctagatctcaccaaattataagattggtacgtgcattccacttgacttccattaatggagttacaatctttcagacaatggagagttctgccagggaattcctgggcaaaggcaactcagcgaccctagtagctagtgtgaatttagttgatttggcagggagtgagcgcgcatctcaggcatcatcagctgggatgagattaaaagaaggttgtcatataaaccggagtttacttactcttggaacagttattcgtaagcttagtaagggaagacatggacacatcaattacagagactccaagttgacacgcatactgcagccttgtttgggtggaaatgctagaacagctatcatttgcactttgagccctgcacgtagccatgttgagcaaaccagaaacacacttctttttgcttgttgtgcaaaagaggtgaccactaaagcacaggttaatgtcgtgatgtctgataaggcattggtcaagcatttgcaaaaagaggtggctagattggagagtgagttgaaaactccgggtcctgctacctccaattgtgattatgcagcattattgagaaagaaagatcttcagatagaaaagatggagaaggagattagggagctaactaagcaacgtgaccttgctcaatcaagggttgaggatttgcttcgcatggtcggaaaggatcagatatctggaaaagctagcattaataatcatcttaatctgcaggaaggggaagatatctgggaagatgattgttcagtatcagagtcatccagcatttgtggtcctcatcgtcctaatacacatattagagagttcaacaatcctcattataatgatggagacagtgatcctgatgatcccgccattattatacattcgttagcttttgcttgtacagaagaccctgatgattattgcaaagaagttcgatgtgttgagaatggggagttagctttaccaatatctggagacgaaagtggaataagccaagaaatatcttcacatttgaatgaagatactggagacagtcagatccaagaaaattcaacattgctggagcagagactgcatgttgtacagtcaaccattgattctcttgtatgtccttcccctgatgaacaatctccacaggtcatgtcagaaaataataagaatcttagattaactagaagctggagttgtacggaatatcacatgactggttctcccgagtcagtagggggaatacagaggactccagccaatggatatgaaaaaggattccctggaaggccagatggtttgcagaagtttcctccattaaattatgatggttccacaaaattgttaaggaatggttctcagtcttccatgggaagtctttctgtggatgatcttagagccagcagcatcagaacatctgctgatgaggatattactagcatccatacttttgttgctgggatgaaagaaatggtcaaacaagaatatgagaagcatcttgttgatggtcaggatcaggagacaggaagaaagaacgtgaaagatgtgggtgtggatccgatgttggaggcgcctagatctcctttagattggtctctgcaattcaagagacagcagaaagagataattgaactgtggcaatcttgctgtgtaccattgacccacaggacctacttctttcttttgttcaggggtgatccaacagactccatttacatggaggtagaacttagaagattatccttcctcaaagaatcattttctgatggaaaccagtctgtgagcgatagtcagacaatcacactagcttcaagcgtgaaagctcttcggcgagaaagaggaatgcttgtgaagcttatgcagaggaggctttcggagaaggagcgaagaaggctatacgaggagtggggcattgcattggattcaaagcgcaggagggtgcaactagggaaccgtttatggagcgaaaatgatatgaaccacgtaatgcaaagtgctacaatagttgccaagttagtgaggttttgggaaagaggcaaggccctcaaggagatgtttggccttagcttcacaccccaactcacggggcgaagatcatcttatccatggaaaaatagctcaacatctcttttatag

SEQ ID NO: 30455 - DNA, 848 bp, Glycine max
  Peptide Sequence Number=SeqID_147233
atgaaaaattcaggagagtggtgtcaagcattgggaaggggttctgggatgagttttgagaaccgttctgatggtttgagccagatccctaacccctccctttacgcacttgaaaccatgctttttcataatcaaccgatggagctggttctccttcaaatcctgaggctggcatggctcgctgccacattacccatcatcgtcgcttctattcccactcccaagctcagctgcctccgtgccaccttgttggcttttgctcgtagaggcaaaatcatgcactcctcccaaaaattcactatttctcagaggttcttcttgcacttctacattgtggcttttatatggacaacgttgctacttcttgggacttgggcgtatgcgtacaacatggtgccacttgttgtggagccgttttcttactctaccatcactagcttcttgacaggtggttctactatcaaaactgatacgtataaattgaggcagggatatgtggcttggcaagcggtttttctgcttttgatgatggaagttcaagtcctcagacgactttatgagactagacacgtttttaactatagtccttctgctcgtatgcacgtcattgctagtttctacgtaggagcaccactatcgctgtgtggcggttgtgcagtagaggtgtttaacttcctagcaaatctagtgaccaagttcattgtcaagggcaagaatcagatgcaagtaacagagttagaattctggcaagttgtaaatcctctcttcaagcttgggtggaagcattggattggtgctgctgttttcttatgggttggattcatcaacaccagtgccataagattctt

SEQ ID NO: 30456 - DNA, 234 bp, Glycine max
  Peptide Sequence Number=SeqID_147234
atggcttataatgattatgagtttaaagaagaaagggagttgatgcatcaaaaagaaactcttgagtacaatgcttctcttaacaagcaagatgttcagtacttgcataatcatagaggacactgggcttatagctctcaattcaacaaggaaacactcattgtcatactacaggggatttttgctttggcgatgcattccacttgctatagtaagaattcattggtgaagtga

SEQ ID NO: 30457 - DNA, 192 bp, Glycine max
  Peptide Sequence Number=SeqID_147235
aacacaggggaggcgaagcaatgtacaacaacgccaaccacttcgccgcgccatgtgcataaaccacctgtatctgccaccgctccggcgccacaaccacttttcagcctcttcaaactcgccgcttgcgataagcctacgacgctcgtggagcagcttaagaaggagagcgagtggcttgacgaatcttaa

SEQ ID NO: 30458 - DNA, 303 bp, Glycine max
  Peptide Sequence Number=SeqID_147236
atggtaggtttacagccatcatcatggtacccaacacatgtaactaagaaagtgaggaaaatgcaagggtcatgcatgagtgaacatgacatgcaaatgatgaaaatagaatgtatgcagtattcaaaacaaaaaagcatgctaaatgtagatgtgtggtggttatatctctcaatggtttctagagatatcattccctttgacatcaatgttatggcgatagggactaccagcgacagcatatcatcaaagataaaaactctagatgaggtttcactatcatcaagcaaatcggggacttag

SEQ ID NO: 30459 - DNA, 429 bp, Glycine max
  Peptide Sequence Number=SeqID_147237
atggcagagaagagaaggttggatcacatagaggaaaggcttggagccgttgaaggaggtgaaaggtatgcttttgctgacttggcggacttgtgcttagtgcctgacatcaccatcccttcgaagttcaaggtgcccgacttcaataagtacaaggggactacttgccccaagaaccacctgaagatgtattgtaggaaaatgggggcatacacaaaagatgaaatgttgttgatgcatttcttccaggaaagtcttactagagtagctgtcacctgtattagtacaatttcgatatggctccagataggatgtagctacagaacttgtgcaaaagggagcacgaatctttcaaaaggattgaagtggcctggggcaaatggagagaaggagaaggaggaaggaacccatgttgaaggttgttgttag

SEQ ID NO: 30460 - DNA, 321 bp, Glycine max
  Peptide Sequence Number=SeqID_147238
atggaatgtgaccgtgaggctttggttaatgatccttccttgatatctgccattcctactagcttatttcagttgagcagtcatgctaagcggaacctgtgggctcagctcgcatctatcactaagcgcaactacagcatgcttagcgtgatgagaaaatctggaagagcacaagaatcgaggccatgcgcaaagcaagacattcgtctcttaccaggctcagcgcacgactggcaccaagcccaaatccacttactcgcgctaagcgtgacagtggcgctaagcatgatatcacgatttcagagcccatttaaagcctga

SEQ ID NO: 30461 - DNA, 375 bp, Glycine max
  Peptide Sequence Number=SeqID_147239
atgcttactccttttctattggagttatcaataaaagacattagacatggcaacggggcggggacgggtattgcctccccagtccctgaccccgactcctcaacatatccccgtcgggtattggatattcccgtccccgctctaaatgaggcgcttactgctgaggttcaaagactaaagcttgccacagctgaactaagtggcgattcgcatggttctggctgtttgattcctcaacattctgtcaatcctctgatgttccagcaacagcagcagcctcctactgcatcccaacaaaacattcatcttcaacagcagcaacagcagcagcatcagaatggtaatgccaactcaaattccgacttaaaacaatag

SEQ ID NO: 30462 - DNA, 1266 bp, Glycine max
  Peptide Sequence Number=SeqID_147240
ccctttgtcgccggttaccgcttcggctccgtcggcgtggcccacaacggcaacctcgtcaactataagaccctccgaaccaacctcgaagacaacggctccatcttcaacaccacctctgacaccgaggttgtcctccacctcatcgccacctccaaacacagacccttcattcttcgaatcgttgacgcctgtgaaaagctcgaaggggcttattctattgttttcgtcaccgaggacaagcttgtcgccgttcgagaccctttcgggtttaggcctttggttatggggagaaggagcaacggtgctgttgttttcgcttctgaaacctgcgcgcttgacctaattgaagcgacttatgaaagggaggtttaccctggtgaggttcttgtggtggataaaaacggtattcagagtctctgcctcatgtctcatcctcaaccaaaacaatgcatttttgaacatatttactttgcacttcccaattcggttgtttttgggaggtctgtgtatgagtctcgtagacaatttggggagattttggctactgaaagtcctgtggagtgtgatgttgtgattgctgtgcctgactctggtgttgtggctgcgcttggttatgctgcgaaagctggggttccgtttcagcagggtttgattaggtcgcactatgtggggaggactttcattgagccctctcagaagattagggactttggtgtgaagctgaagctatcacctgttcgtgctgtgcttgaaggtaaacgtgttgtggttgtggatgattccattgtgagaggaaccacctcgtccaagattgttaggctgttgaaggaggctggtgctaaggaggttcacatgaggattgcgagtcctccgattattggttcttgttactatggtgtggatactcctagctctgaggagttgatttcgaataggatgagtgtggaggagataagggactttattgggtcggattcacttgcctttttgccttttgatagcttgaagaggttgttgggaagtgaaagtccaaatttttgttatgcttgtttctctgggaattaccctgtggagccaagagagcttaaagtgaagagggttggggactttgttgatgatggcttgaatggaagcttggagtctattgatggtggttgggttcaggcaaaccgaaatcaaatcaagcataaggcatccctcagtggacaaaaatcagatgcagttcttcaggtgtttttggtgttgttcttcattttaaattga

SEQ ID NO: 30463 - DNA, 291 bp, Glycine max
  Peptide Sequence Number=SeqID_147241
atggcatcgcaacactcattcccgattaaggcatatatacaagtattaggtgcacgtgtgaacacaaagaagaactatgttgaaattgctgtcaatctatcaagaaaaaaacatgttgttaatgtcatacctactatgggattgtacgttcatcatgatcattctacccgccttatggccttgagaaaagttgagtatgtgaggaaaacccttcatacattcattgcatggttgagacatcttgtgagacctgtttcacatgaggattcacagatgtgtccaaagaaatag

SEQ ID NO: 30464 - DNA, 411 bp, Glycine max
  Peptide Sequence Number=SeqID_147242
atgaggttctttttgaagtttttgaagaactggctgttgagctttggagaaactcttcacgatgaaatcaatctacaacaagttagttttgaaatgatgtttgtttggcctccaataagggaaggtacactgctaaaggaacatcttgatgagataaactttgttctgatggagctacatgactttgatgtcaagagggaagaaaaagaagagaaaggcaaaggtggcaagaagagcaaagttgatcctaaggacatctgcaattactgcaaagaattgggttttgtacaaatcaaaatgcatcatggtgtcaatagaaccttgaatgaagttcatcatgttatagagcttaagaaaaatcttgttgaaggtggagttatgcagatcagagggaaagagaaacctatgtaa

SEQ ID NO: 30465 - DNA, 264 bp, Glycine max
  Peptide Sequence Number=SeqID_147243
atgaatgaagagtcattttgggtgatggtcagcaccacaccaacttgggtaagtctaggggcaagtggaaaggtgatacgagcatcgcatagtattttttcacatttgcatgttaacactttcattgtcaaagcattagggcaggtgccaacaggtatggctccgaagaagctttctactaaaagggccaagaaggccaccgcaaaggagggatccagtgcggccccgcgattggagattgagtttgacagacaccatttctaa

SEQ ID NO: 30466 - DNA, 543 bp, Glycine max
  Peptide Sequence Number=SeqID_147244
atgcatgaagagctaaatcagtttaagagaaatgaagtgtgggacttagttcctaaaccaacctctcacaagtcaatcggaaccaacatcatagtaagaaataaagcaagattggttgcaaaaggttacaaccaagaagaaggaatcgactatgatgaaacctacgctccagggtcaaggttagaagccataaggctgttgcttgcatttgcatgtatcatggatttcagactattccaaatggatgtgaagagcgccttcctcaatggtctcattgaagaaaaagtgtatatggatcaaccaccaggtttcatggactacaaatatcctaaccatgtctatagattgaaaaaggctctatatgatttgaaacaagcaccaaggtcatggtatgagagattgagcagttttctaatcgagcaatctttcacaagaggcctggttgataaaacattgtttattaagaaagtaaacagtgagttgctaattgttcaaatatatgttgatgatattatatttggtgctactaatgaaattgtgtaa

SEQ ID NO: 30467 - DNA, 1389 bp, Glycine max
  Peptide Sequence Number=SeqID_147245
atggagaagctagaagcagagaacgttctggtccttccctctgagcaacccaacaacaataggccaaagccaaaaccaaagcgtttcgtgaaaaaccaaatcccagactcaatccttaacaaccctcttctgagcgccgcaatctctgtgctcccttccaactacaacttcgaggtccacaagtgcgtctggcgcgtgctctccacgggagcaaaacgcgtggctctccagttcccggagggtctcctcatgtactctctcccactctccgacatcttcaccaccttcgccggcgtcacccactgcttcgtcctcgccgacgtcacctacggcgcttgctgcgtcgacgaccttgctgcctccgccctcggcgccgacctcctcatccactacggccacagctgcctcgtccccatcgacgccaccacaatcccctgcctctacgtcttcgtcgacatcaaaatcgacgtccctcacttcgtcgacaccctcagcttaaacctcctcgcccaaaccaaaaccctcgtcgtcgctggaaccattcaattcgcctccgcaattcgcgccgccaagccccaattggaggagttaggatttagggttttgattcctcagtccaagccgctctccgcaggtgaggttctgggctgcaccgcgcccaaggtatcatcgtcgaaattgctcggtggtggtggtgacattggtgaatgtgttttggttttcgtggcggatggaaggtttcacttggaggcgttcatgattgcgaatccggggattagggcattcaggtatgacccttacatggggaagttgtttttggaggaatatgatcatttgggtatgaagaggtctaggaaaaatgcgatttttaaagccagggaggctcggagttggggtctggttttggggacgctggggaggcaagggaatccgaggattttggagaggttggagaggatgatgagggagagaggcttggattatactgtggttttgatgtcggagatgagtcctacaaggattgcgctctttgaggattccctggatgcttggatacagattgcgtgtccgaggttgtccatcgactggggggaggcttttgtgaaaccggtgcttactccttttgaggctgaggttgcgctcggagtgatacccgggtggtgggagaagaatgaggtttgtgaagagggtgagggttgttgcaacaagagtgggtcttgttgtgaggatgcaaagggaggggaagattttggtggggattatccgatggattactatgctcaagatggtggggagtggaattcatcttatgtgaaaaagtctactcgtcctgccagaagagtttccgtgtcgtctgttgctgatactgccatttcccaacagccttag

SEQ ID NO: 30468 - DNA, 930 bp, Glycine max
  Peptide Sequence Number=SeqID_147246
atgccatctccccttggtcacaacacaaactccttcactatggccttagcagtgccaccaactctatccttttccctctccaaaccctctttattccttttccacaaatccaaactcctcccaatgaccaccactctcactcgcgctgacgtcaaaacccctctcctagttttctccaaaaaccagatttccgataccatcggcgcctacaatgtcgacgactacgataagccgcgaagaatgcggcgtggtgggcatatacggcgaccccgaggccttgcacctctgctaccttgccctacatgccctccagcaccgcggccaagaaggcaccggaatcgtcaccgtcaacaacaacgtcctccaacccatcaccggcatgggcctcgtctccgaagtcttcaaccaactccccggcagccccttcatcggccacgtccactactccactgtcggacaacgtctccatcttcaccaccacctccgacactgaggttgttctccacctcacgggcacctccaaacaaagacccttccttctacgaatcgttgacgcctgtgaaaagctcaaaggggcttattcttttgtcttcgtcaccgaggacaagcttgtcgtcgttcgcgaccctttcgggttcaggcctttggttacgggaaagagaagcaacgattttggctaccaagagtcccggtgagtgtgaagttgtgattgctttggctgattctggtgttgtggttgcgataggttatgctgcaaaagcaagggttgcgtatgagctgggtttgattaggtcgcacaatgcggtgaggaatttcgttgcgccctctcaggagctatcacccgttcgtgctgtgctcgaaggtaagcgtgttgtggttgtggatgattccattgtgagaggaaccacctcgtccaagatagttaattag

SEQ ID NO: 30469 - DNA, 318 bp, Glycine max
  Peptide Sequence Number=SeqID_147247
atggccattagaaaatcaaacaaacttccccaacacgcagtagttttgaagcaaatcctaaagaggtgttcgagcctaggaaagaaaaacgggtacgatgatgatgggcacccagttgatgtcccaaagggacactttgctgtttatgttggcgaaaaccgacgtaggtacattgtgccaatctccttcttggctcaccctgagttccaatcactccttcgacaagctgaagaagaattcggttacgatcacgaaatgggcctcactattccttgtgatgaagttgtcttcaggtctctaacatcctccttaagatga

SEQ ID NO: 30470 - DNA, 270 bp, Glycine max
  Peptide Sequence Number=SeqID_147248
atgaatatctctatatatagattaagagatggccttggaaaaccattaggcacagaaataattgatgaagagatatccaacaaatggggtctacctagagacactgtaacaagaaataatggagttccacttagcaggtattaccgtattagactgtcacaattttctgcatcgcaagcaaggaacctaagtggaatcaagtaccaaaaggataccttgcagactgtagtctatgctggagataaaatgacgaggatgccccagttgtga

SEQ ID NO: 30471 - DNA, 348 bp, Glycine max
  Peptide Sequence Number=SeqID_147249
atggccccaccttctcaaacaacggccagcataaagcatatatgcacttgcaaccgaataggactcgctctaccgaagcccaatgtttgttcatccattgaatattactccataattttgttaacatgctttagacatgtttccatcattttgaaaacacagcttaatgttgaattacagctgcaaacttcatttcaagacatgctcagtctatccgatgaagaatttgggtataaacgtccaatgggtggtcttatgattccttgtggagaaaatgtgttcttagatatcacttctcgatcgcttgaattaataggttctaaccctacaatgataagactgacatag

SEQ ID NO: 30472 - DNA, 1077 bp, Glycine max
  Peptide Sequence Number=SeqID_147250
atggaagaatatctcagtccattagctgttacacatcttcttcaacaaacactcagaagcttatgcatccatcaaaattctcaatgggtctatgtagtcttctggaggatcgtgccaagaaactatccaccacccaaatgggaaagtgaagcggctaatgataaatccagaggaaacagaaggaactggatattggtctgggaagatggtttctgcaactttgctacctcatcagcacctgaaattaattcaggcgattatcctcccttatcagtttatgggaactatgaatgccagccctaccaagggctccaacctgagcttttcttcaagatgtcacatgaaatctataactatggagaaggcttgatagggaaagtagccgaggatcagagtcacaagtggatagacatcaacttcttgtcatcatgtaacaatccagcagatttggtgaggggtaaaaagtggcatcttgcttgtacttacacataccctaggacctgggaagcccagtttcagtctggtataaagaccatagcccttattgcagtaagagaaggagttattcaattaggaggagttcacaaggtgattgaagaccaaaactacgtatttctattgagaaaaaagttcagctacattgagagcatccctggcgtgctcttaccacacccatcatcattttctgcataccaatgttgtaaggtggaagactatggtgcctcagagcaacggcatttccaagacaattataataatgttaaagccccaaatgaattatatcatgaccaatggggccattattactcaataaacagccttgaggccctactctttaacctgccttcagtggagtcaccaccaccaccaacacagtctcatttgtttccatctcaaagggacttggagtttatgggtttgcaaaatgaagtggcagagaaaaagttagatgatgtggtgcattggactgaactagatgtgggtgagagtagcaatttcatgtcaaggtaccaccataggtaccaagatcagaatgttattagtggtagtggagccaataatggattttggtattag

SEQ ID NO: 30473 - DNA, 405 bp, Glycine max
  Peptide Sequence Number=SeqID_147251
atggctgtaagcattttggacagcaacaatcattcacatcctaaagcatttgaagttcaaaaacttgcatcatatttacgactctttcttcacaaattctctttgcaagtctcagcacatacaacgatgggatttcgtctacctggaataagaaaggcatcatttgctgcaaacaaagcatcttcaaaatcagtggatgtaccaaagggatatcttgcagtctatgttggagagaaaataaagcggttcgtgatccccatatcatacttgaaccaactttcatttcaagatttgttgagtcaagctgaggaagaattcgggtatgaccatccaatgggtggtctcacaataccttgcggagaagatgtgttcttagataccgtttctcgcttgaatatgttttag

SEQ ID NO: 30474 - DNA, 297 bp, Glycine max
  Peptide Sequence Number=SeqID_147252
atgggtttccgtttacctggtatcagaaaggcattatttgcagccaatcaagcatcttcaaaagcagtggatgctccaaagggctacgtgttatacttgaaccaaccttcatttcaagacttgttgagtcatgctgaggaagagtttggatatgagcatcccatgggtggcctcacaattccttgcagcgaagatgcatcttctaaacttgtaaagatctccctttctcaagaaatatggaaaagaaagactatcagattgacaaaattacagtatgtcgttgttaatgtgcaatga

SEQ ID NO: 30475 - DNA, 492 bp, Glycine max
  Peptide Sequence Number=SeqID_147253
atgggtttccgtttaccttctattcgcagggcctcattcaaggctagccaagcagcttcaaaatctgcagaagtcccaaagggctatcttgcagtatatgttggagagaaacagaagcgatttgtgattcccgtatcatacctgaaccaaccttcattccaaaatttattgagtcaagctgaggaagagtttggatatgatcatcccatggcaaaaacaatgggttttcgcttacttggaagacggacatcatttacaagcctagcagctagcaaggttgtggaagtaccaaaaggatatgttgcagtttatgttggagagaaaatgaagaggttcacaattcccatagcattcttgaatcaacctttatttcaagaattgctgaaacaagctgaagacgagttcagctactatcatcctatgggaggtctcacaattcccatcaaggaatatgtgttcttagatatagcttctcgtttgaacttgctatag

SEQ ID NO: 30476 - DNA, 291 bp, Glycine max
  Peptide Sequence Number=SeqID_147254
atgggttttcgtctacctggtatcagaagggcatcatttgctgaaaaccaagcatcttcaaaagctgtggaggtgccaaagggctatcttgcagtctatgttggagagagaatgaagcggtttgtgatcccgatatcatacttgacccaatcttcattccaagacttgttgagtcgagctgaggaagagtttggatatgatcatcccatgggcggccttacaattccttgcagagaagatgttgcttgccatagtataagaaaaaccagacttggttgtcctgatgattag

SEQ ID NO: 30477 - DNA, 441 bp, Glycine max
  Peptide Sequence Number=SeqID_147255
atggcagcggaatggagaaggaagagagagaggagacgccacttcaaggagaagataagtctagaagaagctcaccaccataggaggccatggataagagcttggaggaagaaggagatgaatgaagggagggggagagaagagcacgaaattttgtgctcaaaaagagctctgaaatctgaaataattggacccaaccttggcccatgggctcagaaatctaccctaaggttcatgagaaccctagggccttcttcagcagctctagcccaatcttcttggagcctcttgctcatggttcttgtgattggtcccttcctagggaggattgcatcagaggactataagataagagtcatgggaccaacagggagacaggggcatatggcgttgccttggaggactttctcaaggatgaatctagcatcttatagtttataa

SEQ ID NO: 30478 - DNA, 222 bp, Glycine max
  Peptide Sequence Number=SeqID_147256
atggctttccacataccaggtaaaaaccacgggacaaaatatctctcaacttcatccaacaaggatgacttacaatttgtctcaactctcaccaagtgtggtgtaaactataactctctaacacaagatcagtcagagtcaggggtgggtgtttgtcaccacaaagcgaggactagcggaagcgtagtcccaagatcagaattgactctaataccatcttag

SEQ ID NO: 30479 - DNA, 291 bp, Glycine max
  Peptide Sequence Number=SeqID_147257
atgcaattgttgcccaagctagaacttgccagtacaggcaatactcttgagaatgcttcccaaagtgtaactgtcaaatgtgagcatagaccttctcatggctctaaggagtttccattggcatctagtttaccagagttaacatatgcaaaaattatggtgtcccaagacaatgtttttgtgggaaattttgtgaaacacttggtttgctatggaacatatcttgatggcttggcaatgggttactttgaggccaagcaaagtgagggagtgcaacctcttcattcatga

SEQ ID NO: 30480 - DNA, 363 bp, Glycine max
  Peptide Sequence Number=SeqID_147258
atggctaagttcaggaggtatgctctagagattgaaggccttgtggttgccagtggactaagtcctttgatcacttgttccctaaatacgggcgatcggagactaatcttcgagcaattttatgtcgacgacgctatcaatatgctggtggaattactcgaggtcaacgccacagaggcgagagctgagacgattcaatatcatgactcttatgttcgactatcgtggctgcgcgacgtgtatcagatgaaaatcgagatggggtcccttgatggtcattcatcgaccgaagaaggttgtacgacagtttggatacatccagactattctgccatattctgctgcatcttcgctctctgttga

SEQ ID NO: 30481 - DNA, 249 bp, Glycine max
  Peptide Sequence Number=SeqID_147259
atggggtccgcctggaaaaccctcaacatcaataggaggatcctcaacaggtgcttcttgttgtcattccttgttgtgcaattcctctacagtcgcaagaggatcctcaagaacacgctcttgctgttgcttcctgcgagtagatgcggtgatgacaaaaagctcaaaggtcaatcaaagaatgagttcaagatgttcaagatagaatcaagaacacttcaacacttcaagattcaagaggaaagttga

SEQ ID NO: 30482 - DNA, 765 bp, Glycine max
  Peptide Sequence Number=SeqID_147260
atgggtttgatgaggaggccatcgcccagttgctgtgtataccggggcaggatttttgcccggactgctgctaggagacgggtgcggatcatgcgcaccaacatgaccaccctgacccagatatggatgacgttgctgctcagcaacatccagcccagcgatcataattccgacctccccctgccgaagtgtcagctggtgtacgccgtcctgacacgaatgagcattcacgtggctcagttgattgctgatgacatttatctatttgcaggtatggcgccgaccaggcaccctttggacccggataagtccaacagggccctgggatttcccgcattgatcacaggactttgtcattcgttcggagtccccatcgcacctagcaaggtgattcggccacccatcacccgggcttttattgagaagtattgcacgcagaggccggcccagggtgatgcaccacaggccgcaaacgcgccgccacctcatcaggctggcccagctgggtcatttgattcggagcagtatttacggcatttggtttgccagcaggcggccaaccaccgagcgcacagccagggttttacttcttttccatgccctactccggatcagttcagggcagagatcgcatggcccggagattggcttgaggcccaggcaggggaggcacctgcagaggctcccggcgaggcagatgaggcccacgaggacgaggagatgaccgatttgcttgatttcttgggagggagcggagccacatga

SEQ ID NO: 30483 - DNA, 783 bp, Glycine max
  Peptide Sequence Number=SeqID_147261
atggagattttactcaacttctggctcatagttttctgtgaatacattgtcttaactcctgaccatgtccatggtgatgcaggatacatgcgggttcttttaaactgttttgccttctcccaatgtttatcaaacaaaatcttattctctattctctattttttaaggtgggataccattttatggactttctttggtattgagcttttttgtcatttatgtttatggaatgcgggacataatttggctgaattcacattgccagctttgtatgtgatgctgttgatggctggtgtgcccgcaaattcaatcaagagcattctgattatgatctctctgttaattttttttgtacccttagcttccttctgctttgtgacaacagtggcaaatttagatgaagatataaagtgtccaccaaatgtggattcatcatgtgctgactgccaagtgtcaacctttggagctgtgctggacatggtaacagacagaattagcactgcttgtctacttgtagtcctttcccaactgtacaagcctagccttatcttcttgtcattgcttgctttagatattgccagccactggctgcaaatgtacagcactttcttgacgggaaagactagtcataaagatgtaaaagacagcagcagctggcttttcagggcatactatggaaataggatgtttatggcttactgctgtgtctcatgttctttacttaatcctgttttatcttgtggagaatcaaacacagaaactggtggacgttatatcaagtaa

SEQ ID NO: 30484 - DNA, 1251 bp, Glycine max
  Peptide Sequence Number=SeqID_147262
atggataggcttctatcttcttgttcttcttcccttaacaccaatctcaagcccttttctcttctccctcgatttgactccgtcagattcaaccctttctcatcaacgcgctgttccttcacctcaatttcatccaagcatgaaaccccacctccattatcgtcttctcctccaaaaaccctaccacccctttccccctctccactcattcattttcatgcctccgtgcccccatcccaacccctcactccgaataatttccaaaatccaaaggcaataacagctcgaacgtttgcaatactctcttctcttgttttgctcttaatccaaccagcttttgctccggcagcttttgccacgtttcaaaatgctgccaagactggtggccctgctgctgccgcagttggtggaaaactaatccgcactgagcttctaactagtgcttggactggtttctttgctggctgcttgcacacactgtcagggcctgaccaccttgcagctttggctccattgtcaattggccgaacccgaatggagagtgctgctgttggagccctttggggttgtggccatgatgccggtcaagttatctttggcttaatatttttgctcttaaaagatcgacttcacattgaaattatccgaacttggggcacccgagtggttggccttaccctgctagtaattggtgctatgggaattaaggaagcttcagaagtgcctaccccgtgtgttgccttagaaaatggtgaatgtgatgtcagtgtctatgaatcacgcgatagtaatcctgttgtaggaaagaagaagattggttttgctacttttgccactggaatagttcacggactgcaaccagatgcattgatgatggtgttgcctgcccttgctctaccctcacgcttggctggtgctgcatttctcatcatgttcttacttggaactgttgttgcaatggggagctatacggtatttatcggttcatgtagcgaggcactaaaagatagagtacctagaataactgagaaactcacttgggcttcttctcttattgcaatagccctcggatttgccatcatcattagccaggacgttagagagaaatttgattgtttggagcaaggtcattatttatgcaagattttgattgtctattatttgactacgtttgtgaatgtatatatcggtgtacccgatgaagcgcagtgtagccagaaagcaggagtatattcatggagggttaagtaa

SEQ ID NO: 30485 - DNA, 276 bp, Glycine max
  Peptide Sequence Number=SeqID_147263
atgaagacgacgataacggagtgggaatggaaggaggccttgaagacgaagcgaggggagtggaagcgaagaagaccaaagttgctgctgctgcgtttgttcctggagcgaagagaaggtggagtcggaggaggagggcggagagtgtgggtggaaccgaggaagtgtgtgcggagagtggagagggagggagtgggggaggttagagtgagggagcggtggtggttgagagagaggttaacttccatggatgaacaagagagagaaagactctag

SEQ ID NO: 30486 - DNA, 213 bp, Glycine max
  Peptide Sequence Number=SeqID_147264
atgtctctgagaataaaagcagtagtagataagtttgtccaagagttgcaggaagcgttagatgctgatattcaggataggatcatgaaggacagagagatgcaaagttacattgaggagcgtgaacgagaggttgctgagcgtgaagctgcttggaaggctgatctttctcgtcgtgaggggaaggtaatgaacaaaatgcaaaaactctga

SEQ ID NO: 30487 - DNA, 714 bp, Glycine max
  Peptide Sequence Number=SeqID_147265
atggtgtatcgtgaaacaattgaagccggtggaaaacctacaagtgaaatattaccacaaattctgggatgcctgcaactcccttatgatacatctgtgaaaaatagacttgttgagaacctaggagtacgtgcagaaacttcaagaagctcaaacctctgttcattaatggatggatttggtgaatatgatcctcgtgctttttcaatacttgaggaatctgcttcacatggagttgttccatctgtatcatttaaagtgagtcctattgttattgatgctaaagaattgcatgcttctactgctgaggtatacatcataacagttttgaaaggtctcaagtatcgactagcagcaggtgcaagattacccaatataatcattttattgcctgtagaggaaacagaagttgtgtctcccaaggggaagaagattattaaccttggaggaagagctggccaagcagttggagcgttattgaggaggcttcagattcctcaccaaggtagtgaatcgaatggaaagcttagaattggtggtttggctctgaaaaaatggtttcagccgaaacttgcatctccgttcagtgttaatatgggatctccaacattcagtggaaaaccaggtgattggaactcgtccctatcacgactgggcaaaaatattagtaatcagcaacgaaacatccgaattggcaatctgtctttggattaa

SEQ ID NO: 30488 - DNA, 711 bp, Glycine max
  Peptide Sequence Number=SeqID_147266
atgacaatcacagttcacagttcacagttcaatagtgacttaaattctgataacacacgcaaagttaatagaggttccaaagtcaatatacaatttctgatctctgcatctcaatccaatagatcaaatatgccttcaaacgatggtatagttatcgtggtcatgggtgtcagcggtgctggaaaaaccacaataggtcagatgctggaaaaagagttgaaatacaagtatcttgatgctgatgattttcacttagaatcaaacaaagaaaagatgcgaatgggaatccccctaaccgatgaagaccggatgccatggcttgaatcgctatgctacgccataaaagaatacttgaataacaaaaagggtctggttcttggttgttctgctttgaagaaggaatatagagaaattcttagatcaggtgatactagttataattgggggacttatgcaagtgctgtcaacttcattctcttggatgctcctgctgaagtgctaagtgttcgagtgaataagagagctgcagaaggaaaacattatatgcctgcatcgcttttgcaatctcagttagatttgcttaagattgatgagcctgagggagtacttagagttgatgctactttgagaccccaagacattgtaaacaccattctaaacatggatcagtttcagggctgtttcaatcatgattttgttgaatctctttga

SEQ ID NO: 30489 - DNA, 348 bp, Glycine max
  Peptide Sequence Number=SeqID_147267
atgaagctgttacccgagctggagctcgccagcacgggcaacacccttgagaatgctcccaaatgtgcagctttcaaatgcaagtgcagaccttctcatggcaccgaggattttccatgtggtgtcccggtcaccggagcttacataagcagaaattatggtgttccaagacacggtatctctgtggcgcatttcgtcaaacacgtggctaacttgattgcttggcaatgggttgctttgaggccaagcaaagtgagggagtgcaacctcttcattcaaagagacgatggcgtcgttttaaattttaaaatacataagattttgatgcacaaaatggaatttgaatga

SEQ ID NO: 30490 - DNA, 897 bp, Glycine max
  Peptide Sequence Number=SeqID_147268
atggcttattcagagtgctgctccttcgaagatgctgagagagtgtttgatggtgctgtccagtgtcgtgatctggttgcatggaattccatgcttggtgcttacttaatgcatgagaaagaagatcttgcatttaaagttttcgttgatatgcagaattttgggtttgagcctgatccttatacatacactgggattgtcagtgcttgttctgtgcaagagaataaaacttgtggaaaatgtttacaagggttggtgataaaaagcagtcttgactattctgtgccagtttctaatgctttgattaccttgtatatcagatttaatgatagcatggaagatgcatttagaatattcttttccatggatcttaaagattgttgcacttggaactccattttggtaggatgtgtacaaggtggtttgagtgaagatgccttgaggttatttttactgatgagatgtctggtcatagaaattgaccattatactttttcagctgtcataagatcttgctcagatttagcaactctacagttaggtcaacaagttcaagtcttagcacttaaagtaggctttgataccaataattatgttgggagttcgttgatcttcatgtattctaaatttgggatcatagaagatgctaggaaatattttgaagcaacttccaaagatgctgcaattgtttggaatccaatcatctttggttatgcacaacatggacaaggaaacattgcacttgacctcttttacttaatgaaagagagaaaggtgaaacctgatcatatagcctttgttgcagttcttactgcgtgtagtcataatgggctggtagaagaaggctgcaactttatagagtctatggagtctgattttggtattccatcacgatag

SEQ ID NO: 30491 - DNA, 534 bp, Glycine max
  Peptide Sequence Number=SeqID_147269
atgccttttgaagctgatgaaatggtgttgaaaaatttattaggtgcctgtagattttgcgttgatattgaattagctagtcaaatagcaaaaaatttgctagagccggagcctgaggagccctgcacgtatgttatactctccgaaatgtatgggtgtttcaagatgtgggatgagaaggctagtgtaacaaggatgattcgagataggggagtgaaaaaggttccaggttggagttggatagaagcgaaaaataaagtgcacgctttcaatgctgaagatcattcccatccccaatgttcccaaagtcaaaatatgcattttctcatctctgcatcccaatccaatagatcaatatggcttcaaacaacgcacaataggttggagaggctggaaaaagagatgaaatacaagtatcttcatgctgatgattctcattctgaatcaaacaaagaaaagatgtgtatgggaatcccacttacagatgaagaccgatgccatggcttgaatcactacatctacgtgataccataa

SEQ ID NO: 30492 - DNA, 1059 bp, Glycine max
  Peptide Sequence Number=SeqID_147270
atgcatgtgcaccaccagccaagccagtactgccacaacgctatttgccatgccctatatcctgccgtgagaacgtggaaaaagaaaaactattttcagttttttcacccttggaacattcaactttcagcagatataatctcatcagcatgtgttactgaaggagatttaagggtggaaaaggttcaggttatggccattcaagcacagtggtatccaaataattctgcttctccgttttgcaacaatggtttttgtgctggtgggcttattgactctcatatcaatttccaaccgaaaaatcatcttcaacaacagcagttgcagctatcagaacagcatttgaaagagttatataatgcgagtcatggaactgttgatccaaatcttcatgtttataattcaaaagccgtgaattctcatatgtttgctgttcagcttgagaagcaaagggaggagattgatcagtacatgaaatccgaggatgagaaattgagatatatgctacgggagcatgggaaacaagtgatggcattgttgaagaaactggaatctcgatcacttcatgttttaagggaaaaagatgaagaaattgcgcaagctattaagaaaagggtggagttggaagagtatttaagaaagctagaggcagaaaatatgaagtggcagaaagtggctcaagagaaggaaaacatggcattgtccctctataaaacattggaggaaatgacagaaagtggcaattttttgaacaatgggatggtggcaaatgatgcagtgtccttttgtggcgaaactgggggaaaagaagagatggacgaagaagaagcaacagcagagaaagagaaaaaacgtatagaatgttgcggtggggtgagtgagtttgaacagaatacgagaagaggagtaatggtttgtaaaagctgtcattctaggagctcgagctttctgtttctaccatgcaggcacctttcttgctgcaaagtttgcaacactttcctcgaggcatgccccgtttgcagcacaccaaagaaggctaccattgagttgagactttga

SEQ ID NO: 30493 - DNA, 174 bp, Glycine max
  Peptide Sequence Number=SeqID_147271
atgggtgtcaagttcctcgaagcggtcaagcgaaggttgcatgccatcaaacaatggtcctcgaacgaaattgggattagggataaaggaggcacgaggaagagagtgtggctgcgcagcgtgactggtttcataggtatttatagaggaggacaagatgtaatcgattacaag

SEQ ID NO: 30494 - DNA, 405 bp, Glycine max
  Peptide Sequence Number=SeqID_147272
atgtcaggatttacacgtgatactcctcaaatttcagccagcccgcatcaattagaccttgcaccttacgcttcagagccctacaatgctcaatggaacgccccgaggattctccgtgacaagcacacgttgcgttcgagtcgtattctcggagaaatggaggttgatgaaccttggctagggttatggctaccattgaattatcgagtagatatgggagcaaaccctaaggttttttgctgcaaaattcccttttggttggtgcttcggtgggttttgtggtttgatttagggatggcctttgtgcataattgggtggtgggaatggcagtcacagcatgggcttctccctcattctcaccctcttcgtttgccctagttgttttggcatttatcaaagcatga

SEQ ID NO: 30495 - DNA, 660 bp, Glycine max
  Peptide Sequence Number=SeqID_147273
atgtcatcaccaaacaactcggtccctcagccccacgtgtcgctccttctcctgcgcctcgatgtcatcgctcgcctcctcgtcctagagctcctcctcggttgtcacgatcactctgtcgtgatccaagagacggatacatgtgagctggaggagcattgcaccaaatggacctactcgaagtcggtggtagcacttgacatgacatggaacatggcattcatggtggtcttggcgattatggttgacgaggatgatgttggaaccttcgagagttcctcttcctccgggtttgaaggaatttcttgtgaattgatttatctgaagacactaattccttgggataaggaaacaatagaggcctcggttaacaagacaagaagattgcttgttagtcatgaagctcctataactagaggttttggtgctaaaatctcagcttccattgttgagtgttgcttctcaaggtaccatgtgcctataaaaatggggttacaagagcgtacaagtgtaagcttagcccataggattattcttgtctatagattttcctttctaattctacctacaaaaaagggtgatgttcatctatgtgaattgattgatatgcaaaaactatgtatgtgggagaagacgttgtatcatggagtcaatgtataa

SEQ ID NO: 30496 - DNA, 207 bp, Glycine max
  Peptide Sequence Number=SeqID_147274
atgggttcagagttaagagttcagaatttgggaagtggaaatgggagtgggatttggaggggttgcaatatagtaatggaagtgcggtggtggagttcgcagtggttggttagaggctctcagcaatggcactggcgggatcaggaacactccgagatcaaagatggaacatggaaaggaataataaatatagttgatttggaataa

SEQ ID NO: 30497 - DNA, 3315 bp, Glycine max
  Peptide Sequence Number=SeqID_147275
atggacatcctcttcgcccagatccaagccgacctccgctccaacgacgccctccgccagtccggcgccctactccaggccctccagcagtctgccgcgggtcgcgacatcgccgtcatcgccaagaccgccgtcgaggagatcgtcgccgctcccgcctccgccgtctgcaagaagctcgccttcgacctcatccgctccacccgcctcactcccgatctctgggacaccgtctgcggcggcatccgcaccgacctccacttccccgaccccgacgtcgctgccgccgccgtctccatccttgccgccatcccctcctaccgcctctccaagctcatctccgactgcaacaaggaaatctccgactgcttcgactcccccagcgactccctccgcttctcggccaccgaaaccctaggctgcgtcctcgcccgcgacgatctcgttaccctctgcgaaaacaacgtcaacctcctcgaccgcgtctctgcctggtgggcccgcgtcggctccaacatgctcgaccgctccgacgccgtctccaaggtcgcattcgaatccgtggggcgcctcttccaggaattcagctccaaacgcatgagcaagcttgccggcgataagctcgtcgattccgaaaactccctcgcgatccgctccaactgggtctcctccatggtggacttcgtgtggcggaagcgccgcgccctcatggcgcgctccttgatcctccccgtcgagaatttccgcgccaccgtgttccccgtcgtatactccgtcaaggccgtggcctccggtggcgtcgaggtcattagaaaactctccaaggcttcctctacctctgcatccaatgcggatgctgaggttgattcccacgcggagaagctggtgggggtttctgatgtgctcactcacctggctccgttccttgtttcgtcgttggagccggcgttgatctacgaggttgggatcaatatgttgtatctggctgatgtgcctggagggaagcctgaatgggcctcacaatcgatcattgctattctgacgctgtgggataggcaggagtttgcttctgccagggagagcattgttagggctgttgtcaccaatttgcatctccttgatcttcacatgcagttggttgtgcttgatatagcagtgcttattatgtataaatggctgcttgtaggtatcactgttcaagaggaaagtgtacgaagagggcaaaaacctcttcccggaacggatatagcttccctttttgaggatgccagagtgaatgatgatcttaatagcattacaagtaaaagtatatttagggaggagttagttgcgtcgctggtggaaagttgctttcagctgtctcttccattgcctgaacaaaaaaacacgggcatggagagcagggtcattggagctttggcatatggaactggttatggtgcattaaactggactgaacctgctttggaagtagtggaagtttgtcggccttgtgttaaatgggattgtgacggccgcacctacgcaattgactgctacttgaagttgcttgttaggctatgttacatatatgatacccggggtggtgtaaaaagagtcaaagatggagcttctcaggaccaaattttgaatgaaacaagattgcaaaacttgcaacgtgaacttgtgaaggacttacgcgaggtcaatacaccaaggatattggcccgccttatttgggctattgcagagcacatagatatagaaggattggatccgctcctagcagacgacccagatgatcctcttaatgtcattatatcaaatattcacaaggttcttttcaatatcgattcaactgcagaaacaacaaatagagttcaagatgtacaggcagttcttatatctgctcaacggctgggatcacgccaccctagggctggtcagttacttaccaaagagcttgaagagtttaggaacaatcctttggctgattctgtcagcaagcatcaatgtcgtttgatattgcaaagaatcaaatatgctacaagtcatcaagacagtaggtgggcaggggttacagaagctagaggggattacccatttagccaccacaaattaactgttcagttttatgaagcatctgctgctcaggatagaaagttggaaggattggttcacaaggctattctagagttatggagacctgaccccagtgaactaacccttttactcacaaaaggagttgattctactttactgaaggttcctccaaatgcaattactttgactggaagcagtgatccctgctatgttgaaggttatcatttagctgattcaagtgatgggaggatcactctgcatttaaaggatccagtgttgtgcagtgtgacagttggtgtttcccactttgaaagatgtgctctttgggttcaagtattgtattacccattctatggtagtggtgctgtcggagactatgaaggtgactatgccgaagaggatcctcaaatcatgagacagaagagaagcctaaggcccgaattaggtgaacctgtgattttgagatgtcagccatataaaattccattgactgagcttcttttgccacaccaaatatcacctgttgagtttttccgactgtggcccagtttgccagctatcgtagaatatactggcacatatacatatgaaggtagtggctttaaggctactgctgctcagcagtatggtgcatctcctttcttaagtggactgaaatccttgtcttccaagccattccacatagtttgttcacatataatccgcacggtggcagggtttgagatgtgttatgctgctaaaacttggcatggtggcttcttgggcatgatgatatttggtgcaagtgaagtgagtagaaatgtggacttgggtgatgagactacaaccatgctgtgcaagtttgtggttcgagcatccgatccatctattaccaaggagattggatcagatcttcaaggctggttggatgaccttactgatggcggtgtggagtatatgcctgaagatgaagtgaaagtagctgcagccgagaggcttcgcatatcaatggaaaggatagccttgttaaaggcggcccaaccacgacccaagactccaaaatctgacaacgaagatgaagaggaggaagatgacaaaaataaagaaaagaaagatggcgaagatgagaaaaagaaggggccttcaactctatcgaaactaactgctgaggaagctgaacatcaagctcttcaagcagcagtactacaggagtggcatatgatctgcaaggatagaacaactgaagttaattaa

SEQ ID NO: 30498 - DNA, 2265 bp, Glycine max
  Peptide Sequence Number=SeqID_147276
atgacggtgttctccgccaagcaggtgttcccggtggactacgaggagaccgaagtgtcacagcgcctcctcgaagcctcccactccggcgatctctccctggcattccgctgcattgtcgatccctccgtcgacgtcaacttcgccggcgccgtcacgctcaagatcgcctccaccgacctcctcctcctcccggagtcccccagccaagtccgcctcgacttccaggaattcatctccgacgtctcgccgctcttcctcgccgtccacgccgcccacgccgccctcgtcagaaagttactgagtgtgggagctgatgtaaaccagaggctcttcagaggctttgcaacaactgcagcagtgagggagggtcactttaatattcttgaaatcttacttaaagcaggggcatcacaaccagcatgtgaagaagctcttatagaggcaagttgccatggtcaagcagggtgtttagaattgctcatgagctctgatttcatccgacctcatgttgctgtacatgctcttgtcactgcaagctgcagggggtttgttgatgtggttgagacgctcataaagtgtggtgtggattcaagtgcaacagaccgggtgcttttacagtcacttaagccttctctccacataaatgtggattgtactgcacttgttgctgctgtaattcataggcaggttcccgttgttgatttgctattgcagaatggtgtgaggttagactttgaggtgaggcttggagcatggtcatgggacacttctactggtgaagagcttcgtgttggtgctgggctgggagaaccttatggcataacctggtgtgcagtcgagtattttgaaaaaagtggtgctattctacgcttgctcctgcaacatgcctcctccaaacctcacagtggaaggacccttctacatcatgccatactctgtggcaatgttgaggctgtcaaggtgctcttagaatgtggtgcggatgtggaatccccagttaaaactaccagcaagactcgtttccttcctatacacatggcatctcggataggcttaccaacaattattcaatgccttattgattttggttgtgatttgaactccacaacagactctggtgactcagctttgatgatctgtgcaaaatataaacaagaagagtgtctcaaagtactgacaagggctggtgctgattttggcttggtgaatattgctggtcaatctgcaagttcaatcgctaagtcggacaattggtcacttggttttcaacaagcagtgttggatacaatcagaagaggcaagatacccaaatccagcaatgctactactttttcgcctttaatatttgtagctcaagctggagatactgaggcattgaaaattgtcattgaatcgggagcatttgatgttgactatcaagatgacagtggtttctctgcagttatgcatgctgcttcaaagggccatgtggattcttttcgattgctggtatatgctggagctgatgtaaagttgtgcaataaatctggtgaaacagcaataaccctatctgaaatgaatctgaactgtgatttattcgaaaaggtcatgcttgagtttgagcttgaaaagggcaatatcaatgctggtggattctatgctttacatcgtgcagctcgtcgtggtgacttggatgctgttacattgctcaccagcaaaggttatgatgtcaatgcccctgatggagaggactacactcccctcatgttagcagcaagggaaggccatgcatccatttgcgagcttctaatttcatatggtgcccattgtaatgccaaaaacgctcgaggggaaactgcacttttactcgcaaggaaagtcacaggagggaaaagcgatgcagaggctgttatactaaatgaacttgctcgtaaattggtattaggtggtgcctatgttctgaagcacaccaaaggtggtaagggctctccccatgggaaacaaatgcaaatgttgggatctgccggtgtgctgtgttgggggaagtcaagccggagaaatgtggtttgctgtgaggcagagttagggccaagctcaacattacgcagaaataggtacaagaaaggtgatgcagaagaacctggaatgtttagggtgcttactagcaagagcagggaagtgcattttgtatgtgatggggggttagaagttgctgagctttgggttaggggtattaaacttgtaaccaaagaggctatttttcataagcagagatcggtctaa

SEQ ID NO: 30499 - DNA, 168 bp, Glycine max
  Peptide Sequence Number=SeqID_147277
atgtcggactccaacggaggatgctccacttcgcggtggtcacaaaccccaatggcagtcgtgaacggtgacgatggtaacgaggagatagcggtcacaggtcacaaatggcggtcacaggtcttgcagctaggtgggcactcaagcatccagcttatggcattatga

SEQ ID NO: 30500 - DNA, 162 bp, Glycine max
  Peptide Sequence Number=SeqID_147278
atggttgagattatatctgatgcaaatctgaaggatgaagggaacattgataagatgtctgagttgaagaacttatctgagctaaagcaatgttgcttgaagaaacaatttgatccttcacccaagactgcaatacttgaggccaaatccaaggaattgtag

SEQ ID NO: 30501 - DNA, 303 bp, Glycine max
  Peptide Sequence Number=SeqID_147279
atgttctacatcactgagtcactagataaaatgaaaagcataggaaactctttgcaatatcttgtggtggcattttcaatttatgttggaaccttgttggttaatgttgtgcaccaactgactcggaagcatggtggaattgattggttgaatgatgacatcaatgctggaagattggactactattacttcctcatggctgggttagctttgattaatctcgtatatatcttgttctgtgttaaacattactgttataaggttaatgtcgaagaaaaagttgtggagaaacttgagccttga

SEQ ID NO: 30502 - DNA, 264 bp, Glycine max
  Peptide Sequence Number=SeqID_147280
atgtggtaccatgtcaatgaaaaacctcgttgggcgcttaagatacatgacaagacaaaccacacactgggagatcagtcaggttcacgctattttgcgagaatgctccaaccatgtgggatcggcacaagcttaaaggaacactcaaaccgggtgtatttacccccaaggcctacacttcgaagagtccatcagggcctctccctcctgattcagttttatctcgtcgcgcttgtgattaaactcgtcgagtctccacaatga

SEQ ID NO: 30503 - DNA, 199 bp, Glycine max
  Peptide Sequence Number=SeqID_147281
atgtgggaagactttaacccttggtctcatttgcacaagtaccgcccaagatggttcatgtgggtggccaacacggatgcgaaagctattgacagtgctgagatctatagttcacaagtactacacgcagagaagaggactccaggaaagatgatcgaggaaataaaaggtgagaagggatctagtgtggatgatgcac

SEQ ID NO: 30504 - DNA, 387 bp, Glycine max
  Peptide Sequence Number=SeqID_147282
atggaagcaatagctagccatgacccacaggccacaacgttgttattgacgcgtccggtggaaccccaaatcacggaaacattatttaaactagtttatatgtcaagccagatgatgctaaggaaaaaaaaaaaaaagaaaaccacgaaacagcatatacttccccaagaaaggtgccatgatttgtgtggaaaatctgaatcagagtaccctagcttggtgctggcggtggcgagtaattgcgcatcaagtgagagtgaaacaagaacgagagaatctgtggaggcagaggagggatccagtgtggaggatgcacggtatcaatcgagacagatggagaaagcacggacaatgaaccgaatgatcattattcatagagatgaataa

SEQ ID NO: 30505 - DNA, 118 bp, Glycine max
  Peptide Sequence Number=SeqID_147283
atgaatatcgtgactgacgatgcttcaaaccaaatgataaatgtctcggagcttatgctgcagcaaacaagggttcagtctattgttgctaagttgtcattaatactctacctaccat

SEQ ID NO: 30506 - DNA, 1986 bp, Glycine max
  Peptide Sequence Number=SeqID_147284
atgactgttgaaaagagaattgttttggttgggattagaattgatggctatagcagacagctcctcaactgggcacttgccaaagttgctgagcctggggattgtgttatagcagttcatgttgttaaaagttcggattatgtttccaaaaacaagactctgatagatggctatttagaagtttatgaaggcctatgtggtgtgaagaaggtaggtctcaccggtcaaatcttcacaggaagctccattaaaaacattcttgttagagaagctaaaaagcatgctgccctggctctagtggtagggggtcgagctgccacagctaaatattgtgctaaacgtctacaacccaccaccaatgttctagccattcaagactcaagaattgtcttcagaagttgcaccaataaacaactaccaggtggtcttatactggatccaagaccaagtttaacaatcataaaagaaaatttgcgtgacagagcaatccactcttcaatttgtgactccatcgtggagattgaggaatcaacgcgcaaaaattccttagaatcgaaggaagaagcgtttaatggatcagaaaagagcaagtcaaggtcaatatccatgtttgcaggtgattctgccgaacagaagcttggatggcctctactccgcagagccaattcaggaatgtcacaaacccttcatgcaagggacatgtcagtagtacaatgggttatgaccttaccagatcgttcaccaaataaaggttctagctcttcttccactgaggaaaatccatttgaaaggagcatcagcgatgttgaatatgagagctcttcaaattcctctccttcatctgttgatataccaaatggcctggaagagatgttaaatttaaattctctaaattgcaagcggttcagccttgaggttctgaagtcttgcactagccaattctcttcagaaaaattggttgggaaaggagggagcaatcgtgtgtacaaaggagtcctcactgatggaaaatcaatcgcagttaaagtaatgcagtcatcaaaagaagcatggaaagattttgcccttgaggtggaaataatatcctcattggagcacaaaagcattgcccctttacttgggatttgcatagagaacaatactttaatatctgtttatgactatttccccaatggcagcttagaggaaaatctgcatggaaagaacaaggatgaatccatcttgtcatgggaagtaagatttaatgtggctattaggatcgctgaggcccttgattacctacacagggaagctttgaagcctgtcatacataaagatgtcaagtcgtctaacattcttctctcccaagggtttgaacctcagttgtctgattttggactagcagtatggggaccaacaacttcatcctttttgacccaagatgtagttggaacatttggttaccttgctcctgaatacttcatgtatggaaaggtcagtgacaagatagatgtctatgccttcggtgtagttttacttgaactaatatcaggaagggaacctatcaactcggcagcttgcaaaggacaggagagcttggtcgtgtgggcaaaaccaataatagagagtgggaatgttaagggcttattggacccaaatttagaagggaaatttgatgaggcccaattgcaaagaatggttttggcagcatctttatgcatcacacgggctgctagacttcgtcctaaactgagccagatactgaagatcctaaaaggagaagagaaagttgaatatttcttaaactctcaaggagataatgatcaggaggattcagaaaatcaagaaaacattgatgacgaagtgtatccaaattcaagtgcagagttacacctaagtcttgcattacttggtgttgacgatgacagtacatcacatagtagcacagaccacagctatagtgaagacttgaaagaacaatggagcaggtcatcaagttttaattag

SEQ ID NO: 30507 - DNA, 207 bp, Glycine max
  Peptide Sequence Number=SeqID_147285
atgagtaagcacaaattcattgcatatgtactatcaggactcagggagccatgttatcaatggcggaaggccaaaattccaccttataacatgtcattgcagcctatggtgccaccagagcgggcctcccttcacaaattgcccatggcagttggcaacaattccaccacaccattctgccatggcagcagtggtggcaccatttaa

SEQ ID NO: 30508 - DNA, 696 bp, Glycine max
  Peptide Sequence Number=SeqID_147286
atgagtgcgtccaggttcatcaagtgtgtcactgtgggtgacggtgccgttggcaagacttgcatgctcatctcctacaccagcaacacttttcctacggtttttcttggttctgttgtcctaacctttcttttagagttgctgatgctagctaaggactacgtgccaactgtctttgacaatttcagtgcaaatgtagttgtggatggaagcactgtgaatcttgggttgtgggatactgctggccaagaagattacaatagattaagacccttaagctatcgtggagcagatgtattcctgcttgctttctctctcataagcagggctagctatgaaaatgttgccaagaaatggattcctgagttgaggcattatgctcctggtgttccaattattcttgttggaacaaaacttgatcttcgggatgataagcagttctttcaagaccatcctggtgcagtgcctatcaccacagcacagggtgaggagctgagaaagcttatcggtgctccagtttacattgaatgtagttcaaaaacgcaacaggttaaaggaagtcatgaccttattgatgttagcctttgtatacagaatgtgaaggctgtttttgatgcggccatcaaggtagttctccagcccccaaaacagaagaaaaagaagagaaaggggcaaaaggcctgttccattttgtga

SEQ ID NO: 30509 - DNA, 228 bp, Glycine max
  Peptide Sequence Number=SeqID_147287
atggggttggctcggacaacagaaagaagcatggatttatgcgaagagtggaaaggaactttgcgaacgaagagaacaacgagaattaaaatgcacgaagtagttaaaatacacagaaaaatgaagagagagagagagagagagagagagaccgcggaagaagtagggttcgagaagcgactgagaattcagatgcgaatagagagcgcgagggttttgatcgtgtga

SEQ ID NO: 30510 - DNA, 252 bp, Glycine max
  Peptide Sequence Number=SeqID_147288
atgaaggataaagagtttgcatatgacatgtttagaagacttaaatccaaggctcagataaacttgaaggtgttagacaacttccctaaggtatgggaacccaagaacaaagccatccaagaagcaagagatatgaaaaatcttggatgggatgaattgttaggcatcttgagattccatgaagtccaaattatgtttgttgcagctatccttggtaggaaaaagtcagggcttaagctgatacctgtatag

SEQ ID NO: 30511 - DNA, 840 bp, Glycine max
  Peptide Sequence Number=SeqID_147289
atgaggagattttatgagggatccactattgttcataacactcctttgttgtctggccaagtaaaggtgagtgtggaggaggttacagatgcagatgctccagttcctgtacccattgatgaggtttccttagtggggcaggcacttcacaccttccttgcttggccgacacatctggtagttgtgtctccggcaaaaccacctccaaagcccgatccggaggtcgatgatctgctttatctgatgacattgaccatcccagagcttttcttgaggccttatcaggttagatgggatgccaccgtgttcggggtctttaatccagatttccccctctacataaagcacgaagacctctccgaaatcgcacacggtggtcaatgtctcagcatatcagtgttacagttgtggattctgcatctcactgaaacatgtatgcgagcggggaattctgatatctatggattcctcgagccacagtccattcagaggtgggggcaatcgctgttggagtctgaaagttacataaagacttggatgcagagttcaaaacgcgatgtctatcttggagcctacctaaatgggccagacaactaccttaaggggattattaatagcctaaatcaaaggctcctgctaggtggattgtcgtcaagacaaaaaggaagtactgagtgcggctactatgtgatgcactggatgtccaccatcattttaggaacttttaggaataattgggaagcgtattttaacgatcctagaccattggaactagagagattaaaggcattgcggatccagtgggcacagttttatatccgagttagagatcaggcctag

SEQ ID NO: 30512 - DNA, 4575 bp, Glycine max
  Peptide Sequence Number=SeqID_147290
atggaaactcggagccggaagcgggcggaggcttcctcagctgccccttcatccccttcctctggtcccaccactcgttccagcaagcgtgcacgcctctcttcttcttcctccgcttccgccgccgctgccgccgcatccgtttcttccgtgaacactcgctcccgttcatcccggactaaggaacccttgccccctaagaatcctcctcccatggactctgccaatgaatcctctggctcccgccgcgatcgccgcaacaaagacaactccgacaaggggaaggagaaagagcatgatgttaggattagggacagggatgctgacagagggctggcattgaacatggatggtggcggagacgatgatgacaatgacagcgaaggcggtgtggggattttgcatcaaaacttgacctctgcgagtagtgcacttcaggggcttcttcggaaacttggtgctggtttggatgatctgcttccatcatcggctatgggttctgcgtcttcctctcaccagagtgggaggctgaaaaagatcctcttcggattgcgggcggatggcgaagaagggcggcaggttgaagcattgacacagctctgtgagatgctttcgattgggactgaagagtcacttagtacattctctgttgattcgtttgttcccgtgcttgtggggttgttgaatcacgagagcaaccctgacatcatgcttcttgctgccagagcattgacccatctctgtgatgtgctcccttcatcttgtgctgctgttgtgcattatggtgccgtgtcaatcttttgtgcgaggttgctcaccatagaatacatggacctggctgagcagtcccttcaagctctgaagaagatatctcaggagcatcccactgcctgcctacgagcaggtgctcttatggccgtgctttcctatttggacttcttttcaacaggagttcagcgggttgcattgtctactgctgcaaatatgtgcaaaaagcttccttcagatgcagctgattttgtgatggaagctgttcctcttctgacaaaccttcttcagtaccatgattccaaggttctggagcacgcctctgtttgtttgactcgaatagctgaagcttttgcgtcatctccagacaaattagatgaattgtgcaaccatggacttgtaacacaagctgcctccctcatttctaacagcagttctgggggtggtcaggcttctctcagcacgccgacatatactggtttaatccgacttctttcaacttgtgcgagtggatctcctcttggagctaaaaccttactacttcttggaattagtggtattcttaaagatattctatctggttctggagtttcttctaaggcctctgtttctcctgcattaagtaggccgccagaacagatatttgagattgtaaacctcacgaatgagcttctgcctccattgccacatggaacaatttctctccctatcatctccaacatgtttttgaaagggcccattgtaaagaagtctcctgctggtagctctggaaaacaagaagacacaaatggaaatgttcctgagatatcggctcgtgagaaactattaaatgatcagcctgaactacttaagcaatttgcgatggatctccttccagttttaatacagatatatggttctagtgtcaatggtcctgttcggcacaaatgcctttctgtcattggaaaattgatgtatttcagcacagcagagatgatccagtctttgttgagtgtgacaaatatatcaagtttcttagctggcgtcttagcatggaaagatccacatgttttgcttcctgccttgaaaattgctgaaattcttatggaaaagcttcctgggacattctccaagatgttcattagagaaggtgttgtgcatgcagtggaccaacttattttaactggaaattcgaccaatatctctacacaggcatcttctgccgagaaggataatgattctatatctggagcatcatctcgctctaggcgttatcggcgacgcagtgggaattccaatcctgatggaaatcctttggacgatttgaaaactccagtttcagtaaatgttggttcacctcctaattctgtggatatgccaacagtaaattccagtattcggttatctgttagtacagctgccaaagcttttaaagataagtattttccttcagatcctggggctgctgaagtgggtattactgatgatcttttgcatctgaaaaatctttgcatgaagttaaatgctggtgctgatgaacaaaggaccaatggaaaggggaaatctaaaacttctggatttggtctggaagagtatttaattgggatcatagctgacatgctaaaggaacttggcaaaggagatggggtatctacttttgaattcattggtagtggtgttgttgcagctctgttgaattatttttcttgtgggtatttctctaaagatcgaccattagaaacccaccttcccaagcttcgccaacaagcacttacaaggtttaagttatttatagctgttgcactaccttctactactgaagatgggactgtggctcctatgactgtcttggtccagaagcttcaaaatgccttgtcctccttggagcgtttccctgttgtgctgagtcattcatctaggtcatctagtgggagtgcacgcctctcctctggactaagtgcattatctcagcccttcaagttgcggctttgtcgagcccagggtgaaaggtcacttagggattattcatccaatgttgtactggttgatccattagcaagtttagcagcaattgaggaatttgtttggcctcgtatccaacgaagtgaattgggtcagaagtccactgtacctgctgggaattctgaatctgggacaactcctacaggagctggtgtatcctctccaactacccatcgccattctactagatccagatcatctgttaatataggtgatacatctagaaaggaaataagtcaagataaaagcacaagctcttccaagggtaagggaaaagctgtattaaagcctgcacaagaggaggcaagaggacctcagaccagaaatgctactcgcagaagagaagctcttgataaagatgctcaaataaagcctgtaaacggtgactctacttctgaggtaaatgctagggctctggttgaggaagtaaaaagagggatgcgtaaaaatgatgaagatttggatatatcccctgttgagattgatgaggcattggtgattgaagatgatgatatttctgatgatgaagatgatgaccatgatgatgtactgagggatgattctcttcctgtttgttcacctgacaaagtacatgatgtgaaattgggcgacatagtggaggagagtaatgttgctcctgcaactagtgatggtggccagactaatgctgcctcaggttctagtagcaaagctggtacagtcaggggatcagactctgctgattttaggagtggctatacctcaagctcaagaggtgcaatgtcatttgctgctgctgctatggctggacttggatctgccaatagcagaggtatcaggggtggaagagatcgactagggcgtccattgtttggtagttctaatgatcctccaaagttgatatttactgctggtgggaagcagcttaataggcatttgactatttatcaggcaattcaaaggcagcttgtgctagatgaagatgatgaggagagatttgctggcagtagtgactatgtatccagtgatggaagcaggttgtggggtgatatttatactataacttatcagagggcagagaaccagacagataggactccccctggaggttcaacctctaatgcttcaaaatctggcaaatctgggtctgtattgaattctagttctgaagacaagctaaatcagacatctgtattagatagtattttgcagggagaattgccctgtgaactggagaaatctaatcctacatacaatatattggcattattgcgggtgcttgagggtttgaaccaacttgcatctcgtttgagggcccaagtggttactgatagctttgcagagggaaaaattttggatttagttgagctaagttttaccagtggtgctagggttcctacagaggaatttataagcagcaaacttactccaaaattagctaggcaaatacaagatgcccttgccttatgtagtgggagtcttccctcatggtgttaccagttatctaaagcgtgcccttttttgtttccttttgagacccggcgacagtatttttattcaactgcctttgggttatctcgtgcattgtatcgccttcagcagcagcagggtgctgatggtcatggatcaacaaatgaaagagaggtcagggttgggagattgcagcgtcaaaaggttcgtgtctctcgaaatcgcattttggattctgctgctaaggtgatggagttgtattctagtcaaaaggctgtacttgaagtagaatattttggtgaagttggcaccggtctggggtcccactctggagttctacacacttctcagtcatga

SEQ ID NO: 30513 - DNA, 2667 bp, Glycine max
  Peptide Sequence Number=SeqID_147291
atgttacttgtcactaatggaattgcagaaacagtttctgagcaactattgcatctaattagaaggagggtcacttcgatcaaaccacactttacatctttctctttctctccattctgcacatacaatcttaacatgtcaattctcaaagttcttttgattaccatcattgtttcattggtcatttctgccagcagcgcccatgatgaagacaacaagaagatgacttctgaaagcgatgacaacgacaaagacaagaaaaagactgtgacttatgatggcaggtctctcattatcaatggaagacgagagcttctcttctccggttccattcattacccacgaagcacccccgagatgtgggcagacattcttgaaaaagcaaaacatggaggcataaaggtggtccaaacttacatattctggaacattcatgagcctgagaaaggcaagttctcaattgagccgcagtatgattacataaagttcatgaagctcgttcaaaagaaaggaatgtatgtaaccctcagggttgggcctttcatccaagctgaatggaaccacggaggacttccatattggctgagagagatccctgatatcatattccgctctaacaatgaaccctttaagaagcacatgaaagaatatgtatcaactgttgtaaaaacgttgaaagaggcgaagctctttggtccccaaggaggccccatcatcttggcacagattgagaatgagtacaaccatatccaacgtgctttcagagaggaaggagataattatgtccaatgggctgcgaaaatggcagtgtcgctggatgttggagttccatggatcatgtgcaagcagagagatgctcctgatccagtgattaatgcttgcaatggaaggcactgtggtgatacctttgcaggccccaacaaaccttacaagccttctctatggactgaaaactggacggttcagtatagagtgtttggagatccaccatcccgaagatcagcagaagacattgccttttcagttgctcgcttcttctctaagaatggatctttggtgaactattatatgtaccatggtggaacaaattttggtagaacaagctctgccttcactacaacccaatattatgatgaagcccctcttgatgagtacggtatgcagagagaaccaaaatggagtcacttgagggatgtgcacaaggcattgagcctatgcaagaaggccttgttcaatggtgagtctaccgtcacaaaactgagccaacatcacgagactatagttttcgagaagccaggaagtgatttgtgcgctgctttcctcaccaacaaccacaccttgacaccagcaaccataaaattcagaggtactgactactatatgccaccacgttccattagcatactccctgactgcaagactgttgtcttcaacactcaatttattgcttcacaacataattcaaggaacttcaagaggtcaatggcagcaaacaatcataagtgggaggtgtattctgagaacattcctaccaccaagcaaattccaaccaatgaaaagattcctacagagctttacagtttgcttaaagacaccagcgactatgcatggtacaccaccagcgtggaactgggtccagaagacttgccaaagaagaatgatatatcccccgttctccgtattatgagtcttggccattcattggttgcctttgtaaatggagaattcattggatcaaatcacggttcccatgaagagaaaagttttgaattccagaaacctgtaaccttgaaggttggagttaaccaaatagctatcttggcttgcactgtgggactccccgacagtggagcatacatggagcacaggttcgctggaccaaagtctattttcatccttggtctcaactctggaaaaattgatctcgcttctaatggttggggtcataaggttggtatcaaaggtgaggagcttggcattttcactgaagaggggtcaaagaaagtacaatggaaagaagccaagggatctggaccagctctctcctggtacaagacaaattttgaaaccccggagggaacggatcctgttgccatcagaatgactggtatggggaagggaatgatttggatcaatggcaaaagcattggtcgtcactggatgagttacctctctcctcttggaatgcctactcagtcagagtaccacatccccagagctttcttcaatccaaaagacaacttgattgttgtgtttgaggaagagatagcaaatccagaaaaggttgagatcctaactgtagacagagatacaatatgcagtttcatcacagagaatcacccccccaatgtgaagtcatgggcagttaagagcgagaagttccaggctctttcgaataatctggtgccaacagctacactcaaatgtccaaaccgcagaaccattaaggctgtggagtttgcaagctttggtgatcctgctggtgtatgtggagcctatactttaggcaaatgtaatgcaccttccaccaagcagattgttgagaagcattgccttggaaaacaatcctgtaatgttccaattgacaaggacgccttcactaagggccaagatgcttgccgaaatatggtgaaggcacttgcaatccaagtgaagtgtgaagcctag

SEQ ID NO: 30514 - DNA, 354 bp, Glycine max
  Peptide Sequence Number=SeqID_147292
atggccttgccagtggtcgtcgacgcagagtacctcaaagaggtcgacaaggctcgccgcgatctccgcgcactcatcgctaacaggaactgcgctcctctcatgcttcgattggcctggcacgatgccggaacttacgatgctaagaccaagactggtggacctaacggttcgatccgtaacgaggaagagtattctcacggcgccaacaatggcttgaagaaggctattgatttctgtgaggaagtgaaggaaaaacatcctaaaattacatatgcagatctctaccaggtgaaaattgtagaatggggtcaatggactttcaaacttgtctggcatgtgcatgatagttga

SEQ ID NO: 30515 - DNA, 666 bp, Glycine max
  Peptide Sequence Number=SeqID_147293
atgttaaagcttgcgggtgttgttgcagttgaggttaccgggggtcccacaattgatttcgctcctggtagaagggattcaaaaatatctcctaatgaagggcggcttcctgatgctaaaaaaggtgtttcacatctccatgatatcttttatcgaatgggcttgactgaccgagatattgttgcactatctggaggacatacactggggagagcacatccagagagatcagggtttgatggcccttggacagaggaccctctgaagtttgataactcatactttgtgcattttgtagagcttcacttttgccttgcaataccgaaagagtttgatttttatctacaactaaatatcatcgttaacatcagggaacttttgaaagaagattctgctgggctgcttaaacttccaacagacaaggctttattggaggatgctgaatttcgccgttatgttgagctatatgcaaaggacgaggatgcattttttcgagattatgctgaatcacataagaaactttcagagctaggctttgtgccaagttcaaagccgatttctattaaggatgggaccatactggcacaaggtgctgtaggagttgtagttactgccgcagtggtgatcatcagttacttgtatgaagttcgcaaaagagggaagtaa

SEQ ID NO: 30516 - DNA, 210 bp, Glycine max
  Peptide Sequence Number=SeqID_147294
atgttgcctaaaagttacaatgaagcgaagaagatactgcgtccgatggatatggaatatcagaaaatccatgcatgccctaatgatttcctaatgtacagagataagtatgaagaaatgcataaatgcctcaactgtggggtatcacggtacaaagtgaatgatgatgatgagtgtagtagtgatgaaagcacaaacaaaggcccttag

SEQ ID NO: 30517 - DNA, 252 bp, Glycine max
  Peptide Sequence Number=SeqID_147295
atgacaagtgtagcagtgattaaagcgcaaagaaaggcctcccaacgaaggcatatggttgagacaaatatgcgagtggggaatgcctcgatgtatggattcctcgagccacaatccatacatagatctgagcaatcacaatttgaattagaagattatattaaaaaatggattcggaattcacagagtgatgtctacctaggagcctgcttgaatggtgcaatattggcaaatgatagttatatgtcctaa

SEQ ID NO: 30518 - DNA, 264 bp, Glycine max
  Peptide Sequence Number=SeqID_147296
atgaatccactcttggtggattcctccaccatcacttccgaccaagaagtggacctcctccaatggagcattaagaaagtaaagatgaaggagcctgaagtggcaactgacatggaccaagattgtaatgggggaaaggtggagccttgcccttacaaggataacctcctaggccatgagggcttgattttgcttgaagacatcatggaggagcaggatgaagaaaaaaagttgttagaagacaagttctatagggaaacttag

SEQ ID NO: 30519 - DNA, 444 bp, Glycine max
  Peptide Sequence Number=SeqID_147297
atggacggttttggtatgttcaatgagtttgttctaactgcaactgggtcagagtccgagcaagaaatatcctttcaaaaacacagatggagagctgcacgggtagaaaaacttcaaatattttatgttgcagacaaagtgtgctttttccttgtattccctttgaccacaagcgtgctattcatattagtgaatgatccatttgtgatgaactcatgggccaaaacattcctagagaacaagcatgttaagttccttgctgatggtgcagccaaatacaccaatgcccttggtcttcaggttgacctcactgacaagggtcacggcatccgctcaaagaggtttgctctgatggtggaagacctcaaggtgaaggttgcgcatgttgaaagcggaggagagttcaccatctccagtgctgaagagatcatccaggccctttaa

SEQ ID NO: 30520 - DNA, 2461 bp, Glycine max
  Peptide Sequence Number=SeqID_147298
atgggactgatacgggtacagggtatgaagaagaagatgctgaggaagaagaagatcagagttcagctcaagagaagaaaaaagggagccaacactggtgctttcattgttcttcccgctcccatggccgaatccagcaacgatcgtgtcgaggctgccttagcccgactaacttcacgcatagaggaccttctgcaacacgttaccccctctgcttccccttcctttccacctcgtagcccgatacctgcacattcacatagaatgaagttagatgtaccgagatttgatggtacggatcctcttgggtggatttttaaaatcacccagttctttgagtaccacggtaccccggatcacgaccgcatcaccattgcagcattttacatggagggaagagcccttgcttggttccagtggatgtcaagcaacggacaattcacctcctggcctgtatttctacaggcactgcaaaatcgttttgccccaagtcagtatgaggacccctcagggtctttgttcaagcttacacagaggacaacggtgacggaatacttatctgaatttgaggaattggccaatagggtggttggactcccggctccattcctgctcagctgcttcgtatttggactcgtgccggagattcgccgcgaggtgatggtgaaccaacccctcatcgtggcccaggcggcagggctagcccgtctccacgaggagaagctccgcgacttccgttttgacttccgccaaatcccacgaccccgcgcgccgccgccgccgccattggctccaacgcagcctccgccgctcacaccctttgcttctccccgcttctcaccccttcctcctctcttgccctcacctccgcgtccgttcccgtcaccaccacccacggtccgccggctgaccccagaggagctagcctcccgcctcgagcgcggcctctgcttctcctgcgacgagaagttccacaaggggcataggtgcacccctagggttcacctgctgatagcagatgaggacgaccctctcgagcacgtgggttcaaatatagacccagctgacccaggcgacccgactccaggcccaattgagttacccgaaaccccagcccacatcagcctcaactccctcgcgggccaccttgccccagagactctgcggctcgtcggtcacatctccagccaccccatcctggtcctgattgacagtgggagtacccacaatttcattcaggaccagctcgtggcccaattggggctaccctgtcggcccaccactccattgaaggtcctcgttggcaatggccagcatttgcagtgccacacgacttgtgattccaccaccatcgaccttcagcaacattccttcgccgtcgacctctatgtccttccgattgccggcgccaacgtcatccttggcgtgcaatggttacaatctctaggccctattttaactgattatactaagctcagtatgcagtttttccatgatggcaggatagtcgagctccaaggtgatcctgtggctcaacgagacttgctctcctcccctcaattccgacgtgtctgccgcaatcaacccaacagcatttgcttccacattacggtgctccctgaggattccgaactcgcgttgaccatccccgttgacccgcaagtccagcaccttctccatcaattttccgttctctttcaggacccgacaacgctcccaccggcacgagatactgatcaccaaattcacttgcgtccagatgccacccccgtcaatgttcgaccatacaaatatccttattatcaaaagcgcgagattgagactcaggttgaggcaatgctccaacgcggcatcattcagcccagcaagagtcctttctcttcgtcggtgctgttggtgaagaaatccgacaatacctggaggttctgcgtggactaccgtgcattgaacgccttaacaatcaaggatcatttcccaatccccaccattgatgagctcttggatgagctcggcggcgcgagttgcttctcaaaactggatttgctgcaagggtatcaccagatacacatgcaatcggaggacattcccaaaacaactttccggacgcaccacgggcactttgaatttaaggttatgccctttggcctctgcaatgcgccctcttcgtttcaggcgacaatgaacactctcttcaggccttaccttcaacgctttatcatcgtcttcttcgacgatattctcatctacagcgtctccctcagcgaccacttgcgtcacctccaaacaacctttcaggtgttatatgacaatcacttcgttctgaagctctccaagtgtcttttcgctcaacctcagtggcttcaaagattgcagccattgcgcagtggcccattccacgctccgttcgtgctctacgcagtttcttgggacttgccggtttttatcgccgattcatctgtgg

SEQ ID NO: 30521 - DNA, 246 bp, Glycine max
  Peptide Sequence Number=SeqID_147299
atggggttcttctcaaagtttttcctggcaggtgctcttttggagctgccacgtggagagggacgcgctagttgcagctgcggcttgaccttctgcttacgtggagtgggacgcgcaaggtgcactggcgcgttgtgcatggagaccaggggcgccagtcaaaatggcgttttaggtttgcagcaagcacaacagctttggcagaccaggagcagggaggaagcgcaaatggtgttggcgttttag

SEQ ID NO: 30522 - DNA, 468 bp, Glycine max
  Peptide Sequence Number=SeqID_147300
atggctctagatagaatgcaactacataatatgtgcaagagagacaatgaatctttcaaagaatacgctcaaaggtggagagatctagcagctccagtagtgcccctgatgatggagacagagatgataacaatgataatggacacattgttggtgttttactatgagaagatggtagtgtttgttggcgaaaggatcaaagtgggtctgagaagagggaaatttgattatgctgcttctgcgggctctagtaatgagggacccgggaggagtgatgagaggaagaaggagggagaaactcatgttgtggctgcacttcctgtgtggccaaactttccactaaccccttataatccatgtaccaatatccttcccaacaaaatcaccactcaaccaatatcagtccttcccattacccaccaccctaccaaccaagaacacccaattagccacaaaggccactcctaa

SEQ ID NO: 30523 - DNA, 312 bp, Glycine max
  Peptide Sequence Number=SeqID_147301
atggcggactaccaacatgtgattccagttcatgctgatgttgcccggaggaagaagcggaactggtcagagctagaagaactgcattttgataaaggtggtttcatggatctggatcacgaggatgttatgattatagtgcctccaattttcgctccaaaagatgtgccagaaaatttagtcttaagaccagctaccatgtcgagttcgaaaaagaaaccagaggaagttgtacaaccccattttgagggtaggaaaataaactacattaatgagaaaagaggcaagatacagctagagagaggagaatga

SEQ ID NO: 30524 - DNA, 102 bp, Glycine max
  Peptide Sequence Number=SeqID_147302
atggccctctacgggttggcgttcgcttactcgaacccactcaaggatactaggctaccttgcagcggcactttccgcttgtcccgagctgggaaggggtga

SEQ ID NO: 30525 - DNA, 204 bp, Glycine max
  Peptide Sequence Number=SeqID_147303
atggcaaagtgggtcgggctagacaagctggcatgccagcccattattaatttggcagacgggtctctccaatctcacaagtgctccacatccattcctcacatcgtagtcacaaaacctccacaccaaggctctactccatcgcaccgcatcgcgctaccgtctctcaattcttacactgtggcgactggggcgtcacgctaa

SEQ ID NO: 30526 - DNA, 243 bp, Glycine max
  Peptide Sequence Number=SeqID_147304
atgaaagcaaaagaaaagacgtcatggaagcgtacgttagatggagtgagagcaagggagttaacatacgacctcgggaaagtcttatgctgccaacgattgaggtggtttcgaagagaatggaagaggtgtcgatgtcatcaaggagaacgaatggaaaagatttcgataatgtttaagacaatggaagaggtttggcaacgaagagaggtgagagacgtttgggcacatgagatggaataa

SEQ ID NO: 30527 - DNA, 264 bp, Glycine max
  Peptide Sequence Number=SeqID_147305
atgacccacaccaagaacattgggcaaatgacttctgaggcaacaaaggaaattgctggcaagattggttcctttgtcacccatggatgtcaagatgtattgaatgttgccattaggcgacctgaatatcttggttgtgtgcgtgctgctagagccggtgtcacgatcaaacaatactttggaccgactccaaggacctcccgcgcgtctgcgcccatgggtcccgaagacctagagcagctgacgcaaaaacttagggactag

SEQ ID NO: 30528 - DNA, 504 bp, Glycine max
  Peptide Sequence Number=SeqID_147306
atgctacttttgcagtctggaactgggtggttctcacaacacatgatcaattgtattagacaacgtcttatggtgcgatatctatcagtattccccaagcctggtgctgagaatttactcagagctgccactttaaagtttgaaaaattgaagagggagtgctataggcatgccatgaagctcgatggagaagaatgccaacaagctaatttaggtttggaagagaatgaagaacttgataatggtgaagatgaagaggaggcagctgagggtaatgatagtgatgaagaatgggaagaagagcatgatttggctggagataatgaaatgcctctgccatctgattcctgtatccttttctattccaactctaaatttagtcatgatctttttgttaacttccctcctaatgaaattgattgtgacaatgtgcaagcaaatggcagcgaagaagaatatcaaatatacggggaagatagtgaggacaattactctgatgaatga

SEQ ID NO: 30529 - DNA, 549 bp, Glycine max
  Peptide Sequence Number=SeqID_147307
atgcagtcccaatttcaattgcagatgcaatcacagggactcgcactacctcttaagcctgaggttggtccttcagctgctcgtgttagcacaaaggagagttgtgttgatccctcagggaacgatccagacatgtgtgactcggagaaatgttggttgtacattgaagaaaatccctcctgcttggttgccataggaagactttatgaggggtccataatcgttcacaacatccctttgcgccatgatcaagtcaaggttggtgttgaggaagttagagatgtagatgttcacattcctgtacccattgaagaggaagctgtgggaccgacaaaacctgtaaataggccggatcatgatgtcgatgatcccctatatcggatgacatttactatcccacaactttttcttaagtcgttaaaggttatgtgggatgctaccgtgtttggggtatttaacgacaacttccccttgtacataaagcatgaagatctatctaaaatagcacgcagtggtcaatatctcaacatctttgttatacagttgtga

SEQ ID NO: 30530 - DNA, 210 bp, Glycine max
  Peptide Sequence Number=SeqID_147308
atgcctgaaagcaaaggccttgagatcaggcatgtagaggaaatagtgagcatgaagataaaaggacttggtagctttgttacactatcaaatatctatgtcgctgatggtgaatgcctcgttttagttggattgaaaaagtcaggtgagattcttgaaggggacaaagacaaagaatggaacaatatggccagtgaattggatatgtga

SEQ ID NO: 30531 - DNA, 310 bp, Glycine max
  Peptide Sequence Number=SeqID_147309
ttgtttgatgtagaaatgggagattgcttagaggatatgattcatgaccttggacaagagtcttttcagcaagcatatgcccctatgtatgatacattgcaaactgattcaaagaagcctttgtattcagggtgcaacaattcctttacgctgttgtctgcagtgttaaatctggttaatgtcaaggccagatatgggtggagcgacaaaagcttcagttcactacttcaagtagtgcacgatatgcttccagaaggaaacacgttgccaaaaagttactatcaggccaagaagatattgtgcccgatgg

SEQ ID NO: 30532 - DNA, 363 bp, Glycine max
  Peptide Sequence Number=SeqID_147310
atgcataagaagagggtaatatcatgtgatgaagaatctcagaatgtcaatgagttgcagtgtgttgaagcatctttaagcacccttctaagtgaaggtactaatgtttccaagttgcagggtgtgcgtgacagattggaggctttggaaaacgccattgaaagcctagaaaatggtttggagagaatgtttaagcggcaagagtttgaagggaagaaagtagtcaagcaccataattatgtgagggattttcaaactaatagaagtccaaaaacattaaagaaggataccaatgaaagaggacacaatttcaaagcagggaagacactgcaacaggttgctgagcagcgtaagggctgctga

SEQ ID NO: 30533 - DNA, 928 bp, Glycine max
  Peptide Sequence Number=SeqID_147311
atggcttctaccttttctccaaaacattctcgtggctatgccattcgatccataagcttgccaactagatcacatccaagcacagttccaattgaagaggagctgaacaagctcaaatcatgggaaacatcatcttcctctgaggtggagagaattttctttggtctttcaggccttgcaaacttgtacgagtgcatggaggatcttttgaagttgccactcacccaacaagcactatctcatcaccacaaccaaaaatgggtcgatgagttgctagactgtccagtgagattcttggacatattgggagaaacaagggatgcaatcatgctaatgaagggaaatgttagagaccttcaatcagcacttagaaggagaaaagttggagacttggtgattgaaagccatgtttcttcatattggagtctcagaagaaacacaaggaaacaatgcacaaaatctcttgttttgttgaagcacagtactgaagggtcatcatttggggcctcttctcctttggatcttaatcaccacctatcagcagttgtgcgggttctaagagaagctagtttgatcactagctccatctttcagtcactagtggcgtttctttcttcaccaatcttgaggtcaaagattaataataagtggacatttgtgtcaaaagtgatgcggaaaggggtgcttcagcttcaatgcaacaatcaagaggagaatgtgaatgaacttgaaaaggtggacctagcactttgtagaatggtcatggataatgcaaccaaggattttgaggctgagaatattcaatttgcacacaaagagcttgaggctgtggtggtagtcattgaagggcttgaaaatggattggattgcttgtttaagcaccttattaatactcgtgtgtcctttctgaatatagtttctccctcag

SEQ ID NO: 30534 - DNA, 954 bp, Glycine max
  Peptide Sequence Number=SeqID_147312
atggcaaacaagttccatgttcgctcaaatagttttcccactggatctcatcctagcaccattacagtagaggaagagctgagcaagctcaaaacatgggaagccacttccacatccacatcaaagtcaattggcactggcttgtccttgcttcaagacttgcatattgacttggaagatcttctcaacatggcatcaacccaaaagctgatttccaaccatcaaggtgagaaatgcatggaagaactacttgatggatcagtgagaattttggatatctgtggcatcacaagggacaccattttacaaactaaggaaaatgtccaatcccttcattctgctcttagaaggagaaagggggattcaagcattgaaaaaattgtagccgaatacaatttcttctcaaagaagatgaagaagaatgccaagaaaatgatctcaactttgaagcaaacggagagcaaatttgtagcatccccactcttgaatcaagaccaacaacttgttgctttggttagagtgcttagggaagtcattgtaatgaacatgtctatcttccaatccttgttaactttcttggccgcgcctgcttcaaagtcaaaggcaaccaaatggttattcgtagcaaaattaatgcataagggagtgatagcatgtgaagagaaacaagagaattccaatgagttgcaatgtgtggaagcatctttaagcacccttctaagtgatggtactaatgttgaaaagatgcaggctgcacgtgaaagattggaaaaattggagaatgccattgaaagcatagaaaatgctttggagatcgtctttaggcgcatgaataacatggcaggaggcctcaagaggattgaagaattggagcagcacgctcagcgcgtcaacaatcgctcaacacgaagagccaactgggaggttaggcttaggatacatatgacggcttag

SEQ ID NO: 30535 - DNA, 531 bp, Glycine max
  Peptide Sequence Number=SeqID_147313
atggcaaacatgtaccatgttcgctcaaatagttttccttctggatctcatccttgctccattagaatagaggaggagctaagcaaaatgaagacatgggaagccacatccacttccacatctgagtcaattggcactggcctatccttacttgaagatttgtatatttgcttggaagatcttctcaacgtggcatcaacgcaaaaagtgatttctaaccataaaggtgagaaatgcatggaagaattgtttgatggttctgtgggaattttggatatctgtggcatcacaaggaacaccatgtcacaagttaaggaaaatgttcaagcccttcattcttctcttagaaggagaaagggtgattcgagtattgaaaaaagtgtagccgaatataacttcctcacaaaaaagatgaagaagaatgccaagaagttgatggcatctttaaaacagatggaaagcaaatttggagtatccccaattttgaatcaagatcaagaccttgcttctgtgataaaagttcttagggag

SEQ ID NO: 30536 - DNA, 1194 bp, Glycine max
  Peptide Sequence Number=SeqID_147314
atggcaaacaagttccatgttcgctcaaatagttttcccactggatctcatcctagcaccattacagttgaagaacagctgaacaagctcaaaacttgggaaaccacttccacatccacatcaaagtcaattttcactggcttgtccttgcttcaagatttgcatattcgcttagaagatcttctaaacatggcatcaacccaaaagatgatttccaaccatcaaggcgaggaatgcatagaagagcttcttgatggttcagtgagaattttggatatctgtggcatcacaagggacaccatgctacaaactaaggaaaatgttcaagcccttcattctgctcttagaaggagaaagggggattcaaacattgaaaaaattgtagccgaatataattgtttctcaaagaagatgaagaagaatgtcaagaagttgatgacatctttgaagcagatggtggagagtaaatttggagtatccccactcttgaatcaagaccaacaactcgcttctttaattaaagtgcttagagaagtcattgtaatgaacatgtctatcttccaatccctgctagctttcttggcctttcccacttcaaagtcaaaggcaaccaaatggttaatggtagcaaaattaatgcacaagggagtaatagcatgcgcagagaaccaaaagaacatcaacgagttgcagtgtgtggaggcatctttaagcagccttgtaagtgcaggtactaatgttgcaaagatgcaggctgcacatgaaagattggaagctttggagaatgccattgaaagcatagaaaatgtattaccaatcaaagcagagagaacaattgcctgtgtgtgtaatatatttgatagacttgaggtccgagtctgtgacagagcctctaatcaaaacaacaaattctcgtgccaaatgcattttgtgaggatattgcaattagcatgttcctctgatcaggtcaaggcattctttgatgccaggactttcctccattttataaaaatccagattaaacttcgtaccccattgcccagaggctcttcgctatgcgaaggtatgggggagggatgttgtacgcagccttacccttgcatatgcaaagagactgtttccggattcgaacccatgaccaacaagtcaccaaggcacaactttaccgctgcaccagggctcgccctcttataa

SEQ ID NO: 30537 - DNA, 381 bp, Glycine max
  Peptide Sequence Number=SeqID_147315
atgaatgggtcacgtgctctcttgtttcttgttttacggtggctgttaaccttcgaaaccgctgttcaattggagtttcatttcgcttttctggatgtgttttttctacaatttgaccaagtgaacgaaaacacttctatgaatgatgctttagggtattgtgcgttcccacaagaggcttattttgggataacgattatgtattctcgtggggatgagtatgaaatgttggaaattgggaagagtggcaaatatgagaagaccaagcttttgattcaaggtaactgcgtagggtgtgatacgatgtttcggtgttgccaatgtcaagaactaacggcgggggtgaggatgagagatgagcacgtgacccacaaattttaa

SEQ ID NO: 30538 - DNA, 612 bp, Glycine max
  Peptide Sequence Number=SeqID_147316
atggcatttctaggagaaactagcagtcagacgattgtcaactcaaggttggctttcatttatccaaatggatcgattattcacaatgatactggggtttacttccaaacttcaactccgatgcccattcgagtaccaaataggtgtgattttgcaagcctaaaaaccagaatacacaatacccttcagctatccgacaaacaatttttggatgaaattcactatcggaagccattcaccgatacaggtaaccaaattcgctttgagtgtatcaaattgataaatgatgacgatgtcaacacaatgttaatgtgtaatgatcaattttcttgtgttggtccgattgagttattatgcaccgttggaagaacaccagatggaataataaacttacttgaacgcactatgcctcgtattcatgacgcgatcctgtattacaacggcaaatggaacatgccaccgcagaacaaatttgttggttgtgcgttcagaggaaaaaatcctaagaaatttcaaattccttcaacatgtaccatcgacgaactgaagaatttaatcaagcaagttgcacctaaagggatcccccctcttggaattcacgaatcacaaacg

SEQ ID NO: 30539 - DNA, 150 bp, Glycine max
  Peptide Sequence Number=SeqID_147317
atggctagctctaaacttactcccattcctgaaatagaagagttcaaagctatgaacatgagaaataggcaattttacaaggcagtctcactcaagcggggtataggcctctcaagccagctcaggcgaggtataaatagagagacatag

SEQ ID NO: 30540 - DNA, 477 bp, Glycine max
  Peptide Sequence Number=SeqID_147318
atgggaagaactgataagggtgcttgcagtttgttgggaagtttttgggtgccaagtttagcgatgattattacctcaaaaactatattagagaatactatttggggatgtggattgagacaggtaataacaaagttctgctcagagcgcattgctaaatatgcttttgagtatgcttacctaaataacagaaagaaggtgactgctgtgcacaaagcaaacattatgaaacttgcagatggtttattcttggaatcttgtcgagaggttgccacaaggtatcctggaatcaagtacaatgaaattattgtagacaactgctgcatgcagcttgtttcaaaaccggagcagtttgatgtcatggtaacccccaatctttatggaaatcttgttgcaaatacagcggcaggtattgctggaggcactggagtcatgccgggaggtatagttcttatttctaatatattgaagctctag

SEQ ID NO: 30541 - DNA, 1548 bp, Glycine max
  Peptide Sequence Number=SeqID_147319
atgacagaattttcttgccatcctattcttaggcgtaaatcccttatatcaactctcctctttgatgtacaaagagttacaacaactcccttagaaaatctcaaagttacagcattggcaccaaatattccagcactgtacgagcttcattttggtgttcctatggcagggggtgttctttctgctctcaatacccaattggatgtaacaacattggctctacttttggaacaactagagccatgcaaaatcatgtttgtggattaccaattaattgattctgctctcaaagcatgtgaaattctctcccacagaaaatgcaagccacccatcattgtcctaataccaaattatgaccaagaacaatctttcttagcgaagaatatcccaccaggtaccttaaactacaatgaactaattgcaattggaaaaaaagattttgaggctttaaaaccaaacaatgaatgcaatcccatatcagtgaactacacatcaggctccacggggattcttccaaaaggggttgtttatagtcatagaagtgcttatctcaattcactagcagcaattgctcgttttgagatgaaacaattgccagtgttcctatggacagttgacatgtttcgttgcaatggatggtgcttcccttgggcaatgtctgctattggtggcaccaacatttgcctaaggaatgtctcagcaaaaggcatatatgatgcaatttatctttataaggtgacacagttttgtggtgcacctacccttctggacatgattgcaaatgcatcacctagtgaccagaggcctctgcctcatagggtgaatgtcacagttgctggtgtgttaccaccttttcatgttcttaacaaggtgtcacaacttggatttgatgtgaacattggatatggcatgacagagactttaggtcctgtgattgtaagaccatggaaccccaattcggatggcgaacacacaaagctgaattatggtgtttcggagtttaggcaagatgttgatgtgaaggatcctgaaactggtgaaagtactcctcatgatgggaaaaccataggtgaaatcatgttcaaagggaatgctttgatgctggggtaccttaagaattcacaagcaaatgataaggcttttaggggtggatggtataggactggagaccttgctgttagagaaccaaatggttctataactatgaaggatagagcaaaggatgtcatatattctaagggagaggttgtgagttcactagaggtggaagcagtgttgttgaatcatccaaaggttttgaaagctgctgttgttgggagatgtgatgaatgcttggtggaatctctatgtgcaattgtcaaattgaaagatggatgtagtgccactgttgaagaaattatcaagttctgtgaagatcatttggctactcacatggttcctagtaccgtggtatttggagatttacctgttaattcaactgggaaggttcagaaatttcgcatcagggagaagatcaaaggcagtgagtggtatgactcaaagaattag

SEQ ID NO: 30542 - DNA, 1566 bp, Glycine max
  Peptide Sequence Number=SeqID_147320
atggctaaacgcaaaacatccgacgcctccgatgcacaagacgacactgtatcgctgcttccttcccaacgcaataaggccaagcatcctaactctaactccaacgcctgcttcgccggaaagcccattccgcccgccgaggccctcgccaaatggccccaccgatatccctccgaggggaaaaagaagggttcagctagaacctcaaaagaggctacgagtgaaaacagtgaagttatgccggcacggtgtcattatcgtcaagctaaagtggatggggttgtttataacctctatgacgatgcttatgtcaaggccgaagatggaaaaccagattatattgcacgaatcgttgagatgtttgaaactgttgataaggaacaatgttttacggctcagtggttctacagggctgaggacactgtgataaaaaatcacggtgaccttgttgacaagaagcgaatttttatatctgatgtgaaagatgtagatttgacttcaaagaagggaaaactcccttcttgtgattactattatgacatgaagtacactgtgccgtatctaaccttttccaacatcgtcaacgaaacagttaaaacagagagtgatgcatcttccacaatttctagtgaatctggatccaatggttgcgttagtaatgctaatctagctaatggaaagactactcaaaataatagttctggttcctcggagtggactttgctagacttgtattctggttgtggagccatgtccacagggctttgttttggtgcatccttggctggaataaaacttgtcactaggtgggctgtggacattaatgcacatgcatgcgaaagtttgaagctgaaccaccctgagactcaagttagaaatgaaccagctgaagacttcttaaacctaataaaatcctgggccaagctttgtgaagagtttgcattattaggatcagaacggttagattctgatccagacatggatgaagatgagaatgaagctgtgagaaaagaagagtcaggaaatcaatctgattcagaggaatttgaagtagaaaagttacttgctgtgtgctatggtgatccaaacgacgttcgttggctgggttatgcttccagctatgacacgtgggagccaatagaaggattgagtgattgcaaggaagctatgaaagattttgtgacaaaaggctacaagaaaagattattgcctcttcctggtgatgctaactttatttgcggtggacccccatgccaaggagtaagcggtttcaaccgcttcaggaatgcagcagctccattagaggacacaaagaataagcagttgcttgtttacatggatattattgattttttgaagccaaaatatgtcctcatggagaatgttgttgatattttgaggttttccggtggttatctggggcgttatgccatatgccgtcttgtagctatgaattatcaagcaagaatgggcatgatggcagcagggtcttatggccttccacaatttcgtatgcgtgttttcctttggggagctcgtcctactgagaggagacaacaaggttag

SEQ ID NO: 30543 - DNA, 330 bp, Glycine max
  Peptide Sequence Number=SeqID_147321
atgaaggtagtgagtggtaagtgctcaggttcaagaacagcctcatcgtcgtctagtcacagtttttgtcgggccaaagaatgtggggagggacttgagcatggccaagagttacaaccgccgtcagaagtttctagcattcgtcagaggttctgccaacaatgtagcaagttccatgaacttgttgagtttgaagacaccaaaagaagttgcaggaaacattggctgagcataatgaacgtagaagaaaagctcgtagaaacatatcagcatcagtcacacccatctcaagtgactaacagctcgttaccacttctagagttgttctga

SEQ ID NO: 30544 - DNA, 441 bp, Glycine max
  Peptide Sequence Number=SeqID_147322
atggcaaaaacaccatctgaagaagagagagaaatggataatggaaacgatgaggagggtggtgaaggagaagtgggagctaaaatggtacagaatataaaaataaagttagtgtgtggtaaggattcaggttcaagaacagcctcgtcgtctagccacagtttttgtcaggccgatgaatgtggtgtgaacttgagcatggccaagagttacaaccgccgtcacaaggtttgtgagagacatgctaaggctcctgttgttttagtttctagcattcgtcagaggttctgccagcaatgtagtaagttccatgaacttgcagagtttgatgacaccaaaagaagttgcaggaaaacattggcagggcataatgagcgtagaagaaaagctcgcatagacgtatccttaggaggtggtgaacagcatcagtcacatttctaa

SEQ ID NO: 30545 - DNA, 1326 bp, Glycine max
  Peptide Sequence Number=SeqID_147323
atggaaaccatttccaaatttccctgttcacatcaacctgtaagatccattagtttccctcctagggtacaccccgtttctcaaagagttgaagcacttctaaaccacctaaaacctcatcattctcagcctatctcaatcactacttgtttagaagctgagacaattcagagcgacttagttgtgcttgctgagttgtacaactgcatggaagaacttttccattctccacaaaccaaacaaactcttctacgctaccaagatggaaaactagtagaagaagcattacgtggctcagtcacattgctagacgcatgtgagtctgcaagggatttgttattggttcttaaggaacacatgcaaacccttcattcagccgtgcgtagaagaaagggagattcaaacattgaaagcatcatttctgcttatgaaagcttcaagaagaaggcaaagaagacaattgctaaacaacttggacaattaaagagaatgaagaataaggctaattccttttctttattggatcaagatcaacagctagtgtttttggctagagttataaaagaagcaagcaccatcaccatctctatattacattctctattagtatttatgtccatgccaacatttggaacaaaagggtcttccctgatctcaaagttgaagccaacggttttgttttcttccctgaaagaacagaagaacacaaatggggttgcagatctcaacaatgttctgtgctctctccttagaagagagaaaaacggtgattccagtggtgaatttcaaagggcactaacagtgttagagacattgaatgttaatattggtggtcttgaggtggaggaagagctgagcaagctcaaaacttgggaagccacttccacatccacatcaaagtcaattttcactggcttgtccttgcttcaagatttgcatattggcttggaagatcttctcatcgtggcatcaacccaaaagctgatttccaactatcaaggtgagaaatgcattgaagagcttcttgatgtgcttagggaagtcattgtaatgaacatgtctatcttccaatccttgttaactttcttggccgtgccagcttcaaagtcaaagccaaccaaatggttattcgtagcaaaattaatgcacaagggagtgatagcatgtgaagagaaacaagagaattccaatgagttgcaatgtgtggaagcatctttaagcacccttctaagtgaaggtactaatgttgcaaagatgcaggctgcacgtgaaagattggaaacattggagaatgccattgaaagcataaaaaatgctttggagatc

SEQ ID NO: 30546 - DNA, 903 bp, Glycine max
  Peptide Sequence Number=SeqID_147324
atggctggctcacatacagccaaggaatttcactaccatgttagatccattagcttgccttgtaggctacatccttcattacccaagattgaaaaagagctgaagaggctgaagacatgggaattagcctcatcacattcacaatctgaggacatcaaagcagggttaacatggctcgcagagttgtataattgtgtggaggaacttgttggttgtccacttactcaacaagctcttctacgccatgaaggaaaacacgtagagaagccacttgacatgtcagtttgtttgcttgacatgtgtggatcagcaagagaattgttgtcattggtgaaggaacatgtgctagatcttcaatcagcattgcgcagaaagggtgtggattcaagtgttaatagccagatttgtgcttacatttgtttccggaagaaggctaaaaaagacatcacaaaaaagctcaaagcactcaagacaatggaaaatggctttaaatcatattcatcatttcctctcttagatttagatcaccatctattaatggtgatcaatgtgctaagagaaataagcaaaatcaccatctcattttttaggaaattcctactttatatatgtgcacaagtgttgaagaaaaacactggtgggtggtcattgtttactagaatagtgtccactggatcagacaaacaaaagaggatcataagtgaaatgggggacattgataatgttctttgcaccttccacaggtgttttaagaaaattgatacaaagactgatttacaaattatgaaaaggaaattgggggaactagagggaagcgttagagaattggaggcgggattagattgtctctttaggtgtttgatacagcaaagagtgtcacttcttaatcttttcacctcttga

SEQ ID NO: 30547 - DNA, 222 bp, Glycine max
  Peptide Sequence Number=SeqID_147325
atggttcggggcattgttattataagcttggatgtgcttggttcaatttctagagctagcaacaatgcgggatttcgagagcgtaagatagagaaaatggaacaggatgcaggcatgaaccaagctctagatttgttactgccttactggtacagtggtactgctctcttcacaaaaaattcacccactgtgttcaacaacgatggaaccagcaaggcataa

SEQ ID NO: 30548 - DNA, 156 bp, Glycine max
  Peptide Sequence Number=SeqID_147326
atgaggcctacaaccacaagtgtagggacagggcgggcacattctgaaccattcataatgccacatttatttcagggtgtagtcgcatttttgtcatctctcacctcacctttattatctttctccgacttctttaatccatctcaaaatgaataa

SEQ ID NO: 30549 - DNA, 348 bp, Glycine max
  Peptide Sequence Number=SeqID_147327
atggaaatgaagtactacttggattgtgatggaatgcaagaagaagcaaggaagaagcaaggaagatgcagaaagtacttgaggcacaatagcgaaatgtacacacacagaaggcttagcgtaacaggtgcgctaagagcacttccaagcattccaaaaacagtaagagattggcacttagtgcatcctgcggctaagcccaactatgaaagctcaattccagaatggatctggggcttagctcaggacatcgcgcttagcgctgctacaataaatttttccagagaagaagtggcgcttagcacatcatctccgctaagcccactgcttgaagtttatttccagtga

SEQ ID NO: 30550 - DNA, 132 bp, Glycine max
  Peptide Sequence Number=SeqID_147328
atgaagaagactttggtgttctgtagtggtggtgaacccaaagggaacatgaccattcgggttatgcatgagtatgaccttactttgaaggagcttggtggtaccaatcctgggcaggaagctttggattag

SEQ ID NO: 30551 - DNA, 666 bp, Glycine max
  Peptide Sequence Number=SeqID_147329
atggacccaagtgtatatgggtcattgagaaactcaattagtacagtctttaatttaagcttgttagtgcttgggtggtgtcaggcatttaaagatcgtgaccctgcttgtttgtcgtattgctccgcgcttttgtatatgaagggttatcatgctctgcaagtacatcgggtagcccatacattatggcaccaggggcgcaaagtcttggccctagctttgcaaagtcgtgttagtgaggtttttggtgtggacattcatccagctgcgaaaattggggaggggattttattagatcatgggacaggtgtggttattggtgaaactgctattgttggaaacagagtttcactgatgcatggtgtaacattaggaggcacggggaaggaaataggtgatcgccatcccaaagtaggtgaaggggcactaattggagctagtgcaactatacttggaaatataaagattggtgaaggtgccatgattgctgcgggttccctggtgttaaaagatgtccctcctcactgcattgcggcaggaataccagctaaagtcattagtggtctacaggagcatgacccatctttaaccatgaagcatgatgctactaaagattttttcacacatgtagctactaacttcagagatgaaaaacccaatggttag

SEQ ID NO: 30552 - DNA, 1503 bp, Glycine max
  Peptide Sequence Number=SeqID_147330
atggcgtccgtttacataccggtgcagaattcggaggaggaggttagggttgctctcgaccagcttccgagggacgcctccgacatcctcgacatcctcaaggccgaacaagcccctctcgatctctggctcatcattgcgagggagtacttcaagcagggaaaaattgatcaatatcgccagattttggaggaaggatccagtccagaaattgatgagtattatgctgatgtcagatatgagaggattgctatcttaaatgcccttggagcttactacagctaccttggaaaaatagagacaaaacaaagagaaaaggaggagcatttcattttggcaacacagtattacaataaagcatctaggattgacatgcacgagccctccacttgggttgggaaaggtagtttgccggagacatgtcatgtgcatggacttaatgtgccaggccctgcgtggggccgcgtgagctctgacgaaaaggtgtcgggaagcctgccaaaagagggcagagcagcagtgcaatactgttcaccgcaaagaggggaagaaccagcagaagccatgataaatgaaaacagaaacaagaaacggagcctggcactggaaatggaggctggaaatatggctggatgcgctgccacaccccggaacagttgggctcaaatgctgtctggcgtgcaaaggaagggcgttgccggagctttggcggcggcttccagaaaaggagaaaaatcgcgggaaagagggacagtgatcagaaaagtccactggaatgcagaaacagtcaccggaaaagacgggagacaaggtgaagtagaacaggcgtctgctgcatttaagattgtgttagatggagaccatgataatgttcctgctcttttgggccaggcatgtgttgagttcaaccgcggccgattttctgattcacttgagttgtataaggttggtagtatagccatattctttgctgcagctgtgagacttggcataggtctatgtcgctacaaattaggtcaatttgagaaagctcaacaggcatttgagcgtgttttacaggcaaatccagaaaatgttgagtctctcattgcccttgcaataatggatttgcgtactaatgaagctactggaatcaggacgggaatggtaaaaatgcagagggcatttgagatatacccatactgtgcaatggctctgaattatcttgcaaatcatttcttcttcactggacaacattttttagtagagcaactgactgaaactgcattggccgttactaatcatggcccaacaaagtctcactcttactacaatttagcacgctcataccatagcaaggttgaagggatgtttgagttccaagatgacggttttgttggggatcaacttttaggctcaggtccacgtaagccaacccatatggaaggtgggaatcatgttgaggagtattatggttgtttggctgagtgctctctaaggggagccttggctctggtagtgtag

SEQ ID NO: 30553 - DNA, 237 bp, Glycine max
  Peptide Sequence Number=SeqID_147331
atggattggttcgatcgaagaagcacgctctccactccttcgcctgagtcgattcatgaccgtcgtcagagtcagcttgatgccgccagtggctacaacgctgatgaacagtgggtgggcggggttgcggcagacaaaatcacggtggattgcggcgtaggtgggtgtaggtcactctgtcgacgaggtgtgagtcgagggatgacatgcggtgttggggaggataaagctgagtga

SEQ ID NO: 30554 - DNA, 1680 bp, Glycine max
  Peptide Sequence Number=SeqID_147332
atgggaggtgatgacgctgccgctgagagtgccaccacagagcggaacgccgcaaacgaagtcaacatcaacatccgctgttccaatggttccaagttttccgttcagattggcctcgattccaccgtcagatccttcaaggaggcggttgctcacaattgtgatatatcctctgatcaacagcgcctgatttacaagggtcggatcctcaaggatgatcaacccctccaaagctacggtttggaggctgatcacactgtccatttggttcgtggtttttctccttctaacaccactggtgggactaatagtggtggtggcggtggtggaaataccacaactgccaacacgagaggtgctggtgctaatgagggtgggggtttaggagggccaggatttggagcttcaccgtttcctggacttggtggtaacaatgggatggggggcggtggcctcaatggcttatttggagcgggctttccggatcttgaacaaatgcagcaaccatttttgtcaaatcccaatttaatgagagatataatgaacacacctgctatgcagaatttaataaataatccagacatagtgcggaatcttataatgaataacccgcagatgcaagagctaatggataggaaccctgagctggcacacatacttaatgatcccagcactcttcgtcagacactcgaagctacaaggaaccctgagatcatgcgcgaaatgatgaggaatacagacagagcaatgagcaacattgaatcttctcctgagggatttaacatgctgagacgcatgtatgaaaatgttcaagaaccatttttgaatgccactacaatggctggtaacactggaaatgatgctgcagcagtcaggaaccaatccactaatccctcaactactaattctgaagcaacttcccctgtacccaatacgaacccacttcctaatccgtggtcctcaactggaactggaggaggaggccaaactaacaccagaaggtcaactactactggtggggacgcccgacagccggcacccactggcctaggagggcttggactgccagatcttgaaggcatgatgggtgggatgccagatactgctatgttgacccagttaatgcaaaacccagccatttcacaaatgatgcaaagtatcctttccaatccacagaccatgaatcagattcttggggtcaataatgagcagcgtggcatgcctgatttaaattctctaagggaggtgatgcaaaacccagagtttctacgcctgttttcctcacctgagacactgcagcaactcttgtctttccagcaaactcttctgtctcagcttggtcagcaacaatcagcacattatggtaccaaaagcaacaacaatgactatgatgtgttaggaatcaggaattgggaaccaggtcaaacaggtggaggcactggaccattgaacaacatggggctggagatgttatcaagcatgtttggtggacttggagctggtagcctggctgttcctaacagatcaaatgagccaccggagcaattgtatgccacccaactttctcagcttcaagagatggggttctttgacacgcaagagaacataagggctcttattgctacatcagggaacgtacatgcagcagttgagcggcttttggggaaccccggacagtag

SEQ ID NO: 30555 - DNA, 1029 bp, Glycine max
  Peptide Sequence Number=SeqID_147333
atgggggagggatgttgtacgcagccttacccttgcatatgcaaagaggctgtttccggattcgaacccatgaccaacaagtcaccaaggcacaactttaccgctgcaccagggctcgccctcttacacacacacaaatattctggtgagaaagcggtttcgtggttcagccgcgccgaagttgttggacgttgttttccaatatgcttggttcatataaaaggctctgtagttgaggtaaccagttttgagacagtggcacgaacttccaataggaaggaacaatttttacactctctgttgcccaaatgcagtaataaaaaggacttatttcgctgcaaaaactccttgcgcagggacttcacaattaatagtttattttatgacccctttgccaataaaatctaccattatactgatggaatggctgatttgaggtccttaaagctagaaactgttatccctgctcagatgtcctttaaagaggatcctggtagggagaattttgtgtggcttccaaattgcagctcggcttggtttatcatttatcaagggagactgaggctgcaatgtggaaatattcttcacttgttaagagcttggacaagttttagtctcatcactcatcttgctgctgttctttatatatttcagaataaaattatgattgaattgaactacatgctgtcttatggagcttctgaaccatctctgcgtctactttggaaactcaaattgcttgaatttttacttcccgtgcatcatatcttgatgaacaagcgatcaaagaagatgtgctctggcttccaatatgttgatggatgtaggtctgagtgggaacaaatatctgatggagatggaacgtataaagaagcagagctaaattctgaaactttgcttgcagctttcatccgtgagctgacttggcacctgaccagacccatttcaagaagtacttttaagaagtgccatcaactctggcaaatagaaacaaccaacaaggactggaagcatttcacctggcattag

SEQ ID NO: 30556 - DNA, 549 bp, Glycine max
  Peptide Sequence Number=SeqID_147334
atggcatatgcagaacgaagcaaaccaccgcgccactccttccgcgtgtcgaggcttaagatgaatcaacgcaccacgttgttgcctggtgatgttttcaaattttccattagggttcgtctcaacactacacctgatccaacactcttgttatactctccctctcaaaccgtaccttgccatagcttcttgcaagagggtcaattattgaagacaatgttatctcgcatacacttcttcattgattctattgaagaagtaacagaaggggtcatttcttgtgttcaagaactgttccaagttgatgatgttgcttctactcttcctttggaatttcaacacggagagatccctttatggtttgaaatgacaatctttgatgctgccttgcttgcggtcattgaagagtccaagccgtgttttggaacgattccggcgtctgaggaagccatccatacgtcaatggaggaatgtacggatattgaagaaagtgagtggtgtcctatatgcatggaggaattggatctgatcaattgtgaatgctcctaa

SEQ ID NO: 30557 - DNA, 567 bp, Glycine max
  Peptide Sequence Number=SeqID_147335
atgtgtttttacgacgttgatttaacgtcggtcgatcaaaacaatcttaaaaataaacgtggtgacattttgaaggaaggcctcatggaaggattcagaaggtcgctcccttgccgagacgaatgttgtggtgctcttttgccttctcggcatctgggaatgcttcgatatgcttcttttgtcttcttgacgcctttggtggagtcgctgatgataagggggagctctgggacggactcggtgtggtggctgtgggcgaggatgaaggaaggaatggtagaggcagtgatggcggaggcgatagtgcaccacttttggttcacgtttgtgccagcgacactagatcttggtcatggcgaacatgcggttgttgcggcacatgtttccgaaggctccttggttggcgtagtgggttccgttgttgggatcatggaggatatgagggatggcttggccggttccctaagactcaacagaggtctagtggccggtacaacaattaacggcatatggctggcggctattcttggagatgttcgagtgtacaaaattgatgaaattttataa

SEQ ID NO: 30558 - DNA, 366 bp, Glycine max
  Peptide Sequence Number=SeqID_147336
atggagcatgatgggagggcagatcactttacaaggagattgctcaaaattcaagggaaatgttccacattcatgcaagaaagatccaaaaattgtggatttgcttcccagaacaccttacaatcaacaagtagcaaattgttgcaaagatggggtgctcagttcatggttgcaggatccatccaatgctgctgcatcatttctagtcacgttggtaatgttagaaacacagacaaaattgtcaaactccctaaaaacttcaccttgaaagcaccaaaccatgttatacttgtgggccaactaagattggacatggaaggtggtaatggcgttgatgagaaaggtattaagagagaaaagtcataa

SEQ ID NO: 30559 - DNA, 1678 bp, Glycine max
  Peptide Sequence Number=SeqID_147337
atgaagaactctgagtcagtgaagatggacgccgccgccaccaccatgaccactgcttcttctcccattcaagggggtgaagggtcccatggagatggagagaaggcacttagcctctcaccacagttggaaattaagagtggtggtgatgatgcagtggctcctaaagggaatgacgaagtgggtcagaaacccaccttggttggggttagtcacaagagaaaggcttcaacggaaaccaatccgttttgcgaatccgatccaaatagcagcaacgattctaagcgtttcaaatcgtcttccgtttcaaccccaaatgttgaacaacaaaaagttgatgaggaaatgcggcctcaagaaggtggagatgttgagagtgagaaagtggaaggagacaagggcgtgcctgatggaggacttgtggagatggactcggaccaaaacaaaggagaagggttaacagtgaaatcacccaacgacaatgtggagactgaagcaactgagagcatgaatatggagcctgaaggtgacaataagggcataaacaaagaaggaacagtgaactcgcccagtaacgtcgaagaagaaaaagtggagactgaagccattgagagcatgaatgtggagcctgaaggtgatgacaagggcatgcctcatggaggagtttcggagttggactcaaacctcatcaaaggagaaggaatagtgatcttggacaacaatgttgaagaagaaaaagtggagattgatggtgcggtagagagcatgaatgtggagcctgaaggtgacaagggcacttcgcatggaggacgttttgaattggacctaaatcgaagagttgacgaaatagtggactctcccagcaatgttgaaacagaaatgaaagtggagagtgacactataaagaacatgggtgtggaacctcaaggaaacaatgacatgcctcgtgcggtgagacttttggggattgacctaaatctagaagctgatcaagaaatggtgctgcactcccccagtgatgctgaaagagaaactacaagagtggagcctgtcgttggagacaagggcatgcctcatgaaggattttctttgttcgaccttaacaaagaagtagaagagatggtggagcatgatgattctgtcgatcagaaaattaaagttgtgccttatattgcagaagaaaacactgaaatgaattgtgcaatagacaaaatggtccaaattggaggggagcttctttgcgagttgaacaaagaagcagagctttcttctgatgaaaaggaagttgaagccgagcctgcagcagctaatgcggaagagaagaagaagaagactgaagtggagtcttctgctgaagttgagcaatgtgctgaagagaacaatgaagaggacgatgatgatgatgttgtagaggtggagaagagagaagtggtgcttgcacttcctgcaattgctgaaaatttagaggaggatgatgatgttgtagaggtggagagcagccaagtggtgcttgcacttcctgctgttgttgaaattgaagaggatgatgatgatgatgttgttgaggtggagaagagagaagtgatgcttgcacttcctgctattgttgagaatgatgaagtggagacatctcctcctccagggaactttgttattgacctcaacaaacctcctcctg

SEQ ID NO: 30560 - DNA, 288 bp, Glycine max
  Peptide Sequence Number=SeqID_147338
atgaacccacttatctgtgtacatattagattagggtttcattatttgtgggccttgtatttagggctccatagtgtagggaagttgagcttagctcatcactgggctaagcgtgcatccacctctaagcgcagcttcagcactcttagcgcgacagaagaatctagcagggcatcaataccaaggccacgcgctaagcgcgagattagtgcgctaagcgcagcagttgtctctagccaggctccgcgcacgactggcactaagctcaaatctacttactcgcgctaa

SEQ ID NO: 30561 - DNA, 240 bp, Glycine max
  Peptide Sequence Number=SeqID_147339
atggaaaatgcgtggagtcgccaccaacgtttattcaaggaaaacattggaaaaactaaaatggaagaggtcaaaagtctgcgtattttgaaaatgagggttcgagaattgtttatgcatagggaagttgacaagggtgtttccctcgctcctacgtattcttcaattgcgatgaggaaatcagacctacgtagttctttgagaactgaacgttggttaagttgtttttatcttttctga

SEQ ID NO: 30562 - DNA, 282 bp, Glycine max
  Peptide Sequence Number=SeqID_147340
atgacagatcttgtgagcgcggaagatgatgtaaatctccgcgtgtcaacgggtttgtcggccgcgattgacgaagggcgcagaatgaccataatttgtctctgcgtgccatcggacacaactgtgcctgaatggcaaaaaggtgcggataaccgtaaggtgtctccgcgggctaccagctcttgggtcatggtaacaaaaagcggtgtggtcgacaaaagcaaggcttttgctcctacgtatcctcaaatgaggaactcagacctacgtagttctagataa

SEQ ID NO: 30563 - DNA, 136 bp, Glycine max
  Peptide Sequence Number=SeqID_147341
agattggcctgaggcccgggcaggagaggcgccagcagaggcatcggcagaggctcctgacgaggcagatgaggcccgcgaggacgaggagatgaccgatttacttgatttcttaggagggagcggagccacatga

SEQ ID NO: 30564 - DNA, 183 bp, Glycine max
  Peptide Sequence Number=SeqID_147342
atgaggattccttttttacaggccaaggttgaaaaagccaggtgggcactcaagcatcctgtttatggcattgtgatactacggttgggaatttacacatacagacccaacgtttccaagttatgttctttcatcagctcaatgaattcatccattcttatctcggtttattccggaaaataa

SEQ ID NO: 30565 - DNA, 897 bp, Glycine max
  Peptide Sequence Number=SeqID_147343
atggctggagtgacaaaggaggacgagtcgggtagtcctagttggggtgcttcattttttacacagacaacagaggatgtggctagagctgttgctgctgcaatgaattctccgaggccatctgtggtatattcatcgaaaaatgatcatggtggaagccaacttcaaaagctacagtatcaagttacgaaaatgataaaaggattttctcgccctacagaagttaaatatacaaattacaatccagaaatcttgacaactcagaagcgtcaatgggctgcaaactttcagttacagtacatggaccataaatcttggaaggagccgacaaggctgtttgaaagcatggtggttgttggacttcatcctaattgtgatattcaggcactgcaaaggcaatattttttaagaaagtctgaaggccctggtaaattgagaagtgcacttggttatcagaatcaatcccgtgtggaagcggaacccaatttagaacctcaggttttatttgtttaccctccagaaaaacagatgcctcttaaagacaaggatcttctctctttctgcttccctggaggcttggaggttaatgctgttgagagaaccccttccatgagtgagttgaatgaaattctatttgggcaggaacaccttaaacaaagggatctgtcttttgtatttaggctacagggtgctgataattcaacactttacgggtgctgtgtcttagttgaagagttagtgcaaaaaccctctggatttctctccttgatttctgataagcaggcgacttattctcctttgaaacgccaacgccatatattaaccacacagagatgttactgcattctctcaaggctcccattttttgaattgcactttggtgtattgaataggtag

SEQ ID NO: 30566 - DNA, 1173 bp, Glycine max
  Peptide Sequence Number=SeqID_147344
atgcaagaacggctagagcggttgacgagaattggtggagatttaaatttagaatatgctgaagatagctgcgaggaagaaaatttggaggaaaaatctgagtgcatgttggtgaatgatagattagaagatagacatgatgacaatccaatgatttctcaatcaagcctaagaaattcctcacctgaaaacattgagaatgatagtaattatcccaagaaacaaatggttaacggggatctgcatacctttaaggagagagtcaatgatgacaatgctgtgcctagtgatcctgaaactgatagaaaaactgtcagagaagaatctggccctaccaatgctgaagaaagcgatttgtatggagatgcttttgtaacaaacaaacagtctgaagataggcgtttaccaaatgccattctaccactcctgcgctattgccagtatgaaagctctgaatcttcttgcagttttcagggttctccttgtgatgacagaaattttaggagtgatgctgatgatactgagacagaagatgcttcattctctggccaagaggatttaaatgacctacaggatattcttgaatgggcgaaggcaaataactgtggaccattacagattataagtgagtattatcgcttaacttgccctgcaaggggctcagcacttaggtttcatcctttggaacacctgcatcccttggaatatcacagaccagatgagacaattctacatcttgctggttcaactgttgacttgaaatcttgcagtacgggtctggaatttgcagaggcacataattctcttttggctgaggaggaggcaactgcattatctatatgggctgtagcttgcatgtgtggtaccttgaggcttgaaaatgtgttggcattctttgctggagctctactggagaagcagattgtttttgtctgttctaatttgaaactaaaggtggttcgctggagatgcgtcacacgccagggccctgcgtgggttcatgtgcagcagtgttttgagttggctgtgcacgtatacggcatggcagtcttcaacggtgatgatgggcattgttcacctatgaaaaagacagaaatgtctaccagagatgcctttttggtggaggggagagaagaccagtgtgacgctggctggagatgcgtcatgcgtcgt

SEQ ID NO: 30567 - DNA, 324 bp, Glycine max
  Peptide Sequence Number=SeqID_147345
atggtgggtgacctcgttgctggaagcacggccagaacggaggctgcacgtgccggagacgtgtctagcgcagaagttgtttggcgcgtctttatgatgtgcgtgagggagcctccttgtagatcggcgaaaggttcttcaaatggtggggttgccggtcggaaaggtcgccagaaaagtgatgatggccggaaagtcatcggagcaggagaaagggtcgtcggaagaagggcagtgagcaaaagggctcaccggaatgcggaaacaagtcactggaagaagggcatcggagcacgattttcattattcctctatcaagaataa

SEQ ID NO: 30568 - DNA, 606 bp, Glycine max
  Peptide Sequence Number=SeqID_147346
atggcaaagcttgcttatgccgtatttgataagagcatactcttccaggttttaccaaatggcatgctcgagtttctagatgcacctgtcccctacatagttggcatcaagaacaagaccaatgaagttcagtcaaagttaactaataatgttatcctgattgacgccaacagaaaccaggtgaagtcatcaacagtacctcaactgccaaggcagaaagagttaatgtcttctttacgtccttatcatgaaactcttgtgggagaaagttacttgggtaggagaaggccagtgtatgaatgcacggaagtgcagacagaagctgctaagggttttttatcggtgttaaggtcttatttggattctctttgctataacattcgttctcatacaataaccaatgtacaatccaatgatgataaggtatccttgcttttgaaggagagtttcattgactcgtttccttatcgtgatcggcctttcatgaagttgttgagcccaattccaaatctatatttgtgtgaatatcattggaacttattgattgtcatcttggaatcacacctagggcactgtgtaagcagtttcttgcggcagtttttctag

SEQ ID NO: 30569 - DNA, 147 bp, Glycine max
  Peptide Sequence Number=SeqID_147347
atggccggcagcgggaaacagaacgcaccgccatcacctctagagttcacctctgctcatccacaaaaaaggacgcacctagttgctcatgatcctggggatttaaataaaacaagcgcaagctcggaaggtagaaagataccttag

SEQ ID NO: 30570 - DNA, 336 bp, Glycine max
  Peptide Sequence Number=SeqID_147348
atgataaatgatggaacatacgaatttggggatcccacggtcatgtggctccacatgcccttggactcttgggtcacggtaacaaaaagtggggtggtcgacaaaagcagggcttttgctcctacgtgtcctcaatttgtgatgaggaactcagacctcgtagttcttgataactatgagattatgttgatgaaattttctcataaccaggaagcactgggtccaacaaagataggagaaaatcactcaaagtgtatcaatctcacacagtgtgtggcgagaaagtcgctagcgcacaggattttgtcggcaatcaaagggagaggaccactttag

SEQ ID NO: 30571 - DNA, 333 bp, Glycine max
  Peptide Sequence Number=SeqID_147349
atgagcagtcgcactaagcgaaacctatgggctcagctcgcatctatcgctaagcacagctacaacacgcttagcgtgatgagaggaactggaagaacacaagaatcgaggccgggtgctaaactagacgttcgtctcttgccaggctcaacgaacgactggcgccaagcccaaatccacttactcgggctaagcgtgacgggacacaatacctttaccagagatgcatacttttgcatagaattcgagaggagtgctctggaggcagcagagaggcaacaactaagcaaggaagctagggttcttcactttgatagattagagagtgtttga

SEQ ID NO: 30572 - DNA, 693 bp, Glycine max
  Peptide Sequence Number=SeqID_147350
atggagaaactgagaccagcgtgggccgttaaggcgatcatcgtgatcgttttcacttcgatcctcttccgatgcgtctgcggcgagaatcacaccgtcggtggagcttccggctgggatctccgttccaatatccaagcctggtcttctacgacaacgtttaacatcggtgacgatctcgtattctcatacacaccggtgcacgacgtggtggaagtgaaccaactaggttacaacacgtgtacgatagcgaacgcgcttgccacatacgacaacggagaaaccgtgatccacctgagcgacgcgaaaacgcgctactttgtatgcggccgaatgcgccattgccaacagggccttaaactccaggtccaaattctagcccagtccaataacggaaccagcgatgatcaaaaccaaagccccggcgccggcaccggcaccgtcggttctcctccgtctccttctcctcctccgcctccgcctccgcctccgcctccgcctccgcccccggtttctccgccgcctcatggtgatgaacagccacctgcagacgagcccgtaccgtgcgattgtaatcgtgcggaggagcgccatggggtggtgccgttgattacactcgtaatcgtggtcgcgttggctcatgctcctttcttcatcgcatttccacatctccgttttcatctcatgcgttga

SEQ ID NO: 30573 - DNA, 306 bp, Glycine max
  Peptide Sequence Number=SeqID_147351
atgcaaatcgcaaggaggaatggcgatttcgtcgtcgacgcgacagctggcaccggtgtcgccatcttcaatggcgtgttgcaccaagcttggactcgccagtttgactggcgagttgagggtaggggtttgcagttcctaggtgcagctatttccgacgctgcagtctgcaacctgcaatgggcagttcctaggtgcagggtgtcgccagctccaatggcgttttggttggccaaaatcgccagcacgagcagcgatttgccttgcttggggtttttaaatcccccctcccctgtagaccattga

SEQ ID NO: 30574 - DNA, 2454 bp, Glycine max
  Peptide Sequence Number=SeqID_147352
atggcgtttacatacgcggctccgatcgctccttctctctacggcattgctcgcatcggttactgcgaccagaaggtttcgctcgctggttctcccggcgaggtgaatacgtcgttgttttgcgtttcgtcacacgcgggaaagagtgatgtgctgttcgagaggaggaagctgaagtcggctgatactcgcattgccgaaaacacgcagatgaaatcgagcgttgaaattgaaattccggtttcttgctaccagctcattggtgttcctgatcgagctgagaaagatgaaatagttaaggccgttatgggtttgaaaaatgcagaaattgatgaaggttacacaattgatgttgttacagctcgtcaggtgcaagcagataaagatcttctgatggatgttagggataagcttctttttgagccagaatatgctggtaacctgagggaaaaaatcccccctaaatcttcccttcaaattcgttggtcttggttgccaggtgctctttgccttcttcaagaggttggagaatcaaagcttgtgctggagattggacagacaagtcttcagcatcaaaatgccaagccatatactgatgacttgattctttctatggcactagctgagtgtgcagttgcgaagattggcttcgagaagaaaaaagtatctcaaggtttcgaagctcttgctcgtgcccagtgtcttctaagaagtaaaccgtccctagcaaaaatgacactgctatctcagattgaagaatctcttgaagagcttgcacctgcttgcaccttggaactactgagtatgccacatgctcctgaaaatgttgatcgaagacgaggtgcaattttggctttgcgggaattgctcaggcagggtcttgatgttgaaacttcatgccaagtacaggactggccttcctttctaagccaagcatttgacagtttgctggcaaaagagatagttgatcttcttccttgggataacttagctgtgatgcgaaagaataagaagactattgaatcacagaatctaagggcagtaattgattctaattgtttttatcgagtttttaaagctcatatggcaattgggttttccagcaagcaaaaagagttgattaacaaagcaaaaggcatatgtgaatgtttgatagcttcagaaggtattgatttgaagtttgaggaagctttttgcttattcctacttggacagggcacggaggctgaggtggttgaaaagcttaagcaacttgagctaaactcgaatcccaaacataattcagtcttggggaaggcaataatagatgcttctactgtaaacccgtcattggaaatgtggctgaaggattctgtgcttgcattatatccagatactaaagattgttctccagctctggccaatttctttaatgctcagcagaaattttctggaagcaagaattctaaaggagctcaacaaatgttgcccactatatgtcatagacctttatcttcatctggttccttagaacgtagagaagttgaggaatctcgctcatacatgagctcttctcctagtctagggtttgctgtcaagcagctgactcctactgatttgaggagttcattgctatctggaagaaatgaaactggaagcaatactattgagtcacctgttcaggtgaaaaggaaccttggtagtcatcgcaattcaggaatttggcatggttacttccctcaaggacacatattcaaaagaataacatacttaaccgtattgggttgtattgcatttgctagcattaagttgtcaggaattggtctaagcaagactcttactgcttctcattgggcttctactaaagccaatgataacattgcttggactgcagattcagctgattaccctgtgggcccagcttatattaggcaaagtaccatgaccaacaaactgaagaggatcctgtcaatgtttaagatacagcggttgcaccagtcaggtgctggaaatcatagtgatttacacactactcttacctcatcatcctcccctattaatgtttccagaaggccaatgcctgtggaagaagcagaaaccattgtcaggcaatggcaaacaatcaaagctgaagctttggggccttgccatgaagttaattgcctagctcaagttcttgacgaatctatgcttgctcagtggaaaggtttggccaatgccgccaaagaaagatcttgttactggagatttcttttgctcaagttatccattattcgagctgacattctatcagatggaaatggagatgatatggcagaaattgaagctctcttagaggaagcatctgaactcgttgacggttcacagcaaaagaacccaaactattatctcacttacaaagttaagtatgttatgaagaggcaagacgacggatcatggaagttctgtgaaaatgatataatagaatcaccatga

SEQ ID NO: 30575 - DNA, 1161 bp, Glycine max
  Peptide Sequence Number=SeqID_147353
atgaagttattcgggaccattgtatatccaaagaacagatacttgactctacagttccctaaaggtggaaagagtgtaatgtgtgaggattattttgataacatgattgtattttcggatgcatggtggatcgggaggaaagatgaaaacccagaagaatccaagctggaatttcctaatgaattgtatgagggacaccaagctgagtatgactttaaagggggtgcgggtgcaggtgcagcttctgtagttaatcaaggtgttcccagaaccaacattcaacgtgtagagcaagagtcaccaaagacacccaccgaagatgatttgtcagacaatgaaatcaatttaaaagatacaaaggaattggttccggtccgacattcaacaagaactgcaaaaaaatcatacaaatttgctgaaatttcttccggtgatgattctggtgaaaacagccctgagctttctgatgatgaagagaaagtggtagaagttgatactgctgtaaatgatcataatagctcaaatatccttataatacagaaaaaaactgtagtttttgacctcgatgatgaggatgatgcaccagtagatcaacctgccaagataaatactgagtctgcttctcgatcaaaaagtaaagaagtgtctcaatctgcttcagccagtgcatctactgaagttaagtccagtaatcgtggatcacttgttcaggctactatatccacattattcaagaaagtggaagaaaagcttgaattcagagctttagttgagccacaggcatttgcaacttatgttgctttgggtaaacttcccattctgtcccacccaattttttgtaaagctacacgcctacaccagttacgaaatgcctgtgattatgaccctaggttcacaatggttttaccttctttcacgaatggatctgaatcatcttatggccagaagtcacagcctgctggttcaaaaagaaagattgatctggatgaaggatccaagaaaagggcaagaaagaccacggacaaagatcctggtaaaaaaatcaaggcaaaaagcaaggaagacgatgttgaagatggtgatgatgatggtgatgacattgaagaattttcaaatgcttcagaggatgctaatgaaagtgatgaagactggactgcttga

SEQ ID NO: 30576 - DNA, 318 bp, Glycine max
  Peptide Sequence Number=SeqID_147354
atgtgcgagatgcacacctcagtgttggatgtcggcaacgacacgacgtttgttacgaacaacaaggacaaaggaaagggaacaacctaccttcaaggactaggaacctctagaagttcggaaagggaatggccgcagggggcagccgagacggcaagggaaaccaagtggggcttcgcattcagggagaggttggtggagggggagcccagggaactccaggttcatgcccaccaagatgtggtcggagggggccaggccctaaacaatgacggagaacttagaaatgggggcagaccaggggctgggcggaggtaa

SEQ ID NO: 30577 - DNA, 1530 bp, Glycine max
  Peptide Sequence Number=SeqID_147355
atgggagggtttggaagttacctctttggaatgagtgaagaaatagccaagcaatcttcagacactggtcattttaaggacccaaaattagggtggataataggttttctctttgttgttagctttcttggcctattctcagttgtacctctacgaaagataaacttctcaataaacacttttaataagattatggtcattgacttcaaattgacatatccaagtggtactgcaactgcacatctcatcaacagcttccacactcctcaaggagccaaactagcgaagaagcaagtgaaaatgttaggaaaattcttcagtttcagttttttatggggcttctttcaatggttctacacagctactgaccagtgtggatttcaagccttcccttcattggggcttaaagcatataataacaagttcttttttgattttgctgcaatctatgttggagtgggaatgatatgcccatatatcataaatatatcagtgcttcttggaggaattctttcttggggaataatgtggcctctcataaaaaccaaagagggtgattggtatgataagggcctaggtgaaggcaaccttcatggcatccaaggttatagggtatttatagccattgccttgatactaggagatggtttatacaacttcataaaggtgcttactcataccctttggggattgtatcatcaagtccggatcaagactccccctcaaaccctcacctatcttatgatgaccagcgccgcacccaactcttccttaaagatcaaattcccacatgattggtcccttgcatccacctatggaaagctcgccatcttcacaattggagcatgggccggttcatcacacggtggagttcttgctgggctagcagcatgtggagtgatgatgaacattgtttccacggcctcagacctgatgcaggattttaagaccggctaccttactctggcttcaccacgctccatgtttgtgagccaaataattggcacaacaatgggttgtgtaatttctccttctgtgttttggattttctacaaagcttttcccgatcttgggagaagtacaagtgaatatcctgctccatatgcaattatataccgtaacatggccatattgggggtacaaggttttggcaatctaccaaaaaactgcctcttactttgttacatattcttcgctgctgccgtcgcaataaacttgattaaagatttcattggaaacaaagggaggttcataccacttccaatggccatggcaatacctttctacatagggccatactttgccattgacatgtgtgttggaagtctgatattgtatgtgtgggagaggattaacaaggctaaggcagatgctttcgcaccagctgtagcttctggtttgatatgcggggatggaatatggactcttcctgcttcaattcttgctcttgctggtgttaagccaccaatttgtatgaagttcttgtcaagagcagcaaatgcgagggtcgatactttcttagggaattaa

SEQ ID NO: 30578 - DNA, 471 bp, Glycine max
  Peptide Sequence Number=SeqID_147356
atggctctaaatggaagtggggatagagtagcggtggataatggttttgaatccattgatgatgcatatgatgatcatgaacacaaactgagccaaaagggtagcatcaagctcaaggaggaagaggtttctgtggagagggtgttccagcaccttctggtgccatcatggaggaaccaattaacagtgagagcctttgtggtcagctttgcactcagcatactcttcagcttcattgtgatgaagctcaacctcaccactggtattattccttcgctcaatgtctctgctggccttctggggttcttctttgtaaagacatggaccaagttcttggagaaatctaacatgttgaggcaacccttcacaaggcaagagaatactgtcatccaaacctgtgttgtagcatcctctggcatagcctttagcggtaccttctttcttcctttcacctattctgtgcccttttga

SEQ ID NO: 30579 - DNA, 717 bp, Glycine max
  Peptide Sequence Number=SeqID_147357
atgactgttgcagaggatgagcatattgcccctattgatctaacattgaaagatccagttaaaactaattgggacgatgaagatgtggatgaaaatgatgtgaaggaatcatgggaggatgaagatgagcctgctccggcacctgcagcacctgctgtgaaaactactgtaaaggctcccaaaaaatcttctgataaagataatgacaagaagggtaagacagtagaaccaataaaggaagaaccattagatcctgtggctgaaaaacttcgccaacaaagattaattgaagaagcagattataaggccactaaagaattgttcagtgggggaaatgaaaaagatgaaaagaaccttgacactttcataccgaaatctgaaagtgatttcttggagtatgcagagctcatctcacacaagctccgtgcttttgagaaaagttatcattatattggcttgctgaaggcagtaatgagactatcaacgacttctctaaaaggggcagatgccaaagatattgcatcttcggtaactgccattgcaaatgagaagataaaggcagaaaaagaagccaatgctggtaaaaagaagatagttttcaaggtctttgctgtgactgcaggtggaaagaaaaaacaacttaatgttgataaacctgatgaggattttattcctgctgatcgatatgatgctctggatgattatgatttcatgtga

SEQ ID NO: 30580 - DNA, 378 bp, Glycine max
  Peptide Sequence Number=SeqID_147358
atgattgatgatggagaagctgttgacataaagggtacatcagaaaagtctttaacgaagcatttgaaaaagttgttcctttcgttaaaccttgaggatggaaatagggttttcttactgcattctaaagctcaccttaatttggatgttgttggccctctcattcaatcctatatgaatatgaatcccatgaatgagcaagttgagacttccacactagtgcctgaatcaagttcaattccaatagatactggaaatgaacagatgatcgatgaccatgcaacaacaggtccagaggatcattctgttggtcctagaagaaggatgattggccctgcaatgccatcagctgaattacctctgttgctgcaaaattaa

SEQ ID NO: 30581 - DNA, 549 bp, Glycine max
  Peptide Sequence Number=SeqID_147359
atggcagaggaaggtgtgagtgtgacagaagaggcgacttcaacacagccaagggagagacaacttcaaaacaggagaagcgacatgcaagaggaaaaaaaattgagccctaatcgagtgagagaagacatgagagaactgagccctaattgtttgggtccagccacaactcaacattcttttgctgtgcatctacgttttggcgacgatagagagggcgtggaggccgctctggagctcctcggcgaggaggtcgtagacgagacggtgtcgtttgacgaggctctggccctcgaacttgggcgatacgatcttcacgttgaagtgggtttctttgtcggaacttcccttcacggcggcgtggcccgcgtgctgcgaatcctgctggctcgagatagcagcgcgctggctcctctcgaactcattggatcggatgaatggtggcgtcgggttagggttttgagaacggaggagtttccgcagatgaaaacatggacagaaattggggagggaaagtttatatttccacctctggctactgacggataa

SEQ ID NO: 30582 - DNA, 195 bp, Glycine max
  Peptide Sequence Number=SeqID_147360
atggaagttgtgtcaaatgctaatgaatacaaaagatcttccatgcttccttctcttgaattttttttccttcctgttcagtctaccacagtacatggcaaagtaactattgctattgatgaaagattcagttgttttgatcaagcaattaataaatcaccagttatgcatcctaacgatgtggaaacaatgtaa

SEQ ID NO: 30583 - DNA, 606 bp, Glycine max
  Peptide Sequence Number=SeqID_147361
atgcttgctaaccttgacagcatatgcattaaaacttctttttgtttgagacagatcagagatggatatgaatacaagtttattgagaagattgttgagcaggtctctcgggagattaatcccgtttgtttacatgttgcggattacccagttggactagagtcacaagtgctacaaaacacctccaaagcatccttcttacgaaaatacatggagatggagaaggacatcaacataacaagttgtcaagaaagagctacaatgatacatgataggctccaacaattgaaggttctcttggttctagatgatgttgacaggctcaagcaattacaggaacctgttggaagacctgattggtttggtcctgcatctcataaggttaaaagaaggtacaaggtgaaggagttgaatgagaaggatgctcttcagttgcttacacagaaagcttttgaaaacgaaaaagctgatccaaggtacaaattaagaggtcttaaatcttgtagtaaagtatgcttcaggccttccattggctttggtagtgataggctccagcttggttggaaaaagtatggaagattggaaacttgctatcgaaaaatataa

SEQ ID NO: 30584 - DNA, 657 bp, Glycine max
  Peptide Sequence Number=SeqID_147362
ctccaactcgtgatcgagtccggcgaccccggcggagtcttccgcttccccggcgtcacccacggcgactacttcttcgggccgggcctcgaggagctgatccagcacctcgccgagaacgatcctaaccgctacggcaccccgccggcctccaagtccgccgtcgagggcctgccggacgtctccgtcaccgaggagctgctggcgtcggattcctcgcagtgcgccgtttgcaaagacaccttcgagctcggcgagaccgcgaagcagatcccctatgatcctgattacgagcagagggctcgtcgtggtggcggtggcggtagtggtggtgatggtgccggaagtggggcagctccacaagtgaattggaacatggcattggggcccgctggtggttctgcggattcatccggtggcggtggcagtggcggtgatagttcgcagaggagaagatttagggtgtctttgccgtggccgtttaggcaatttgccgagacaagtaatgttgggagtgccaacaatgatagcaacaacaacaacaacaacagcaatagcaatagtggtagtagcggaaataatggtgggcaatcgaactctggaaaccgggggaatcagaattttgactcggagaccagacaggaagatctcgattga

SEQ ID NO: 30585 - DNA, 207 bp, Glycine max
  Peptide Sequence Number=SeqID_147363
atggaagcgaggggtagtcttcagtcctgtgctgaatcagtaggttcaggacacgacatgctccccttggaagtgatcgagaagtcgacaatggcctcacctcggtcatcgcctagaagtgctccactttgtaggaactccaactgcagcgctacagcgacaacattctccgcgggattgccgcttgtgggaatctgcagattctga

SEQ ID NO: 30586 - DNA, 258 bp, Glycine max
  Peptide Sequence Number=SeqID_147364
atgggtgaagtagaggaggtacaagaacgaatcaaggctgacatgaaggccatgaaagagaaagtggccacaatgatggaggccattatgagcatgaaggagataatggagccaacttcgagccttgcctcggatgtgccactgaagggcaagcagttcgtggtatacccctgcaaacacttcggaaggccctcattttcgcctacaaccgcaaccattgcattttgcgatgggaagagcccctcctgctatggctga

SEQ ID NO: 30587 - DNA, 211 bp, Glycine max
  Peptide Sequence Number=SeqID_147365
atggcatgtccggagaggcaaaaggttgcttttggtacatatactctagtggaagaggctgagtattggtgggagaatactcgccaatgcctagaagctgaaggtcaagatgtgacctgggatgtcttcaagagagtgtttttggagaaatactttcccgaggatgttaggaacaagaaggagatggagttcttggagcttaagcaaggaa

SEQ ID NO: 30588 - DNA, 276 bp, Glycine max
  Peptide Sequence Number=SeqID_147366
atgaatttatacctaacaacatgccatagtgttgaagaatacaccagagttgagataatggacctttaccacttgttgagtagaaagcataaagatggacctagagggaggttgcatcaggtgtctacaaaagaaggcaaggagacattcatagagagtaaggaaggaaatccactcaatggagagaatggaacagaggtggaattgcttacgggaaggagaaagagggacttaacagaaggggtagctggaaaatggggagcaggattctggtag

SEQ ID NO: 30589 - DNA, 187 bp, Glycine max
  Peptide Sequence Number=SeqID_147367
atgtgtggtggttggtggagtagtgacaacaacgacgacaatgacaatggaggcggtggtgacgatgattgtagtggaatgatgatggtgatagtgatgataacaatgatgaatgatggtagtagcaatgacaatggtggtggggcatcaaaggcaaggtacgatggtggtggttgtgctagtggtg

SEQ ID NO: 30590 - DNA, 387 bp, Glycine max
  Peptide Sequence Number=SeqID_147368
atgccagggaaagtatttgacatcctcaatgaggtggttgttgatcggggttctaatccatacctttcaaagattgaatgctatgaacatgatcgacttataaccaaagtacaaggtgatggagtcattgtggccacccctacaggaagtactgcctattctacagctgctggaggttccatgattccggatgatgcaagaagtaatgcttgggtttcatttgatgggaagagaaggcagcaactctcgagaggtgattctgtccgaatatctatgagccagcatccccttccaactgttaacaagtttgatcaaacaggtgattggttcagtagcttgattcgctgcctaaattggaatgagaggcttgatcaaaaggctctgtaa

SEQ ID NO: 30591 - DNA, 300 bp, Glycine max
  Peptide Sequence Number=SeqID_147369
atggctacacctaccacacctagggcagatgctccaattttctccaatcttttgctctctattaaaaagttggatgggtgcaagagatgtggcatggaaaaggagcaactcccggaaggcttccagcggaagggatacatgaatgaatcgaatacacatccaaatgagagggatccagaggttgtgttggcatgtaacattcagatgttgatgaaggcagggagtgatcgtcagtgcacaagagatgtggcagggacaaggagcgacttatggaaggcttccaacgggagcgatacttga

SEQ ID NO: 30592 - DNA, 264 bp, Glycine max
  Peptide Sequence Number=SeqID_147370
atgtgcaagggagataatgaatcattcaaagaatatggccaaaggtggagggacctagttactcaagtagtacccctcacggtagagagagaaatgataaccatgataatggacacattgttggggttctattatgagaaaatgataggttacatgccttcaagttttgtggatctagtgtttcctagtgagagaattgaagtaggtcagaggagaggaaaatttgattatgttgcttctgtgagttctgatgtcgtcaagtga

SEQ ID NO: 30593 - DNA, 165 bp, Glycine max
  Peptide Sequence Number=SeqID_147371
atgacaaagatgctagaaaacggggttagaacagaggcattgtcaccaattgttggaatggtcccaaaaacctgggggcgtgtaaatgttgtttggcacaaagaggtagggcacgtgcgaggtcatggttggtcgtttggtgatgctgtgaccactgttgaatag

SEQ ID NO: 30594 - DNA, 1959 bp, Glycine max
  Peptide Sequence Number=SeqID_147372
tccaatgatccatcacagttgtcttggatgggtccagttccaggtgatattgctgaagttgaggcattttgtaggatctttaggaattcagaaaggcttcattctgcattaatggatgcattatgtaacccattgactggtgaatgtagtgtctcatatgaggttccatccgatgagaaacctcaactagaagataaaatagtttctgtccttggatgcatgatatcccttgtgaacaaaggcagggaggatattctttctggaagatcctcaattataaattcctttcgtgctgcagaggttagcacaacagacgataagctccccccacttgctctttttaggagtgagatgaaaaggtgttctgagagcttacatgttgctcttgagaactatttaatacctgatgatgatcgaagcttaaacgtgtggagaaaacttcaaagactgaagaatgtctgctatgattctggttttcctcgtggggagggatgtccttgtcacacactatttgcaaattggaatcctgtatatttatctgctgcttctaaagatgactcggaatccaaagacacagagccggccttttggactggaggtcaggtaacagaagaaggcctaaagtggttactggataaaggatataaaaccattatagatctcagagcagagactgtaaaagataacttctgtcaagcggctctgcaagatgctatttcatctggaagaattgaattggtaaaaatcccagttgaagttaggactgcacctacaatggaacaggttgtgcagttcgcatcttttgtttcagattgcagcaaaaggcctatttatcttcacagcaaggaaggagttttgagaacatctgccatggtctcccgatggaggcagtacatggctcgatcttcatcacagattgtttctaatccaccagttacaccctatgacatgttattatgtaatacaaatggttctgcaaaatcttgggactcttcaatgactgcagagagatcctccctggaaaaggatatcaattcattgcaagagagtttgaactcaactcataattctgttggaacatttgacaggagtacctctcaaaagaagtataatggtaaaccacaaggtactacagccatgagtaaagtttctactgataacagggaattatcagaagccactgctgctaaggaagaacgatcttttccacgtaacttcagcaaaattaaccctttaaaagctcaagttcctccttgtgatatcttttccaaaagagagatgtcaaaatttttgggaagccagaagatctcaccaccctcttatgtcaattatcagagtagaaggtcagaatgctctccgcaaccaaggaacatgaatgtcacaagactacagggaggtgtgactgtcagcactagtgataatctcatacctaaaattgtaggttcagaaagttcaaatggatcagcccgtgttgatcatccatctagagagacccagattacagttagcgacaattgggaggtagtgaatgggagtatttctagttctgtttggacaacagtaaatggatttagtgaacaggaaatgcattacatgactaatgccaatgcttccaacattgtgaaggacgattttgataatgtcacaactaactctcaaaggattgaagatcgtatggttaaggataggttagccttaaatgacgacgacatgggatccgttgaaggagatatgtgtgcttcttcaacaggagttgtaagagtgcaatcgagaaagaaagctgagatgttcctagttcgaacagatggattttcttgtaccagagaaaaagtgactgaatcttctttggcattcactcatcctagcacccagcagcagatgcttatgtggaagtctatgccaaagaatgtgttattgctgaaaaagctgggggaagaactaatggaagaagcaaaaatg

SEQ ID NO: 30595 - DNA, 246 bp, Glycine max
  Peptide Sequence Number=SeqID_147373
atggaggaaaacaacaaacgagttgctaagtctgatgagaaaacgtatatgccaaaaaatgtaatcaaacatgatgatgcaatcctccctaggaagggaccatttactagagccatgagcaacaggctccaagaggattgggctagagctgctgaagaaggccctaaggttctcatgaacctcagggtaagataccctagaaatataggatttttcagcccttgtattttaaggcacctagactag

SEQ ID NO: 30596 - DNA, 474 bp, Glycine max
  Peptide Sequence Number=SeqID_147374
atgacagaagagaacaacctaaaccctatgtataaagcacaaattgttgtgaaagggtgtgaccagaagaaaaacatagattttgaagagatcttcttaccgatgatgaagatgacatctattagagcaatccttggtctacctgccaaactagacttggagatagagcaacttaataaaaacctttatggtcttaaccaagttgcaagacaatggtacaaaaagttaaatcttttcatgacccaacacaatttcaagaagacctatgcaaaccattgtgtatttgtgaaaaactacaaaaatggtgagtccatcatgcttttactatatgttgattgttgggaaaacaagacaagaatagatgctctcaagaagattgagcaagtcttttgccatgttgctttgggtgcagtgaagaagatcctaggaatgaagattactagagattgttctgaagtgatcaaaacgtcataa

SEQ ID NO: 30597 - DNA, 120 bp, Glycine max
  Peptide Sequence Number=SeqID_147375
atgaactccgatggtagcatgtatcgacatggcattctcggcggacatgaccgcagctctgtcaccctcgtaccagtgtttcttcaagccccctccctcgggcttgggcttgggctttga

SEQ ID NO: 30598 - DNA, 318 bp, Glycine max
  Peptide Sequence Number=SeqID_147376
atgttgtggatatctcaagaagcttatattgagaagatttttgaaagccttatgtatgcaatggtacgtacaaggccaaatattgattatgttgtaggatttgtgagcaaattcctattgaacccaggaaaagagcattgggaagttgaaaaatggatactaaggtatctaagaggaactaccaacagatgcttgtgctttggcaatggaaatctcatgctgattgggtattcaaatatagatatagctggagatgtgaattcaaggaagtttacattacgatatttgattacttttgtgggaagagctatttactag

SEQ ID NO: 30599 - DNA, 171 bp, Glycine max
  Peptide Sequence Number=SeqID_147377
atggtggttctcgagcataacaggtcattggaggggcctcttgctagacgtggaggcatattggcaatcggaggcatagtggagcatcaatcagaggctttgttgtcatggcgtgtgagatgcacgcgttggagaatggcggtgcatttggctgttggtggtagcgggtaa

SEQ ID NO: 30600 - DNA, 486 bp, Glycine max
  Peptide Sequence Number=SeqID_147378
atggccttaagaaagagagcaagagctgaagacatcccttcatcatccaacccacctcctctaacaacaaccatggaaccagatggcctacaagcacaacctatagttcctatgttgcagagcctattccgggggcagctgattattgtctacaaccagcagcaattggctcataacaggccaatagtatccatggagcaatttttagataaagtggcctggcctaaagctcaactgccgttaggaagatctcccgaggttgtgccctccagtcccataccaacaaggacagagcctgcaccagctgagtcgcaaccaccagtagtagacctaccggcttccccagaggttgagattctaccacctccattggcaccacctttgatactcattctcgatgacttagataacgaagttgcagctcctcctgactcaccagcctactacctagaggatggttcagacttttctgactggatggactag

SEQ ID NO: 30601 - DNA, 489 bp, Glycine max
  Peptide Sequence Number=SeqID_147379
atgtggagtgtttggagtaggcggaaagagcttgtgtgggagggagcaagatcggaggcagcatttttccctacagtaggtgtgtttggattcgatgcttgtataagagatgacactggtagtgttgtcagggctttttctgactacaagcagtgccttcctaaagtccatgaaggtgaagcacttagagatgcaatcttttggttgcgacatttagacatcgaagatgtaactattgaaatggattgtcaatctattgtcaataacatttacaatgggcagagtgatttttcagaatttggtgctactattaagcaatgtcgtgatttgttgcaaagcttaccaaactttaaagtctgttttgtaagaatacagaccaactttcttgctcatagtattgctagagcagcaagttcttatgctggtccccatttcttttctgagtttcattcttgtattgccaccaattctgatttagcagtaatataa

SEQ ID NO: 30602 - DNA, 1157 bp, Glycine max
  Peptide Sequence Number=SeqID_147380
tgggcaagactgctactggaaagactgcatcattacctgtgaaaaatacaattagttcctcccataatttgggcgtacctggtgaacattatgaagacatgaaatttcggaatcaattggatgtgtctggaattagttcgaaaaggaaaactacggacactagaccaatgtcggatcctcctgtttgttcaaaagtatcaactgatgatgctcctgctgctgcagaagatgctgaaaaaaagaagaccagagtacttcaatctaagaacactagtgataaatataaagatgcaagtggcttgcttgatacttctcatcagaagtaccatgaaaaaagtgcatctgcacattccaaatcccactctggaaaaacctcaagtagtgttgacaatttagaaaagactggtcggttaaaagataaaaatggcatccgtgaactgccagatcttaacttgtctgtgggaaaatctgctatacaagcaccaaaatctgaaaatgtgctcaagaaagatggttctactgctaggcctaaaattacaacacttgagaaagctattcgagagttggagaagatagttgcagaatcaaggccaccaactatggaaaaccaggagcctgataccacacctcagggtgtcaaacggagattgcctagagaaataaagctgaaacttgctaaagttgctagattagcggcaagccaagggaaagtatcaaaggagttacttaaccgtcttatgagtattcttggacatctgattcagctcagaacactaaagagacagactcaaccagggcggtgcagcggcgatggaggcagactcggcgtagttagcgcagttgaagtagatgaggaaggagaggactcggtggtggcagtgaggcagtcattgcggaaccagacaagggcagtgcaacagcattggaggggagagatggtcattgagaggagagcgataatagggcagggggatcttgggttggatgaaggaggaactgatggggagagtgaggctactgcaaatggaggttttgtggtggaaaggggaatgaaggacctgtttgctttagactttggtgactccacagtgacatatggccttcctgaattgattctaagtcaagattggtatagcttattttgggagaaatactag

SEQ ID NO: 30603 - DNA, 345 bp, Glycine max
  Peptide Sequence Number=SeqID_147381
atgggtttgtctgcgaagcaggagaaagatgttaggtttcaacagaaaaagaacgaagttattgagatgattaagatgcaggccccgactatggaatccaagctacagaagcaagctggagtatctggggagcaagaattaggtcctgatgggaagccaataactacaaggaattttagtatggacactgcattggaagacaagatttgtgatctctatgacctttttgttgatgtacagaagtttgaacctaaagggttagatgaaaatgctggtccgcaaatcagaaagttgtatgctgaggtggttcaaattttctacgccttcctctcaatatatgtctag

SEQ ID NO: 30604 - DNA, 609 bp, Glycine max
  Peptide Sequence Number=SeqID_147382
atgatatctgaactcttgttctcaaacctgaaaagtttagagactaaaaaattagttaatcctactagtaaagaaaacacaataggaacgcacaaacgtgaacaacatcaaaaataccatctcatccgtatcaaagccagacgcgagtactttgacgtcatccatggcaaggcaacaagtgaagccttgtttaggcagaggccttcgtccttcgacacacaaaataacaacgaagaaaacaaaagtgaaattagagtgtttcaatcaacaatacgcagaaacaaaagattaccgagcaatttgcagcccatggatgtgagatcctcgaagttcacctacaagacggagagaggaatcagaagaagaaaaaatgagcaaaagagggaaaacgaaaacgaagtgaaactaagaaagttaggaactgttaaatacatgtttgttggaagaaatgatgtggtaatcgttggggcccttacgggaagggtcgtagcagaggtggacttgggtgtcgttatctttgacggtgtcgtttgttcccgtgttgtcctcccttcgaaacgacgtcgttttgaaggaacagcacgggaacaacttcaaaagggacagtag

SEQ ID NO: 30605 - DNA, 399 bp, Glycine max
  Peptide Sequence Number=SeqID_147383
atgcgagaaaggttagctacagactctagcagtcatactcatacttcagtaaacaagacagtttctaatacaatcaccgctgcacgggttcacaatccttctgagaatggtccaaaacaagaaagagcaaagggaagttcaagtggttctctggatgatgtcaagggtgcagacggtgttttaataaagaaaaaggtaaagagaaagccagatcagggtttggaaggaactcattttcgccccgagaagtcagcagcttctctgcaaggagaagaaaaaccaagatccctaaagcagtctgcagatttgttggttgttaagtcatattggcaactcgagtctggcctcaccgtgcttctcgcagttagtggtgcttctgcagcgagatcgcaattttga

SEQ ID NO: 30606 - DNA, 240 bp, Glycine max
  Peptide Sequence Number=SeqID_147384
atgcagttcttgaagatgatcaataaccatgggcatgcatggagaagcagtgcattgattccaacttttgaggtaaaagaaacagggcttgggcttggtctaggaagggttgatggcagcgtcaatgcaagggttagggattggtctaggaagggttccccaagtagtagtcaactaagggggtcaatgcaagggtttgggatgggtctaggaagggttccccaagtagtagtcaactaa

SEQ ID NO: 30607 - DNA, 348 bp, Glycine max
  Peptide Sequence Number=SeqID_147385
atgccgttatcactgtcggaagtcgttatcgctgttggaagacacgtgagtccgcttagagatgtgtattgtgttgtgagctatgaattgtgcaatcacacagatgtaagactctttaagggcgacgagttttgcgcgatgagtattgtgatgggatccattgtgggaacccaacaagagggagaggccctaacggactcttcggagtgtaggccttgggggtcacccggtttgagtgatcttttaagcctgtgccgatcccacatggttggagcattctcgcaaaacactgtgaccctgactggtctccctatgatattacctagtgagagtgacttgacttgctag

SEQ ID NO: 30608 - DNA, 681 bp, Glycine max
  Peptide Sequence Number=SeqID_147386
atggaaatcaacgaagaaagctcagccttgtataagaatggcaacattgttgtagagctgccggtattcaagctcgttgtcgttatcatctggcacatcgagtccaagagatcatccagtggcacctcatcgtcatccgcaatcaacaagaaaagttcgggagagcatttgtggtcccttgtgaatttcttgtcgcacttgaagcatagtcccttctcacatcgagtggttatcttctccggcaataatcatttaaaaggaattggaggatgtttggtcggggttggaagcagaggtgaggaggggtggattgtggaagttgtgccagagttaatgcttgtattaacgttaatggttgctttggagccaagccagagacgaagtaactcagcaagaaaggtgttgagtgccagtggggtcctcgtaagtcgacaaagtgggcttccaatgcctaaaggtgtagtgatactggaagaactaggttatcttgaagatccgacccataggatccaagccattgaatcgcaaaacctccagcttcatgcgatttttgtggacatggaattctgggttgcagtgagctggatttgggtggagaacgtgtggattccgccatggaagctcaatgaaagcaccaagatgttggggataagaagagggatcttagaatttgaggactaa

SEQ ID NO: 30609 - DNA, 634 bp, Glycine max
  Peptide Sequence Number=SeqID_147387
atggcggcggaggagatggctcctctcgttggcggcggcgattcctcgtcggcgacggcgagggctcagtcgtcgttcgtgaagaaaggcgaccggcaaatgttcacggtggagctccggccgggagagaccaccatagtgtcgtggaagaagctcatgaaggacgccaacaaggtcaacaatggatctgcttccgcaccggagcaccgcgctcccaatgcgaaccctgcgctcgagtccagaatcgctccgggacaacctaaggagattgaagaagagggcgcacctcagacaaaccgtttcagtgctgtaatagagaagattgaacgcctttacatgggtaaggacagcagtgatgaggaggatgcacttgatgttcctgatgatcagtatgatacagaagactctttcattgatgatgctgaattggatgagtattttgaggttgataattctgcaatcaaacatgatggattctttgtaaatagggggaaattggaacgcatggctagccttggtgcaaaactaaggctgctgccttgtggcttggacatatctagtttgaatcctagaaatagcctcttgacttgcggggtcatgtctgtgtacatcttccctcctcaaatcccattag

SEQ ID NO: 30610 - DNA, 234 bp, Glycine max
  Peptide Sequence Number=SeqID_147388
atggcgctaaaaactaaagcaagacccaaaatcattattgtgacatcagatataaagcttttcatcaccgtcaagacccaatgttttttatctatgttggtgttgggtaccaatgtggctatggggcggcacactagtgtcatttggtggatggagtgctgcgaagattgcaaatctaaaggggcagtggttctagtgttttgttgtggtggttatggagtttgcagaagatga

SEQ ID NO: 30611 - DNA, 741 bp, Glycine max
  Peptide Sequence Number=SeqID_147389
atgggtgccaaatacctcgaagtggtcaaacgagggtcgcatcccaacaacggatggtctccggactggagaccacatgttacaaccttaagagatatcaagaatcttgattcaattcttgaagagctcctcagaatctttaaagttcatgagcaagagcttgctctagatgaaggaataaagaatgggaaatctcaagcccatacggttcaaaggccaaaatgcaactttgcgtccaaagcctttgctgtgaataatccttggaatgatgataaaaagatcttcaattttgttataaataagctttggccaattatgccatttccaagtaaggcaaaaccaacactggatgcgagttcagatgaagacgattctcatcctgaagacactgttaactcttatgatgaagagccaccttgcccaatagtgtacaagatgcctttgtttgtgaggaagtcaaagcactattggatgaaaaaggtatccagtggacgaaaaactcttcgtaaggattttcaagacttggaagaaaggcttaaggaatgtgaggccttgaaggaactacctcctgagattgtgcaaagaaaccccaaagacaaatttggccatggttttaaaggcaaaaagatggtacatggtgaagaagtcattgtttgttacttttatggaaaaatgggtcatgaaactcacaagtgtgaagacctccttgaaaagggcaacccatcaaggggtttcatctag

SEQ ID NO: 30612 - DNA, 201 bp, Glycine max
  Peptide Sequence Number=SeqID_147390
atggattttaactctgaagttcgcaagaaagaatttaatttccctcaagcctatgcagccaaatcttcaagaaaggatctaagtaataaagctcttgtattcaaaaactccatcttggtgttttcagaaacctatgtgtcacaactctttaagtatgctggtatctgcaaaagttctatatatgcacgcaaattactctga

SEQ ID NO: 30613 - DNA, 1183 bp, Glycine max
  Peptide Sequence Number=SeqID_147391
atggcttccaacaatgttccattactagcacctcctgtattcacaggaaagaacgacgaaatctgggttgtgaagatgagaaggcagttgaaagcttttgatctttggaaagcaatggaaacaactgaaccaccagctttggaagagaatccaactgttgctcagatcagatttcacagtaagcaagttgccaaaagagcaaaggctcttaccatcttgcacttagttgtggatgatgatgttctcaaccttaagagggagtttgaagccttaaagatgaatgaggctaaaaacataaaagatttcatgaccagaccgatgaagccgaaagatttgaacctaatgtctaatgaaaaagctagtaagtttgaacaatggaaccattctatgaaggagatgaccaccattgaagacaacaatacatggcagctggttgacaaactggaagacaaaaattctattggagttaaatgggtctataaggtaaagctgaatcttaatgggtccattaacaaatacaagaccaaacttgttgttaaaggttatgctcagcaacctggaattgattatgtagagacgttttctccggttacaaaaatgaacactattcgcattcttgtagctttggcagctgaaatgaagtggaaaatttggcatttagatgtgtataagcttcataaagcttcgtatgggcagaaacaagctcctagagcttggtacaacaacattgatgcttactttagcagtcaaggttttaggagtgaaaatgatgcaactctttatgtgaaaaggttgttggatgtgcatcaaagtgaagttggtatttttctgaatcaagaaaagtatgcttatgaaattttgaagaaatttagaataaaaagttgcaaatttgtccctactccttcggtgcagaatctgaaactatccaaagatgatggagctgaaaagatgggcgattctctttatagaaatgtgattggaacaaagagagcacttaagtacttgaaactcaatttagaatctggtttaaacccgatgaaaatggaagacattgtaactcaatctactgctgaagctgaatatgtagccgcagctgcagcaacaaaccaagccatttggttgaagaaaattatgtttgatttgggagtggagaagatggacgctactgagatttattgtgaca

SEQ ID NO: 30614 - DNA, 1503 bp, Glycine max
  Peptide Sequence Number=SeqID_147392
atgggaagagaagtgttgttgccatcagatacgtctcaatacagggcttatttgcaagattcagtcatagagctgctaggaacagaaaagtcaaacaatgtggtgatagagcatactaaagatggatctggaataggagctgctgtattggctgcttcaaactccatgttgcgtgaatatgaagttgatgttgatcgttctaaaagacgtggacctgaggttgaaagaatttattccgtgattctagagatggcatctgtgacatacatagattctagtgctgttcaggctttgaaagacttgtatcaggagtacaaattacgggacattcaaattgcaatatccaatccaagtccagaagttttgcttaccttgtctagatcgggtctggtggagttgataggcaaagaatggtactttgtgagagtacatgatgctgttcaagtttgcttgcaacatgttcaaagcttgaaaggagcatctaacaatccacaagcaccattctcttcagtagagaacaaaccaagtttgtttgcacgattatcaaaagagagagtggagaagctttcaattactgacatggagtctggggcagggaaggacatagaaagtgcttattgggaattggttgtgaaggacatacaagatacttgcaaacttctggagccaatttacaatgaaacagatggggaagatggacatgtatctcttgcagtttccccaaagctagcaaatgacaccaaggggacaattgaggcagcaaaatggcttcataatatggttggaagtccgtgtgtttacatgaaaattcctgccactgatgaatccatctcttccatgaaggaggtcatttctctggggataagtgtaaatgccactctcatattctgcctccctaaatatgaagcagtgattgatgcttacttggatggccttgagtcttgtggcatgactgatctctctaaggtttcaagtgcagcagcattctacatcagtagagtggatgttacacttgacaagaaacttgagcaaattggtactgctgaggctcttgatctcaaaggaaagggtgcagttgctcaagcagtcttagcataccaactttaccagaaaaaattttctggtccaagatgggaacgcttggagaatagaggtgctaagaagcagaggttgatgtgggcttcaacaaatgtgaaaaatccatcttaccctgacacattttatgttaattctgttattggaccagatacaatttcaacctttttagtacaagctcttcaagcattcatggaccatggtattctttcaagaacgcttgatgcaaaagtatcagaggctcaagacatgtacaatgcaattgagaagttggggattgattggagttctgttggatcagaactggaacatgaggtgctggattctttcacaaaaagctttgacaatgtgcttgaatgcatgcaaaagaaggctatgagcatatattcatttcaaaagcacgtttaa

SEQ ID NO: 30615 - DNA, 603 bp, Glycine max
  Peptide Sequence Number=SeqID_147393
atggacaattcaagattcaatacaatgattaatgcaaactgttcgcaagaatcattgtattcaatctcaaatgggaatctaagaatatttagacaaagggattctagtttggcctctgatgaatcaaggattgaaccacaaacactattttcaaagccaattcggattgttgagacatatccttctagtgaaaggggcgatttgaaaaagaagcacatgcccttagacctagaaacggaactaacactaggatttttgaatcactttctgatgggcatccctgcttcaccactaaggaaaaaattgctagaaagtagaccaggcgatgccattgttggtggtggggttgaagatgaactactccagcctcaatttagcattggaaggaagggtgattttgaagatgatattcataagggtcaatggatttatgatatgaatccctttgagccactgaagtatcaaaagcatcttcaagacctaaaatctagaatagcaaagaagggctctagatctatgttttctcctctaatagagaaattcatcttgaacaaccctcatcaacttactatggaaatgcaacttctttattacttatcttaa

SEQ ID NO: 30616 - DNA, 318 bp, Glycine max
  Peptide Sequence Number=SeqID_147394
atggatcagctactctatagaaggttgaaactctggggacagaagcttatcgacctgacaaacccaaaaagcaatcaaaagcctcagattgataaagggcaatccaaccagacaaggagccatgcaaaacaagaacagaagcagcaacacatagaaagaaggacaacaacaccacaacaggacctcacaatcaggctagacagacaatgggatctctttgatctagagatgccaaaagaagacaggttccagcaatacaagtgttatcaatggcatatcacgcaaaatgacaaaccaataacccagtatatcatataa

SEQ ID NO: 30617 - DNA, 258 bp, Glycine max
  Peptide Sequence Number=SeqID_147395
atggaatcgaagtacattgaggattacatgtcattggataaaatgatgaaagagattgagaagaagagagacttgcttcaccagactcgtgctgaagatgatcatgtaaattgtgctccagtgttgaagtcgatggtaatgcgtggacgtgaaattacttataaagccatggaaaaaaataaaaaattgcaacaagagatagatacaatgaatgatgaactcgatcactggtgtcaacaactgactagaagatgctag

SEQ ID NO: 30618 - DNA, 489 bp, Glycine max
  Peptide Sequence Number=SeqID_147396
atggaattgcaagctatggcttccacctctgaaagctgttctccatcaaccaacccttttattaaggtgttggcatatgctttattaggggcacgtaatggcaccttcccagatttgaaaatttcaatatcaagaaccggaatagacggtgttggaaaagaaggagaagaggtcagggatgaaggagttggagacagttttgtggtcggagaaaaggatttaggagtggtgggagtcataccagacgcgttccttggggtcggagaggactttgtaggcgtgttggagttcttgggactgcgcggtggcttcttcttgggagagacccgatttcacgagcttgtccaggtggcgctggggaaccaaatgcgaaattggagcaaaagtgggggatcaaaagtgcaattttgcctttcatattttattctcctctccctcacatttgctctcctatccttcttaatggtatgtttggttgtggagaagtag

SEQ ID NO: 30619 - DNA, 636 bp, Glycine max
  Peptide Sequence Number=SeqID_147397
atggtggaaatcctaagccccaatcttgcgaagggtttaggaaacaaactcggttattggctctactgtgagggttcgtgtggtttgggttttggggatgaatcagagtttcaaggctcaggaatcgcaaatgctcgttgctttaaagcagagggagcaacaatttggggtttgagggcttccgtgatgaaggagaatgagggggaactcgcattgtttttgaagatgaagaagcacgagaaggagtgcaatgaccttcttcttaactgctcagaggagttcaatgcacctctcgggagcatattgagaaactacatcggacttgtaatcttctttgtaaagtttaggctaagcaagtgcatcaagttggaggcctatgcagatgcaatcaggcatatggagattcttcatttcgggattgggaagctattttcagattttgaatcaatacaagtgagagcttatgcaacagtgcttcttaagcagttggatttttcgctttctcttaattctagttctagcacatttaccttatacaaggattgttcaaaaagtcttgcacttgtgtttaaaggagatgaggcaatggttactgccatttcagaggatcctttgagttttaaggaccaaccctaa

SEQ ID NO: 30620 - DNA, 192 bp, Glycine max
  Peptide Sequence Number=SeqID_147398
atgaatgttaacaagaaaaccaatgttattctaacagatgttaaaagtaaattttctagtagtgctatcctaagttcctgcaatgcctcatacgacgtcgcctcctttacatcagtctcgcgcaatggaggacatccagtccctcaaaggaagagatcagcggaacggatcaaacggacagtaaagaagtag

SEQ ID NO: 30621 - DNA, 525 bp, Glycine max
  Peptide Sequence Number=SeqID_147399
atgatactcaaattttacgacgatccaacggtgaacaggttggagatcgtcgtttttctgagactgtggtgggacttttttggaccaatcccgaaaattttccctgagcaggttcaacaaggatttgcacagttcaacaagcattttaactctcaggaatcacaaattctagcagatttaaaatatttttccagttttactttgtcctggatattttcttggcaatacaggtatagcaaaatagaaaacaacaagcaattttcatcccttcagcgacatggatttgtcaagtggtggaatcaatttgacacatcaaaagcacagttagataaggtgaaaatctggtttaaaactcatctagagttcctgaaagcacctgatccagagacttctttgtttctcaatcaaaagtctcaattagctgccttcctagcaagatctaactccaaggaacatctcacgaaaaaattaaaagaagttttgcaattactccaaagccaagaagaagggagttcccaagcctag

SEQ ID NO: 30622 - DNA, 639 bp, Glycine max
  Peptide Sequence Number=SeqID_147400
gaagagaaccaacaagatactagtcatttgagagcacgcagagtaagggaaggaagaagagctaaggagcatttgaagtacaaaggcattgttgcctacatatttgggaagccaaagcatgaaccagtagagtgtgatagcatgtattggctgagaaagtttgaacaatacaaacccgaaggggcttatgttttgcattgtgcagaagatccaacagggtacgttgtgctggaatttggtacagaatggactgggttcatgcaaatgatgaagttagatagagattttcttgttgatcatcatggaaaaaaggattattatgagtcaaggaaaatgggttattcttcaggcttatttggttggtgtgcacaagcagaagattacaactcagaagggcttgttggaaattttctccgtcagaaagctgagctgaaaacaaccttaatggttgcacaagagtcattgaatgaaaaaactgaaactctggatcatttgtatggggaaataggctctgtaaacaaaaagattagtgagatggaatcaaagtacattaaggattacatgtcattggataaaatgatgaaagagattgagaagaagagagacttgcttcaccagactcgtgctgaaggtttgtaa

SEQ ID NO: 30623 - DNA, 111 bp, Glycine max
  Peptide Sequence Number=SeqID_147401
atgtgttttggcatacccgtcgttgaaatggatcacaacaacgacaggttcaagatacaattgaaagtctctgatgatactggtgtaacaatattcacaatgtttgattga

SEQ ID NO: 30624 - DNA, 459 bp, Glycine max
  Peptide Sequence Number=SeqID_147402
atgatttttgatatgtccgtaaaagatgatgaaaatcaagctttggagaagaaggtacaagaagctaaaaccgagctagaagatgctaggcaacaagttattaagctattggctattggtactgttttatcacaattaatgttttccgtgcaaaagctaattgaatgcatttgcttgacaattcaggaattaccacggtccttgaaaggggaagtaattgatgaaaatgatcctaaattattatctttaaagaatgatttggaggaggaggcatacgttgctgtggtgacagctccaaaggaattgcatgagtatcataattctgatgatgctgagaacacccataattcaagtgagaaacaagtgatacctgagatatgggactaccaaaatggacgtagagccaccgtaactgaagctttgaagtacataagcaatagggttatcaagatgcggtga

SEQ ID NO: 30625 - DNA, 498 bp, Glycine max
  Peptide Sequence Number=SeqID_147403
atgggagaccgattagaggatatgattcgtgattttggacaagagttttttcatcaagcatatgcccctttgtatgatacattggaaagtgattcaaagaagtctttgtatccggggtgcaagaagtcattggcattattgtcaccggtgttaagtttggttaatgtgaaagccaaatatgggtggagtaacaaaagtttcacatcattgcttaaggtagtgcagggtatgcttctagaagaaaacatgtcaaaaagttattatgaggtgaaaaagatattgtgtccaatggatgggagaaactacgatggaatgctctaccatccggctgattcttcccaatggaagaaaattaatcgtttgtatccagatttcgagaaagaggcaagaaatcttaggtttggacctgtcactaatggaatgaatccctttgacaatttaagcactaagcacagttcgtggcctgttttgctagtaatttacaacctgccttcttga

SEQ ID NO: 30626 - DNA, 279 bp, Glycine max
  Peptide Sequence Number=SeqID_147404
atgcctaccatcaatggagaagaagaagttgacaacgtgcacatggctacaccactgagttcccctcctcctgaatcagcacctttaccatctacatcgaaaaggactagaaaagtcacacggcttagatccttgtttgccagactcgtgggggtggagagaccggtggttcatattgatcttaccactggaaaaactgatggtccacacaaaaagaaattaaggacctatttgggggtcattgctcgagacaaagtgaatgttacatatgttaactaa

SEQ ID NO: 30627 - DNA, 231 bp, Glycine max
  Peptide Sequence Number=SeqID_147405
atgaattgttccacctgggaaaaatggtcatcaatgggagatccatctgataccacgagaacaaaaaaagcaagggactggaagtattcggctaaggcttcttcagtaatatttggtaagatgggttgtgtgaaagctaacaactgtccaaaggtcattgttggtacagaaggcatggcaaaagattcaaaaggcacattggaaggttcttctacagaaactgattcctga

SEQ ID NO: 30628 - DNA, 234 bp, Glycine max
  Peptide Sequence Number=SeqID_147406
atggatgcacatgagaaaattgaccaagttccaaaagataaggagaaaggaagtgttgctcaagaagagtcaatagaacaagagttgaagcagacagaagactcattgctggaggcttggttgaatgatgacgacttgctaagggtcaaaattgatgctataagcttgatacctagtgaattttgggccaatacgagccaaaatgagagcttagatggagatgtttgttcatag

SEQ ID NO: 30629 - DNA, 897 bp, Glycine max
  Peptide Sequence Number=SeqID_147407
atgattgtaatgtctgagaaacctcttcagggagttcctccacagataacagacaccactttttcctcttcatctaaaaggttggaaggcaaagttgctatagtaactgggggtgccaagggcataggtgaagcaaccgtgagagtttttgtgaagcatggtgcaaaggtgatgattgctgatgttgaggatgcagctggggccatgcttgcagagacactatctccttcagcaacctatgtccactgtgatgttagcattgaaaaagaggtagaaaaattggtcagttccaccatctctcgctatggacaccttgacatcatgttcaacaatgctggggtgctagggaaccagtccaagaacaagagcattgtcaactttgaccctgatgagtttgacaaggtgatgtgtgtgaatgtaaagggtgtggccttagggatcaaacatgctgcaagggtgatgattccaagaggaattgggtgcattatctcaacttctagtgttgctggggtcatgggggggcttggaccacatgcctacactgcctcaaagcatgccatagttgggattaccaaaaacactgcttgtgagttggggagatatgggattagggtcaattgcatttcaccatttggggtggccacttccatgcttgtgaatgcatggaggccttgcgatgatgagggcaccaattttggggtgccattcccagaggaggttgagaagattgaggagtttgttagagggcttgccaacttgagaggaccaactttgagggctttggacattgctgaggctgcactttatcttgctagtgatgaatccaagtatgttagtggccataaccttgttgtggatggtggagttacttcctcaagaaattgtattggactgtaa

SEQ ID NO: 30630 - DNA, 561 bp, Glycine max
  Peptide Sequence Number=SeqID_147408
atgggcaaggatgggttttctagttgtatcattagaccatcgagttctaacacccttggcttagaaacaaggcaaagccatatgcctcaagtctttctcctgttggcacgaaaaatctcatggaatgaccattattccgtcaaatccgcttactatcagcttctggagaacttgattgataatagtgccctcaaatatggaaactccatgtcccccagaaaattaaacatcttttttggagaatttctagaggatgtctcccttgtcgagcccatctccaaaccaaaggagtgtcatgccctctatgctgcccactttgcaaatccaatgtcgaaaatgagtggcatatcttctttgaatgccataaagcccattaaatctggttatggcataggcaaaacaacaaagtatggacgaagcctaccactttcatctccctttctcgtaaattgctccattaatggacccatgcacatcaacaacattctcatcaccaacaccgacaggtacttacctcacaaccatctccctcttggacgaaacctgctactagcaccttaa

SEQ ID NO: 30631 - DNA, 171 bp, Glycine max
  Peptide Sequence Number=SeqID_147409
atggctaagaatttgaagagtcgatggacaaatgaattgtcacgtgttttagatgaatgtcgtatcgttctgttgttagttgatcacttgtcagtatgtcaccaagaaaaagatgaatgtcctctcgttgtggttgtagttgcactttgtggtcacttgtcagggggttaa

SEQ ID NO: 30632 - DNA, 3789 bp, Glycine max
  Peptide Sequence Number=SeqID_147410
atgttccatgacttacatgaagaagtactggctactgctgcaagaggccacaatcttgtgtctcgtgttcaacagcttgaggctgaagttccagcactagagaaagtttttttgtcacaaactcatcattcatcattttttacaaaaggagggattgaatggcatcctaatcttcggtctgaacagaatcttgttacacgcggagacttacctcgatttataatggattcatatgaagagtgccgtggacctccaagattgttccttctggacaaatatttgaaactttttttttctcttggctctgaaaggtttgatgtggcgggggctggggcatgtctgaagcgttatactgatccgtcgttctttatagtggagtctgcttcctctggaaaagtaacagtagaagttcaaagggaaaagaaaattcataaagttaagcaaaagaaaggaacacgactgcggaatggtgaaacccctgaagttgtaccgtcacatgcaaaactgcatcagttacttcttcaggagcgcattgagaatgcttgtggggatcctgctcgccttgtgaagttgaaaaagaaacaattgaatggatctgcagttgaagcaaaaacatggaaaagttacatggagaaaattctggaaatcccctcccctgatcataaaatggtttgtgaaacttcaattccacagcccgggaagttggtgtcagatgattctagtgaaagtgggattaaaatacttgaaatcagtagcattactcctatgaataggtctttgggaaatgaaaacacatggtcatcaccaaatgagcaggaactagaagtgaattcatacgcagaaatggatagggagatggatggatatattgtggaggtgaatgaacaaatctctggtggtgtcacagaggaaatgtcttctgactatctcaaggtactcgatgaagcaggattagtatttgatgaacaaaataaaagagaattcaacttagatagctaccactctgatgatgtgattagtgaggttgatgattatatggatgcattagctaccattgagtctgaattggatacagacaatgagtgtggacctacgaaaaaattattaaatattcaaaatttaactgattcaaatggcaaaggcgaacctcaactgcgagctcaattttcagattctcaatcatttggtgactccttaacttctgctgaagaaattagttcatttgaacaagatagaaatggagagcataatgaagtgcaaggtcagctgtcagattctctgtcaacagggacctcctgggcatctgatgataatagtccattcagaagagatataagtgaagaacattcccaactacaacagttttcagattttcaatatatcagaaactccacatcaaggattgaagatatgtcatctgaccagcttccccctacttttgagtttcaaaggacttactgtcgtgagtttgtcgtggatgatgatgaacatgctcagggtgaagtgatttctgattctagaccagtctcttctggttcatgtctgatggattctgaacatttaatgttgtatagtgatcttggagctgcctcaccagtgtccctatctgcagggacaggaaggcaatcagatgaaacaccctccggccctgttgagcttcatttaagaatagaagatgatgaagaaaagaagtgtcttgtcgaatctatagtggccagatctgatgcttgctacccaataagagatgatgctttcccagtggtttcttttgataacaattctttgaacaacttggatgtctgtgatccctatgtccattccaatgatctgttacaaacttctaatgaattaaacttagctcatgaaggtgaatctggtggtcattctgggattgaagtttttcaggcagaatctcttaatgaatgctcttctgaaatattggttagtggagatgttggtttacaaggggaggatcccatttgcccatctatggaagtagacctgaatccagatactaagctgctgcttgatgtccaaaatttaaaatctgaggatgatattatagctacccagcttaactcagaagatttgtttcctgttgcagagactacatcaaagagcagcattacacaggagctatgctttgattttacaagtggaaacaagccagatttagcagaagttgaatttttgcctcctgatcatcaagtgaattttgaagaggtaccaaggatattgcctggtgatgaaataagtggatccacctgcagtttggatctagttgaagatgatgttcatattaaacattcatcttcagatatcatatcttctccaatgagtaatcttacaaagttggaagaaactctttctatttttgcagatccttgtgagaaagagatgatagtcagtgaggcagacagtagagaatctttgacagaattagcagcacagaaggtagtggatcaacctgaaattacttctattgatgtacagttgagcatgagcagatcagttccatgcgatccttctgattctggaattaggaataatatgcaacattcatctattaaggagaaaatccattatagctcttctatcaatggcctgaaaacggtgcctgtttgttcagagctagacacgcaaaggttatctggtcagggaattaatccaacaaaacgtgtcatgaatccattaaaacccctaattcctgacttcttacccaaggcatctaaaaacagtctagaggagatgccacctatgccccctctgcctccaatgcaatggagaacgggcaaggttcaacatgcttccctttttacacagagagaagacatagaagtaaacctagcctcactccaaccaatacagcccaataaacttgatgataagtctcaatttggtttaccaacttctgaaaaagagaccttgccgtatcagaatctatttttgcctgtcatggctgtggaaagtaatatccatcaatattcttctgggttttcagtgggaatgtcagagcagcctgtttctattccttttcaatttcctgtaatggtaaatgaagcaaatggtcaatataatttcctagttccagaacaaagccaaatccagaaccctttcttaacattacaggacaggtctccacttggatatgctgttgctttggagggagaaataaatccaagtccatgcccaccatcacttcttgctgaatgtgttgtttctagggctgatcccattttacaacaagaaaaaccaactcaatctcctagtgaattaacggaaggtaccagcttagaagttacaaaggatagacctggagaattgcatttagtgctacctgcagaatgtccagattctggagatgatcccatttctccaaaagagaaaccaacacaatctccaagtcagttaatggaagagactagtttagaagttaaaactcttgagcagtcttcgattaatctggaaagggaacaagaagatccttcaacctcacccatgtcaccgccaagtctagaaattaaggagaccaatcacagcctgctaccttcagagggagaaatggcgtttccattggatacatcttctcaaacatccaagcgtgataatactgagacgccaaatggaaagccaaagaataagcgtcctcttcctcaggaggatcctgtaattgatcctgttgctgctctagacaaaagcaggctgaggaaggtcactgaacgtgttatgccccccagagcaccaaaggaagatggaagagaatcactgttagaaatgataagatcgaag

SEQ ID NO: 30633 - DNA, 1299 bp, Glycine max
  Peptide Sequence Number=SeqID_147411
atggtgaaaaacgaaatgaatagcatcatagaatctgagcttaccgtcgccggaatccaactcaacctgggtcggattcttgggtatcatcgcatcgccattcgttttagcctctcaataagagattttagttcgcttcaaattcgagtagaattgtcatccaattcatttctagcttacaaatctgctaaggtgtttgttgctggtcaccggggtcttgttggctcggccattggtcgcaagctcacccaacttgggttcactaatctagtcttgcgctcccatgccgagcttgatctcactcgacaatctgatgttgaagccttctttgcttatgaaaaacctgaatttgtcattgtagctgcagccaaagttggtggcatccatgccaacaacacctaccctgctgatttcattgccatcaacctccaaatccagaccaatgtcatcgattctgcatatcgcaatggtgctaagaaactgttgtttttgggttcctcttgcatttaccccaaatttgcaccccaaccgattccggaagatgctttgcttactggacccttagagcccacaaatgaatggtatgccattgccaagattgctgggatcaaaatgtgccaggcttacagaattcagcataagtgggatgcaatttcgggaatgcccaccaacttatatggaccatatgacaattttcatcccgagaattcgcatgtgttacctgctctcatgagaaggtttcatgaggcaaaggtcaatggtgctaaggaggtggttgtgtggggcaccggaagtccattgagggagttcttgcacgttgacgatttggcagacgcggttgtcttcatgatggaaaagtatagcggactggagcatttgaatgtagggagtggaaaggaggttactattaaggaattggctgagttgatgaaggaagtggtgggatttgaaggggatcttgtttgggattctactaagcctgatgggactccaaggaagctgatggatagctccaaacttgcaagcctgggttggacaccaaaagtctcactcaaggatgggcttgctgatacctacaagtggtacttggagaacgaagttttagcctcaaaccatcgacccagcatcaccatgttgtgggctttcatcttcatcactacaagccaccatccaagaaaaaacacaataaaagtaaagcatctggtgatgggagagcttcgagcgacagtttactgcatcaccactaaccaccatagccaccaccaaccaccatcttggtgggagagcttcaagcgatag

SEQ ID NO: 30634 - DNA, 501 bp, Glycine max
  Peptide Sequence Number=SeqID_147412
atggtgtcagtttccattccttatgccgttaagagtcaccctgttttcctgtttatgaaggaagaggccttggttaaggctgcccaagctaatgaggcactgttgcaatcggctgaggaatctcacaagtcttttgtggatacaaagactaagttgaaagaggttgaatcccgagaggaggctttaaagaccaagctcactactattgaggattcaactaagactctccaggaagagatcgagtatcccaacaaggaatttgctctctttaaggtgaatgttgagaaggtcaaagaaaagttgaagattgatcttggcgaagttgaagctgagatcctaaagacctatgaagctgagttcaacaaggctctctgtcaggtcaagtattttttcaaggatgtcgacacttccctttttgatgttgacaaggacattactcgtcatggggagttagtcggtgaaactgatatgcatgtggagaaagttcctgatttggcttga

SEQ ID NO: 30635 - DNA, 684 bp, Glycine max
  Peptide Sequence Number=SeqID_147413
atgaggatacatctacttggggattgttatactgagaataagagagggtacatctcttgtggatcagttcaagtggagggtacatccacttggtttttcaaagagaacaagggatggtacatcccttgtggatctttggcttgtaaaggattttacaaggttgaaaagaaatctcaagaaccccaggttgcttggggactggatgtaggcacgatgggttcatccaatgaaaaagggagtaggactggtgtcatcctagaaagcccaaatgaaataatcctagagcaatccctaaggttcaagtttgggacgatgaacaatcaagtcaagtatgaagtccgtttagccgacataagattggctaaggaagtgcgagctaagtatcttaagtgttggagcaactccaagcttgtcattggtaagaacggtcatccaagaaataatcttagaaccaagcctagacaaggttgtggcgagtgtaactccccttggctgagaatggatgaccgagatctaggacttcctggagaaagactcactcccataaaatccaagaacaataagaaggctcaagaaaaatgccaattattatgtgatagagggataagacatgtactgatgaggcttcatgatccccatgttgaagtttttgactcgggatcaatccaaatacgtaatgaatga

SEQ ID NO: 30636 - DNA, 513 bp, Glycine max
  Peptide Sequence Number=SeqID_147414
atggcaaagaggtcccaaagattccctgtgaattatgagaaagaccagtcaggatgtatgtggggttttattagtatatttgactttcgtcatgcctgctttactcgaaagttgatcgtggataggacgcatggcaacaagcatgttgttggtgctgcacttatcaagaacaagtttgaagtgttgagcaatttggataagaatatgaaggcaattttattgaatgggaaagatctgcctgaagatggacaattcctgagctcacgtgaactcatgaaagcacttcagggacaacaccaaagggggacaactaataatattgctatgtctggtatgtcagcattcaaaacaattggtcttgctagtgttggtgcattattatttagtcctcttttcatgcatgagttccgcttggagaccccacatatgcctccaaagcttttaaatcctgaatgtaaatcctcaaagcaactgaaagctttagtttgcaagattgaagtgaagacacagtga

SEQ ID NO: 30637 - DNA, 2202 bp, Glycine max
  Peptide Sequence Number=SeqID_147415
atgctgccatctgccaccgccggagatgccggacacggcagtgccggtgaccgcatcgtggtggtgggcatgaagatggactcccacagcaccgagttgctcacttgggctctgttcaaagtggctcaacccggtgatgttgtgcttgctcttcatgttctcgggaatgatgaaattgtgaatcgagaagggaaatcctctttgttttcacttgtcaaagcatttgactctatccttgctgtttatgaagggttctgcaatttgaagcaggtggatctcaagttcaaaatatgccggggttcatcagtgacgagaattttggttcgagaagcaaatgcttattctgcaacacacatcatagttggaagttctcaaggtcttcatataactcggccatgcatatctgtggcaaggtactgtgctaagaagttaccaaaggattgttgggtttttgctgttgataacgggaaaatcgtgttcaagagagaagggtcagccgcaactcgttcagacttaaaaggacttgatcgggatcacaaaaccgggttgctcggttcgattcacaggacaatcagcaagagttcaaaagtgctagatgatgatggcacggggatgcacgaaaagggtagtggtgaatattcagatcacagtttggccaaggcttttctggattctaaagaattcattgagaagaagaggtgctctactagtgcttcagaagaagaagaatcttgtgctgatgcttgtgatgagatgaacccattggcaatagtgcctgtgcagaccaatgatgctgcttctaaaccgggttggcccctgcttcgtaagacaattgtatctgacaggaaatgttctcaaagatcgctcttgtgccagatctcggtggtacaatgggcaatgcagttaccctctagagatctttcatatgctgcacatcaagaccataaaacaaacaattgtggcccaaataaggatcagtttctggcccttgatagcaagagtggtgctcttgttccggtggatgctgaaatagggactgctccttcgactgaacacaattcaagaagcattcctaaggaattggagggccttcatgagaaatactcatccacttgcagattgttcaagtaccaagaacttgtattggcaacatcaaattttttgccagaaaatttgattgggaaaggaggaagtagtcaggtttatagaggttgccttcctgatggcaaggaacttgctgttaagatcttaaagccatctgatgatgttttgaaggagtttgttctagaaatagaaattatcactaccttaaatcacaaaagcttaatttccctccttggattttgctttgaggatggcaatcttcttttggtttatgatttcttatcaagaggaagccttgaagagaatctccatggtaataagaaaaatccacttatgtttggttggactgagagatataaggtggcaataggtgttgctgaggctttggagtatctgcataataatgatggccaatctgtgatccatcgcgatgtgaaatcatcaaatgttttgttatctgaggattttgagccccagctctctgactttggacttgctaaatgggcgtcgaccacttcatcacatataatctgcaccgatgttgctggaacctttggttacatggctcctgaatacttcatgtacggtaaagtaaatgacaagattgatgtctatgcatttggtgtagtgcttcttgagcttctttctggaagaaagcccataagtggtgattatcccaaaggtcaagagagccttgtcatgtgggcaagtccaattctaaatagtggaaaggtgttacaattgttagatcctagtttgggtgataactataatcatgaagagatggaaaggatggtcttggcagccacactttgtaccagacgtgctccaagagctaggcctcaaatgagccttatctctaagctccttggaggtgatcctgatgtgatcaagtgggcaagactagaagttaatgctttggaagcaccagaaatgcttgatgatgaagcttgtccaccttccaatttgcagtctcatctcaaccttgcactgcttgacgtggaggacgactcgctctccatgtgcagtgtcgagcaaaacgtctcgttggaggactacttgagaggccggtggagccgctcatcaagctttgattaa

SEQ ID NO: 30638 - DNA, 954 bp, Glycine max
  Peptide Sequence Number=SeqID_147416
atggtttcattcaaaaacagctcgagggagtttgaggagtcaagttccaatgtcagagctcctaccaaagaggtgtttgttgtgccttcagatgatttctctagggtggcaaataacataactcctagtgcatacaaggttgttgatgatactactgtcaccgtaaatgttatggtcggacctttaaatcatccgacaaggcttggaaacctagcttttcttgagtcaccccctcggctccttcttgccaaggctattgttaacttgtttaaatctcctaatcctattaggatcttgaaggtgtgggtggcatctatcgtccaacatcttcaaggctctttagtagtgagcaagttgaaggatgatttgaaaaaggctgaggactctcttgcctctatgctttctgccaacattgcattggccagagacaactcagagttgaaggctcatgttgccgcccttgagttaaagtcaaaaggagaaaataaagaggctgaaacttcactagccttggcagagaaggagaaagacgttgaaaaggaagaaaaagcccaaattgaacatgaggcctattatgatgtgtatgaggccatgcatctagctttaatcattgcctctgccacatcctttttcattgatgacgcccctatcggtaagaagttggcaaccccttctagagccaaatgctggcttagcgagccatccgttgagcgcaacactccttcgactgagcgtgaggaagaatctggaagaaggatgagttgtgcatgtttgctgagcgaagggtcatccagtgaagcgcaccgcttcagtccattcgctgagcaagaaaagcacatgctgagccgaaatccactaatgagagctgagcggtccatagtcgcgctaaaggttttgctatgcgaagacctgcagagaactgagcttgaagaggaagccgtcctgagagcttga

SEQ ID NO: 30639 - DNA, 1497 bp, Glycine max
  Peptide Sequence Number=SeqID_147417
atgaagacagaatctcaaccccagcaactgaatgtaatttttcttccatatccagctcctggccatatgaaccccatggtagacacagcaaggctatttgccaagcatggtgttggtgttaccattatcactacccctgctaatgatttgactttccagaaagccatatatagtgatttcagttgtggaaactgcatcaaaacacgtgtgattcaattcccagcatcccaagttggtctccctgatggggttgaaaatgtcaaaaacgtcacttcaagagaaatgttggacaaaatcagtcttggactattgattctcaaagatccaatagagcttctgtttcaggaaatgcaaccagattgtatcgtgactgatatgctttatccatggacagtggagtctgctgcaaaactaggcattccaaggctttacttttacagctcaagctacttcacaagttgcgctggtcattttgtgcggaagcataagcctcatgaaaggatggattctgataaccagaagttttcaattccttgccttccacataacattgtgattaccactctgcaggtggaagaatgggtaagaactaagaatgacttcacagatcatttgaatgctatatatgaatcagagagcagaagctatggaacactgtacaacagttttcatgaacttgaaggtgattatgagcaactttatcagagcacaaagggggtcaagtgttggagtgtaggaccagtttcagcctgggttaatcagcgtgatgaagaaaaggccaataggggacacaaggaggagcttgtgctagagtcagagtggctaaactggcttaactctaagcaaaatgattctgtactttatgtaagttttggaagcctaatcaggctccctcatgctcagcttgttgaaatcgctcacgggcttgaaagttctggtcatgatttcatctgggttattcgaaaaaggtgtggagatggggatgaggatggtggagacaatttcctgcaagattttgagcaaaggatgaatgaaagaaagaagggttatatcgtatggaactgggtgccacagttgctgatattgaaccaccctgccattggaggtattgtgactcactgtggttggaactctgttcttgaaagcttgagtgctggtttgccaatggtcacatggcctgtatttgcagaccaattttacaatgagaagttggtagttgatgtcttgaaaattggagtcccagtgggatcaaaagagaacaagttctggacgcgtattggtgaggatgcagcagtgagaagagaagtgattgcgaaggctgccattctgctgatgggaaaagaagagggtggagaaatgagaaggagagcaagaaaacttagtgatgctgccaagaagactatagaggagggtggatcctcttacaacaacttgatgcagttgttggatgagctaaaatcattgaaaatgtcaagagaacttgagaaaacaaattag

SEQ ID NO: 30640 - DNA, 393 bp, Glycine max
  Peptide Sequence Number=SeqID_147418
atgggacaagggaaaacttatccttcaaccaacttcaatggcaataacaatgaaaagactcccgcagccaaccaaaaaagatcatcacagggaaaggcgtccaccatatttggaatgcctaccatgggaacccctaaaaacaagagtcccacaacagtggtgaacatcctacgtaaagtgcctaataatcatgctttgattggtgggatcgatgacaccaataggacgtggagaaaaggaacaatgttagacactcaatcaacccaaatagtagcaaatgcagagaaccaacttcatcccttcattgatgggatcatggaagcacaaccaccacccgaatggaagatgctaaccatagaccattacgaagaactcttggaccaagatgagcat

SEQ ID NO: 30641 - DNA, 420 bp, Glycine max
  Peptide Sequence Number=SeqID_147419
atgtcaacgctccaaggtcaaattgagtttctatttcaggatctgcatccagattgtcttgtaactgatgtgctttatccttggacagtggagtcagcagaaaaactaggcattgcaaggctttacttttacagttcaagctacttcgcaagctgtgccacccattttatcagaaagcataagcctcgtgaaagtgattatgagcaactttatcatagcaccaaggcggtcaagtgttggagtgtaggaccagtttcagcctccgctaacaagagtgatgaagaaaaggccaataggggacacaaagaggagcttgcactagagtcagagtggctaaactggcttaattctaagcaaattgagtctgttctttatgagttttggaagcttcaccaggctctctcattctcagattgttga

SEQ ID NO: 30642 - DNA, 237 bp, Glycine max
  Peptide Sequence Number=SeqID_147420
atgtctcctccacctctagaacctcacaatcactcacaaactcatctcaagctctcaggacggcttcctcttcaagctcagttctctgcagcgaatggactgaagcggtgcgcttcactggatgacccttcgctcagcaaacatgcacaactcatccttcttccagattcttcctcacgctcagtcgaaggagtgttgcgctcaacggatggctcgctaagccagcatttggcttag

SEQ ID NO: 30643 - DNA, 1500 bp, Glycine max
  Peptide Sequence Number=SeqID_147421
atggaagctcaatcacaccaccaactcaatgtcctttttcttccttatccaacacctggccatatgatccctatggtagacacagcaagagtatttgccaagcatggtgttagtgttaccattatcactacccctgctaatgctttaacattccaaaaggcaatagacagtgacttaagttgtgggtaccgcatcagaactcaagtggttccattcccatctgcccaagttggtctccctgacgggcttgaaaacatcaaagatagcactaccccagaaatgttgggtcaaatcagtcatggaatatcaatgctcaaagatcaaattgagcttctgtttcgagacttgcaaccagattgtatagtgactgatttttgttatccttggacagtggagtcagctcaaaaactaagcattccaaggatttgcttttacagctcaagctacttctccaactgtgttagtcattctatcaggaagcatagacctcatgaaagctttgcctctgataccgacaagtttataattcctggtttgcctcaaagaatagagatgacccctctgcagatagcagaatgggaaaggactaagaatgaaaccacaggctattttgatgcaatgtttgaatcagagactagaagctatggcgcactgtataatagttttcatgaactcgaaaatgactatgagcaacttcataagagtacactggggatcaaatcatggaatattggaccagtttcagcctgggttaacaaggatgatgaacgaaaggccaataggggacaaaaggaggaacttgcacaagagccagaatggctaaaatggcttaactctaagcaaaatgagtctgtactttatgtaagttttggaagcctcgtctggctccctcgtgctcaacttgttgaactggctcatgggcttgaacattctggtcatagtttcatctggctcataaggaaaaaggatgaaaacgagaataaaggagacaggtttctgctagagtttgagcagaagatgaaagaaatcaagaagggttatatcatatggaactgggcaccgcagcttctcatattggaccaccctgccataggaggcattgtgactcactgtggttggaattccattcttgaaagtgtgagtgccggcttgccaatgatcgcgtggccagtgtttgctgagcaattttacaatgagaagttgctagttgatgtgttgaagattggagtcccagtcggagtgaaagaaaacacgttttggatgagcttggatgatgaggcaatggtgagaagggaagagatagcgaaggctgtggtgcttttgatgggaagtagccaagagaacaaagaaatgaggaagagagcaagaaaacttggtgaggctgccaagaggactatagaggtgggtggacactcttacaacaatttgattcagttgatagatgagcttaaatcattgaagatatctaaagcacttagcagaagcatgttagataagtga

SEQ ID NO: 30644 - DNA, 411 bp, Glycine max
  Peptide Sequence Number=SeqID_147422
atggaatatagtactaatctaagatttaagaagatgagagatgtatccgaggctgcagtgatggcaggatccgtccttcacaagaaagtgagggaattggatgcatcagctaagcaaccttcacagatcaataaaaccattagcagctctaatttatcagcaaccaacaaaagcctaactgtagcagagaacaaaaaacctactattgctgataaaagtgcatcttctgtaaaagcttttaatcaatcaagatcagataagtctgggcctcccaaggttggtgatatggtgcatgtctcttcccttgggaaaaaggtgactgttttaaaagtggatttatccaaaggagaaattgtagttcaagctggaaacatgaagttgaagctgaaactaactgacattcaaagataa

SEQ ID NO: 30645 - DNA, 753 bp, Glycine max
  Peptide Sequence Number=SeqID_147423
atggaaaagaaagtccttgatctcatattagtcccaagtggcttccttgtgatgttggcttaccatttctggctcctccaccaaatcatgaaacaccccaccaaaacagtcattggtgtcaatgcaatcaatcgccgtttatgggtccaagccatgatggaggatgtgtccaagaatggggttctagcagtgcaatctttgaggaacaacataatggcatcaacccttttggcttcaacagctataatgttgagttctctcattgctgtgttaatgagcagtggcaatgagagaaaaaccgtggtttatgaggtgtttggggacaggagtgagcttggtttgtccataaagttcttttccatattggtgtgtttctcgttggcgtctttgttgaatgtgcaatccataagatactatagccatgcaagcatcttaatcaacgtgcccttcaagaaagtgtctccaaaccttaggcaccaaatgctcacagctgagtatgttgccaacactgtgaaccgaggcagttacttctggtccctcggcttgcgtgccttctacttctctttccctctcttcatgtggctctttggacccattccagtgttcttctcttgcgttgcccttgttttcatgctatacttcttggatgttacatttgagtgtggatgtgctggagtttctgacactcatagtgttgaatctgctgaattgaacaaacacaatgttgatgtggaaattggaaaggccaattag

SEQ ID NO: 30646 - DNA, 5469 bp, Glycine max
  Peptide Sequence Number=SeqID_147424
atggaatccgatgccgatgcggcggggagaacaacctccaagagatgggtaatgagtgatagagatagaggaagagagatgctcgagtcttcttctagtttagtgagtaatagtgttaacaatgagaaatattatcatggctctgagagcaatatgatgggtaggtatagtagagggaatagtagagagtgtggtcatacccatgaatttgcacgcactcctccgaagaaacaggtgcagaagaagagtgctcttcttaggattcagacggttaaacctaataataatcataggaaccgcgacaatcgcgaggttgagccgttacggtacccaggttatggttctgagtgtagcaatggtttttacaggggaaaggagcagtatttgggtcatggggtgaagggggatgagagggaagagagagaggggagtcctgttgagattgatatttcttttgagtccaattcgctggtggcaaaggcgaaggcgattgtggcgccaccttcgagtttggtgtcggttcctgatttgaatgtgatgccaattgcagattcggatttggtttatggggggaggagtaaaagggtttcgggcactgatggtgattattctggtttgcaattgcagcaaccggttagaatgtcttcggttgttgttgtggatttaaataggtcgccttgcaaagggaatgatagcttgggctcgaggaaggaggttatggggtcgaagaagaagaatgttgatgatggttcttcccggtctagtgccagggaggccgatggttcccgtgggaaaaaggaggtgccaaattctgttaaggttggcaatgttggttctggtaaattgaccttgaaggttgtcaagaagaagaaaattgttaagagagtggtgaagaaaggtactgcaagttctaagtcatctgtgtcgaattcactaccagctaaaacacttcctggaactgtgaaagcagagagtgttgcatgtatttcattgactgcctctggtcctgagaaaattgaagctaatttggatgagaaaagcaacactgttgatgaggtggctaagcctgactgtttgcaccctttaccaaaggaagggaatgtattgaaagaagaagcagaggtaggcttattgcagccgagtttggggccacattccgggtcacaagagtgtaagagtgacaaagattctgatattgggaaagtatccaggtttgaaaaagatggaaacatttcaaattctctatcttgtgcttctagtagtgaagataaaaagagtgattctgattgtttagatgcaaatgattctgtccatgataatgcaaatacatctgactgtttagatgcaaataattctgtgccaaatactgtcaaggttactaaatcattaagtggaagtaatatttcagtagtcactaacatggattatggtaataagcaattatgtcagaatgaagtgtctctatcacctgggaaatattcaaatgcaggatccccacagaataggaatcttgtagatgcaggggatgaacttttgaaaagcagtgttatttcatgttcaggaaaaactaggattcaggatggtctggattgcctccaacatgccagtgcactaaagcacagttctgataatggatcatctaatttagaagatagtactagtgttgacttttctggtattatgcatgatgctggaaagcaggtgtcccctggtcatgtcatcatatcccctgagaattgtgagacagaaaaagcattccccaattataatgtttcagctggatctggtgaaggggacacaaatatgataaaaaagagaaaagatagaacacacttaaaatatttgagttcagagatggagtgcttatctccagactatgtaaattcagataggcttgcaaataatgtggatggaggctcaagtctgttgttgaaagatccatctccttcagaagttttagcgcaacctgttcaaagcttagattttaactcactatccggcctggatggggttactgctttacatgttgtaaataatgacaatgataatgcaaatgaggtttcaccagcttctaaaaggaaaaaagtcacagctaacccatatttcacaaaatgtcaatcggaattctgtgctgtgattgtgccttcccccacatctgaagctcctgtgagtttcagtgataaccaagaacatcagaaagaagttgtttttgcaagcatgggtatgagtattctgtctactgctcagtcaatactttattcagagaatattactaaaatgtctgaaaatattttggctggaggatcttttgagtctattgatgcagataaggaaactatgagttctgagcatttggaattgcagcactcagatatagtctctttttcaccaagtgaggacgtggcatttccaaatgttcagttgtcatcattggaaggtgagtgcaaagaaaacattactccaattgtgcctacaagtaatattcaaacagatgttttggctgtgggaattatagcggggcaaaagactgatttacaggctgttgaagaaaattaccagtatagagagcatgtgcaaaggtcaccaagagctgatatggaacctaatgatcacaatatgaagaatgatttgcttgctcggcagaaccttatgtcttgtccagccagtagtgatgaagtcactacaagtaatttgaataacgaagtgattgaggatgtacctgatgcattatcagatatgttttctcaagggatggcatctgaagtaccggatcaaagggttttagaatttacagcaatcaacgatgaaaatatttgtggggttgaagaaaatccagataacaacatatctattgttggacatggttctgacttaaatacttcatcaatacagcagactagaaaaaatatgaagtcaggtcatgcaatcgaacatagtaacctgatcacaaagaagacaatgtcagaaccatcccaagtttcttccagagttacaactcaggctttaaattcatatcgttttgggttgagtgggaccaaaaaccagtcaggtagtgtcattcccaaaacttttccaggtcattctttcaccttttcaaaggcatctgcctcttcacctcatgtatcaaagcctcgaacttggcttcgtacaggtaatattcctcccacttctgtacttagaatcaagccttcagtagaaacagttcctcccaaaaggccaattctagaaacaaaagggaactttcaaaatacctcttatgttcgtaaaggtaacagtcttgtaaggaaacctactccagtttccactctacctcaaatctcctctgttaatcagacatcttctttgggcatagatgaaataccaaaaagcattaaatctggaaggagggctgatgggacagataaaccaatgtacttgaaaacaggagcaataaatgctccacagcagagaacacctccactaccaattgacaccaaattagaggaaaatagatcttcctcattggtagaacctccttctggtggttgctgtgaaaatgcatcagatgttaggaaatttatagaaactgataatattgcaccaaattcttctgaagatgcactgaagcattgtgaaactccagaaaatcaatctggtccatctgataatggggagagccaaggtgaagcaaacgatggaaatgtttttcctttgaatacaaagagaatagtatatataaagcccaaaacaaatcaattggttgcaacatcaaattcttatgatgtttctgtctctactgatgacaatctccaaactgccttctctgatggctactacaagagaagaaaaaatcaattggttaggactacaatcgaaagccatatcaaccagacagttgcaatgcccaataacacggcaaattctgatggacaaggaactagtaatgctctttgcaacaggaggtttagtaagaagcggacacataaggttggtaggagttcatttaaacgttcaagagcctcattagtgtggacactctgtagcaaaaattcttctgaaaatgacagggactcacgacattatcaaagggctttacctctattgtttccatggaaaagagcagcatttgcttcaagcttgaataacagttccttatctgcaatcagcaaaaaattgcttcagttgagaaagagggatacagtttacactaggtcaatccacgggttttcacttcggaaatccagagttttaggtgttggggggtgtagtttaaaatggtccaaatccattgagaagaactcaaagctagctaatgaggaagccacacttgctgttgctgcagtagagaggaagaagagagagcagaaaaatgcagtttgcatcagttctctgtcaaagagtaggaagcattcttttcacgagttagcggttgattgtgcaggagagcgtatatttcgcattggttcagttcgctacagaatggatccttccaggagaacacttcagaggatttcaggtgacgatgaatccctgtcctctgcatctacctgttcaggtttggcttccaaaagagcttacattccaaggagattagtgattggaaatgatgaatatgtccgaattggcaatggtaaccagcttatcagagacccaaagaaacgaactcgaaaattggcaaatgaaaaagttagatggagcttgcacactgccagacagcgattggcacgaaagcagaagtattgtcagttttttactagatttgggaaatgtaacaaggatggagggaagtgtccttatattcatgatccctcaaaaatcgctgtctgtactaagttcctgaatggtttatgttctactcccaactgcaaattgacacataaggttattccagagagaatgccagattgttcttacttcttgcaaggcttatgctcaaatagaaattgtccatatagacatgtcaatgtgaaccccaaggcatctatttgtgaaggatttctcaagggttattgtgctgatgggaatgagtgtcggaagaagcacagctatgtctgtcctacttttgaagaaacaggaacctgtactcaaggaaccaaatgtaaacttcatcaccccaaaaaacaaagcaagggaaagaaaaggaagagaactgcatatcaaaacaacagtagagggcgttattttggttctattcctgctaatgtttctgaatctgggatgatgttggctccaaagcgacatagacagagtggtgaacttgaagaggaactttctgactacatcagcctagatgatgtgaatgaagaagttttagacacggtcgatcaatcatttgagccagcaactttctgtgacaatgactccttggatttacagttggacgattttgatgaacttattaaaccagttcttctgttgaaaacaaagttcacaatgcaatcacctcagtttagtagcctccaagcttttaggcaagtggcggagagttag

SEQ ID NO: 30647 - DNA, 1140 bp, Glycine max
  Peptide Sequence Number=SeqID_147425
atgcaaaggcaaaggcaaagggtgtcactttcactttcagcttccattcaccatgacagcttgagagtgctcgaatgggacaagctttgcgacttggtcgcttccttcgcttgcacttccttgggccgtcaagccctcaaggaccaactatggtctctgaatcaaacttttgaggaaagtcttgcacttcttgaggaaaccaatgctgccgttgaaatgaacaagcatgggagtctcagattgcacttggggcaccttgatgctatgctagtcaaaactgccattcaacaagccagaagaagtataccggtgagtggctatgaggcatgggctattgtggctcttctgcagtgtgctgagaccttgccgggtgatctcaaggctgcaattaaggaagacaaagattggcataatcgtttcatgccacttacagaagtgataatggagtttgtcatcaatcgatctttaattaaagcgatagagcaagttgttgatgaagatggttctattaaggactctgcggtacaacagttaatagagagcataatcaggagtgaaaagagtgagacatcaatcctcgtaggcatagaattccttttcttaatgatggtatttattggaagtggatccggagtcggaagtactatagagccactgtctgctgttcctttaaatgatgagttgcagcgagcaagaagtttggtggtaaaggctgaagcagatgtgcttttgacattaaccaaaaagatgcagctggaccttgaagatattgaaaacacattgaacagtttggttgaactagatgtgatggtcagtaatgtggttcctatgcagattaatgcccgagctacttatggtctttcatttggatggtcaagtcctcatatatttctgccagataggggtagctcttctactgcagaagcattcttaccaaggaaggaaaatccctatggaccattacccagcaaaagggaatggatgttatatcttctaaaagcttatcctcctttattgctccagagacataaggagaaattgaggaaggccaaaaaggatgtcaatattgctgcttcagttaagtcacagatgacatgtgttgaatttgaaggtggaggaagatggataaagagaaaataa

SEQ ID NO: 30648 - DNA, 648 bp, Glycine max
  Peptide Sequence Number=SeqID_147426
atgaggagcagaggaggcaacaccacaacagttggagcttcgaagattacatcaacagtgcttgtctacaaccgtcaccaccaccaagccttccccgttatcgtcggcactctcctcggcgtaggagcaggcctcttatgggctgaacaaggtgctataatgacatcttatcctccaaccaatggaaaagcatcttcaacatgggtggagtcattggtgcatggcttgattcctttcatcttgaactaccatcgtagtgaggctgcttctgtcaatattggaacctacataggcttcatgtgcttcatattactggggacccttttgtcattagccatcttgcctgcatgcaaggttcttcgtgatgatggtagcaggtgcaccaacatgttgtactccaatgtttccaccgagtgtgtggaggttctcaagttgttttccaattggaaagtgcttcttatggttccagctgcttgggtttgggggatggtgggagttgtagtggttggtgttcttgggactgtgatttgggggggtggacttgctaatcagcttagctttgggttgctggatgccatgttccagagcttggtctattgggttattggagccctggctgatgattctaagcaggttatgatgaggtag

SEQ ID NO: 30649 - DNA, 609 bp, Glycine max
  Peptide Sequence Number=SeqID_147427
atgtcaggttaccatctggtcggttcatgtaatgggttgcactgtggggttagcgaaataccagaaggatactgtgtttgtttcttgaacaaggcgacaagggtgatatccagagaatcgccaatgctgtctttttccccgggcattggtcgtagaacaatgtttgggtttggctatgatccgtcaagtgacaaatacaaggttgtagcaattgcgttgactatgctctcacttgacgtatctgaaaagactgagaagaaagtttatggcgcgggtgacagtagttggagaaaccttaaaggttttcctgttctttggactttacctaaagttggtggagtgtatctgagtggaacccttaattgggttgttattatgggaaaagaaaccattcattctgaaatcgtaattatttctgttgacctagagaaggagacttgcatatcactgtttcttcccgacgatttttgcatttttgatacaaatattggagtttttagagactcactgtgcgtttggcaagatagcaacaccaatcttggcttgtggcagatgaggaagtttggagatgacaaaaaaatcgatgattttaccattgtgcatgtctaa

SEQ ID NO: 30650 - DNA, 1058 bp, Glycine max
  Peptide Sequence Number=SeqID_147428
aggatcccccggccgatacggtcggacagccagccgaagaagatgaagaacggcacgcccagcgccagcgcggccgcgatcagcaggtaggaggtggtggcatcgaccttcagcatgctgctgaggaagaacagcgcgtagaactggccgccgtaccagaccaccgcctggccggctgcagcgccgagcaggaccagcagcatcagcttcaggttgccgcccttcaggctgtcacggaacggggtcttggaacccttgccctcggacttcatctgctggaacagcggcgattcgctcagctgcaggcggatccacacggacacgcccagcagcaggatcgagaccaggaacggaatgcgccagccccaggcttcgaaggcttcgttgccgaggaaatagcggcaggccaggatgatcagcagcgacatgaacaggccgagcgtggccgtgcactggatgaagctggtgtacaggccgcgcttgtcgtccggcgcatgctcggccacgtaggtggcggcaccgccgtactcgccgcccatcgccaggccctgggccaggcgcaggatgatcaggatcaccggcgcggcgaagccgatcgaggcgtagttgggcagcacgccgaccaggaaggtcgagatgcccatgatcaggatggtgaccaggaaggtgtacttgcggccgatgcggtcgccgaggctgccgaagaaggccgcgccgaacggacgcacgaagaagccggcggcaaacgccaacagggcgaagatcatgcctgtggtttcattgacgccactgaagaactgcttggcgatgatggccgcgagcgagccgtacaggaagaagtcgtaccactcgaacaccgtgccgaggctcgaggcgaagatgaccttcttgtgacccttggtcagggtgcccgctttgtgtgcggtactgggtgtgctggacatggggcgttttccctcggtagatgccgaccttggtcggtactcaattcggtaggtaccggccgcgggccggcacgcaatctctataggtgccgaccttggtcggcactcctctag

SEQ ID NO: 30651 - DNA, 165 bp, Glycine max
  Peptide Sequence Number=SeqID_147429
atggcagaatcgtcaaagaaacgtaagggttcatccgcctccgtttcggcttcaagagctcatcgttccggagccactagcgcatccacagtaccaattccaccttcattatcctcttccacattgttttcttccgaagaacaccagaaacggacagcaccttaa

SEQ ID NO: 30652 - DNA, 937 bp, Glycine max
  Peptide Sequence Number=SeqID_147430
atggcacagaagattataaataaacacagcctgctagcttgggctgtgctatcaacactaggcagtagtgaagctgttttacaccagttgcaggcagcagagctcaataccaatgtgcctactgtcagtgaaacgggtggcttcccggtgcaaatcaacttgccagcccaacccttaaatcaatccatccgacaactggccaatcaaacaggcttaagtatctcgttcgatagcgaactcaccaaaaacaaaaccgccccagccgtgaagggttttttatcgccacaagcggctttaaaaaaagtacttcaaggcagcggattgcaactcaacatcagtggtgattcggctgtgatcaaacccgagccagaaaaaacctcccaatctctcaagctggatgctgtagaagttcgtgccaagcgtttttatgaagtagggccgctgcctggtttgggtttaaccaaagaagaaattcctggtaacgtacaaagcatttctgccaaagagattaaagaagcgcattcattgagtattacagacttgatgaaccgcaagctgcaatcggtcacagtgaacgattatcagggcaacccgttccagatggatgtgcagtaccgtggttttactgcagggccacaaattggcacgccgcaaggtctgagtgtgtttattgatggtattcgcgtcaatgaaccatttggtgatgtcgtgaactgggacatgctgccgatgaatgcattggcaagcgtggatgtgtttccaggctctaatcctatttttgggttgaatactctgggtggtgcattctcccttaaaaccaaagatggttttaataatgctggtgccgatgttgacatcctgacaggctcatttggtcgtaagcaactgcaactggaaggtggctggaacaacggcacagtgggattgttcgccgcag

SEQ ID NO: 30653 - DNA, 435 bp, Glycine max
  Peptide Sequence Number=SeqID_147431
atgtggatggaccgatttgctcttactttgaacggaagtcaagaacttccccgattgctagccaaggccaaagcagtggcgaacacctactctgctcccgaggagatccacagacttctcagctatttgcgaatcaagtcactccctcattttatctctagcatgcattgtatgttggtctcgtcctttgtcacgggaagccggaagaattgccattccttggattatagggttgaaccaagctcatgcttttacaaaaaggttcatcaagtcaagttgaaatatggaagtaaacgtcttgcaaaattggggcaaaagatgaatcgagtcacatcactgcttcgtctactgccaaagatatttaggattgttgatgtccttgttacttccagtttcaccttgacaaagatgtcatggaccatgttgaaaatctaa

SEQ ID NO: 30654 - DNA, 748 bp, Glycine max
  Peptide Sequence Number=SeqID_147432
gaagttccccgacgtggtgctgcgcttgccgctgctcaagtttctagatctgagattcaacgaattcgaaggtacggttcccaaggagctcttcgacaaggacctggacgcgattttcatcaatgacaaccgcttcgtcttcgacttaccggaaaatttcggaaactcgccggtgtcggtgattgtgctggcgaacaaccgcttccacggatgcgtgccggcgggaatcggcaagatgaaggggctgaacgagattattttgatgaacaacgcgttcaagtcgtgcttccctgcggagatagggttgctgcagaacttgacggtgttcgatgtgagcttcaaccagttgctggggcctttgcctgatgctattggtggtgcggtgagtttggagcagttgaatgtggcgcataacttactttcggggaagattccagagagcatttgtaagcttccgaatctgcagaactttacttactcttataacttcttcactggcgagccgccaagatgtctcgctttgccggcgtttgatgaccgccgcaactgccttccggccaggcctgcccagcgctccgctgggcaatgtaagtcgtttttgtcgcaccctgtcgattgtaattcgtttaggtgtaagccttttgtgccttcattgcctcctcctcctcctccctcaccaccattgccatcgccgcctccgccgtcgcctgtttacattcctcattcccctccaccacccccaccgccg

SEQ ID NO: 30655 - DNA, 291 bp, Glycine max
  Peptide Sequence Number=SeqID_147433
atggatatgctagttgatgctgaggtatatcttattcagacatcttcaaaaatgaatatctcggtttctgattccaatcattctgctcaacatgaatctcaatccctgtctgtgacagcagaccatgatccattgcttggactccccttgacgcctacaaagcggcagacatttcaagattgtgatgatgaagcagggacctctcaaatttcacctgcacagctttcatccaaaaaattaaaaaaaacatggcgcaatttagtgcatttggttgttttcaagttgtgttga

SEQ ID NO: 30656 - DNA, 276 bp, Glycine max
  Peptide Sequence Number=SeqID_147434
atggaatgcccagggctcctccacgataagcacacgttgcgttcgagtcgtatcctcagaaaaatggaggttgaggaaccttggttggggctttttgctgcaaaattcctttttgttggtgtttttttggtttgtgctaaaggtggtcttcgtcattggaataatgacattgttgggtttggtgggaaacttggccgtataggaatggcagtcacagcatgggtttctccctctttctcaccctcttcatttgccccagttttctcagtcgtccta

SEQ ID NO: 30657 - DNA, 399 bp, Glycine max
  Peptide Sequence Number=SeqID_147435
atggctgagaagacaaataaaatactggaagaagctgcccagtccggaagcactgagggcatcattgaccctccatctcccatcagacgccacgtgaagtggaagctggcccgcaccaagaaaactgggcagatgacgattctttggatgagcaggcgtcacagggatcgttcgtccccccatggatgtcaagatgtcctaactgctgccattgggcaaccagagcaccctggccgggtccgtgccgctggagccggtgtcaccataaagcaatacttcggatcggctccacgaatgtcgtgtagttcttcctctatgcttcctgaagacctacagcagctgacccaagaaatcagggacctgcttgatgagtcgatcacaaaaaatgtgactcgatag

SEQ ID NO: 30658 - DNA, 222 bp, Glycine max
  Peptide Sequence Number=SeqID_147436
atggtggtcatcctgcccaaggaacacttagttgtctggttctgttcattgcataacaggccagacaactaccttaaggggattattaatagtgctatcaagggtcttgatgatgctccacagcctaaatcaaaggctcctgctaggtggattgtcgtcaagtattttaacgaccctagaccattggagcctgagagattaaaagcattgtggattcagtag

SEQ ID NO: 30659 - DNA, 529 bp, Glycine max
  Peptide Sequence Number=SeqID_147437
atggggacgaggggttgcatcagctacaatcccgttcttgctataagacaacttggctaccctatgagaggggcgccactagaggatgagctcgcgcctgtcatttcacgaggcttcaataagaccaacgtggagacacttcagaaggtccgcaaggcatgggaggtgttgcaaaagaaggacaaggaactcaggggtagtaacaatgggcccattggtggctatcgtaagtggttaaaagcccacgtgcaaggtttggattggcttccgagtttgagaaccgctaaaagagaggaagttgaggcaccagaggaagacgaagaagtgcaggccctcagggcggaactcgagcaagcccaaacagttaaagaaaggttcaagtcagcagctctgaaaatccaaaaggagaatactgaactgagagatataaatgtggctaccaccaaagccttggaacgagaaaccaagagggcttgtagggaagaacacggccgaaacaaattccgaggggctctgtggggcagcaata

SEQ ID NO: 30660 - DNA, 279 bp, Glycine max
  Peptide Sequence Number=SeqID_147438
atggcctcctatggtgggatcgcgcccccaagacacccagtggacctagagaagtccaacagggccctagtgcccgtctcccccagcaaggtcatcaggccccctattaacaaggacttcatcaagaagtactgcgcccctaggcaggcgaagggcgaggcaccacagcagcctggggacggccagcagtgggcgacaaacgcaccgccaccacctccagtatccacctcagctcatctacagaggctagagcgttgcctacgacacatggccaattag

SEQ ID NO: 30661 - DNA, 681 bp, Glycine max
  Peptide Sequence Number=SeqID_147439
atggcctctaccacatgtttgtttcgtcatctattattcaccatgttacagggttgttactgcttaactgttggaacagttgacgaaatcattattgatgctccatggagttatgacagttgtcctaactgtaaaacgacatttgatccatcaaaaggtggctccgcttgtcgttcttgccataccagtgtggtcgatacagtaccacggttagccatgatcattttttgtactgattatttatttacacgctttgctgttttagcaaatttccctgaaatttctatggatgtcaaggatgcaacatgtatcaagctgtttggtaaaactgttggagaatgtcgagatgagttgatagcggctggggatgatattaaggtatttccaacgtgtgttgatgaaatcctgttgaaaacttgggctgtcagatttaagtttcgttcacaattacgccaatcatctgtgttggatgtgagtgaagaactccatcatattcaatcattgataaccacccttgggttgaagccatcattgtcacagtcttctgattacgatcctggaaactctacctgtttaactccaaccaaaatgattagttgtcaacaaaccaattctgatttcgattctgatgagcacgcacagtatcagttatcaactaacaaacatatcaaggctgagtaa

SEQ ID NO: 30662 - DNA, 453 bp, Glycine max
  Peptide Sequence Number=SeqID_147440
atggcaagacacaaggtcacacgcacacacacacacacacactcacgcaggcacaagggggaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctaacccggattctgacttagaggcgttcagtcataatccaacgcacggtagcttcgcgccactggcttttcaacccagcgcgatgaccaattgtgcgaatcatcggttcctctcgtactag

SEQ ID NO: 30663 - DNA, 252 bp, Glycine max
  Peptide Sequence Number=SeqID_147441
atggaggagttgattacaaaacacaactctctctccctaaataatgccaacgtcatcacgtcggctcctcaccagaatcttactccttgcaccctgctactgtcattatgctcccacgaacaaggttcgcgatcatcacaggaaaccatgcagagttcgtcgagaccacctggttgtgcacgtaattgcccccccataggtgatcagcctggggaccaaaggagttccctaccaggtgacacgcccccttag

SEQ ID NO: 30664 - DNA, 231 bp, Glycine max
  Peptide Sequence Number=SeqID_147442
atgaaatcatacggaagtcccggaccggtcgatgctccccatatgggatccaacagacatccggaatccggagtcgatccaggcgctccctgtacgtcggtgtacgtatgctcttcacggtcttcttcgtggcaattcacctacaggcacgcggtgaatcctcgtcgtagtcctgatcagcagtggactctgcgactgagggaaagtgctcgtatatccaacactacaaag

SEQ ID NO: 30665 - DNA, 252 bp, Glycine max
  Peptide Sequence Number=SeqID_147443
atggaggttgatgaaccttggctggggttatggctaccattaaattatcaagcagatatgggagcaagtcagcataggacactgaaattgggtgcggtaggtaggctgtggttgattttagggatggccattgtggatgactgggtggtgggtaatgagaaggggattttctatttaggaacgacagtcgcagcatgggtctctccttcattctcaccctcttcatttgccccagttttctcattcgtctaa

SEQ ID NO: 30666 - DNA, 158 bp, Glycine max
  Peptide Sequence Number=SeqID_147444
atggcttataccgccatcttattggttggtttaggtccagctcacactactgaaaaaacagtaggatcggcgatatccgaaacaggtaaccttacagcttgcttaggtgcaagcaatctcaatgcaatgagagagggagtctccggttccatgaaagg

SEQ ID NO: 30667 - DNA, 207 bp, Glycine max
  Peptide Sequence Number=SeqID_147445
atgtggtatttatggtgccaattctgcagaatggattatgagcatgcaggtgttggggctatagagtttattatatgccattcagaggtctcaattgcacttgcagaagagaagaagatacctgaggttctcctatctaaaccctcttttttttatagcagtttaattgttaggaaggatttgagagttgtgtacaatcttttgtaa

SEQ ID NO: 30668 - DNA, 390 bp, Glycine max
  Peptide Sequence Number=SeqID_147446
atgagtgaaatagaggaggtgcaagagcagatgaaggccgacatagaggccatgaaagagcaaatgaccacaatgatggaaggcatgatgagtatgagaaaaatgatggaggttaacatggctacagtcattaccgcaagtaccaccactaaggtggacccgactcttccatctggcctcaaccaagcacaggtccctcaacctatgggggagacacatgaagtaccccgagaccaccctctagccgactctgagccttccctcggatatgccactgaggggcaatcgtttagtggcatacccttgccaaacactttgggggcctttagtatcgcccataaccataacccttacattttatggtataaagactgcctcctaccatggtag

SEQ ID NO: 30669 - DNA, 198 bp, Glycine max
  Peptide Sequence Number=SeqID_147447
atggcaaagttgtgcttagtgctcgacatggtcattcctctaaagtgcaaggtaccggacttcgataagtacaaggggactacttgccccaagaatcacttgaagatgtactgtaggaaaatgggggcatacacaaaagatgaaaattttttgatgcttgtgaattctgacatttgtcaagtgacatcacaatgctaa

SEQ ID NO: 30670 - DNA, 309 bp, Glycine max
  Peptide Sequence Number=SeqID_147448
atgaaagtcccacagcccaagtaccatagcatgtggaggataagtcatttgaggccaccattccagagccattcattagaggggaggaggaaggttgaagccactttagagcctcctgcaccagtggaggacctatcatcgcctcaacatgcaacagacccctccactcctatcctagacatacctgaggacccgactacaccagtcctgactttgaacacttctcctccagcaactctagtgcttcatctaacaaatgaggaggatgttcagacacacgatattcaggaccagtcacaggaattttaa

SEQ ID NO: 30671 - DNA, 333 bp, Glycine max
  Peptide Sequence Number=SeqID_147449
atggatatagttgaacaagaaaatcagagtctcagggaggaggttgccactttacgagagggaatggataggttgacgaccatgatgagtgcactcctgtcggcccagaactctcaagctgccgccgttgctgtagagcagcctttggtgagcacaaccccgttatctacagtgacttctccacccctctttttgcctccaggttgtacatggggaatgccatctccagtctgtggaagcccccagcccgctgtatctgaagttccacctccttttgctcagcagtcagcaccgattccgcaacccaatacctctttccctcaagctgcttag

SEQ ID NO: 30672 - DNA, 324 bp, Glycine max
  Peptide Sequence Number=SeqID_147450
gagaaatatcaacatcgtcaagatgaaatcttacaacattcgacaaaggaaggcacatctacacgtgattcccctaacactgctacttttgttaatgataatgaaatatatttgaatgctgatggaggtccaaattacaaggggaatgtgtacgagctaggtactttgagcaaaaggtttagttgctcaaaatcagctccatctacttctattgcacccgtggaagaccaaatagagaaaatgcgtgagacaattaataaattgaatgttgagcttttagcaaaggcaaataaggagaaaatacttgaggaaaagatgttgtag

SEQ ID NO: 30673 - DNA, 639 bp, Glycine max
  Peptide Sequence Number=SeqID_147451
gctactccacctgcctcgcctcctcctcctcttcctcctcctcctgtagacgctgatgcgtctccatctacgttgaagcggacacgcaaggcgacacggctacgatcattagccactagaccacctagggcagaaagacctgtggtcaatgtcgatcctactaccggcaaggtcgacggtccccacaagaagaaattaagaacatatttggggattgtcgctcgtgataaggtcgacgtgacatatgacacctggaaggaagtcgctactgctcagaaggatttgatatgggaggatattcagtatgacaaagaagaaattcttcagattgtcggcgagcgctggaggcagtttaaatctgacttgactaggaaatgggcacttgcagtcgacaaggacggtgtggacgacattgtctgtgaaaaatatggcattagcaaggagaaatggactcagttttgtcagacccgcagagacccctcatgggaggatgtacgaaaaaaggcacaggcctcccagaagcaaaacactgccccccacgtattgtctcgtgggggttatgaatatttagaagaaaagctcatggctgagaaagacaaagaaaagactggaagaagctgcccagtctggaagcactga

SEQ ID NO: 30674 - DNA, 228 bp, Glycine max
  Peptide Sequence Number=SeqID_147452
atgtgtaaccgtatattaatgatatttacggtcgtgggaaccagaccgaggcttgagccgtccaatacggaggagagagacagagaggatttagattttagactgatgcatccatttctcacagtcacgcgcgaggccaaggcgcgtgaaataatcaccccgtgtaaacgagtgcaagtttcagaaaccctgcaggaatgtccacgtggctccatctgtggaacgtga

SEQ ID NO: 30675 - DNA, 357 bp, Glycine max
  Peptide Sequence Number=SeqID_147453
atggcagaacaagctaaacaagtattttatgttcaagacccttgtgatgaaaggtggcaaatgactacaccacctaggtctcctcctttttctcctcctcctcctattgatgcaacatcacattcccctcctaccttaaagcggacaagaaaagccataggcttgagatcattagctgctactagaccagttggggcagagagacccctggtccatgtggatcctacaatcgggaaagccgacggtccccatagaaagaagttaagaacatatttggggattatcgctcgtgataaggtggatgtgacatatgagaattggaaacaagtccctattgcacaaaaggatttgatatag

SEQ ID NO: 30676 - DNA, 456 bp, Glycine max
  Peptide Sequence Number=SeqID_147454
atgttggtgcgcatgatgcgcactcgtctctttacagcggcacgggtgaaatcttgcctcggtatacatagtagctgcatgatagcctccctctctggttgtgctcgcacagttggtcgtcctccaatatcagggggtagcccaagaactgataaaaggaaacggaccttaaattttcttaaggcgcagatgtggagccctctgaaagtgaggatgcgtagccctctaaaggcgagggcgtgcagtcctctgaaggtgaaggcgtgcagccccttgatggtgagggcatgcagccctctgatggcgaggacgacgaggacgtgtagtcctctaaaggtgagggcgtgcatccctctaaaggtgaggacgtgtagtcctctaatggcgaggacgtgtagtcctctaaaggtgagggcgtgcagccctttgaaggcaagggcgtgcaaccctctaaag

SEQ ID NO: 30677 - DNA, 398 bp, Glycine max
  Peptide Sequence Number=SeqID_147455
atggagaagaaagtagaaaaaagttattatggaaatgggtttaagcagtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggacagtgtgatgactgtggtggcgaaccctaggcagttcaagatcccaaactggtttttgaacagaaagaaggattacaaggatggcaaatactctcaagttgtgtctaatgctcttgatatgaagctcagggatgatctcgagagactcaagaaaatcag

SEQ ID NO: 30678 - DNA, 459 bp, Glycine max
  Peptide Sequence Number=SeqID_147456
atgtcggcttcccaatttggaggggagtgtgcttattgcaactctttggctgttgaagagagtgaatatgcttttatggatgttgttgaatctgattctcttgaaattggttctactaatgttgattcagattcctttgaaatggaacttgacatggatgatgagatgactacactttcaatgatgaagaacaagcaagaaaaacaacagaaaatgcagcagacaagaaatgtcatacacaccgaattgtgcagcaaaggtgaaagagagaagaataagaaagaacacacacaggattacgtggttcaccttgagaaaggctacatccacggaagggaaaaacagaaagcttttattatagttgcagtatacaagtggaagcttattctatctttgaaatacaggacatccttgccttatataggcagaagacaaaacaaaaaaaaaataacagaataa

SEQ ID NO: 30679 - DNA, 273 bp, Glycine max
  Peptide Sequence Number=SeqID_147457
atgcagaaatcaaagagggatgtgtatctagcagcctacttgaatggtgcatcttggcaaatgatcaccattttgcctaaggaaaatgttttgattaggttttgttcgttgcataataggccagacaactacctcaaaggaataattaatagtgctttgaaaggacttgatgatactgcacaaagtaaatccaaggctgctgctaggtggattgttgttaaatgtaatagacaaaaaggaagcattgagtgtgggtattacgtcatgcactag

SEQ ID NO: 30680 - DNA, 495 bp, Glycine max
  Peptide Sequence Number=SeqID_147458
atgtcttgtctgtccaattctgttcgtgaaggtttggaacattgcatcacatcccctgttggaactgagaggaacccacttatagttggtgatgagatttttctttctagatcaatgacaggaaagagggaattccctaggcaggacacaatattggacaggctgtctgagagggcgaagcaactgattactaacctagtgaagatacaaaatgatggcactgttgaagttgatatagaaatgagtgcatatgttgctccagaattgttagagctccaatcttttgtcgagtcaacagagtatggtcatcatgttaggctggcaactcatgataatttcaaaacatttgtgaagtcagctggtgtagatttctatcctctgggtggcgatcctcgtgtattggcaggattcttctggtattttgtgcttaacttgactatagcaggatgtaagaggttcctttatattggttcacctattaaaaatggtatttag

SEQ ID NO: 30681 - DNA, 1015 bp, Glycine max
  Peptide Sequence Number=SeqID_147459
atggcaaggaataaaggtttaatcccttctggaccagctgaaatatctgtccaacgaaagcagctgaaggccatcattgattcccttcttccagcatgcacagcacctgatatggaaactggtgttcctttcaaagctcaagctattattgccaatcctcctgcttatggacatgtacatgttgctgaggcccttggggtgcccctccatatcttcttcacaatgccatggacgaaaacaacactgaagcttgctcctattgcatacttcagtatgtaccgtggatcaatatctcatttaccgactagctacatgtggagtcctcatgttgttcccaaaccaagtgactggggccctttagttgatgttgttggttattgtttcttgagccttgcatcaaagtatcaaccccaggaagattttgtccaatggattcaaaaaggaccacctcctttatattttgggtttgggagcatgcctcttgaagatcctaaaggaacaacagatgttatattggaggcactaaaagatacagaacaacggggaattattgaccggggttggggcaatctagggaacttggcagaactttctgacaatgttttccttctggaggaatgccctcatgattggctgtttcctcaatgttctgctgtggtgcatcatggtggagctggaaccacggctaccggattaaaagctgggttcttttggggagatagaatatatgagaaagaattgggaccagccccaatcccaatatctcagctcaatgttgagaatttatcaaatgccataagattcatgctccagccagaggtgaaatctctagcaatggaaattgctaagttgattgagaatgaagatggtgttgccgctgcggttgatgcattccatcgacatctgcctgatgagctgccactgccaactcctattccagtggaggaggaccacttgaatcctttgcagtggttttttctccaacttggaaggttctgttgtgcaccttgtggtg

SEQ ID NO: 30682 - DNA, 261 bp, Glycine max
  Peptide Sequence Number=SeqID_147460
atgagggcaggaccaatagcatttgaccaagataggaggagcaaagcaagaattgaaaagttgataggtttttttgtaacaaaaaaagagttggcacagagacccaccaatcatgaaagcactgtaagaacgtttggtaaacctaaagttcaaaccatttttccaatccagttcatgggtgtagttcacgttgctcacgagaagctgacccatctctactgcaactacattctttctttcactggcaaagctcaaatttaa

SEQ ID NO: 30683 - DNA, 1071 bp, Glycine max
  Peptide Sequence Number=SeqID_147461
atgttggcaaaattaagagcttggaaaaccagttctcaagatgtgaaggaacgtagagatgacccaaaaagcatcaacttccatgaggagtacaatagtgtattaaggacaaaatcctatgttaatttcttcaataaagttcaattacttgcaaaccaaccttcctctaatgacaaccataacaaattttcagaaatcctccttgaaccttgccaagaaactataacttccattcttgattcagcaaccctttcaatgacaccagaactcaaaaacctcatgctcagttactttgacattagtgcagaggcctcacagatttgctgtcatcttctcaaaagcatcaaccaactccactccaattatcagtttattcaaagggcactagacattatggatggcgactctttggaaacttttgacctaatcaccttcgggcttaactcattcaattactcaaataaccctttttcaaaccttaaaaaccatgacttcaagctcatcactgataagctctcatcaatattgcaccatctaaagtcaatgagaaaaaaagtgggaaggaaaattaagcttatgaagtatttgaagaatacatctgaggtttgtgtcacagcagcttgtggcatagtggcaatcacagccatggttatagcagcacatactctaacagcagttattatgggaccagcaattcttagttttccatttaagcattttaagaggaagcttagagcctatgaattttcaggaaaagggtctcagagtaaagtttatgatcagcttggtatagcagcaaagggaacttatatattgaatagagactttgacacaatgagtagacttgtagctaggcttcatgatgaaattgagcatagcagggcaatggtgcaattatgtttggacaggaaagaggacaaattctctttgcaggtggtgaaggagcttaagaaaagtgatgttcggttcaggaaacaagtggaagaacttgaagaacatgcgtgcttgtgccttgtagcaataaaccaggcaaggaccttggtagttaaggaaattaaaagatcgatgtga

SEQ ID NO: 30684 - DNA, 477 bp, Glycine max
  Peptide Sequence Number=SeqID_147462
atgcacttccccattctctttctcttccttctaccttcactcttcaagttttcatattcagccacaattctagtagacggatcttcagagtggaagaaccccactgtttccatcggtgactccatcattttcaagcacaagcaacactacaacctctacattttcaagaacgagaaagccttcaagctctgcaacatcactcaagccactcttctcaccaacccctacacgtggcatccatctcggcctggtttcttctacttcaccttccataatgggtcactgaaagcgtgccaagattctcaaaagctagccatagaggtaacttcttcagcaatggctccagaagtttctccggctccttcttctggtggagaggtaccatcttctccttcgtttccatggccttttcatccaggacaagaagcttcttcacctggtcctgcaccacaagcacaagcacaagcaagttcgccg

SEQ ID NO: 30685 - DNA, 282 bp, Glycine max
  Peptide Sequence Number=SeqID_147463
atgggtatcggaattcagtctctaaatctgtcatttccgatttctattgtctcaacacatgctactgtgcttgttttcattgctagcatgcttgcatttggaatgtttcttcgaccattttgggttgcaaaaaacccacattttttactgaatgttcccaaaacaggggatgctgagaggaaaaagaagaggtacaagcagctaatggaaaaagtactccctattgcgcagaagcaaaagccaccatgtatactccgtagggctcgctccttgcaatggtag

SEQ ID NO: 30686 - DNA, 267 bp, Glycine max
  Peptide Sequence Number=SeqID_147464
atggaggagcacgtgccagcattgcacactgctatcaacgctgtgaaggcattaggtagaggctttgatgtgaactgcgatacgaggttgctgtattgcaaaggagtggcagggtccagggtggtccatgttgatgaagaacacgtgagggacttgtggttgtacgatgatgtggttgttcccaatgtttcaatggacattgttaagaactctcaggagcatgtggggcgtcgcagttctggagtctgtagttaccaggagggttga

SEQ ID NO: 30687 - DNA, 144 bp, Glycine max
  Peptide Sequence Number=SeqID_147465
atggcccgaaatctttatggcctggcagcaacttgggcccaagtacgtctcaccgttgaggaagaacattacgacctcaccaacatttttctgactcaacatctagcttcaaccgtgcaacaaggctcgtattggatgatgatg

SEQ ID NO: 30688 - DNA, 4647 bp, Glycine max
  Peptide Sequence Number=SeqID_147466
atgggtgttccctgtgaatgtgatgggtacccgaggggtcacataacaggaatgagtttgttctcatcaatgctgatgaaactgcaagagtgggtgaatgctgttacagaattgagtggacaaatttgtcagatctgtggggatgagatagaggttactgttgatggtgaaccatttgttgcttgcaatgaatgtgcattccctgtgtgtagaccttgctatgagtatgaaaggagagagggaaacaaaatttgccctcagtgcaaaaccatatacaagcgcctaaagggtgagggtgatgaggaagaagaggacattgatgatttggaaaatgagtttgacattggaagcaatatcaggcatgaccctcatcacgttgctgaggccttgctctcggctcgcctcaatgctgcccgtggttcacaaatgaacgctccagggatcaccacaccatcagagtttgatgcagcttctgtggcggctgatattcctctcctgacatatgatcacgaggatgttgggatttctgctgataaacatgctttaattattcccccattcatgcatcatgggaaacgggttcatccaatgcctcctgattcatctgtgccagttcaacccagacctatggatcctaaaaaagatttagcagtttatggatatggaagtgtcgcatggaaggaacgaatggaggaatggaagaaaaggcagaatgaaaaaattgaggtggttaagcatgaagggggtaatgatggtgggaaaaatggtgatgagcttgatgatccagatttgccaaaaatggatgaaggcagacagccactgtggaggaagttgccaattagcccaagcaagattaatccctatcgaattataatagtactccggattgctgttcttggtctctttttccattatagaattctccacccggtcaatgatgcatatgcattgtggctaacatcagtaatatgtgaaatctggtttgctgtgtcttggattttggatcagtttcccaaatggtgcccaattgagagagaaacataccttgatcgtttgtcatcgaggtatgagaaagaaggaaagccatctgaattagctgatatagacgtttttgttagtacagtagatcctatgaaagaacctccacttataactgcaaatacagtactatccatccttgctgtagattatccagtggagaaagtttcatgttatgtctcagatgatggtgcagctatgctgacatttgaagccatttcagagacttcagagtttgcaagaaagtgggttccgttctgtaagaagttcaacattgaacctcgggctcctgagtggtattttgctcaaaaggttgactatctgaaagacaaagtggatgcaacattcatcagggagcgtcgtgctattaagagggagtatgaagagttcaaagtgcgtatcaatgcattggttgcaatggcacaaaaggttcctgaggatggctggacaatgcaggatgggactccgtggcccgggaacagtgtcagagatcatcctggaatgattcaggttttccttggtcaaaatggtattcataatattgaagggaatgagttacctcgtcttgtctatgtgtcacgtgagaaaagaccaggatatgaacaccacaaaaaagctggtgctatgaatgccttagtgcgagtctcagcagtcatatcaaatgctccttacctactcaatgttgattgtgatcactacataaacaacagcaaagcacttcgtgaagccatgtgcttcatgatggatcctacatcagggaaaaaaatatgctatgtacaatttcctcaaagatttgatgggattgatcgtcatgatagatactcaaatagaaatgttgtattctttgatataaacatgaaaggtttagatggcatccaaggaccaatatatgtgggaactgggtgtgtctttaggcggcaggcgctctatggatatgatgcccctgctacgaagaaaccaccaaggaaaacctgtaactgttggcccaaatggtgctgcctgtgttgtggatctaggaacaagaataggaaagtgaagtcaggtccaagaaagaaaataaaaaacaaggatgctacaaagcaaatacatgcactagaaaatattgaagagggaattgaaggtgagacttattgcgttcctcttgaaatcccaatcacaggaattgacagtgagaagtcatggttaatgtcacaactaaaatttgagaaaaaatttgggcaatcagctgttttcatagcctcaacacttatggaagatgggggtattctaaaaggagcaacttctgcatcactcttgaaagaagccattcatgtcatcagttgtggttatgaagataagacagagtgggggaaagaggttggatggatatatggttctgttacagaagatatattaacaggtttcaagatgcactgtcatggttggcgatccgtgtactgcatgcctaaaaggcctgcttttaagggttctgctcccataaatctttcagatcgtctgcatcaagttctccgttgggcacttggatctgttgagatcctgttgagtaagcattgtcctatatggtatggatatggttgtggcttgaaatggctggagcgtttttcttacataaactcggtcatttatcctttgacatcacttcccttaattgcctattgcaccttgccggctgtctgtcttctcactggaaagttcatagtccctgagattagcaactatgccagtatcattttcatggcactcttcatctccatagctgtgactagcatccttgaaatgcagtggggaggtgttggcatacatgactggtggaggaatgagcagttctgggtcattggtggtgcctcctcacacctctttgctctcttccagggtttgctcaaggttctggcaggagttaacacaaacttcacagtcacatcaaaagctgcggacggcggagactttgctgaactctacctcttcaagtggacatcattgttgatccctcctttgaccttgctcatcataaacataataggagttattgtaggtgtttcagatgcaataaacaacggctatgattcatggggtcccctatttggtaagctattttttgctctttgggtcattgtccatctttaccccttcctcaagggagtcatgggaaaacaggaaggtgttcccaccatcattttggtttgggctattcttctggcttcaatcttctcacttctgtgggtgaggatcaacccatttttgtcaaaaggtggcattgtgttggaactttgtggcttgaattacatccgtgcatgcagtagagtgtctattggtgataggcattgctgccaaaagggcaattgtagtgtagagggccgcaagttggaaattttgaaaattgaaaagagagagaaaatagcagcagggatacatgggacatggcgaatcaggaggagaaggatgtctcacaggaagttcgagcacccaaggcacggttcactgggatttcttcccaggaagcgtgctgctcgtcacaggggaaaagtgaaggcattccccaaggatgacccatccaaggcacccaagctcactgcattcttgggttacaaggccggtatgactcacattgttagagaggtcgagaagccaggatcaaagcttcacaagaaggaaacttgtgagcctgttacaattattgagacccctccaatggttattgttggtgttgtgggttatgtgaaaactccacgtggtctccgaacattgaacactgtctgggctcagcatttgagtgaggaattgaaacgtaggttctacaagaactggtgcaagtccaagaagaaggccttcaccaagtactctaagcagtatgaaactgaggagggaaagaaaaacattgaggcgcagctggagaaactgaagaagtatgctactgtggttcgtgttttggctcacactcagatcaggaaaatgaaagggttgaagcagaagaaagcccatatcatggaaattcaggttaatggtggtagtattgcacaaaaggtggactttgcatacagtttctttgagaaacaggttcctattgatgcagtgttccagaaggatgagatgattgacatcattggtgtgaccaagggtaaaggttatgagggtgttgtcactcgttggggtgttacccgccttccccgtaagactcacagaggtttgaggaaggttgcttgtattggtgcctggcatcctgcaagagtttcattcactgttgccagggctggtcagaatggataccaccaccgaactgagttgaacaagaaggtttacaagcttggcaaagctggagatgaatctcactctgctcttactgagtttgataggaccgagaaagacattaccccaatgggtggtttccctcactatggtgttgttaaggatgattttatcatggtcaagggatgctgtgttggtcccaagaagagggtcattacattgcgtcaatccctccttaagcagacttctcgtgttgctcttgaggagatcaaactcaagtttatcgatacctcttcaaagtttgggcatggtcgcttccagaccacacaggagaagcagaagttctttggacgcctcaaagcataa

SEQ ID NO: 30689 - DNA, 960 bp, Glycine max
  Peptide Sequence Number=SeqID_147467
atggtgtatcgacctttgcaagcctatgctcaggttgatcttagcgttcttccattttgcacatcatctccagtgatcgtgtttctgtgcccctgggtgaaaaaattctggtttggtggccaaggacaggctttcaggctctcatccagtatcaatcacgtcagagtgctgttgcagcaagaagtacacttcagggacttcacaaacccaaatctccccacagagcagaaaggcagaccttcacaacctggatatggtgatgcaggaaacatgtatgctgcccagggttcaggagccagggcagttggatttccacagatggcaaatgctgcagccattgcagctgcctttgggggaggtctgcctcctggaataactgggacaaatgacaggtgtacagttcttgtatcaaatcttaatcctgatagaattgatgaggataaactattcaacttgttctctatttatgggaacattatgagaattaaacttctccgaaataagccagatcatgcacttatccagatgggagatggttttcaagcaaaactggctgtacactttctgaggggagccatgttgtttgagaaacgattagaggtcaacttctccaagcatccaaaaataaccccaggtgctgacacacatgaatacatcagttcaaatctcaatcgtttcaaccgtaatgcagccaaaaactatcggtattgctgccccccaacaaagatgattcatttgtccacacttccactagacatcactgaagaggagattgtgagccttgtagaggaacatggaatcattgtcaacagcaaagtcttcgagatgaacgggaaaaagcaggctctggttcagtttgaaaatgaggagcaggctactgaagcccttgtgtgcaagcatgcaagtacactttctggctcagtaatccgtatctccttttcgcagttacagaatatatga

SEQ ID NO: 30690 - DNA, 183 bp, Glycine max
  Peptide Sequence Number=SeqID_147468
atggcattacttttctcagttgaaggtttgctgaagagtgacgagctaggaatctacattgatgtcacaaaaactcaattttacaactcaacttggatcctgatgcttgttctatcgtgcatgggtgggggacaaataatatctatgatagatgagtttcatgctgggaagaggaacagctaa

SEQ ID NO: 30691 - DNA, 450 bp, Glycine max
  Peptide Sequence Number=SeqID_147469
atggacccagaaaaagaatatgatgttcttggtttacttttttcttttggatacagtaagggaagaaaacaagacaaaccgagaggaaactacactactgcaagaagatcccgaaagtatcaaaaagggattgcaggaagtaaaagccatattttcttcgagaagcgcatataccagctgagttatcggaagttgaagcccaatgagtggcaaacaccaatagagcctttgaatggccttttctccaacctttgggtcacctatagaaaagaagaaccttcttcttctgaagaagctaccggaagaagttcttccggtaacttctccggaagaaggttcttctggatgaacaatttgttctaccggaagaaccttcttccagtagcttctccgaaagaaagttcttccgatagaacaaattgtttatccagaagaaccttcttccgatag

SEQ ID NO: 30692 - DNA, 844 bp, Glycine max
  Peptide Sequence Number=SeqID_147470
atggagcttggagacactaccacagtgatggaaacgtcgtccggtgaggctgtggcggcgcatggcggtggcgaggtgattatgatggatgcgaattccggtgaagaagagaataataatcataataataaaggaaaattagaagagggtggtggagaagaagaagaaggtgacaataagatcaacaactcatgcggtggaaacagatggccccgccaagaaactttggctctcttgaagataaggtccgatatggatgttgtgtttcgagattcaagtcttaagggtccactttgggaagaagttgcaaggaaactatcagaactgggttaccaccgaagcgctaagaagtgcaaggagaaattcgagaatgtgtacaagtaccacaaaagaaccaaagagggcagaagtgggaaacacgagggaaaaacctacaaattttttgatcaattacaagctcttgagaatcaattcacagtctcttcttactcgccaaaaccacaacccactttggcaacagcaacaacaacaacaaacacaataacattaccacccccaaccaggccaagtgccataacaccaatctcttatgtcaccaccactgttccgtccacaaaccctacaatcatatctccttcaccaccacaaccaccaaccaatgccaccacgacaaccacaatcacttctccaacagtagtaaccaaccctagaaaccctccacaacccaacaacaacaacaacagcaataacatcccttactctttgcccaacatgaacaacctcttctcaacaacttcaacttcttcttccacggcctcggatgaggacttggaagagaagtacc

SEQ ID NO: 30693 - DNA, 198 bp, Glycine max
  Peptide Sequence Number=SeqID_147471
atgattgtcactgttaccgctaccataacgaccatcgtcgtcactaccataaccaccatcgtcgtcactaccatcaccattgttgcgttgccaccactgtcatgtggtcatgttgatggtgacgacggtggtcatgatggtgatcacgatagcggtggtgacaacaacacggtagtggtgatgatgattttgacataa

SEQ ID NO: 30694 - DNA, 393 bp, Glycine max
  Peptide Sequence Number=SeqID_147472
atgggtgccatggatgattccaatccttttctcatacaacccagtgataatcctggattgagtcttgtgactcatcctctatctgacgagaattataattcttggaagaaagccatcaagatggcacttcttggaaagaataagtttggttttgtggacgattctttctatggaccctttcccccttattactcgcattttttctctagtggttcaagaagaaaaacagagagaattggtgcttctatttctgctttcaactctacgaatgatgtttcacagtctcatgcctttgctgtcaaggactccaaatatcagtctgaccacaagtttaatgccaattccaagaatcgacccctctgtgcacattgtggtcgactatgccatacttaa

SEQ ID NO: 30695 - DNA, 576 bp, Glycine max
  Peptide Sequence Number=SeqID_147473
atgcggctcgtgactcgtgacgtaagtgggtggcacccctatgtgactgtggaaaggttgaagtgggggaatgatttcttgaagaagaggttggagtctggttcacactcccaggttagtcctcaggcattggagagcatgaaaagggttaagaaattgactatgatgtctgagaaagttgccactggtgtgctctctggggttgtcaaggtgtccggattcttcacaagttctgtggtcaactccaaagctggaaagaagttctttagccttcttccaggggaaatcgtccttgctaccatggatggattcaataaggttttggatgctgcagaagtagctggaaggaatgtcatgtccacttcatcagttgtgaccaccggcctagtttcagataaatatggagaggaagcagcacaggttacaaatgaaggccttgatgcagcagggcatgcgattgggacagcttgggccgtgttcaaacttaggaaggcactcaaccccaagagcgcaatcaaaccaacaacactagctaaagctgcagctgaagcaacttctactaaacttaagaaataa

SEQ ID NO: 30696 - DNA, 1290 bp, Glycine max
  Peptide Sequence Number=SeqID_147474
atgcctcattgcaagaagattggtagaggggatctccttcaaggactctatgtcttgaacctcaaggatactcattccacttgcaatgtttttgtttctaattcctatataaattttgtatccaatacttatactcaagctattaattggcataatcactttggccatgtatcagacagtgtattgaaagttctgagtaataaaattcctttttccatccctaatgagttttccacaaagagttgttgtgtgtgtcctgttgctaagtttcgtagattatcttttccttctgttaataatgtttttgataagtcattggatttgattcattgtgatatttggggaccttataagcattcaacttatgataataatcgttacttcctaacaattgtggatgattgttcacgatttacatggatttttttgctcaaaaataaatttgaagcaccaactatgatcatgcgattttttgcaatggtaaagactcaatttgcagcttcaatcaaatgtctaagatcagataatgccaaggagttggctcttatagacttcctagcatttcaagggaccttacatcaattctcatgtgttgaaagacctcaacaaagttttgtcgttgagaggaaacatcaacatttacttaatgttgctagagcattatttttccagtccaagattgccttcaccgttgctgaaacaaagtactccatatcaggttcttcatggttcttcaccattgcacctgattattccatttggagatcttttggttgccttgcctttggagctactttagcttctgagaggaaaaaattctctccaagagcagttccctctgtgtttgttggttatccacaaggagtcaaggggtacaggttgtataacttgcatactaggaagttttatgtttcaagggatttagtctttcatgagagcatttttccttttcaaactttacccaactcatatcaagaacctgatttccttagtgaattagttatttccttacccattcctgaacctataacctcaaacattcaacctagagccattgaacccaatacttctgaacctgatcaccctattccccctgacataagtgatctgcctattcagttatctgattctacaattgatactaccattggtgcatcatctacattgtcttctcctcccttaagaagatcaattagaacatctaaccctccaccttatctttctaactatattaaaccacaacctagacaaagatctcatcctatccaagaccatttctctcctcaatga

SEQ ID NO: 30697 - DNA, 465 bp, Glycine max
  Peptide Sequence Number=SeqID_147475
gacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggagtcccgaacccgtcggctgtcggtggactgctcgagctgcttcccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 30698 - DNA, 268 bp, Glycine max
  Peptide Sequence Number=SeqID_147476
atggaagaaagttcagggtttcctgtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagaggtttaagacatttaactaggatacatggtgtggatttgacgaacgaaactcaggatacatacctatatttgtttcattcccctctat

SEQ ID NO: 30699 - DNA, 444 bp, Glycine max
  Peptide Sequence Number=SeqID_147477
atgggtgaagtagaggagatacaagagaagatgaaggccgacatggaggccattaaagagaaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttgggaagtacggatgaccccatgatgtgcaaattcaaaacgagcacgccttcccatcatatggcttgcctcccaactatacaccacccaatgtggcatacactcttaatgaaaatctcaataactccactccgatactcattgagaacaaataacctcatcaggcatatatctctcaaaccatgggggagacacatgaattccccaccacaatctagctga

SEQ ID NO: 30700 - DNA, 618 bp, Glycine max
  Peptide Sequence Number=SeqID_147478
atggagcctaagtttggagggcaacagaggagtgacaagaagcaccatgggcaccacaagaagccatatcagagaccgaaccaagctcaaggaggaggctcaggaccgcactacttgagggattgttggtctgcatctaagaggaacgacaacaatggaagtgaagtcaaggctaactacaagagcaacaatgggttgaagccaaagatggcaggaaaggtgtttgcgatgagcaggtcagaggtggcaacatcgaatgatttcatccaagtcgtagtgtctatcccaactaacaagcccattactacttctagtgcatgcttagactattctgtgatggtcgatggcaagactttctctgtaaatttaatatgtttgcctccatctcatcttgatgtggtgttgggaatggattggttatcatccaaccatattcttctcaacttctgtgaatttcctaaagttttccttgaggatatgattgagttaccacttgagaaggaacttgagtttggcatagacctagtgcttgaatctagtcctgtatcaataacacaataccaagtgtatcctgtggaattagcaaaagtgaaggagcaagtagaagatttgttgtag

SEQ ID NO: 30701 - DNA, 198 bp, Glycine max
  Peptide Sequence Number=SeqID_147479
atgaaagggaacaacggcgtgggagagagaaaacgacgacgtggaggccatgagcgagaaggaagagcgttgagggaagagcgagtgggaaggaatgagagtggaaaattaaagggaagagaagaagagggaactttgcgttgcgtgggtattgagaaaacaaaaaagagaagagagaagaaagaaaaaaggttgtaa

SEQ ID NO: 30702 - DNA, 1773 bp, Glycine max
  Peptide Sequence Number=SeqID_147480
atggctaaggaaagtgttgatttaccactgattccaaaagtaactatgtcaagtggggttgcattaagaaggcactctgctggaatagcaaattctggaaataatgaaaagaaagttgttgttcctctttatctcagagcatctactggctcctgtcatgatttttgtaaatatgggaggaagaatgtggaagaaggaagggagaaactctccatgattaagagagccggaagaaaatcactttcccgaagttcagaaggcattattggtgggataataacatcagttgccaatcaaaaagcatcacttgattcgaagccaacaaagatgttaacagtgaaacataatgaatcagttgattctaagatccagatttctgatgcttctgacacagataagatggaactcccaacaaaatcatctggcagccaaaaacaaatggggaataaagttctggtgaacacaagcaaagcatcattggtcagggtcaaaccatcattccttccaaaatcacatatttcttcaatccccgaagcaaggagagggggaattttttcaagttttgaggtggaagctctatcaaaaccagcttccaaaagggtggaagcttcaccaacagcaacttctgagagggtgaaaactcatccaaaatcaacttctcaaatggtcaaaacttcaccaaaatccatgttcaagatgaagcaaacttcatcaaagttgtctccttttgaagataaagaaatggagttgtctgataagcatgtgacttctttgaatccagatttcgtcacaatgcagaccatatcttctgtgaattattctgatgtctttggtggccaaaagaatagtaagattaagatgaacaagaaagaagcctcacccaaatcttcttccagaggaattggcagtgttagtgcaagaaagcacaagggcctgaaaatcgtgcctcatcttatgaatcaacccaagcctataaaagttgaacttgaggaagacaacaatgaggctcaggaaaagactttgtatgtcatcaagatggaaagtgcaaaccaaagttcgctctctgatcaaaatgaaagccaggctatcgaattacccctttctaattcattgtcatcacccaagttttcacccccctcaaaatctcaatcctcgtcccaagaagaccaagaggaatctgaatatgcaaatagtgaatttgaggaggatgcttgtccagagaaccatgaaattgattacatggctaatgtggaaactttggaagttgaagagaatggaaagcctcaaaatgatgggattgtttgttctgaaaacatcgagtgccaaaatttagggaggaaattggttgaaactcaaattgaatatactgcttatgtggacactttggaagctgaggagaatggaaagcctcaaaaggatgggattgtttgttctgaagccaaggagtgcaaaaagttagggggagaattggttgaaactcaaattgaaaagggtagtctgaggagccttaaaatccagaaaggaaaagtgttgggggcgagcgtcactaatgtcaaggctgttgctataactgctccagagaaggttgttttgagacgtcaaaatgtgcaggtcaagaaagatggacaaggattgtacaataatgtgattgaggaaacagcaactaaacttgttgaaactcagaagggcaaggttaaagcactgattgatgcctttgaagctgtaatctctcttgaagagaaaagaacttctgctgcaaacattgtcaattga

SEQ ID NO: 30703 - DNA, 2670 bp, Glycine max
  Peptide Sequence Number=SeqID_147481
atggcgtggcaggcaatagtttcgtcaccagaggtggccaaggagaacaagcatcagattgtggagacagagcacttgatgaaggctttgttggagcagaagaatggacttgctcgcaggatcttttccaaggttggggtggataacactcgccttctagaagctactgataagtacattcagcggcaacccaaggttctaggggaatcctctggttcaatgttgggccgtgatttggaggcattgattcagagagctagggaccacaagaaaaagtatggggattcatttgtttcagttgagcacttggttcttgcttttacccaagatcaacggtttgggaagcaattcttcagagattttcaaatatctgagccagctctaaaatctgcaatagagtctgttaggggacgtcagtcagttattgatcaagatcccgaaggaaagtatgaagccttggaaaaatatggaaaagatttgaccgcaatggcaaaagctggaaaacttgacccagtcataggaagagatgatgaaatacgaaggtgcattcaaattctctccaggaggacaaagaacaatcccgtgctaattggtgaacctggtgttggaaagaccgccatttctgaaggactggctcagagaatagtgcaaggagatgttcctcaagctttaatggaccgtaggcttatatctctggatatgggagcacttattgctggagcgaagtaccggggagaattcgaggataggctgaaagctgtactaaaagaagtgacagaatctgatggtcagactatccttttcattgacgagattcatacagttgttggggcaggtagagccacaaatggtgctatggatgctggtaatctcttaaaacctatgcttggtcggggtgagctgcgatgtattggtgcaacaacactggacgagtatcggaagtatatcgagaaggacccagcactagagcgtcgcttccaacaagtttatgttgaccaacctacagttgaagatacaatttcaatactaaggggactgcgggaaaggtatgaactacatcatggagtccgaatttctgacagtgcacttgttgaagctgcaattctctcagatagatatatcagtggaagatttttgcctgacaaagctattgacctggttgatgaggcagctgccaaactgaaaatggaaatcacttctaaacctactgcacttgatgagatcaatagatcagtcctgaaactagagatggagagactctctctcatgaatgatacagataaggcttctaaagataggctgaatcgtcttgaggcagagctttctctcttaaaagagaaacaggctgagctgactgaacagtgggagcatgaaaagtctgtaatgactcgtattcaatcaatcaaagaagagatagacagagtgaatcttgagatccaacaggctgaacgggagtatgatcttaatcgtgctgctgaattaaagtatggcagtcttaactccttgcaacggcaacttgaaagtgccgagaaggagttagacgaatatatgaactctgggaagtctatgctgagagaggaagttacgggaaatgatattgctgaaattgtaagcaagtggactggtatccctgtttcaaaacttcaacaatcagagagggagaagttgttgcatttagaggaagtgcttcataagcgtgttgtaggccaagaccctgctgttaaggcaattgctgaggctatccaacgttcaagagcaggtctttcggatcctcatcgtccaattgccagcttcatgtttatgggacctacaggtgtaggaaagacagagctggctaaggcacttgcagcctacttgttcaacactgaagaagctcttgtacggattgatatgagcgagtacatggaaaaacatgctgtttcaagattgattggggctccacctggatatgttgggtacgaagaaggagggcaacttactgagatagttcgccgcagaccatatgctgttattttgttcgatgagattgagaaggcgcacgccgatgtcttcaatgtatttcttcaaattttggatgatggaagagtaaccgactcacagggtcgcacagtaagttttaccaacactgttatcattatgacctcaaatgttggatcacagtacatcttgaacacagatgacgacaccacgccaaaagagttggcttatgaaaccataaaacaacgtgtaatggatgctgcaagatccatcttccgccctgagtttatgaatagagttgacgaatatattgttttccagcctctagaccgtgaacaaataagtagcattgtcagattacagttggagcgcgtgcagaagagaattgcagatcgcaagatgaaaatccaagtgacggatgctgctgttcaacttcttggaagtttggggtatgaccccaactatggtgctaggccagtcaagcgagtgattcagcagaatgtggagaatgaactcgccaagggtattctcagaggagaatttaaggaagaagatgcaattataatagacacagaactcacagcatttaccaacggccaacttccccagcaaaagcttgtttttaagaaacttgcagctgattcagaatctacccctcaagacaccttggaacccttcccacaggctccatga

SEQ ID NO: 30704 - DNA, 1227 bp, Glycine max
  Peptide Sequence Number=SeqID_147482
atgcccgcgacggactaccaaggttcgtcttctccttcatcgttaatccattttggccgttcaattctgagtcttcgtcgagaacaggttcactccatttccatggaagggtcaagcttggaggctgagttagaatcctttcagcaacacgtcactaaccggttccttgaactcacttcggttgttcatgatgatttgctttcgctctcgtgggttgggaagctccttcattgcttcttgtgttgccaagaggaattcaaggccattctccatagccacagggctcaggtgttgagaccccctttggatcgcatggtgtctgattactttgagcgaagtgtgaaggctttggatgtttgcaatgccattcgtgatggtattgagcagattcgccaatggcagaagctattggagattgtgccctatgcattggggcatcagaggagcattggtgagggccaatttcgtagagccaagaaggctctcattgatttgcacatcgggatgcttgatgataaggatcccaacgcctcgattgcacatcgaaaccggtcctttggccgcagcactggtagcagggaccatcatagtcatggccatagccatggtcacaataatagcagtaataatacctatcaccatcggtctttggggcattttcgatcactttcgtggagtgtctctcgaacttggtctgctgctaggcagctccaagcaattgggaacaacatttatccacctaaggcaaatgagcttatggcttctggtggccttgcaatgcctgtgttcatcatgaattcgatcctgttgtttgtgatgtgggctcttgtggctgcaattccatgccaggaccgcggattacatgtccattttaccattcccaggaattactcctgggctgctgcaatcctctcgcttcacgaaaggatcatggaggagtcgaagaagcgggagcggaagaattcttgtggcttgcttaaggagattcatcagattgagaaatgtgctagagtgatgaatgatttggctgattctgtccactttcctttgacagaggagaaagaacgggaggttagacagatagtgcaggaggtttcactagtctgtgatgctttgaaaggtggactagaccctttggagcgccaagtgagggatgtgttccatataattgtgcgcagccgtacagaagggcttgactctattggcaggccaagcaatgctgagtaa

SEQ ID NO: 30705 - DNA, 1179 bp, Glycine max
  Peptide Sequence Number=SeqID_147483
atggaaaaacatgagagagaaatcagagagtctaaatttgcagagctgatgaataaacactttgcagcaagttctatccctaaagggattcattgtctgtctttacgtctgactgatgaatattcatcaaatgcccatgcacgcaaacagttgcctcctcccgagttacttcctttactgtccgacaactcttatcaccattttattctgtcaactgataacatattggctgcttcagtagttgttgcttcaactgtccagtcatctctgaaacctgagaagatagtcttccatgtgatcacggataaaaaaacttatgcgggtatgcactcatggtttgcactgaatccagtcacccctgccgtagtcgaaatcaaaagcattcaccaatttgactggttgactagagagaatgtcccagtgcttgaagctgtagaaaatcaaaatgggattaggaattactaccatgggaatcatattgcaggagccaatctcagtgacatcagtccacgtaaatttgcatctaaattgcaggccagaagtccaaagtacatatctttactcaaccatctccgcatatacttaccagagcttttcccaaaccttgacaaggtggtttttttggatgatgatgtggtgattcagcgtgacttgtctccgctttgggaaattgacctggaaggaaaagttaacggggctgtggaaacttgcagaggtgaagatgagtgggtaatgtctaagcattttaggaactactttaatttttcccatcctctcattgcaaggaatttggaccctgatgagtgtgcttgggcttatggaatgaatatctttgatctgcatgcatggagaagaactaatataagagagatatatcattcttggctgaaagagaatctgaagtcaaacctgacaatgtggaagcttggaacccttcctcctgctttaattgcatttaaaggacttgttcacccaattgatccctcttggcacatgcttggattgggttatcagaacaataccaatattgagagtgtgaaaaaggctgctgttattcactacaatggccagtcaaaaccttggttacaaattggctttgaacatcttcggccattttggaccaagtatgtcaattattctaatgattttttgaggaactgtcatatcctggaagcatag

SEQ ID NO: 30706 - DNA, 318 bp, Glycine max
  Peptide Sequence Number=SeqID_147484
atgaaggggaaacctttgtgcttgatcttgttgttagcactttctctctttgcatcacattcaaattctcttctactttcaaccagcaagagatggatagtggatgaggcatggaaaagggtgaagatgcattgtgtgaactggtcaagtcacctcaattcaatgttgggggaaggtcttgacttaatatccttgaaagatcttataggtgaaataaagaaactagacttcaattcaattgtgttcgctacacatgggcaacacacatgttcaaacgctatagtagccacaaagttggtgaaactctggactcattga

SEQ ID NO: 30707 - DNA, 633 bp, Glycine max
  Peptide Sequence Number=SeqID_147485
atggaggttgagttggggctgaaaatcacaacgaccagagatgataccacttccgtttccgattttcaatttgccaaagacagatcaggacctgtcttcttgtctaaagaaactgatgcaaagctcatcctcactgcacatcttaaaggatataagaaggagaacattgacatcaatatcaataaagatggtagtgagatttcggtgagtggagagaaggaggtgcaggaaatgcaaatgataccgttcaagaaagtgctaaaaaccatagggtttgagaagaagtttagtattcctgatggggtggttttggatcagatcaaggctaagtataacgaaggggatgaagttttgacaattgtgatgccaaaaacggaagtgggaaaaggaagtagagaaattgaggaggtgaaagaagaagtacccgagtcaagtgtacaagaaaatgttgttgatagcgtgacaccagagccacaggaaagtgtgccagaaaagattgaagaggaaacacctgcagtgaagaagccccaaaaaccatggacaccttgtcctcctttggtttttggaggatcaactttgcttgtaactctaatatttcttgtaataaactatattagagcgagaaagagataa

SEQ ID NO: 30708 - DNA, 435 bp, Glycine max
  Peptide Sequence Number=SeqID_147486
atggaatacagcaattgggctgaatctcttcaaaccgaaacccctctaccttctttcccacaaccctcatcatcatatcctcctacctattacccctcttaccctcaaaaccctaaccctaacccttcttcttctcttccccttaaccctcccggggttgatccccaaaccccattgaaccctattagctatgcggctcatgaacccgttcctggtttggtctacgctcagagccttgttggggatgattcatcttctgggtattgcttggaccataattgggttgccagagaggctgttaggcaatttggtactgaccctactctttatgcacctggatgggcttataactgtgcttgtgaaattggttcccttgacagttctatcttgtttacaagctggttgaaggattgtgggaaattgatatgttgttag

SEQ ID NO: 30709 - DNA, 1359 bp, Glycine max
  Peptide Sequence Number=SeqID_147487
atggcctctcaccaccatcaccagcctcctccacccaccacccacagctgttgcagctgccacaacttttcttcttacacctgttgcacacctcctccaccctaccgcccttctcacacctgttgcacacccccaccaccccaacaccaccaccttctgcaagccatttcatcactcctctctcaaccccaaccacaccttattcccatcccctcccagcaacactacaccaaatcctacacccatcaaaatctcaaactccccactcaaaaccaccaccttcaacacccacaccaacaccaaactcattccaccatctcctcactcctcgaccgcatcgaatccctcgaatcctctttcaaccactacacccaccactccctccgccacgccgccgcgcgcgtcatccaaactcatttccgctccttcctcgctcgcagatcaagaaccctggcccaactcaaacaccttgcttccatcaaatccacattcaacgctctcaaatcctccttttccaaccatacccatgtcgatttcgcagcgatttctcttaaagccatgaacttgctcctagaactcgattccattcagggttgtgatccgatgattgtggatgggaaaaggtcgattagcagagatttggttcagtttttggactcaatcgaagaggttgctttgaaaaaacatgtacttcatgtaaaagcaggaaagactgtggggtctgtcaagaaagtccaaaagaatagaaattcagatgatgatgagaggaggaagctgttgcagaatttgaggtgtagagttgagaagcttagtagattgtgtaaggtttctgctaatgatgaagaagattcagagtctggggagagcattcatgatgatggtgtaaccaatgttttgattggtggaaggaatgaggtgtccccaaacaaaaatggggtgtgccttcttaggcgaggtgaacctggagtgaagaagagtgtgaggtttgctgagaataggaatatttgtgaggtttatagtggggatgtggcatgttcagatggaagttgttcatctagtgacgagcaaggagaggtttcggagaatgtgagtggtgcagttgaagataatggggtggattcttctcagggtgctgaggatcatgaggaagtgttagtgttcgatagtggaggattgccacatagcagcgatgatggggagaggaacactagaaggctttttgtaaaggtgggcagaaatgtggtgaaagagcagcttcaagcgcaccaagagaagcttctgttctctgctcctttgccacttaagatggaaaacagaagtggttcaaagaacagtaaaggggtgaaaattttgacgtga

SEQ ID NO: 30710 - DNA, 507 bp, Glycine max
  Peptide Sequence Number=SeqID_147488
atgagatttgagagtaccgaaggaggagcagttgttgacaccttcgagggtgacgagggcggtgaggatgaaaacaaagggaaggagaaaagcgaggatgaggatggtgtggaagagggttcgataggaaatgtggcgagctgcgaccttgatcttcatcaagtcaataaagccattgttgttgttgctgttgctgctgctcgatatggtgatgcttctcatgctcggcgagaagtgaagctgcatcgtcgttcacgccgcagccccaccgccgcaacaaccctaccaccaccgcgccaaaacgacaacgacacccaccatgcccacaccatcacattctcattcctcacgatctcaaaacgacaacaatcgtgtgcctgccacaaatccgaatccaatcaatccaataatcgatcgaggaaaatgatctggcctcttccccatcttcttcggggtgcatgcgttggtagaaaggaaacatctgtccccggggcagattcacattga

SEQ ID NO: 30711 - DNA, 423 bp, Glycine max
  Peptide Sequence Number=SeqID_147489
atgagtgcacttgcagcatcctccgctactccttccgccgcccaagccctctccctcttccgctccctcctccgcgccgcgcgcgagtttcccgattacaacatcagggagtacaccaaactacgcaccaccgatgcgtttcgccacaacgccactctctccgacccaaattcaatttccaccgccttcgcccacggcaagtcgcagctcgccgtcgttaaacgacaggccgtcgtgtactctctctacgcccctccgctccgcaacgaaagggaagttaaagacattgttggagaggttgaggaatcaaaggccgaagtagaggttggggccagggaacttgttgtctgcgagggtagaggttggaaaggaatggaggtgagtgacggggtcagaatgtgcaaggtaggtggagttcagtga

SEQ ID NO: 30712 - DNA, 285 bp, Glycine max
  Peptide Sequence Number=SeqID_147490
atgtcatccgattgtttaggtaggcggttgggaccaaggcttcttgggagggctgatgattcagggagactggttagagatttttacaagatccttaacgaagtgaaggctggggaaattcctcctgatctaaagctgccggattcttttgatcaactggtttctgatatgaagaacaatcagtatgatgcaaaaacttttgcattcatgctaaggggaatggaacacactaacaatattctgtccttgacaacttatataacaaaggctcaatattctgtctag

SEQ ID NO: 30713 - DNA, 831 bp, Glycine max
  Peptide Sequence Number=SeqID_147491
atggccgccgtagcatcatcgccaacgccacttgggtctcgatccaaggctcaacaagaaccatccaaaaacatcgagaatttcgaccccaacaaacaacaacaaagcccggtttcgaaaccctcttgttcctctccttcttcttcgcctctcgtgaaatcaaagaatcctaataaagtcgactatttctcccctaagaacaagatccggcagagaaagttcttggtggcaaagaagaagaaagagaaaaaggcagaagaagagggttcaggtgctgctgctgactcttgcaagtgcaaagcaagtggtgcaaatgcaaacgagaacaacaagtgtgtgtgtgtggcttacaacaacctaaggaagtcccaggaagagtttttcaagaacaatgatgatggtgttgttgatgatggtgaagaagagggttttgagagtgtggttgttgaagaagaaaaaggagaatcgttattggggaatggtgaagtgagtggtttggttgtgaagcgtaggagggagaggttgatggaagaggcgaggaagagtgttcttcctcaaagtgggtctgggaaagttatgcatttggtgaaggcatttgagaagcttctctctattcccaaaaccaaggaggaagaagatgaggagggatctcaagatcaagagagggtagggaaatgggcactgccagggttgcagcagcaacaagtttctgagatttcattttgcccaccaaactgtgtcctcacatcgcaaaaccttggcttggatccgggggcatcggtttcctcttcctgggatagcagccgtgcaaggtttggattcactttttag

SEQ ID NO: 30714 - DNA, 147 bp, Glycine max
  Peptide Sequence Number=SeqID_147492
atggctaggtctcactgtttgtttcctttggcctttttaatggttctctttgtaccagccttggcacatggtcgaagaaggggatggcatctagcccatgcaactttctatggtgacatgcaaggtggagacaccatgcaccattaa

SEQ ID NO: 30715 - DNA, 150 bp, Glycine max
  Peptide Sequence Number=SeqID_147493
atgactttaataaccgataagcatacattaactattcctgctgaatcgcaatgctctcatatatggaaatggaaattcactttcgctgttgaatgtgatgaccattcaccagaaaacgatggcctcaaatctaaaaggggaagaaagtga

SEQ ID NO: 30716 - DNA, 331 bp, Glycine max
  Peptide Sequence Number=SeqID_147494
gtgcgaagcttctggtgactgggaagcacgttattctgttgttttccagatcggtttcttcgccaaaagaaaaaaagaagaagtagagatgagagtcgtcatcgcgaaaagggcaggatggacaaaatcagtgtcctatctttgctttcctcttatctccgatgagaggcttgtgcaatccgtgaaattccgtaatgtggcggaagtcgaaaagaggcccacttgggccttccagaagcttcctccagaaggctgttgcttctggaggaagcaacctggcttgcctgggcgagctgggcggcaagcacctcccctattttgctataaatag

SEQ ID NO: 30717 - DNA, 141 bp, Glycine max
  Peptide Sequence Number=SeqID_147495
atggggaccacaacggagttatgggaattttacagaagcattacgggtgtcccggaagccccagaatcccatcttttaacaaaacgggagaggtggttgccacctagctcgcccaggcgagctagattgcttccactttaa

SEQ ID NO: 30718 - DNA, 300 bp, Glycine max
  Peptide Sequence Number=SeqID_147496
atgctcagtagatactctccacatggaattaatgcaaatttcacttcaatttcaacccgcttaacgagtaagaggaatcttgaagggaatttgccatgcaagcacatgctcagcacgttatcagctcgcctagcgagtcatttgtctcttctggcgcttagcgcgcctggcttgcaaagccaaagttcacttacttgtgctaagcgtgaaaatggtgctaagcgtgccttcgatgacagaaagccctttttaaagcctgaagtggaaaataaaaaaataaaaaaggagtgtagagcatag

SEQ ID NO: 30719 - DNA, 468 bp, Glycine max
  Peptide Sequence Number=SeqID_147497
atgaaagaaagcttctttacgctcttctacagcactctgcagctcggtcccaccttctgcgccgacaataccacctatcacgccgacgcgaagtcgttcaagaaaagcttcaacaagttccacatattcgcgaagatcttcaggaccagatcggagaagttccagtcaaatccatcgtgcgagcaagccttgtacgcatcgtcgtcgtggttctcggccatgtgtctttcccttgcgatgtcggaggtggcgaaaagcttcgatttcaagctcactgagttcgggaggattggggaggattgcgtcggcgaaccggagaaggaagccggaggtgagggttgggttgttgaggaagccgtttgtcggatttgcgatgtcatttttggaggtcaggaagccgtggctgttgcggtgggttttgcagcagagagagatgtatttcggcattctgagagggttagggagtga

SEQ ID NO: 30720 - DNA, 2490 bp, Glycine max
  Peptide Sequence Number=SeqID_147498
atggagggtacccttttccccaataggccagttttgcctgctccttcacacaaaccaacacaacaacctttgaaattcaagccaacttttttgcctccacagtctccaccaccaccacctccttcttttcagttagattcccttctccaacaccttcagcatctctcttcagttcccatcaccactcacactctcacacttgtgcctccttctcatgataacaccaaagattttaataattcagttcattcaaagcaccccactttaggttctggctccataattgatgaggacaagtttgatgatgcaaagtttggatttttatcagacaagggtaagttgctgttcagttcaattgttgggtcacctttgcatgaattgaatgactttttcaactctgttaagtttgagttgcttgaggctgattttcccagcttgttgaaggctttggacctttctgggaactgggaaagggcactcttgctgtttgaatggggttggttgcattttgggagtgatcagaatttgaggttggacaaccaggttgttgaattgatggttaggatattggggagggagtcacagcattcaattgcatccaagttgtttgatttaattcctgtggaaaaatactcgcttgatgtccgggcttacaccaccattcttcattcctatgctcgcactggcaagtacaaacgggctattgacttgtttgggaagatgaaggagattggtcttgatccaactttggtcacttacaatgttatgcttgatgtttacggcaagatgggtcgttcttgggatagaatcttggagttgttggatgagatgaggagtaaagggcttgagttagatgagtttacctgcagcactgtgatttctgcttgtgggagagagggtatgctggatgaagcgaggaagtttttggctgaattgaaatttaatggctataaaccgggaactgttacgtataattctatgttgcaggtttttggaaaggcaggaatttacactgaggccttgagcatattgaaagaaatggaggataataattgccctcctgattctgttacttacaatgagcttgcggcaacatatgtaagagctggttttctggacgaagggatggctgtcatagatacaatgacaagcaaaggggtaatgccaaatgctattacctataccactgtaatagatgcctatggtaaggcgggaagggaggatgatgcattaaggttgttcagcctgatgaaggacttgggttgtgctcccaatgtgtacacatataactctgttcttgccatgctaggcaagaaatcaagaacagaagatgttattaaggttctctgtgagatgaaattgaatggatgtgctcctaatcgtgctacatggaacaccatgcttgctgtatgtagcgaggagggtaagcacaattatgttaacaaggtcttgagggaaatgaaaaactgtggatttgagcctgataaagacacattcaatacattgattagtgcatatgctcgttgcggatctgaagttgattctgcaaaaatgtatggggaaatggttaaatcaggctttactccatgtgtaacaacttataatgctcttctaaatgccctggctcggcgaggtgattggaaagcggcagaatctgtcattcaggacatgcgaaccaagggctttaagcctaatgaaaattcatactcactgttgctccattgttattccaaggctgggaatgtcaaggggatagagaaggtcgagaaagaaatttatgatggtcatgtctttcctagctggatacttttgagaacccttgtccttacaaaccacaagtgcagacaccttaggggaatggaaagggcatttgatcaactgcaaaagtatggatacaaacctgatttggttgtcatcaactccatgctttcgatgtttgcccgaaacaagatgttttcgaaggcccgtgaaatgctgcatttcattcatgaatgtggattgcagccaaatcttttcacctacaattgcttgatggatttgtatgtccgagagggcgagtgttggaaagcagaagaagtgctcaagggaattcaaaactctggtccagagccagatgttgtgtcttacaatactgttatcaagggattttgcagaaaagggctcatgcaggaggctattggagttctctcagaaatgaccactaaggggattcaaccaactatagttacatacaatactttcttgtcaggctatgcagggatggagttgtttgatgaagcaaatgaagtcattagatttatgattgagcacaattgcaggccaagtgaactaacttacaagattctagttgatggttactgtaaagctgggaagtatgaagaagccatggactttgtgtctaagattaaggagcttgatatctcctttgatgatcaatctgtgaaaagacttggttcttgtattagggagagagtggggtctactttgtga

SEQ ID NO: 30721 - DNA, 564 bp, Glycine max
  Peptide Sequence Number=SeqID_147499
atggccgagaaccacgacgacgatgcgtacaaggcttgctcgcacgatggatttgactggaacttctccgatctggtcctgaagatcttcgcgaatatgtggaacttgttgaagcttttcttgaacgacttcgcgtcggccaaggacaataaaaatactagtgatggttgcaatgacaatggcgatagaggtggtggtggtggtagtagtagtggtaatgttagtggtgttgatgatgatggtggtggttttagtagcaatgttggtggtggcagtaacagtggtggtggtcgcggcaacgttggtggtggcaatgacaaagatggtattggtggtgttgatggtagtagtaatgtcggtggtgatggtggtggcgatgacggaggtggtattggtggtggtggcagtgatagtggcattgacgatagtgatggtggtgatggtgatagtgatagtgacgttggtggtagtggtggtgtcaaactcagcacacctcctcgcttagcgatcaagctcaagcttagcgcaaagaaggcccacgaaaaggcccaaaggcatgcttag

SEQ ID NO: 30722 - DNA, 192 bp, Glycine max
  Peptide Sequence Number=SeqID_147500
atggccaaggaatgtctggcttatgacttgaggatatcaattatgcttaagaagtgtctggtcgaggccaaggggtgtccgactacgatcaggggatggatatctatctatatggctacacatgctcccgaagccttgagtcctatagagtatgaagagagttatctttggatcaagaagccaatgttttaa

SEQ ID NO: 30723 - DNA, 966 bp, Glycine max
  Peptide Sequence Number=SeqID_147501
atgcagaaccagaacccttctgaggatgattccaccaataaggctccctctgatgacacaccccatccaaccaacaacgacaataacaatccgccgggtgaaagccttatcatgaaaaccgttaggcaagtgttggaggaacttggtggcagtcgtgatgacaatgatggtggtgttggtgatgggacccctgtggctgtggctctggaagtaggtggtgggggtgatggaagtggcggtgacggtggcggtgttggtggtgggcctcccgtggctatggaagcgagtgatggtggtgatgaggacaatgataatgagcatagtgatagtattggtgatagtgtccctgtggctgtggctgttaaggtgggtggccgtgggggtgacaatagtggtggtggggccactgtgactgtgtcagtggcattgagtgatggtgattatggtggcagtaacggtagcggtggtagccctgtggctgttgctgtggctgtgggtggtggttcaacggtgatggagagtgtggttgtgggtactgagggagtgcaggggagaaagagaaaaactcctctagtgagagaccctcccactgggagacctacttgtcctctttgccaaaaagagttccaaacctggaagggcgcgtttggccacatgcgtgcacaccctgaccgtgattatcgcggtttcttcaagcctcctgtgtttggatccccatcctcaacccaagatcaaccacctagtgatggcaagggtgatgatagtgcaaagaagagtactggtgaggataacactgcagagaaaggttcagcatcattgcctgttcgagtgccgatgtttgatctgaatgaactaatagaggaagatggatcctctcatgctgctgagcctgctgaagacatgagtaccggggagggaaagggttcgggatttgacttgaatgagatgcccccagctgaagattaa

SEQ ID NO: 30724 - DNA, 306 bp, Glycine max
  Peptide Sequence Number=SeqID_147502
atggctgaaggttttattccgcgaggaatcctctttagactagaatctgttcacgcagtccgtaatggacattgtttcgaggacctcactgtgagaggaaatagacagacgggaggtatcgtcttcacctatgcatcagctgctacaggtacctcgtcatcgccggagggacaaatgattcaagaattcagacttccttttagtttctttgggttggcatcaccagacagaggtggaagagaaattacagaaaaagatattgaggaagcgattcgtactatgccccgctccttatatgttccctag

SEQ ID NO: 30725 - DNA, 260 bp, Glycine max
  Peptide Sequence Number=SeqID_147503
ggatcgcgcccacaagacacccagcggacccggagaagtccaatagggccctggggtttctagctctggttatgggcctctgtcagccctaccgggtgctcgtcccccccagcaagttctacggagtgtctgtcgcccccaacaaggtcattaggccccctattaaccgagctttcatcaagaagtattgcgtcccccaggcaggcgcagggcgagacaccacatttgatgcaatcctacctcgcaagggcattggatag

SEQ ID NO: 30726 - DNA, 225 bp, Glycine max
  Peptide Sequence Number=SeqID_147504
atggcaggggttctgtgggttcgagcgagaacaatgtgggtgtcgagggagcggtttccggcagttttcaggcaggaggagaaagagaagagtgatttcaggcaggaggatgacaaagagaagagggagggcaaggttttcgagcgcgcgcggcttgtgaaatctcaatttttaacttataaacataacaacatcggttttttatggataaccgatgttaactga

SEQ ID NO: 30727 - DNA, 501 bp, Glycine max
  Peptide Sequence Number=SeqID_147505
atgggaagcttttctcaaggtcaatggagttgggatctaaaatggagaaggagtttatttgaccatgaacaggatatagctgtggcttttatggaagcaattaatactacacagattcaacgtcatctgcaggacaccatgctgtggaaagctgattcttctgaatatgcatacacattgaaagttgatgaggaaagtgatgtctatagctttggagtggtgctgctagaactactaacagggagaaagccagtggggaattttggggaagaaggtctagacattgttcaatggaccaagttgcaaacaaattggagcaatgacaaggtggtgaagattcttgatgagaggctatgtcacattcccttagatgaagcaaagcaggtatactttgtggccaagctatgtgttcaggaacaaagtgtggagagaccaaccatgagggaagtggttgaaatgcttgcacaagcgatgaaaccaaacacattccaaaagcaatga

SEQ ID NO: 30728 - DNA, 201 bp, Glycine max
  Peptide Sequence Number=SeqID_147506
atgcaggattcaccgatactgatcggaataaatgctagccgacgtcggccaggaaagatgatcgatcaaggtcggctaggttttttcgttcgagctcaaccgaagttgtttttcggccgacaccggcatgttttcatttgcttggcaaggaaaacattagccaacctcggcaaaaacacatgtaggattcaccgatactga

SEQ ID NO: 30729 - DNA, 606 bp, Glycine max
  Peptide Sequence Number=SeqID_147507
atgggttccccacctacctcccctcctcctcctcctccttcagacgcatcagcttcgctgtctgccgtgaagcagacatgcaaagtcgtacgatcattgtctactagaccccctggtgctgagagaccagtggtccatgttgatcctgctatcggcaaggccaacgatccccacaggaagaaattaagaacatatttggggattgtggcgcgtgataaggtggacatcacctacgagaactggaaggaggtccctactgctcagaaggacctgatttgggaggatattcaggcagaatttgatatcccagaggcttctgacagtaggacgaaaaggaagttacttcagaccgtggaggagagatggaggcagtttaaatcagacctcacgaggaaatgggcccttgcagctgatcagaacggtgttgaggacactgtctatgagaaatacgatatcagcaaggaaaagtgggcccagttttgccagactcgcagagacccttcttgggaggatgtgcgcaagaaggcacaggccatccagaagcagaatactgccccccacattttgtcttgtgggggttatgactatttggagcagaagctcctg

SEQ ID NO: 30730 - DNA, 243 bp, Glycine max
  Peptide Sequence Number=SeqID_147508
atgggatcttcgttagcaatgggatgttcatctcggtttgatgtttgcgtttgtggtagttttgaaggtggcgtaaagggggatgaaggatggttttgttggtcaaaggaggggtcttgtgattcaaggttgttgtataaagatactggattattgaggtctatgttgttgtacggtaactgttgtggatgcggtagttgtagttgtggacatgagggttgtggagacgatagttgtggttga

SEQ ID NO: 30731 - DNA, 417 bp, Glycine max
  Peptide Sequence Number=SeqID_147509
atgactagccaaaagatgatagaaatcttccttggaagatacccctgctctcttatcctaggctccgtcttcatctccttgggcctctatgggacttgcacccccctaaaaattcggcctgtccccagaccatgcaacagtggctttgaacatgcagcattaggcactgctggtgcagtgtatactgatagaagctatcattcaactatacctagcccctgtggtttaccgcctgctggtcagccaaatgctgcatgtatgcgtacatttggagctccatcctctgcatatgagctgagatgggctctagggacggtggctgatgtggagccgatggtggggtgtctgttgtcggctgttgctactggtcttgccccaactgttgtgtttaccttggcatccaatacttctcaatga

SEQ ID NO: 30732 - DNA, 315 bp, Glycine max
  Peptide Sequence Number=SeqID_147510
atgggaattactgaaagcactagtgttaatggaggaagcagtagcattaatagcaataacatggtgtttccgagtgtggaaacgcggaacttgaagcagttcaatttcgcggatctgaaagcagcaaccaagagtttcaagtcggatgcattgcttggtgaaggaggttttggcaaagtttacaaaggatggttgcatgagaagacactgacacccaccaaagctggatctggaatggtggttgctgttaagaagttgaactcagaaagtttgcagggctttcgtgagtggcagctagcctcaagtatatattaa

SEQ ID NO: 30733 - DNA, 450 bp, Glycine max
  Peptide Sequence Number=SeqID_147511
atggttgacaacacacgcatgaaggagcttacaggggatgtcaaaaggatcctggagatgatggaaaaccgcaataaagaatatgctgctcggtttgagaccttagaaacaacactggagtatatcactggctatgaacaatcacccttttcaggtggatcagatgttttacaatggatattcaaggctgaacagttttttaactatcataaaacaccgggtgagcaacgattaattattgcttcaattcacttggataaagaggttgtgccctgctaccaaatgatgactcgtgaaaattcattcaaaacatggattgcttttacgcgagccttagagacagaatttggcccatcaccgtatgaatgtcctagatctcagttgtttaaactcgctaaaattggttcagttcagtcatattacgtgcagttcacggctttagctaatcga

SEQ ID NO: 30734 - DNA, 928 bp, Glycine max
  Peptide Sequence Number=SeqID_147512
atggttagatggagaacatacaacttcaaggtagatggagaacaaagagagcaagaaagcttagatggagaagaagacagagagaaggaaaagacaatgcgaaggagacgaaacatacctaggtatggtggcgaaggagaagaagcagagacttgtgacgatgctcgagtgcgacgaacacgatgctcagatgcagacagggacggtttcgctagacgaagattagaagaagaagagagcgtgattttgttagtagcttcccctggaacagtgggattattcatgcaaatcgctagcatgaacagcgccacactcaggcacgcgacacgtggctgtgtcgcctctgccactggcgacagcagtgatgtcgccacctgcaatggcgctttggccatgcagggtagagtcgctggtcaaaccagcgcttccctatgcgtagcaggtgcagcttttgcaggtctagtgaaggtgcagtgcagcagggaaaacgccagggcctttggcgatttagggatgaattcggttataacagtgttgtatttcaatggaagggtatatgaagataatgatggtgtaatatttgaaggaagtaaaaaagcgattcagattaaacgtggaattagtttcaatgccttgaagaaaaaaattggagataaggatgttgctggtggttcaatgtttcattctgcaaattcgcttacatcatgtggaaattatttatctaatgatgagacacaaccggcaacaaatatgagcaatttacatattgacgaagacgatgatgatgatgatgatgatgattatcttgtgtctaactcatacgttgaagagtctgtagacgaagatgacagtgttgacggtatatctgaaacagacgatgaagtcaccgacattcctcaaccagtaagaattgttcacccagcagaag

SEQ ID NO: 30735 - DNA, 253 bp, Glycine max
  Peptide Sequence Number=SeqID_147513
atggtcattcacaccttgaatggttttggtgccgagtatagagaagtatttgcagcactacgcactcagaaaaattcgatcggctttgaggatttctatgatctccatgctgattttgagaattacttaaagagggataagccccggccgaattccatagccactgctcatattaaacataagtacattcatcatctaaagatgtccaaaatatgggagttttgcaaaatacatagtgacatccagagcaaag

SEQ ID NO: 30736 - DNA, 309 bp, Glycine max
  Peptide Sequence Number=SeqID_147514
atggaggatgtcccaagcttccttcaaggttttgacatttcccaacataatgataacactagagtcaagcgagaagaaaattgcatgcaggatcaattgatcttgtcgtttccaataatgatagtcccagtgagatggggcaacgcacatgattgtgccgtcagcaaaaactatgagatcataccccacaaaaagagcattgaattgaactctccatgtaggaaaaatggcgatgggacaacccatcccttgtgttcagatgttatacaacaagagactcaaagtctcttagccaatctcattgaataa

SEQ ID NO: 30737 - DNA, 372 bp, Glycine max
  Peptide Sequence Number=SeqID_147515
atgtctcttggaaattattttctgaaaatcccctctggtaatcaattacaagacttatgtaatcgattacaggagtcatttgacttaatccatcaactgaaagatccttcaactatttctcgtccttggaaaattctttttgcaagaatcaactgcttctttcattcttcctcactacgaggtcgtgaaacaagacaacacttggtacctctaagccctacactggggcaacgaaaggcaccatgcaaaactcaagcgactaggggcagattagaagtttcacccaatagttccctccacaaggtcatgacgaaagacaacgattggtacctcaaagccctacactggggcaatgaaaggccccatgcataa

SEQ ID NO: 30738 - DNA, 399 bp, Glycine max
  Peptide Sequence Number=SeqID_147516
atggagtcaccaactatcaaaactttcccttcggcgagggtgcaatgcgggactcgatggtgcatcttccacggaaggaaaaaacacgcagagtcgccaccaacgttcgagagttgtttacgcgtggggaagggtattgccctcgctcctacgtatcctcgggcgaggctcacgggtgcgtcttccaaaggaggaaaatgcgcggagtcgccaccaatgtttatttgtggaaaatgtcagaaaaaccgaaggaaaccggtcatgaagaatattccagattcgggagttgtatttacgtttgaggaaggtattagcacctctcacgtcgacaaaagcggggctcttgctcctacgtaccctccatcgaagaggaaatcagacctacgtagttctttctaa

SEQ ID NO: 30739 - DNA, 481 bp, Glycine max
  Peptide Sequence Number=SeqID_147517
ggaggagcttgccacccagctcgcccaggcgagcaaggttgcttcctctagaagcaacagccttctggaggaagaatctggaaggcccaacaaaaagggtgcggatgaccatgttttgtctctgcgtgccaccggacttgcttgtctctggatagcaaaggatgcgatgaccataatttgtctccgcgtgccgacgaactcgctagtctctgaaaggaaaaaagggccaatggactcgtctctggaaggcaaaaagggtgcggatgaccataatttctctccacatgccaacagactcgcttgcaaaaagggtgcgaatggccataatttctcttcgcatgccaatagactcgcttgtctctggaaggcaaagggtgcagatgaccataatttgtctccacactcgcttgtctctggaaaggcaaagggtgagaatgaccataatttgtctccacgtgctgacagacttgcttgtctctag

SEQ ID NO: 30740 - DNA, 1095 bp, Glycine max
  Peptide Sequence Number=SeqID_147518
atggcaagaatagccaaggtagtcaaaatctcggcacaagagttggaccgagtaaagcaaaatagaaatgggatagtcggaataccaaggaagcatttggaggaaaaggtgaaggcattgggggatcaaggtgaatgggcttcattcattgacgtcttggcactattgatattcggaatcatcctctttccaaatttggatgggctagtggacctagcggctattgatgccttccttgcttatcaccatagcaaggaaagtcccatcgttgctattctagccgatgtctatgacacgcccgcttgtcccttgcaaggtcaccgcatatgcactgagaaagggaaagcaaattgggagcaactcttggctagtgtggtaggggcatccattagttggttccctcgatggaaggaagggaaaggagcaccgttggaggaaagcatcacgcctttcatcgcatggggttttagtgaccccaatgtgaagatacttcaaggagtccgcaaggcatgggagttggattggctaccaaagctaaaggttttaggcaaggaagaggctgaaactcctgaggagagtaaggaggtgcaagccctaaaggtggaacttgaaagggttcaatcagttaaggaaaagttcaacacaatgaccatcaaggtctggaaagagtgcaacaaactgagggacatcaatgtggccaccgccaaagcattggaacgggaaacaaagagggtacgaaaggaagaatatggccgaaacaagcatgatattgggagacaagttgaagatttgtgtttggtaccagatgttgtcatccctccgaaattcaaggtaccatattttgatagatacaaggggactacttgccccaaaaatcacttgaaaatgtattgccggaaaatggggatgtattctagggacaagaagctattgatgcatttcttccaatatagtttggccagagcagtggtcatctggaatcatttaaggagtatgcccaacgatggagggacttggcagtgcaagtggcgcccccatggtagaaagagagatgatcacaatgatagtggacatgttgttggtgttctattatga

SEQ ID NO: 30741 - DNA, 960 bp, Glycine max
  Peptide Sequence Number=SeqID_147519
atgggtgaagtaaacgaggtgcaagagcggataaaggccgacatagaggccctaaaagagaaaatggccacaatgatggaggccatgatgagtatgaagaagatgatggaggtcaatgcagctgtagttgcggctaccggtgtcgttgctgagggaggcaaggagttgggaagtgcgggtggcccccattttgggcaagttcagaacaagcatgccttcccgccatatagcttgcctcccaactacacaccacccaatgtggtgcacactcccgatgagaatgtcaataactccaatcccatactcattgagagccaacaacctcaatctgatcatgcacatgtctctcaacccatgagggagccccaccacaatctagctgactttgagccttgcctcggatatgccactgaggggcaagcagctgagggtgaacccttgccaaacactttggaggaacctcagtttcgcacacaaccacaacccttgcattttgtggcggggagagtccatcctgctatgacggaaaaaaggaaattggatcatatggaggaaaggctcagggccattgaagggggtggagatcatgcttttgctaacacgatagagttgtacctagtgcttgatgttgtcatccctccccatactggggcagccgtcacatggtacactaatcttgaaccttcccgagtccattcttggaaggacctaatggttgccttcattaggaagtatcagtacaattctgatatggctcaagtagcgcccccaatgatggagaaagagatgatcacaatgatagtagacatgttaccagtgttctactatgagaaaatggtgggttgcatgccttcaaactttgccaatttggttttcgctggtgtaaggattgaaatgggtctaagaagaggcaaaattgattatcctgctttgatggatgagaaagctggggcaaattaa

SEQ ID NO: 30742 - DNA, 288 bp, Glycine max
  Peptide Sequence Number=SeqID_147520
atgatcatcatcaaaacatcaaagccaattgcatctacagatccaaggcctacatgctccacatggagctacatcaatttcaccaaaacgaacgcgttcatccactactcaacaggtccgcctccatttcttatcaatatggataagtttaaatccacccagaagatgaaggtaatctttagaacctacaaagcactagtaatgttttcaaagtggtgcaatgggagcccattcatagagaatccattcctacttctactcctaagtggacgagatatgaataagtga

SEQ ID NO: 30743 - DNA, 571 bp, Glycine max
  Peptide Sequence Number=SeqID_147521
atggctggggacaagggaaccatcactcttgaagagatcaagaacgagactgttgatctggaagttggttcatactctgagcactgtgtccttgttgaggcatgtgcagtatttggctataattgggcatacagtagggaacgtattccaattgaggaagtgttcgagcagctgaaatgtaccagggaaggtttgtcctccacggaaggagaaaaccggcttcaaatatttggacctaacaaattagaagagaagaaggaaagcaagtttctcaagtttcttgggttcatgtggaatccgctttcatgggtcatggaggctgcagctataatggccattgctcttgcaaacggcgaagggaagcctccggattggcaagattttgtaggtattgtttgcttgttgctgatcaactccactatcagtttcattgaagaaaacaatgctggaaatgctgctgctgctcttatggccggtcttgctcctaagacgaaggttcttagagatggtaaatggagtgagcaggaagctgcaattctagtccctggagacatcataagcatcaagctag

SEQ ID NO: 30744 - DNA, 522 bp, Glycine max
  Peptide Sequence Number=SeqID_147522
atggaagatgcaaaagatatgaaaactcctatgcatccaacgacatgtcttggactagacgagaaatccaataaagttgacaactctcaatacaaagctatgattggatccctactatatctaattgcgtccagaccaaacatattattcggtgttggactatgtgctagatttgaacaagacccaagggaagttcacttaacttctcttaaaaggatatttagatatttaaatggaactcctaatcttggtctttactttaagtatagcaaggaatttaggttgattagttattgtgatgctgactatgcttgtgaaaaaattgaaagaagaagcactagtgaaagctaccacatcattggtggaaacctagtcacttggatcaaccaaaagcaaggattagtaacattattcactgcaaaagcagaatacatatcagtagcaagttgttgcactcaactgatatggataaagaatcaactagaagactacaatttgatgactaaaagcaacagcaggtga

SEQ ID NO: 30745 - DNA, 1398 bp, Glycine max
  Peptide Sequence Number=SeqID_147523
atgaattttgggctttctcctccatcgttctacagttcacatgacgaatttcaagatcaggcgcagggaatttttgacaatgttatgaaaatggcagtaatagcatccattgtttcaggagtggtaacaatagtagttattatagcaatagtatatgccattattgagtgcttgaagaaggccattcctgcatatgcccagcttccgagttcagacaacgatcataaagcttcactttcatttccttcaactagtgaaattgaagtagtaataccatcagattccagagtgcaaggttcaaaacctgagtttgcaacaatggaaagattcctaagcaacatcaacaaggagaaacccatcagattctcccctaaggaacttgatataattacatggaattactcaaccatattgggttcaggtgcttttggggttgtctacaaaggggaattgtccaatggagaacatgtggctgtcaaagttatcaaaagtttggatatgggaatggaagagcaattcaaagcagaagttggcaccattggacgaacttaccatgtcaatctagtcaggctttatggcttctgcttccaccacgaaaagcgagctcttgtttacgagtgtgtggaaaacgggtctctagacatgtacttgtttggaagccagaaccggcatgttgaatttgggaagcttcatgagattgcaattggaacagcaaaaggaattgcttatttacatgaggaatgtcaaaaaagaataattcattatgatataaaaccagagaatgttcttcttgacatcaacttggaaccaaaggtagcagactttggcatggcaaagctttgcagcagggaaaacaatgtttcagtcaatacacactttaaaggaacaaggggatatgctgcaccggaaatgtggaagccttatccggtgactgagaagtgcgatgtttatagttttggtattcttctctttgaaatagtagggaggagaaggcattttgatgatgcctacagtgaatcacaagaatggtttccaaaatggacatggaatatgtttgagaataatgaattatttgtaatgctttcacattgtggaattgaaaacaaggacagggagatagctgagagaatgtcaaaggtggctctgtggtgtgttcagtattcaccagatgatagacctctcatgagtaatgtggtgaagatgttagagggtgaaattgaaatttctccacctccatttcccttccaaaacctgatgaatgataagccaaaattgactccaaatggaagcactgtagattcaggtagtggtactactacatcatgggagacggaatctttactagaatctggctctaaaatcaagaacaatgcttttcagatcgaaaaacccacttag

SEQ ID NO: 30746 - DNA, 513 bp, Glycine max
  Peptide Sequence Number=SeqID_147524
atggagtgctatgaagttgctttagtaactttacaaaagcaaaaatggagtacatctagcattgcaacagaagagaaattaaaaattttaaattctttcaaaaatgaaggaattctaaaattcccagcaactttcacagaaggcctctgcggagccatgtccgcgatcaggggaggaggtaccggagcggagcatgaagcgaaggaaggaggcagcgtagagtgtgtggttgaccttggtgatagagacagcgaggaggccgaggcagttggcgttgaggcggtgaagctggcgttcattgcagaggcacgtgacgatggactgggcgcacgtgagaaaagagagtgtgttctggtaagagagcttaaagaccaagcgactgaggcaggtggagttagggaggtgcgtggagtgggagagaagcttgtgatagcaggttccgaggaggttgtggcggtggcgcgttggaagggagagagtgagggtttttttcctttagagcaaggttcctga

SEQ ID NO: 30747 - DNA, 330 bp, Glycine max
  Peptide Sequence Number=SeqID_147525
atggtcaagtctgaaaaggattacgaagattatatggaatgggcgaaacaaaacaagtgcaaggagtgtgtagtggggcgttcatgtcatcgcaaaatcagagtgttcaacgacagaatttttcccaacgcagacaatagccataacaagcaacagcacaatgatcacattagaactggtgatggaattctagaatccagttctgagattcgacagaacccatggatttgtggcatggaaaaattccaccgcgtacttgtgtttgttatcaagcttccctcttgctgcatctttacccattcattgagttcaataccatggcgcaaatga

SEQ ID NO: 30748 - DNA, 342 bp, Glycine max
  Peptide Sequence Number=SeqID_147526
atggagatgacaaggtggatgttgtatgaaaaggagttgccaaagaagttgtgggcagaggttgcaagcactgcagctgtgaatcaagctatttggctaaggcgtatacttcctgatttacatatggaacaaaaggagcctacacagattcttgttgataatcaagcagctatttccatttcaaataatcatgtttttcatggcaggactaaacatttcaagatcaagttgttttttttaagggaagcacacagagaaggtgaagtcaaactaatttactacagaactgaagatcaaagtgcagacgtcttaacaaaagttcttccaaaagctagattttaa

SEQ ID NO: 30749 - DNA, 462 bp, Glycine max
  Peptide Sequence Number=SeqID_147527
atggataaatttctgaacgagatggaaaaggagcggccgatcagattcaccgatcaacatctgaggattgcaactgataactactcttacttgttagggtcaggagattttggaaaagtctataagggaatttttagcgacggaaccattgtagctgtgaaggttctacacgggctttacgacaagaaaatggaggagcagtttatggctgaagtggtgacaattggcaaaactcatcatttcaatctggttcggctctacggattttgcctcgaaagaaacttgatagcactggtttatgaatacatggggaatggctctcttgacaaatatttgtttcatgaaaacaagaccataggatttgaaaggcttcatgagattgcaattgagacagcaaaaggcattgcttacttgcatgaagaatgccagctaaaaataatccactatgacatcaaaccatga

SEQ ID NO: 30750 - DNA, 372 bp, Glycine max
  Peptide Sequence Number=SeqID_147528
atgccatcgaacacggcgaacgacatcataaaaggttcagggcgtgagtccttggggagcaaggatgagaatatggggattactgaaagcactagtagtgttaatggaggaagctgtagtagtcatagcagcaagaacattgtgtttcctagcgtggaagtgcggaacctgaaggagttcagttttgcgaatctgaaagcagccaccaagagtttcaaatcggatgcattgcttggagaaggaggtttcggaaaagtatacaaaggatggttggatgagaagacactggcaccgaccaaagctggttctggaatcatggttgctattaagaaattgaatcccgaaagtatgcagggccttcgagagtggcag

SEQ ID NO: 30751 - DNA, 660 bp, Glycine max
  Peptide Sequence Number=SeqID_147529
atgattccaaacttgcttgatgatctccacatgatatacaagttgaaccggaaggaggaagacagagatatagcccaagactctacaggagaagaaaggcaaggacacagcaacaatttccaaccatcacgaaaagtctttcccgttcttgatcaggatctcaattttcttccttatgaagactatgagtctgagtcaccggacaatgagacagatgttgaaagctcaccaggttttctagtgaagaaaaagagggcacccagtgatcttgtagcaaaaatttctttatcagatttggtgaagtactttggtatgccaattgtagaagcatcaagaaatctaaatgttgggcttactgttctaaagagaaagtgcagagaatttggtattccccgctggcctcataggaagatcaaatcacttgacagtctcattcatgatcttcaggaagaggcaaagaaccaagaattggaggacagggaagcagctatggccgtggcaaagaggcaaaggatgttggagagtgaaaaggaaaacatagagaagaaacccttcatggacataaaaattgagaccaagagattcaggcaagatgttttcaagagaagacacagagctagagctgttgaaaaacacaattctacagtatccagcacatag

SEQ ID NO: 30752 - DNA, 192 bp, Glycine max
  Peptide Sequence Number=SeqID_147530
atgacaagggaaacagaatctgggtcaagagagagatgcatggtgacatacatacctggttggagggtgttgttgaagactagtaggggtcatgagaaagagaaagagacaggaagcaatagcatgaagcgtggacttaatagaaggaagagaatgaggcaaaaaccagcttttaagtgcaagtttgcatga

SEQ ID NO: 30753 - DNA, 1329 bp, Glycine max
  Peptide Sequence Number=SeqID_147531
atgatccggcggcacgcagcgtttgacccagaagtggcaagcaaagtgtgcggtactgtgattgaaccatttttgctgtcactggcaaagacttcaaacctcgtaactctgagacactgcaaccaaatccacgctaagctcatagcctcccaatgcatttcacaaacccacttaaccaacaacctcttgagcctgtacgccaaatttggccactttcgccatgcccacctcctgttcgaccaaatgcctcagaggaacgttttcacctggacaaccttaatttcctcgcatttccgaaccgggtcacttccaaaagcctttgagatgtttaatcacatttgtgcattgaatgagagacccaatgagtacaccttctctgttctgcttcgagcttgtgccactccttcattgtggaatgtgggtttgcagattcatggcctgctggttcggtctgggcttgagaggaacaagttttctgggagctctattgtgtatatgtactttaacagtggtagtaatcttggggatgcatgttgcgcctttcatgacttgttggagagagaccttgttgcatggaatgttatgatttctgggtttgctcgtgttggtgactttagcatggttcataggttgttttctgaaatgtggggagtggaaggcttgaaacctgatgattgtacctttgttagcttactcaagtgctgttcttcattgaaagagttaaagcaaattcatgggcttgcatctaagtttggtgctgaagttgatgttgtggtgggcaatgctctggttgacttgtatggcaaacatggggatgtcagttcttgcaggaaagtctttgactccaagaaggagaagtataattttgtttggagtttaatcatttcaggctattccatgaacaaaggtgttggagaacttgtggatgtggaaaagttgttcagaagaattgatgataaagatattgtaacatggaattcaatgatcttggctcatgctcggttgacgcagggatctggttcctctatgaaactattacaagaacttcatggaacaacctctttgcaaattcaaggtgcctccttggttgctgttttaaagttttgtgagaataagtcagatttaccaggtaggcaaattcattcacttgtagtgaaatcaagtgtaagtcatcatacttttgttggcaatgcattagtccacatgtactctgagtgtggacaaattggtgatgcatttaaagcttttgttgacattggaaagatgatggttcttggagttctattattggaaattatagacaaaatgggatggaaccaaaagctttag

SEQ ID NO: 30754 - DNA, 189 bp, Glycine max
  Peptide Sequence Number=SeqID_147532
atggcgaaagtggccaaatttggcgtacaggctcaagagtgtctcagagttacgaggtttgaagtctttgccagtgacagcaaaaatggttcaatcacagtaccgcacactttgcttgccacttctgggtcaaacgctgcgtgccgccggatcattccaattacaccgtcatcaagtttgaatgcgtga

SEQ ID NO: 30755 - DNA, 1713 bp, Glycine max
  Peptide Sequence Number=SeqID_147533
atgacccaaccccaagatcccttctcttaccctcccattgacccagtcaacttcgatctcatcatcgtcggcaccgccctatcggaatccgtcatcgccgctgccgcctccgccgtcggcaaaaccatcctccacctcgaccccaactccttctacggcagccacttcgcttctctctccctccacgacctcacttcctacctctcttccccgcactccctcccctccgccgccgccacaaccactgactccgacgacgtcgttgtcatcgacttcgtccaacaacccctctgctccgacgcagaaatcgcgacctacgatgaatccgcgtttctcagcgaaaattcgcgaaaattcagcatcgatttgggaggtccaaaggcgctgttctgcgcggacaagacgatcgatctgttgatgaaatcaggcgcggcgcagtatttggagttcaaaggaatcgacgagagcttcgtctacgaagctaacgcgggtttggcgaacgtgccggattctcgaggatcgattttcagagacaagaagctttcactgaaagagaagaaccaattgatgaggttcttcaagctggttcagcagcacctggatgatactcaggaggagaagattcccgaggaggatttggagattgcgtttgttagtttcttggagaagatgaagttgccgcctaagataaaatcgtattcaccatttccatttcctaccatgctagattatgaccaagacaataacgaggtttgtatagagttacttaaaacaaaagacggaatcgattctttagctctatacagctcatctgtcggaaggtttcccaatgctcctggggctttgctttatcctatttatggtgagggagaactaccacaagccttttgtcgccgtgctgctgtcaaaggttgcatttatgttctaagaatgtcggttgtttctctgcttatggataaggttacggggtcttataaaggtgttagattagcttcaggtcaggatttatatagccaccaactaatcctggacccatccttcatgattccatcaccattgtcttcgtctccaagagattttcccagtgaaaagctccaaatgttgggtcagagagatattaaaggaatggtggctaggggaatatgcatcacaaggagctcaataaagccagatgtatcaaattgctcggtggtgtatcctcctagatctttgtatcctgaacagttgacatcaatcaaagctcttcagataggatcaaatcttgctgtttgtcctgcaggaacgcttcaggatagtgacaattactcccatgatttacctttagagttctgtttcatctttattttatacttttccactatgtgcaatgatgccgatgaaggaaagaagctactaaaagcagccatgaatgctcttcttacactgcctgtatctggaaactctgaaagtattccaagtgttcaaagtgatagtgaagatataaaacccattgtgctctggagtgcattttatattcagaaattaattatgtgtaaacttgaatttatcagctccactcctacacctgatggaaatctgaactacgatgaccttttagatgccaccaggaagctatttaatcagatgtaccccgatgaagaattctttccaaagtcaacatcacctgaagatccaacagatgaggatgataatgggttaactctggatagctaa

SEQ ID NO: 30756 - DNA, 300 bp, Glycine max
  Peptide Sequence Number=SeqID_147534
atggtgtctcatctgatggcattggctttgactatggctgccctgagtctctcagatggcctaacgttggcaaatttgccattgaggatgttgaaagttagagaagacaccgatctcttcatcattgacgaagttgttttggcttccattccagttccaaagtttggcagagacataccagaagtagcaaggttgcggaatcatgcaggggcaacttgttttacattgagcgttagtaacagagatgctgttagagaaaagatacgctcacaattggaagatctgctgacaaaacactag

SEQ ID NO: 30757 - DNA, 2622 bp, Glycine max
  Peptide Sequence Number=SeqID_147535
atggccaagaaagtccttgctcgtaagagacatcatggtggcctggaagctcctcgtaatagtctagatctgcaagtacaaacacctcagaactactgtccagaaggagaattaccatacaattatcaagtaaaagaagagggaaggtctgagaaaaaccgctattcaaatgtgggttcaatgaaaaaactgatcaatgaggaactatccaaacaatcaagcaccagacaaaatgcgccaagccttgtagcaaggttgatggggatagatacgatgccattagacactaaatatgttgttccatcagacagaaaaataagtgaaaacatggggaagaggtcttcagtcaaaggagtgaatcgaaggggttcagttagttggggttcttccaactttaattcttctagtcagatggattttgattcattatataaagacataggtgatgatgatgatggatggaaccagagttttggagaactaaggccacgggaacatcctcaggaagaggaactccaaaaattcaagaaagagtttgaagcataccaagcagcaaggtttctggagtgttcaaaggttgctgaaattggcagtgctcctagacaattgcttgctcaagaaaacctgaacaaggaaaagatgatgcataacgattcagttttacacagagcggcagcagggaagcttgcagatcttgacaggcatgcattcaaaacgccacctgaaagttatggttcagaatatcatggtaaagtgatggagttaatcccagctatgcaaaggaaaaccattcctccaaggagcagaacactaagtagagactttgaggagtccttaatgatgaaatcttgcaacaaattagacacgtcttcttctcccactaggatagttatcttgaagcctggtcctgatagcatttgcaaccatgaagaaaatttgaccatatcatcaggaactatacaagggagaaatagtatagaagattttcttgaagaggtgaaagagcgtttgaaatgtgaactgcaagggaaaattgtcaaaaaaggttctgtggttcgagggaatggaattgagacaccttacaatgaaaagccatctgatcctaaactaatagcccgtcacatagtaaagcaagtcagagaaagtgtgagtagagatactggcacaaatttactccactcagaatcaataggatcatacaaaagtgaaatggagttcaatggaccaagctccccagaatttatcagcagagataccaggaggttcttgtcagagaggctaagaaatgttgggagaagtgaagcacatgctgacattcctgagggaaaatcaagttcactttcactagacaaccataaagctagactaaagcaagtgggggatgcaaataactgggaaatttccaaagaggacacagcaatacaaacaggatctttcaggcatgaactcgatgagaatatatttctccacaaggagttatcaccaagaaaccttgtaagatccttgtctgctcctgtatcacgttcaggaacatcatttggtaagcttcttctagaggaccgccacattttaactggtgctcagattcggaggaagcttgaagctgttgaaactatgtctgttgatgtcaagaaacggaaaaaggatagatttaatattaaagaaagagtctccaattttagatataaccttgctttaagagggaggctttttggcagaagggttcaatcaatggtagaatcacatggcaatgaatttggtccctttgtgagagatgtcacaagtggaccaacagttctcatgaactgtggtgtgaggcatgagaactccactgaggtacctcctagtcctgcttctgtgtgcagcagtgttcacgaagacttttggaggcaaactgaatatttaagtccaatatcaactcctgatgtgtcttcaagagacgataatgttgtgccccaggttttcagggatatcagctctggtttgagtgagctaaggagacaactcaatcaacttgaatctgatggtcctgaggatttgactatgaaacaggagcctgctgagtctgaattagaccaattagaggatccagcagaatcttacgtaagagatctacttgtttcttctggtctgtactttggttcatgggataaatctttattaagaggggacacatttgcaaaacctattggcaactctgtttatgaagaagtggaagaatctcacaagaaattggtcaaggaaaatgatgaaatctgtatcaaggatcagaatgagagtaagctagaccacaaagttttgcttgatttgttaaatgaggcactttcagttgttcttggacctcctttgacattgtctaggttcaggaggaaattacgcaactcttccattttgccaccttctggaaaggaactgttgagcttagtgtgggacgttatccgtgtttctttatatcctccatctgacatatctacttattcacttgatactttggtggctcaacacctaggatccatcccttggtctggattaataaatgatgagatcaatattttggaaagagatatagaatgtctaataactgatgatctggttgaagaactcacaaaggatatgttctaa

SEQ ID NO: 30758 - DNA, 273 bp, Glycine max
  Peptide Sequence Number=SeqID_147536
atgagcaggtcaggccaaccaccggatttgaagaagtacatggacaagaagcttcagattaaactgaatggaaatcgcatgattgttggcactctccgtggctttgaccagtttatgaatttagttgttgacaacactgtggaagtgaatggcaatgagaaaaatgacatagggatggtggtgagtcctcttctcattttctttgtggtcaaggtaatcagaggaaatagtgtggtcactgttgaggcgcttgaacccgtgaacagggcctga

SEQ ID NO: 30759 - DNA, 2473 bp, Glycine max
  Peptide Sequence Number=SeqID_147537
gagccggcgaggcgaggaacctatcgggcatgttcatcctaatcgcagcggcggcgggggcttaatggcgagcataaagttattgtcggaggctgtgcgtagctcactgcgttcgggcattttcctcgtcgacttcacgcgtgtcgtcgaggaactagttttcaatagcctcgatgctcgtgccacaaagggagagacagagaagttaaaagtatcggtgtttgttagtactgggagctgctatttgaaagttgttgatgatggaagtggaatccctcgagatgggatggaaatggtgggagaaagatatgttttagcttccatatctgaagtctctttgctggaaattgtgacgaaaacatatggaaggccaaatggatatcgaaaagtattgaaggggtgcaagtgcttatatcttggtattgatgatgatagaaaggaaatgggcaccacagaggatgagctcttttgcacccattctgcttcttctcctctgtcacttgtaaccagtggctttggagtagaagtcacaagctctcttcacaatttagaagttgagaatgatatcataaagctttctggatatatatctggtccttgcaatactgtggatacgaagggcccagttcacaagcttatgcgtcaactggctaataggtttgagcatctgaactcatggaatactgatgaagagttccaaaacaagaagagaaccaggtgtcaaccatgtccagcttatctcttgaatttgagttgcccccgatctttgtatgatttggcctttgagccatcaaaaactgttaaatttaaggattgggctcctatactaaacttcattgtgaaggccatcaaacaattctgggaggaaaacgtagcttgtgatccctccaatggagccacatacatggtagaagatcaacatcattttagcagtatcagggaagatgttgattacttaggggtcacaattttcaaagagaaacaaagtaagggagactttcttcttcagactggttattctggcaacttattggatggttcttatgccaagtgcacgtccactgtgatgagaaagcataatagtttgttgatgcataatagcaatagcttattggaaggtgataacttttttgatggtgaaattcctgctgtagaaagtttcaacattgatgtaccttttgatgcaccgagttcttcacatggaagaagattccataaagtagaagctgatgtgatcaatgaatcatttgaagatgatttgctttataatagctgcagtgggtatggttatgatgtaaagattaatgaggatttgcaacaaccttttctaaagagatgctctacgctaggaagtatcctgcatgagaaggctttgtttgtaaatgatgaatatgaactccaaactgatagcttttggagcaagcagaatgcagaggaggattatagaagtggtaaggatttatatgcccatccctgtccagaagtcacaaaaaagttaaagatgtctaaagattctgatttcctcgttagagcattgtctgaagaaaattgtctccctccagatttatgctattcagcattacaaataggaagctctgggtcagatgatcagttgttaaattttgaatggcatcctgactaccaaaaaccctcatctcaagcatctgcattggaaatgataggcaacagacagattggccgagtgtccaaccctgctttcaatcatcaagaagctagtaattttaaatatcctcaacagtctccggttggtcttcaccatagcactgaagaattcttattgcaagaattcaaaattaatgtgaaacgaacttcagaggttctgggagatatgcaggttaacgacattacagatattgatggatttgaaagtttcaacattcaaaacagtgctccatttgggggtaagttcaacgtgtggaagaatgataaactggctaacattcaaagtcaaaacaatattcttgacatttcttctggattcttgcatcttgctggagactcattgattcctgaaactatcagtaagaaatgccttgaggatgctaaagttctgcatcaggtggataaaaagttcattctagttgtggctggcagaacccttgctgttattgatcaggttgctgacactgatggatcatcaacaatgccaccatctgtcttacgagtgctaaatttgaaagcatgcagaggtgcaattatgtttggggactcattgctaccatcagaatgctcctttatagttgaagagctaaaacatacatcgctttgtttccaatgtgctcatgggcgaccagcaactgttcctctagtcaacttggaggcactgcataatcagatagccaagcttcgactgatgaatgagtgttcaagtgacgagtgccatggattacgtagacatacagtacgcgttgaacgtgcagcacagcgtttaaattctgctagaggaatttga

SEQ ID NO: 30760 - DNA, 268 bp, Glycine max
  Peptide Sequence Number=SeqID_147538
atggccagagaaaataccagctatctcaacggtcgggatgctccgaaaaaggagacggccacacgggcacggcaaggatcgacaggacgtccggttcttgtcattctgatcgtcagcgtgttgttagcgctggtggtctgggctgtcgtggaatacgcggttttcgaaccggacgagaacctgccacaaaatccgcagacggagaacgcccccgtctcgcagcagccgtcgggctcggaaagcttcgacaacaatcccgcaaacggcc

SEQ ID NO: 30761 - DNA, 404 bp, Glycine max
  Peptide Sequence Number=SeqID_147539
atggttatccacaccttttgtcatcctgagatagcaagtctgaggacatgcgggggtaccgcgatgtacggagatacccaagtagttatccgtacaaacgatttccgtcatcctgaccctcaggtgacatgcggggggtaccgtatggttatccacacctttcatcaaccaagggcaaacaagcccgttgacgcgcagagactaacatcgttttctgcaccttttgtcatcctgacccatggagtcaggttttactctagtcgtccggagacatgcgagcccgacgatgcacgagattcttctttgctaggcgggaggcaatcaagttcgatggcgtggggaagtgtcgtggttgtcccactttatcgctttcaagacactgaagttttgatgacgcttctgat

SEQ ID NO: 30762 - DNA, 381 bp, Glycine max
  Peptide Sequence Number=SeqID_147540
atgacggaaatcgtttgtacggataactacttgggtatctccgtacatcgcctgacttcacaggtcaggatgaccgaaagcacggaagatgacataaatcttcgcgtgtcaatgagtttgttggccctgattgaaaaaaggacgacaaaaggtgcagatgacgatgttagtctctgcgcgtcaacaggctcgtttcccctgattgacaaaaggcgaggatgggcattctcaccatgggtcaaggtttatggtgagttgggattttggctcaacgcttatagaacggctggacatgatatatgtcagagtgttggtttggccagcgattcagggataaaggggatgtcccacattatttccatgacacacatgcaacaatga

SEQ ID NO: 30763 - DNA, 447 bp, Glycine max
  Peptide Sequence Number=SeqID_147541
atgtgtaaaaattgtttcatgcttgagcaaagtaaagcaattttggcaagaaaaaatggtgtcaaatctatcaagtataatgaggatgagttctcaaaggttgcttacttcaaattactattaaaaaagtcttttaacaagaacaagagaaccctcatgtttcattttcgcttggtctaccctcttgaccaatccacatggactctctggccaagtatatttcattccactcttagtcctggattggttcaaaaactacaagcaatgagagctggtgatgagaaccaactttgcttgagacatttgtatcaaaatttcaagaacttttttggtgaaggcacacttctcaaagatttagtgatgggtgcatcaaaggcaccatatgaggaggcatgggaagacaagatgactcagattaaggaggtcagtgaagaagcatatatatga

SEQ ID NO: 30764 - DNA, 1299 bp, Glycine max
  Peptide Sequence Number=SeqID_147542
atgacactctccattgatacatgtggggtggttccacatagaaacgatagtcttcctggcattgattacaagaaccatgcccaagttcatcctttgttcatgtatttatgtttaattcaaaaaccttctatgaaggtgaagcattcatatgttgctctcaagatccagaaaagttcggcccagtttgctcaggctgcccttcatgagatcaatcttctttcatccattgctgaccgtgatccgtcaaattccaaatttgttattcaattgattgaccactttaagcacactggtccaaatggacagcatctttgcatggttcttgagtttcttggcgatagcttgcttcgcctgatcagatataaccgttataaaggtcttccattgaataaagttagagagatttgcaagtgtgtgttgattggtttggattacttacatactgatcttggtatgatccacactgatctaaaacctgaaaacattcttctatgttcaaccattgatcctgccaaagacccttcaagatctggactctccccaattctagagcggcttgagggaaacacgaatggtggagttacaagtcttattgagaaaaggttgaaaaggagagcaaggacagcaattgctaagatatctggaagaagagcatcaatgggaggaacaggagatgttgcaaagactggtagaaatatcgatgggattgatgtgagatgcaagatagtagattttggaaatgcttgttgggctgataagcagtttgcagaagaaatacagacaaggcagtatagagcacctgaagttatactaaaggctggctattccttctccgttgacatgtggtctttagcttgcattgcttttgaacttgccactggagatatgttgtttacacccaagggcggacaaggttttagtgaggatgaggatcaccttgccctaatgatggaactccttggaaagatgccgcggaagatcgctactgctggagctcaatccaaggatttctttgacaggcatggggatctaaaaaggattcgaaggctaaaattttgtccacttgacaaattgttgactgataaatataaattttcagtgaatgatgctcaagagttttcagaatttcttctaccactctttgattttgcgccagagaagcgaccaaccgcgcgacagtgcctgcaacacccatggctgaactgcatggaatctcctccaaatgaaatgagaaatgaatctgctgtggaaaaggtagatgttgtgatgagcaaacttaaaatcagggtgggaaagtga

SEQ ID NO: 30765 - DNA, 348 bp, Glycine max
  Peptide Sequence Number=SeqID_147543
atggagtgggacagcaattccgatctcagcgatgacgacgccgtttcgtatgtcctaaacgacgacgatgatgacgccgttggacccctccccttccccgtcctccaaacggcaccgtgcggcttcgtcgtcaccgacgcgctcgaccccgaccaccccatcatatacgtcaacgccgtcttcgagatggtcaccggataccgcgccgaggaagtgctcggtcgcaactgctttttgggaattttgttgtctgtgttgagaggtgcatttctcggttctatggcggagaactcgttcgggtgtgaagggattggggaaattaacttaatactgcacgtgatgtcgtga

SEQ ID NO: 30766 - DNA, 459 bp, Glycine max
  Peptide Sequence Number=SeqID_147544
atggtggtgacgggtgacggagaattaggtaaaaaactcgtagttggaccttgggttgggtcgatcggtccgcctccggtgtgcacccggtcggctcgtcccttctgccggcgatgcgctcctgtccttaactggccgggtcgtgcctccggtgctgttactttgaagaaattagagtgctcaaagcaagcctacgctctacgaacaactgcgaaagcatttgccaaggatgttttcattaatcaagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 30767 - DNA, 930 bp, Glycine max
  Peptide Sequence Number=SeqID_147545
atggccaactccaccaccatgtattacagcggcaaaaacccgctgagcaaggtggggtacaagagcgaagccgtggtggtgccgcgcggcgatcgccagcgccgcctgcacaaggcgctgctgcgttaccacgatccggccaactgggcgctgatccgcgccgcgctggaagagatggggctaaagcacctgatcggcagccgccgcgagtgtctggtgccgggcgccgagcatcgacgagcagcgcgaagcgaaacgcctgcagcgccatacccggccggcgctgaccaaacataccgatatcaatcggcagcgcacgccgtccaaccggccgccgcgcaaaccgattcgcaaagccaagccgtaacggccacgccgcgggcgcaaacaaaaaggagaaccctcgggttctcctctttacttttactcatcacagccgatcgtaagcggcttccactttcatcaaatggcgcggcgcctgtggagcagggtggtgcgcagcagcgcgccggtgccgttgacgtaggcgatgatggtggcgtagcgcagcgtaactggattggcgatccctttaagctgttgtttttgcaaggtggccagataggcggcgccgagatcgatattggtgtcgggatccagcagatcgtcatcgtccgggcaaccgcgtttgcctttgtagcgataggcgtcgcagccggcggtatcggctttcagctgcatcaggccgatcgcattggatctgctcactgcggcggggttgaaaccggactccacctggatcatggcggtgatcagcttggcgtctacgccgtattcgctggcggcgtctttaatggcgctatcgaaggcgtggcgatcgtagctgacgcgctgtttcttgccggcgcaacccgccagcaccagcatgatgcaaagcatgcccagccgtga

SEQ ID NO: 30768 - DNA, 921 bp, Glycine max
  Peptide Sequence Number=SeqID_147546
atgatcaacacgctgcatttcagcggcatgcaggtggggatggtttacagcgccaaaggcatcgccgcgctgatcatgccggggctggcgggcatcatcgccgatcggtggatgaaggccaactacctgtatgcgctttgtcacctgctcggggcgctggcgctgtactgcgcggcgcaggtcgagcaaccgatgctgatgttctgggtgatgctgttcaacgccatggtctatatgccgaccatcgcgctctccaacgccatttcctatttttgtctcgaaaagcacggctttgacacggtgaaggactttccgccggtgcgggtgtacggcacggtggggttcattctggcgatgtggctgctgggtgagcgtgctggggctggatgcgctggtgctgttccgccagcggcgcatggcgctgtttttcctgttcgccatgttgcttggcgcggcgctgcagataaccaataccttcggcaacccgttcctgcacgatctgtcgctcaacccgctgtatcaggacagcctcagcgtccggtatccggcggtgctgctgtcgctgtcgcagatctccgaagtgttctttatcctcaccattcccttcttcctgcgccgttacggcatcaagcaggtgatgctgatcagcatggcggcctggacgctgcgcttcctgttcctggcctatggcacgccggtcggctttggtttcgttctgctgctgctgtcgatgatcgtctacggctgcgccttcgacttcttcaatatctccggcgctatcttcgtcgagaaagaggccgatcgccgcatccgcgccagcgcgcaggggctgttcatgaccatggtgaacggttggggcgcctatctgggggcgctcgccagcggcgggggtggtggacttcttcagccatgacggcgtga

SEQ ID NO: 30769 - DNA, 219 bp, Glycine max
  Peptide Sequence Number=SeqID_147547
atgacgctttctaatcagtatcctaatacagtggttggaacagctgtggttactcgtagtgatggaagattagcattgggaagacttggagctctctgcgagcagcttaaagagctaaataacaacgattatgaggttatattggtgacttcaggagcagttggtcttggccggcaaagactaagatatcgaagattggtcaatagcaggtttttgtaa

SEQ ID NO: 30770 - DNA, 341 bp, Glycine max
  Peptide Sequence Number=SeqID_147548
atgaaaaatcatgaaattcattttggtacgagatactcaatagaaaaatttcaagggagactagagttacaaccttactatcaaaatgaagcagaaagaggttccaatattgataaactattgatgcaattcatggaaacaactaaatcaactcaacaagcactccaaagtgtagaaatccaggttggtcagctagtagaagcagtaactcaatttatgtccagacgagaaaaatcctttgtagaggctgaagctcaagagaaaagccctgtaaaagagcatgagtcaagagaaaaagatgaggagaaagatgaggaacaagcacaacaacaatgggaaaa

SEQ ID NO: 30771 - DNA, 294 bp, Glycine max
  Peptide Sequence Number=SeqID_147549
atgagtgaaatagaggaagtgcaagagcagatgaaggccgacatggaggccatgaaggaccaaatgacctccataatgaaggccatgatgagtatgagaaggatgatgcaggacaacacagccgcagatgccactactagcgtcaccgcggaggcggatccgactcacccattcggcataaaccaaacaagtcatccagttctagacgtggtaggtgatgtaagctctattggagcttgtaggcctaggatcttcttcatcaatggattcctctgtttcttggaagatgaatga

SEQ ID NO: 30772 - DNA, 351 bp, Glycine max
  Peptide Sequence Number=SeqID_147550
atggaaacagtcattcatgttgatgctgacacaccgtatgctgaagttgaggtcatgaaaatgtgcatgcctcttctttcgcctgcatctgggattattcatttcaaaatgtctgaaggtcaagcaatgcaggctggtgaacttatagcaaggcttcatctggatgatccttcaactgtaagaaaggcagaacccttcactgggagcttcccagttctgggacctcctactgcaatttctggtaaagttcatcagaaatgcgctgcaagcttaaatgccgcacggatgattctttctgggtatgaccacaatattgatgaagtgagtaaattcttcaccttgattcattaa

SEQ ID NO: 30773 - DNA, 1461 bp, Glycine max
  Peptide Sequence Number=SeqID_147551
tttgctgttgctaccatgtccgagcaagtttcgttgaaactcatggaaaataaagagagcgacaatgttatatttgcagaggcaggacaagactttgtgggtgttgctaccatgcctgggcaagtttcgttgaaacttgtagtaaacaaagaaaccaataaggtggtatttgcagaggcaggtaaggactttgtggatgttctcttgagcttcttaacattccctttaggaaccatcgccaggcttgtgcaaaaggactcagatgtcggtccagttcaagttggttgtctaagctcactctatgaaagtgtggcaaatcttgaaaaagagtgtctctggacagaggcatgcaaggaaatgctattgcagccaaggaactcttcagaagattattgcaggagtctcaaacttaacattgatgacactgagcccacaaagcacttcatgtgtacgagcaatcttgattgcgcatatagccaattgagcacttacccaaatggaagatgtgcctgtgggtttgctatgaccactttagtttttgttgatgacaaagtctacaaaggatttgtaaatggtggtgccacttttatcgttacagatgatctggttgtccttccaaacacaatggatacaggtcttagtttctttcagagttgcggagtaaaatgtttgagttcagtacagacaattacattaactgtcaccaagaaaaaggtattggatctgctcaagtgttctttattgtccaagtcaactttgacagatttgttcttggtaaagaaaccatttctcgagaactcaagtttttctcctgctgttgttgaaaacagtagtactatccaaatcaaaataaagctagttatgagaaaatcagatgggaagatattgtttgctgaaggagaagaagattttgctgactttcttttgagttttctcactttacctctggggggagtggtgcgtatgttaggaggatattcttcaatgggcagtgttgatgggttgtacaagagcatagctgatttaaatgaaaacaaatatttgatatcagagaaagtgaagaataggcttgttgatcctggccttgccccgcagttccaaacaaaaatagccaaccagatgttaccgatttgtgaacaaatttcagagtattattattgttatccgtttgatcattatacagaatttatttttcgcaatcaattctataaaactgattattatgaatatgagaattatgagaagtttgaacgttatacacggttggtgttagtagatcctaagtcatctgaaggaagcattgaaggtaatggctatgccaagggaccagcaatgtttatggctactgatgacttggttgtcgcacctatgtctccaatttcgggtttatctttactcagccgtttaaatatacctcttagtgacttgaaggaaaaagttgttgtcattggcattaaggag

SEQ ID NO: 30774 - DNA, 441 bp, Glycine max
  Peptide Sequence Number=SeqID_147552
atggctgccttcatcaggcaatatcagtataactcagatatggctctagatagaatgcaactacaaaatatgtgcaagagagataatgaatctttcaaagaatacgctcaaagtgttctactaagagaagatggtaggttacattctagctttgccgatttagtgtttgctggcgagaggatcaaagtgggtctgagaagaggaaaatttgattatgcttctactacgggttctggtaatatgaagcctggggcgaatggagcaaagaaaaaaaagggcgaaacccataacgtgattgcagcgcctacatggatgaactccgcgcaaacccctcacaaccccatgtatcagtatcccccacaccagtaccactactcggccaatatcgatcctcccccttgcccaatgcccctccgaccaagggcacctaaccaactgtag

SEQ ID NO: 30775 - DNA, 129 bp, Glycine max
  Peptide Sequence Number=SeqID_147553
atggggtcggaccaagcgccatcttttaaaaagagattctatcatgtcaaagtcaagaatctagagctagccagcttgcaaaaactggggcaacggatgggtcaagttcaacgtcaagccttcagcaag

SEQ ID NO: 30776 - DNA, 282 bp, Glycine max
  Peptide Sequence Number=SeqID_147554
atgggttgtggcaaagtagtggtacaaggtcgtggcagtgagctatgtttgagacttgtgagtgggttgcgaaagatagtggatcatggttgcgacagggagtgggactcgagtctcaacaaagagtgggtcgaggcgagaggcgtcgagctcgagagcgaagtgacaaagagggagagtagccgagtgtgggtgtatcgttggtgctgccacgtttacttaggtgggttggtgagtctacctagcccaccagaggttcagctcgagtggatcggatcttag

SEQ ID NO: 30777 - DNA, 603 bp, Glycine max
  Peptide Sequence Number=SeqID_147555
atgggggtgtactctagggacgagaagctactgatgcatttcttccaagaaagcttggccgaagaggcggtcatctggtacaccaatttggcggcttctcgtatccactcgtggaaggatttgattactgccttcattaggcagtaccaatacaatactgacatggctccagatagaactcagttgcagaacatgagcaagcgtgagcatgagttctttaaacatgaggtccaaagtttgatcgatgcaggttggttgacgttccaagaggatggtccaaacgtgataacaaaccctcttgctagtcatgggggacaggcggttaacacggtggaggaatacggacttcagaggccgaacgcttgtcgcaacctacccttcagcggaagggcgacgtggggctcatgggtgcgtcttccaatggaggaaggcacgtggagtcaccaccaacgtttatttgaggaaaacatcggaaaaaccagaaaggtgtggtctacaaacattaagtgtgaaaggttcaggaattgtttttacgcacgaggaagggtgtttccctcgctcctacgtatcctcaattgcgatgaggaaatcagacctacgtag

SEQ ID NO: 30778 - DNA, 601 bp, Glycine max
  Peptide Sequence Number=SeqID_147556
atggctgacccaatcacagcggcagacgtgcaggcgtacctcggtgaattgggttacaccattcccatggcgttgctggatccgattctctgcgctgttaacaagattatcccgtgcctcgatggcgcagggtatgacgactgcaccgcgaagctgatcctgatgtacgccgccgcgctcatggcaacgtcgtccggcgcgcgccgcatcaaatcgcagggtgcaccgtccggcgcatcccgctcattcgattacggtgctgacagcattacctggctgcgcgactcgttggcccgtctcgataccagcggatgcaccggtgagttaccgatcagcgctgcgcatccgggcgaccggcgccaaggtgctgcgctggaaggagggctgatgtcatcggtagcaaactggtcatgcacagccacggcgaccatctggcgaaagctggaaggcaatgacgaatacggcgacccgctgggctatgcggaacctgagcaaatcctctgtgactacgagggcgggctcagcaagaagttagccagcttgggtgcagaaatcgtcgttaagaacactgtctggactgagttcgcgctggcggccgcgg

SEQ ID NO: 30779 - DNA, 391 bp, Glycine max
  Peptide Sequence Number=SeqID_147557
atggaaatgtctaacttgacatctaaactgaaagcacttaagttagagcttggtaaaaacttgctcgtgcatttagttttaatctcacttcctgcacattttgggcaatgcaaagcgacttataacactcagaaggacaaatggtcacttaacgagcttatatctcattgtgtacaagaggaagagaggctgcagagagacagatctgaaagtgctcatttaagctccacttctctgaataagaaaagaaagaaaactaagggtgttgctgaaggatcttctcagcaaaagaaactaaagaaagatgaggaatttacctactacttcagcaagaagtttggacacatgaagaaaaagtttcccaagtacgccacatggcgtgtaaagaaag

SEQ ID NO: 30780 - DNA, 231 bp, Glycine max
  Peptide Sequence Number=SeqID_147558
atgggtgtttttgcttccgaggtgctgctgctgctgcaaccacaaccacaacttgtgatgaaactcatgataccactacaggtcataatcatggaactcatgataccccaggtctcatcatgtagtcatgatgccacaggccatcatggaactcgtgaaaccgttggtcatcatggagacgttgattttagtggcggaggcggtgattttagtggtggtggcggtttctga

SEQ ID NO: 30781 - DNA, 354 bp, Glycine max
  Peptide Sequence Number=SeqID_147559
cagtttcgtggaaagttggggcccctgacttttgcctacataaaggatcgataaggaatgtgagacacaaaggcactaacatcgaaaagaaagcaaacatggggagtttttgcttccgagctagaaaggaaggagatgataacaaatacaagcccaatgatattatgacagcaggtgctgctgctgctgctccaaccaaaacttgtgatgaaactcatggtaccactacagatcataatcatggaactcatgataccacagctcatcatcatggtagtcatgataccacaggccatcatcttcatcatcataccgttggtcacgatggaggcgctcattttagtggtgatggcg

SEQ ID NO: 30782 - DNA, 407 bp, Glycine max
  Peptide Sequence Number=SeqID_147560
taaaacttggaccaaaaataactgatacagtaaaaggaaaattaagcttaggagcaagaattcttcaagttggaggagtcgaaaaagtcttcatgcaactattcagtgtaaaagatggtggtgagaagttactaaaagcatgccaatgctatatatcaaccacatctggtcctctagcaggactcctattcatatccaccgataaagttgcattttgcagtgacagatcaatcaaggcctattcttcaaagggtcatttgatcagaattcattacaaggttgtgatcccacttgaaaaaataaggagcattaaccaaagtcaacatgtgaagaagccttcccaaaagtacatagaaataaaagctttcaaatacctgaagcaggctatctctcaagctcaagcgtag

SEQ ID NO: 30783 - DNA, 420 bp, Glycine max
  Peptide Sequence Number=SeqID_147561
atgtatgatgtgttgattatattccatcaggtcatggaagataaatatgaattctttgctaacaggaaactctcaaacacacagaagttcatagttccactgcttagagagctatatcttgatgctaataccgctgatttcaattatatcattggttgtgcatgggcccacattggagcattaggcatgcatctcttgcttagctgtaatgacattgatccagccatgaagtactattgcaagtacgaaaagagtgtggttatttttctgggcagtttttggcacaagaggcagtgtcgaaagctgcaaagaaagtgcattgagtttttaacaagtttaatactttatacattcaattcttctaagaaagaaaccatagtaataggtgatgcaatagcaaaaagaaatggatattggtga

SEQ ID NO: 30784 - DNA, 240 bp, Glycine max
  Peptide Sequence Number=SeqID_147562
atggagactgttgtgcatgactcatattttatgagtaaacatattctagagggtagtggagtagagcacaatagagttattggaaacaacgagctgaattttcaggatgtggataaagaacctaaataccattcccacacctccaccccaaataggaagcatacaaccagtggggggcttggtgaagccttaggagcaggaaaggatgaggatgactctgaaactaacatcataacttga

SEQ ID NO: 30785 - DNA, 324 bp, Glycine max
  Peptide Sequence Number=SeqID_147563
atgtctaaaaaggaagaatcaccggaggactgcgatcgaacatttcctaatagacatcgtccaaatagtggtcggctttgttttttcgtgcgagcacaaccgaagttgtgtttcggccgacactggcatgtactcatttactcagctagaaaaacattggctcacttcgacaaaagaacattattcaccgatattgataaaaaaaatggtagtcgatgtcggccaggaaagatgaccgatccaggtctaaaaaggaagaatcaccatatgacgccaatcgaacatttcctaatagacatcgtccaaatattatcgggggattga

SEQ ID NO: 30786 - DNA, 357 bp, Glycine max
  Peptide Sequence Number=SeqID_147564
atggcggaaccatcgaaaaagcggaaaggaacttcgactcggagtcagcggcattctgggtcacaggaagcaccaattcctccctccattccctttggatcattattctcatcagaggaacagcatatacggtacacaaacctcttttcctctcgttccattgtagacccaaaattcatagatatggagttcttctcaaatgagaattttgaatgcttccaagcatttgaaaactccaatcttattccattcatgtctctgaaattacatgtctattatgaattagtcaaagccttctattctaatttagaaattcatgaaggtgttctaatgtctgaaatctatgggattaagatg

SEQ ID NO: 30787 - DNA, 111 bp, Glycine max
  Peptide Sequence Number=SeqID_147565
atgaatgagaccctggatgttagcatttcgtttctaaacgaccatttagaggaaacactgggttcaacaaaaatagaagaacatcactcaaagtgtatcaatctcacacag

SEQ ID NO: 30788 - DNA, 132 bp, Glycine max
  Peptide Sequence Number=SeqID_147566
aagttgaagaaggcagagaccttaatatgggtggactttgtggagtgtcctaaggttgaagtagtctatggttcaagttggaaaagtggggaccttgaaatggaggaccttgacatagatttgatggagtag

SEQ ID NO: 30789 - DNA, 312 bp, Glycine max
  Peptide Sequence Number=SeqID_147567
atgaacttgattcacaagggtttgtggaagggcgaagaaggggtgcaccaattcgtgttactagggttttgtgaagtgttcaccattgttggacacattgagttctacaacagcgaatcgccagagaagatgaaaagtgtaggtaactcattgcaatatcttttggttgcattctcaaactatgctggcaccttggtgaacattgtgcagaaagtgactcgaaggctagggaaaacagattggatgaacgatgacatcaacaatggaaggttggattactattacttttacttccttatagcaggattgtaa

SEQ ID NO: 30790 - DNA, 504 bp, Glycine max
  Peptide Sequence Number=SeqID_147568
atgcacttcctcaccgcaccctcctacctttcgctgctctcgccccatttgaccccttccctcgcccccccactccacttccccgcctcgaccgggcgggtgcgccggtttgcggttgaaaccggttcggttctccgttcttctctctggaaggtgaaccgctacaagggtttgtggttgtcctgcaccgggttcttgcggcggtgcaaggattgggacggagagttttcctctcttgagtcgcagattttggatttcatgcagaataccgataagcccgaagtgtttccgaccaaggaagagttggttgctgcagggagggtggatttggtcaacgctattgtcaacgaaggagggtggctcgcttttgggtgggatttgaatggtgggtccagcgaaattctcggttttgaagataatagtggcggtggaattgagggtaatggggctcaggcttctggggtttcttcttcttctccttctcaatcagataattcagtgtga

SEQ ID NO: 30791 - DNA, 189 bp, Glycine max
  Peptide Sequence Number=SeqID_147569
atggagaaaaaacctggatggaaggccattccttacatcttaggtctctatctaaacgttggtgcctcaaatattattgggatatggagtggagtgagcaattgcataccacttattggtgcagctgttgctgattcctatttgcgaaaattcagaaccattgccatatcatcttttcgaacacttgcg

SEQ ID NO: 30792 - DNA, 672 bp, Glycine max
  Peptide Sequence Number=SeqID_147570
atggatgaattagatgtaacttcaagtgacaagcagtatcctgggtgttactttctggtatgcaggggaattgaagctggaaaatcaggcattgagggtatattgagtcggttggagaaacaaagaaatagatcttttggacttgacttagataatgtttcttttgaaaataatgaagataaagatgaatgggatcctagaaccacaacggatacaatggccgctggcctagaaaatggtagcagagcatcctcatcaagctctactagcagtcatctcagtggttctcagatcaaacatgatccgcacggatctcaattaggtactgaaaatttaagaaactcgcttaagccagagacgtggaggagttggattattcagagaactggttttctggatacagattttgaagatgctgaaattgttcccaatgaaactgagaaaggaggcatgagtgacgcttcaagacaacctgatatcctcaacagaagggagttatcttctgaacatataaacagagaaacaggactatattctcttgatggaaatgcaaatcacagtgacattaaatcccgtatccagaatctggaatcggagctatcttctatacttcacttgttgaggtctagctcggataacattacaatgcagatggtgagtgcaattatttaa

SEQ ID NO: 30793 - DNA, 1014 bp, Glycine max
  Peptide Sequence Number=SeqID_147571
atggaagaaccgaacaagacagagaacgaagatgacagggacgaatcagaacaacgagtgtggagttggggtgctggaaccgagggacagttaggaacaaagattcttcaggatgagcacttccctcaactccttcaccaattctctctctcctccatctcttcccttgcctgtggcggtgctcatgtcatagccttaacctctgctggaaaggcactatcatggggtaggggcaattctggccaactgggccatggggaggttgtgagtaacactttgtatccaaaggctgtaacatcattggatggctatttcataacccatgtctctgctgggtggagccactctggttttgtttcagatactgggtttgtgttcacttgtggggatggctcctttggtcaactggggcatggggataatgcctcacactgctctcctgtcaaagtgtcatgctttgttgatctgcatgtggcacaggtggcatgtggaatgcgccattcccttgtcttgttaaaagattgctcaggaaatcaagtttatggatttggctctgggaagcgtggtcaactgggtgtcagcaacgatagggtcaaatctgttaatgttcctaaagttgttagtggctttgaaggtgttgaaatcgttggaactgctgccaatggtgaccatagtgctgcagtatctgttgatggacatgtttacacatggggaagaggcttcaagggctttgaagatgctcatgttcctcagtgcttaaactcttcattgaattttaccaaagttgctctgggatggaaccatgctttagctatgagtggtgaaggggaggtttatatgctaggtggaaaccaccttggagtgcttagtgatcttcagaatataggccctgctaagcattttcctgatttaagagaattcaatttggagaaagtccctggccttgatgggacgaagattactgatattgctgccggagctgagcattctgtcattgtcacaggcaagttgtag

SEQ ID NO: 30794 - DNA, 282 bp, Glycine max
  Peptide Sequence Number=SeqID_147572
atggaaggcgtggaatggatcaagcgcgaaagcactgtcctcattttctctgttgagctttggaattttctttacgagacgaagcttctttggaattttctttacgagacgaagcttgtagagttaggaacggcgaaaaaggaaagagagagagcgagaggcgaaagcgtacacgtggcacctcttcacgctgacacctcttcccctatgtggctctattccaacctcaacctccctcactgcccggtaataataacttactttattctaaaagccgcgtga

SEQ ID NO: 30795 - DNA, 768 bp, Glycine max
  Peptide Sequence Number=SeqID_147573
gtgaccgcgcagattaactttgaccgcagcgagcagacggacgagaagtatcagccgaatgcgaacccgaataacacagcgattcgctcacgccagaccagcaccagcgatcagaacggcagcccgtatccgggcggcgtgccgggtgcgctctcaaatcagcctgcgccggctaataccgcgccggtcaccaacccgcagcagcagaacaataacaacgctaacggccagcagaacaacaacgcgcagaatgccggcacctcgaccagcaccgcgcagagcagcggcccgagcagctccagccgcaacgatacggtgaactatgagctggatcgcaccattcgtcacaccaaactcaacgtcggtgacgtgcagcgcctgtcggtcgccgtggtggtcaactaccgcgatgacggcaaaggcaaagcggtggctctgaacgatcagcagatcaagcagattgaagatctgacccgcgaagcgatgggctattcgcaaacgcgtggcgacagcgtcaacgtggtgaactcgcagttcaacaccaccgagccaaccggcggcgacctgcccttctggcagcagcagtcgttctttgatcagctgatgaccgccggtcgctggctgctggtggcactggttgccttcatcctctaccgcaaaatggtgcgtccgcagctgctgcgtaaacgtgaagccgagaaagccgccgtcgaagccgccgctgcacgtgctgccgcccgtgaggaagaagccgcttacagcgtctag

SEQ ID NO: 30796 - DNA, 303 bp, Glycine max
  Peptide Sequence Number=SeqID_147574
atggcatccttcaaccagatgcagtcccagcttcagtcgcagatgcaatctcagggacttgcactacctcctgaccctctggttggtccctccggtcctcgagtgagcacaaaagtttatgagggatccactgttgttcataacactcctttgttgcctggccaagtaaaggtgagtgtagaggaggttacagatgcagatgctccagttcctctacccactgatgaggtttccttagtggggcaggcacttcacaccttccttgattggccgacacatctggtcaagtttttatcacagcag

SEQ ID NO: 30797 - DNA, 726 bp, Glycine max
  Peptide Sequence Number=SeqID_147575
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgggtttgttggtgatttggaggggagggacgaatcaaagcgacaagggctgaatctcagtggatcgtggcagcaaggccactctgccacttacaataaccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 30798 - DNA, 297 bp, Glycine max
  Peptide Sequence Number=SeqID_147576
atgtttttctctatttatcatcactacgggccatatggccagatcgacgttgtcagaataatagtgtgcccctttgaaaaggatgaatgccctacccatgtgatatctgctaaaggatttgtcagtgagggcttgacctctgatgtatggaagtacgtggttgaagtgaattcctcggaaatgcaaccggagggcaatctctcttttgacccggtctgcatatggctatggttcagatacagactaaagactttctttcgtgctttgatctcagtggaagtagagtattgctcttga

SEQ ID NO: 30799 - DNA, 312 bp, Glycine max
  Peptide Sequence Number=SeqID_147577
atgtgccctgcaaacacccacgagttcatgacggtctttccgaaagatatttcacatgagccggtggccacgtgtcccataaccgtggctggcgccgtatccaccatccacgtgcaacagagcaaacatggcaagggggtggggtcgcggggcccacggtgttttttaggtgggggctacgtggctggaaccgcatggtgcagggttcaagttggaacgcccgagggggacaagagtcgctttcctccagataaggatgggctttttgtgggaggtgatgtcatatggggttgtgtgcggtccttgtcgtga

SEQ ID NO: 30800 - DNA, 336 bp, Glycine max
  Peptide Sequence Number=SeqID_147578
atgttgatgcagttagcttctccgtgtttgttccttctaggttttatgcaaacctcatctaccatatttgttcaagctaacaattggggcttatctgttttcgggataaaggaattgagtgctgtcttcggtcccaaaacgctcctttcttgctgttgctttgtgcttaaaaccatgtcacagtatcaagcatggtgtttaggtggggtttttggaaggacctccaaggctagctacaagtcttcaagaggttcactggcccatcgtaagcctgaagtgtcgtacatagatttaaacgaaatatatccaacattttatttttcatttgattcttaa

SEQ ID NO: 30801 - DNA, 207 bp, Glycine max
  Peptide Sequence Number=SeqID_147579
atgggaacaagacttttggtgggttggtttagactttggactttaaaaagtaaaagggaggatcagggagtggagtttgatctagaatttatgacgaaagaagcaggtgatgaggattactataatgtgggaattgtgggagtgaggagagatcatacccatcactcagaggaactggaagcagaattaagagggtgtcagagatga

SEQ ID NO: 30802 - DNA, 234 bp, Glycine max
  Peptide Sequence Number=SeqID_147580
atgccagaaccacctacacctgcacctgctaatgtagatatgcctcgacatgcagtggacgcttgccaacgaataacagatagtttggaacacatgatcaacatgaggatgattatgactagaaatgaagcatacactcaaaccaagccctacctgagattggctaggggtgtcactgagcaacatcatgtttatgttcagtcgagacgaaggagggatacacaggacaagtga

SEQ ID NO: 30803 - DNA, 499 bp, Glycine max
  Peptide Sequence Number=SeqID_147581
atgggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 30804 - DNA, 261 bp, Glycine max
  Peptide Sequence Number=SeqID_147582
atggcaaggcgcagaatgaccataatttgtctctgcgtgccacctgacacgatggcctctggatggcaaaaaggtgtggggaatggccataatttgtctccgcgtgtcttcggacacgatcaagcctgggtggcaaggcgcagaatgaccataatttgtctctgtgtgccaccggacacgatcgcctctggatggcgaaaaggtgtggggaatgaccataatttgtctccgcccagctctcgacttattgtccctgaatga

SEQ ID NO: 30805 - DNA, 741 bp, Glycine max
  Peptide Sequence Number=SeqID_147583
atggctccgaaaaagcttttcgcgaagaggtctaggagagacgctgcggctgaagggtccagtgctgcccccgagtttgatagccaccgtttccggagtgtcgagcaccagcagcgcttcgaggccatcaaaggatggtcgttccacagagagaggcgcgtccagctcagggaggatgagtatacagattttcaggaggagatagctcgtagacattggacgtcgctggtgactcccacggctaagtttgaccctgaggtagtcctggagttttacgctaatgcttggcccacagaggagggagtgcgagacatgcgttcatgggtgaagggtcagtggataacttttgacgcagatgccctcagccagttcctgggtgacccactagtgttggaggaaggccaggagtgcgagttcagtcagaggaggaacagggccgacggtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 30806 - DNA, 489 bp, Glycine max
  Peptide Sequence Number=SeqID_147584
atggctccgaagaaactctccatgaagaggtctagaagagacgccacaggagaaggatccagtgctgccccaaagtttgatagtcatcgtttccggagtgtcgaccaccagcagcgcttcgaggccatcaggggatggttgttccatagggagaggtgtgtccagctcagggaggatgagtatacggactttcaggaggagatagctcgcagatgttggacatcgctagtgactcccatggccaagttcaaccctgagatagtcctagagttctatgctaatgcttggcccatgaaggagggagttcgggacatgcactcgtgggtaaggggtcagtggattccctttgatgcagatgctctcagccaattcctaggcgagccactagttttggaggaaagcgagcagtgtgagttcagccagaggaggaaccggcccgacggtttcgatgaggaagccatcgcccaactgttgtgtatatcggggtag

SEQ ID NO: 30807 - DNA, 1237 bp, Glycine max
  Peptide Sequence Number=SeqID_147585
atgtgtacctggagtcgctttcaggaatcagcttccctacattgagctgcaactattggatcttctaagactgacttcgacagaaatacaaacacaattcttcaagaagcaaggattgaggtatagtttcatgattgctgttttcatggggtgcaaaaacggagaaattgagcttgggttctccaacatttctcaagtaattaagaaaactatactaccttcatcatcattttgcttcatgtcattatccacgggtagccctgatcaatgttcatcatcactattactcagtagtattccgggtacttcccagtcccattttcctcaaacccttcccacacaaacacaccaacaacaaagcatccaagaaatagatttagctcctgtcattccaagttattttcccacaccagatggtgaacatgaagcaatagtaagagcacttatgagtgttatgtctccactttcttcttcttcttcaacttctcagcagcatcaaccccgccaaattttgcctaattatacttcaatagtacatccaggagccaccgctttcaatacatatagatcagatacaatgaaccctaatataacaccctacatgggatccaattttcgcaggcaaagcccacagaatagatcatttgcattctttacaaacttaaatttgatgagaatgagagaactcgttagtcaacctgcatcccgtcccattagtacccaacaccagcagcatcatatgataacagagcgaagaaggcgcgaaaaactcaatgagagttttcaggcacttagagctcttcttcctccaggaactaagaaagccaaagggacgatccttacaacagcaaaggatacaatgagatcattgatggatgaaattgaaaagattaacttgagaaatcagcagctgatggcagttttatcagcaaaagaaactacagtgtcagctactagtactgaagaaaacaaagctaaacctagcagtagctcctcaaatgaaagattgaatgttcttgtttcggccgtgttggaatcgagttcattatcagaagagcgaatggtggacgtgcaagtgacactgagaggagaaagttctcgagttgatgtattgattcggctattggaattcttagaaagggttcagaacgtaaacttggtttccatgtacgcaaacaaccatattataggagggacaaccattaaccaattaaccttcagactgaggattattgag

SEQ ID NO: 30808 - DNA, 177 bp, Glycine max
  Peptide Sequence Number=SeqID_147586
atgccttgccacatttctattctctggctgagttcacaactgctccaagagcatgggttgtgggaagttaaacatgatgttgcttcaggaaacaccatgctccagtgcaagaaatccgaggatgtcagtgtgaaaaaagaagaggacataaaaagacacaaacacttcaacctctga

SEQ ID NO: 30809 - DNA, 597 bp, Glycine max
  Peptide Sequence Number=SeqID_147587
atgacatttttaggagaaactaacagtcagacgattgtcaactcaaggttgggtttcatttttccaaatggatcgattattcacaatgatagtggggtttacttccaaacttccactccggtgcccattcgagtaccaaacagctgtgattttgcaacgctgaaaactagaatacacatcacccttaatctaacctacgaagtatttttggatgaaattcactaccggcagccagtcaaagagacatgtaactattttctctttcaatgtatgcaattgaaaaatgatgacgatgtcaacaccatgttaatgtgtaacgatcaattttcgtgtgttggtccgattgaattgttatgcactattggtagaacactagatgaaatattaaacttacttgaatgcactatgacccatactcatgacgcgctcttgtattacaacgggaggtggaacatgccacgccagaacaactttttaggttacgcattcacaggaaaaaatccaaagaaatttgaaattctttcaggatgtaccatcgatgaactgaaggatttgataaagcaagttgcacctaaaaggattcctgtaacaccctga

SEQ ID NO: 30810 - DNA, 225 bp, Glycine max
  Peptide Sequence Number=SeqID_147588
atggaattggtcactgctttgcctaaggataacaattgcttgaccacaacaacgctagaggcgataaaggacaacggtctttcaaataaacctcttggaagtgattgcataattctaaaagttagactaactatcttcaatgtacctgaacaaaatgatttccaaacacgtgaccgacacatatcatgcggtgcacagaagaatcaggtggtggttgacttctaa

SEQ ID NO: 30811 - DNA, 1257 bp, Glycine max
  Peptide Sequence Number=SeqID_147589
atgcctcactcgtttattccgccgttattgtccgccgacgaaccctctgccgccgccgttgaaatcccgcgcggcaaagcgccctttttgctgctgtgcgatcacgccggcaaggcgatcccgcaatccctcggcgacctcggtttgccgccgggggagatcgaacgccacatcggctgggacatcggcgcgctgagcgtgtcgcgccatctgagccgccaattggacgccacgctgatccaccagcgttactcacggctggtgatcgactgcaaccgggcgcccggcatcgccagctcgatcccgcatttgtccgagctgacgccgatccccggcaatatcggtatcgacgccgagcacgcgctggcgcgcgagcgcgaggtgtttttgccgtatcaccacgccatcgacgatcatctggggcaacgccaactgcgcgaactgccgacggcggtgatcgccatgcacagtttcacgccggtgttcaaaggggcatcgcgcccctggcaggtggggctgctgtttaaccgttacccggaatttgcccatctgctggccgagctgctgcgcgaagagggagatttgcaggtggggatcaacgaaccctatgcgatgaccgatgccaccgactacacgttgccgaaaaaaagtcaggagagacgtgtggagcacagcgataacggactgttcatcaaacgggagcgttttgaagttctggcgattctgcgtgaaatttgcaaacaacgcacgccgctgcgcgtagaaaatcagcagcaccggtttcaaagtctgttattgagcgtcgggccggacaatatcgtgtttagcggtgaggaagcggaaaacgccatcgacggcgcctgcaccatcgtgattgaaagcaacgacgccaaaatcgagttttccgtcggccaggcggaactgaccgaacatcagggcgtccaggcctgctcgacccggctgccgcaggagttggtttacatccagcgccgccgccagttccgcatcaccacgccgcactggcgccaattcttctgtaccggcgaatacccgaacggcacgccttatgagctgcggatccacgatctgtccgccggcggcgtcggtttgcgtttcgacggcccgctgccggatttcttccagccgggcctgcagttcaagaaagcggagttggatttgggcagctacggcagcttcaaggtcaacatggagctggtggtggtcaacgacgatcaggaaaccgacgataacgatcag

SEQ ID NO: 30812 - DNA, 273 bp, Glycine max
  Peptide Sequence Number=SeqID_147590
gtgctggcgcagtttgccggggataactaccaggaagatctggtgcggctcaagagcctgctcagcaatatcggctgctcgatcccgacgctgtacaagcagtacaccgaactgtgcgagccgggcggggtacagtttatcgacttcggcaccgatccggctttcaacaactgcatcgacgggctggtgctggtggataccacgcggctcaagccgtcgcggtatcagcgttatatcgcggtgcaccagccgcagccagccgagacggcatga

SEQ ID NO: 30813 - DNA, 336 bp, Glycine max
  Peptide Sequence Number=SeqID_147591
atgacgccgcgcaatgtggcgaccgccaatgatgtgctgaagatggtcaatcacgcctatcgctatcaatcgattcgccgcttcagcaccgacaagcagcagatcgtgcgtcctggccgaggccagttggtgtaccgcagttccaacggcctgatcaacaacccagcctggaagatccagctgcagaaaaccggctttaccgacgaggccggccactgcctggtgatgcgcaccaccatcaaagggcagccggtggtgatgatcctgctcggcgcgcagtcgcgctacggccactaccgtgacgccattcgtctgaaggcctggctcgaaggataa

SEQ ID NO: 30814 - DNA, 648 bp, Glycine max
  Peptide Sequence Number=SeqID_147592
atggcttatgccttgagcatattggaaaagagtccgatcgccgacggggaaagcgccgcccaggcgctggcgcgcacgctgcatctggcgcaacaggcggaacgctggggctatcggcgtttctggctggcggagcaccacaacacgccgcagctcgcctgcccgtcgccggaagtgctgatcggctacctgctcggccagacgtcgcgcattcgcatcggctccggcggcgtgatgctgcaacactacagcgcctacaaggtggccgaaaactttaacctgctggcggcgttggcgccggggcgcgtcgatctcggggtgggcaaagcgcccggcgggctgccgctcgccacccaggcgctgcaggccgcccatgaccggcaacacaaaccggctttcccgcagcagctgtcgcagctgaccgcctatctgaacgacgacgccgagcccggcctgagcgccacgccgctgccgccgcacggcgctcagcgcttcctgctcggcgccagcaaagagagcgcgacgctggcggccgaatccggctggattttcgtgttcgccgcgcatctgaacggcaatccgcaagatatcagcgcggcgctggcgcactacgccgcacacagcggcggccgcaaggcgctgctggcg

SEQ ID NO: 30815 - DNA, 204 bp, Glycine max
  Peptide Sequence Number=SeqID_147593
atgagcatgcaagttcaagacatgaagagtgacagaaaaaaaataagttgtgcggatgaatggtggttcagtgtgacatggatgtttatgaatcatagcgatgcacgtgggtgggtggttaggtggcaacgtggtggtgaatttggtgcagtgcagaggtggaatgtgttggtcatggaggtttgcttgggagaggaaggatag

SEQ ID NO: 30816 - DNA, 183 bp, Glycine max
  Peptide Sequence Number=SeqID_147594
ggcctctgctggtcattcggggttcccgtcacacctagtaaggtgatccgactgtcgatcacccgggctttcattgagaagtattgcactcctaggcaagcgcaggggaatgcactacaggccacagatgcccgtgatcaatgctggaaaccccagggccctgttaaacttatccgggtctag

SEQ ID NO: 30817 - DNA, 177 bp, Glycine max
  Peptide Sequence Number=SeqID_147595
atgggatccatctattgtcatacaccgactagaaaggattgtacggtagtttggatatgtgttacgcctggacagtgtttagcagactacatggaatggttctacatgatatctcatcccttcatgagtctaacacagccaggggatcctcctagacatcccgcctgtggtgcatga

SEQ ID NO: 30818 - DNA, 357 bp, Glycine max
  Peptide Sequence Number=SeqID_147596
atggctcttgggtttgatggacttcaaacctatgttggtgagaggtttgactccttggaacgtcaagtggacacacgattcgaggagatgaactcaagggttgcaaaggttgaagaagatgtcaccattattcgtgactgctttgatttacctccaccaccaccatcaggggagattgtagaagcaagcttcatgatgatgaaccaagcaattttgatgatgccaaaagcccaagtgattgattcaagacttcaagatcaagcatcaagaatccaatccaagattcaagagaagaaatcaagacttgaggttgtgctcattgctatgccggaaatgattcatgagtatggaagctga

SEQ ID NO: 30819 - DNA, 1073 bp, Glycine max
  Peptide Sequence Number=SeqID_147597
ttgatgctgcgcgcctgcagcgtaacctgcaacggatgcaacagaaagccgatgccgccggcgtcgcgctgcgtccccatattaaaacccataaaagcgtctggatcgctgaacagcagcgccagctgggtgcgcgcggcattaccgtgtcgaaaccgagcgaaggcgtggcttttgtgctcggcggggcacgcgatgtgctgctggcctatcccgtggtgcacgccgccgcgctgaccgaactgctgcagctggcggcacagcatcaggcacgcattacctgcatcgcagattgcgcggcgggcgtgagcgccattgccgccgcccatcagcagcagccggactgcgcgctggcgatcgccattaaagtggatgtgggtctgcatcgcgttggcgtcgatccgcatagcgatagcgcgctgacgctggcgcagcagattgtcgccagcggattgcccttcgccgggctgatctcgcatgcgggtcatgcgtacgctgcgggtcatgccacggcgatagctgaggtggcgcagcaggagatcgcgctgatgcgtgacctgcaacggcggctgctggatgccggctttgttccttgtcccatctcggttggctccacgcccacggcgctggcggcaccggtagccgctggcagcgatgaaattcgtcccggcaattatgccctgctggatctcactgcctggcgtctgggcttgtgtgaggcggatgcgctggcgttaacggtcgtgacgcgcgtggtggccgttaatccttattacgccatcattgatgccggctccaaaatgctgagctcggacaaaggcccgcacggcaccaatgccagcggtttcggcatcgcggtggacgagcatggccatcagtatgaagtgcagaagttgtcggaagagcacggctttttaacctatggcgaacatgcgcctgcggttggtgccctgctgcgcatcttccctaatcacagctgcgcggtggtggcgcaatccgatcgcttcgtgctgcgtcaggccgacggcagcgccggactgcatgacattcaggggcgtggccgttttatctga

SEQ ID NO: 30820 - DNA, 492 bp, Glycine max
  Peptide Sequence Number=SeqID_147598
atgctgccatctcagacagtgacgctcaccattccccgtaactggttagatctgtacgaaaccatctggaaacccgaatgttttgcgaagtgggccagcggcctgagcagcagcacgctgacgcaggaaggccagtactggaaagcgaaaggcccggaaggcacagtgaagattcgtttcactccctataacccgtttggcgtgatggatcactggattgacaccggcagcggtaaagagatttatatgccgatgcgggtcattgccaacgagcagggtgccgaagtcgtcatggtggtttatcgccagccgctgatgtctgacgagaagttcgccggggatgttgcctggaatcaatgcattataccaccagccaccctttatcctccgctggacgcaatcgctaaaaagcggcatttttttcgcgcagcggtgtttaactgtttcaccgcgcgcaaagcgcattttcgcaccattcaccagtctggctaa

SEQ ID NO: 30821 - DNA, 996 bp, Glycine max
  Peptide Sequence Number=SeqID_147599
atgagtggggaattgaatgcggccttccatatggccgatgtccgcgacaagcgcatcacccgccgacgtgcggtggcggtgggcgagctgcatgccggtccagtggcctatccgctgatcgtcgagcgccgcctgcccaagggcgatgcgctggtgatggccgagattgccggcctgcagggcgccaagatggcctcgatgctgatgccgctgtgccatccgctgccgctggaactggtgcaggtgttctgcacgccggtaccggaacggcaggcgatccgcgtgtggtgcgagtgcgccagcgaggcgcgcaccggcgtggagatggaggcactggccggcgtcaacgcggcgctgcttaccctgtacgacctgagcaagccggtggaaccggccctgcgcatcgaaggcatccgcctgctgttcaaggaaggcggcaagcgcggtgtctggctgcaccccgacggcatggacgatgccgagcgcacgcgtttcaagccgcgtgcgccgaagggcctggagggcgcggcctgcgcggtgatcacgctgagcgatcgcgccagcgacggcacctatgaggatatctctggcccgaccctggtgaccggcctgaaaaagctgggcggcgaggtggtggccgctgaggtgttgcccgatggcatcgagccattggcgggccgcctgcaggccttggccgccgagggcgtgcgcctgtgcctgtgtaccggtggtaccgggctgggcccgcgtgacctgaccccggaggcgctgcgttccctgaacgcgcggccggtacatggcctggcgcagatggtgcgggcactgagtgcacagcacacgccgatggcctggctgagccgcgccgaggtggtgcagctgggcaacatgctggtgttcgcgctgcccggcagcccgaaggcggcggcgcagtgcctggacatcctggcgccggtactgggccatgccctggcgatggtcgagggtggtggccactga

SEQ ID NO: 30822 - DNA, 885 bp, Glycine max
  Peptide Sequence Number=SeqID_147600
atgaccgcgacgcttgctgcacccaaccccgacactcagggccgtcccgcctttggagctgtgggcggtggccctctgggccctggccaaccagcgcaccccgctgctgctgggggtatttgccgtgctgctgctctataccggctggatcatcccggcggtgtggcgggcggcgcccaccgcgcacaaccccaacctgggcgtggcggcgcgcgggctgaccgtggcctgggggctgaacactgtgctggtgatcttctttctgaccctgcagctggtggctcaatagaactgaacaggctcgccgccccggtcgaaggcggcgaagcggccgatctgaccgtcgtggatggcgttgaccatcagcttcagcgggcgcgcggcttcgtcgctgttgggtgcgaaaccacctctgccatccagtgccgccacgaacaccaggtcccagtcgatgccggtggtggtcgactcggccgccagcgcctggaagctgggcacctcgtccggcagcttgtccacgcacagcaccggcgacagggtgccgccctcgcggcggtcatgccggtcgcgctggtcaccggtgggcgattcgggcagctcggcgcgcacgaatacgaacagcaagcgttgcggttcagcctgctggccggcggcatgcagcagttgctggaaatcgttcatcatcatgagggttgtcacacgcccgctgcacggaaagccgcatgctgccataacgcctgccgcgcggggccgaagacgattgatttaagtcatgcccatggaactgaaggccgcgtactctggcaatcgttccagcaggcgagggtatccgggccgttccgggcacaggcaagacggtggagcaacaaggtggaccagccatga

SEQ ID NO: 30823 - DNA, 1851 bp, Glycine max
  Peptide Sequence Number=SeqID_147601
atgtaccggccgcgcgttcagggaacgcagcgcctccggggtcaggtcacgcgggcccagcccggtaccaccggtacacaggcacaggcgcacgccctcggcggccaaggcctgcaggcggcccgccaatggctcgatgccatcgggcaacacctcagcggccaccacctcgccgcccagctttttcaggccggtcaccagggtcgggccagagatatcctcataggtgccgtcgctggcgcgatcgctcagcgtgatcaccgcgcaggccgcgccctccaggcccttcggcgcacgcggcttgaaacgcgtgcgctcggcatcgtccatgccgtcggggtgcagccagacaccgcgcttgccgccttccttgaacagcaggcggatgccttcgatgcgcagggccggttccaccggcttgctcaggtcgtacagggtaagcagcgccgcgttgacgccggccagtgcctccatctccacgccggtgcgcgcctcgctggcgcactcgcaccacacgcggatcgcctgccgttccggtaccggcgtgcagaacacctgcaccagttccagcggcagcggatggcacagcggcatcagcatcgaggccatcttggcgccctgcaggccggcaatctcggccatcaccagcgcatcgcccttgggcaggcggcgctcgacgatcagcggataggccactggaccggcatgcagctcgcccaccgccaccgcacgtcggcgggtgatgcgcttgtcgcggacatcggccatatggaaggccgcattcaattccccactcatcgtgttgctcatcctccgatggaggccaggtgcggggccaagctgtgtggtgatgcgtgccagcagcgcgtcatggtcgtcgtcgctctgcagcagcgggcgcagcggcacgccgaactcgccgaacaggcacagccgcaggtcgcccttggcggtcacccgcaggcggttgcagcccttgcagaagtcgcgcgaatacggggcgatgatgccgatgctgccgcgatggtcagggtggccgaactcgcgcgccggaccggcatcggcggcgcgcggccgttcgtgccagccagccgccagcagctgctcgatcaccacgtcggcgcgcaggtggtggcgctggaaataggcttcgttgtcgccggtgcgcatcagttcgatgaagcgcacgctgaagggacgatcgcgcaggtagtccatccactgcggcagctcgtcgtcgttcaggccacgcagcagcaccgcgttgagcttgatcgccggcaggcccagcgcctgcgccaaggccaggccctgttcgatctccggcaggcggtcatgcccggtgatggtcctgaagcgttcgcgctgcaggctgtccatgctcacgttcagcgcggtcaggccggcgcggtgccaccccggcaggcgccgcggcagcagcgtgccgttggtggtgatggccaccttgcggatgcccggcaccgccgccacggtggcgatgatctcatccaggtccttgcgcaggctgggctcgccacccgtcaggcggatcttgctcatgcccagcgcggcaaacgcacgcaccagacgcgcgatttcatccacctgcaggaagcgcgggcggccatcggcctggtaaccgttgggcaggcagtagctgcaacggaagttgcaggcttcggtcaacgacaggcgcaggtacggaaagctgcgtccgaaaccgtcggtgagttggctcatggctggtccaccttgttgctccaccgtcttgcctgtgcccggaacggcccggataccctcgcctgctggaacgattgccagagtacgcggccttcagttccatgggcatga

SEQ ID NO: 30824 - DNA, 339 bp, Glycine max
  Peptide Sequence Number=SeqID_147602
atgcacgaacagcgcttgacaatcaattcgtggggctacggacacgatggtggaggatacatgaacgacaatcaattcatggggctccgaataagatttgatgatggaggattgctaggcaatcaattcccagggttccggactcagtggaggaggatgcatgaacgacgatcaattcatgggactccgaataagattagatggtggaggatgcacgaacagcgcttgacaatcaattcgtggggctccggactcgatggtggaggattcattaatggcaatcaattcatggggcttcgaataagatttgatggtggaggatgcacaaacagcgcttga

SEQ ID NO: 30825 - DNA, 669 bp, Glycine max
  Peptide Sequence Number=SeqID_147603
atgtttaccagtcaagaaggcaagaaagttcctcaggttactttccacacccgtcagggcgaccaatggattgatgtgaccactgatgacctgttcaaaaacaaaaccgttatcgtgttctcgctgccgggcgcatttacgccaacctgttcttcgagccatttgccgcgctacaacgaactgtccagcgtattcaagcagcacggcgtcgacggcattctgtgcgtctcggtgaacgataccttcgtgatgaacgcctggaaagccgatcagcatgcggaaaacatcaccttcgtgccggacggcaacggtgaattcaccaaaggcatgaacatgctggtcgagaaagcggatctgggctttggcccgcgttcatggcgctactcgatgctggtgcgcgacggcgtggtcgagaaaatgttcgtcgaaccgaacaagccgggcgacccgtttgaagtgtccgacgccgacaccatgctgaaatacctggcgccggaattcaaagtgcaggagtcggtctccctgttcaccaagccgggctgcccattctgcgccaaagccaagcaaatgctgcaagagcgcggcattcagtatgaagagatcgtactgggcaaagacgccaccaccgtcagcctgcgcgccgtcagcggccgcgccacggtgccgcaa

SEQ ID NO: 30826 - DNA, 417 bp, Glycine max
  Peptide Sequence Number=SeqID_147604
atgttgagtcaacatccaaacattttaaactacactgactctgtgatgaagagagaatctcctctatccctgcactacaaactgttcgaggggacacatgtcccagacattgtctcgacatcagggaaagctgctgcttcaggtgctgtgtccaaggatgccttgattgctgaactcaaggacacatgcaaggtactggaagcaaccatcaaagccaccacagagaagaagatggagctagaacggctgatcaaaaggctctcagaaagtggcgttgatgatggtgaagtagccgaggaagaagaagcagctgagcaagaagaagaagaagctgaggaagaagaagaagaagccgatgaggaagatgcagcagaggatacagaatccaatgacgatgattctgaagccaccccatga

SEQ ID NO: 30827 - DNA, 336 bp, Glycine max
  Peptide Sequence Number=SeqID_147605
atgtcacatgtcaacgaagtcattgaagttgaaaatatgtcttcagatagtttgccatcatctacctcatccccgtctactgtatctataccagttaggccttccaatgttccacctacaccatctccacctctgactgatgttagaccatcttcatctcatcttgatgcatgtggactatccccgatacctacatccacaccatcctcatccctgattgtagccaacatgcctattaatgaagacgtttcaaatttggccatggaagacacccctaatgatcgtcctatgattacacttatcaatggagtgcaagtattgcaaaatttacattaa

SEQ ID NO: 30828 - DNA, 342 bp, Glycine max
  Peptide Sequence Number=SeqID_147606
atgaccaaacttggtctctgcttgtcatcgggcccgccgcctctgaatgacaaaaggggtgcgaataaccataaggtatctccgcgtatcatgggtatctccgcgtatcatgggtgcagaatgaccaaacttggtctctgcgtgccaccggacacgactgtgtctgaatggcaaaggggtgcggataaccgtaaggtatctccgcgtatcatgggtatctccgcgtatcatgggtgcagaatgaccaaacttggtctctgcgtgccaccggacacgactgtgtctgaatggcaaaggggtgcggataaccgtaaggtatctccgcgtactaccagctcttga

SEQ ID NO: 30829 - DNA, 134 bp, Glycine max
  Peptide Sequence Number=SeqID_147607
cgcacccgtgagcctcgcctcgctcgcccgcaaaagggcacgttgcgacagttggcgactccactggggaatggtaattttgatcgccaatacttcaacaacacacatgaggcactgcgccttgaaatgtgcaa

SEQ ID NO: 30830 - DNA, 663 bp, Glycine max
  Peptide Sequence Number=SeqID_147608
atgtcctcgccttcagaggactacacgtcctccccttcagagggctacatgccctcgccatcaaatgactacatgtcctcgccttcaaagggctacacgccctcaccttcagaggactacacgtcctccccttcaggactacacgtcctcaccttcagaggactacacgtccttacctttagaggactacacgtcctcgccttcaaaggactacacgccctcaccttcagaggactatatgccttcaccttcagagggctacacgtcctcaccttcagagaactacacgtcctcgccttcagagggctgcactccctcgccttcagaggactacaggtcctcaccttcaaaggtctacacgtcctccccttcagaggactacacgtcctcgccatcagagggctacaggtcctcaccatcggagggctacacgccctcgccttcagaggactacatgccctcgccttcagaggactacacgttctccccttcagaggactacacgtcctcgccatcagagggctacatgcccttaactttagaggactacacgtccttggcttcagaggactacatgtgctaacctttagagggctgcacatcttcgctttcagagggctccacatctgcgcctttagaggacttaaggtcctctgcccttaa

SEQ ID NO: 30831 - DNA, 213 bp, Glycine max
  Peptide Sequence Number=SeqID_147609
atggtaaagcaacaggcgaacaatacatttctcctgagcagcaggggtgttatttttggcctgcaagcaaggaagattagcaacaacagtaaatcttgcacactaatcagactaggcttaagctacatatttacaagtgaaaatggaaaacaatttatcattcctgccattatcaaaggggttcagtcaataaaccattcaaatatagcatga

SEQ ID NO: 30832 - DNA, 609 bp, Glycine max
  Peptide Sequence Number=SeqID_147610
atggttttttcatatcccgtcttcagatacatgggcatgcggagtagttttcccctaccgtcctggaaagtagttctaattcaaataatcttttacttcattttggaggactttatattctactggggacatagaatactgcacacaaaatggctatacaagcatgtgcacagtgttcatcatgagtatgctacaccgtttggtcttacttctgaatatgctcatcctgctgagatacttttccttgggtttgctaccatttttggtcccgccattactgggccccacttgataactctctggttatggatggttctgagagtcctagagacagttgaggctcactgtggttaccatttcccatggagtctttcgaacttccttccattgtatggaggagctgatttccacgactatcatcaccgtttattgtacaccaagtctgggaactattcatcaacttttacttacatggaccggatatttgggactgatataggctacagaaagttgaaagcattgaagagcataggagttgaagacaatatggccggtgttgtctacaatgtgctgatggctgtttctggacattcatgccctgttaattag

SEQ ID NO: 30833 - DNA, 2592 bp, Glycine max
  Peptide Sequence Number=SeqID_147611
atggctgaggctgtcgttgaaattgtgcttgagaaattgaactcactcattcaaaaggagctgggactatttttgggtttcgatcaagacattaaaaggattgccaacttgctcacttcaatcaaggctacgcttgaagatgctgaggagaaaaaattctcaaacagagatattaaacattggctgggaaagctaaaagatgcagctcgtatcctggatgacatcttggacgagtgtggtccatcagacaaggtacagaactcttacttgtcctcttttcatccaaagcatgttgttttccattacaaaattgctaagaacatgaaaatgataagagaaaaattagaaaaaattgctaatgaaaggactgagtttaatttgactgagatggttcgtgagagaagtggagtcattgagtggagaaaaaccagttcagtcatcactgaaccacacatctatggaagagaagaagataaggataaaattatagaatttttggttgatgatgcttctcattatgaggatttatctgtctatccaattgttggtctaggggggcttggaaagacaacacttgcccaactcatcttcaatcatgagaaggtagtccatcactttgagttaagaatttgggtatgtgtttcagaagatttcagcttgaggagaatgacaaaagttatcatcgaagaagcaactgggcgtgcccgtgaggatatggatctagagccacaacaaagaggacttcaagatctgcttcaaaggaaaagatatttgcttgttttggatgatgtgtgggatgataagcaagagaattggcaaaagttgaaatctttattggcttgtggggcaccgggcgcttccatcttggtgactacccgtctatcaaaggttgcagaaatcatgggaacaataaagattccccatgaattatctttgttatctgacaatgattgttgggaattgtttaagcaccaagcctttggaccaaatgaggtagaacatgtagaacttgaggacatagggaaggagatagtaaagaagtgtgggggactacctcttgctgcaaaagaactaggaagtcttttacgcttcgaaagaaagaaaaatgagtggctcaatgttaaggaaagaaaccttttggagttatcacacaatggaaactccataatggcttccctgagattgagttacttgaatttaccaattagactcagacagtgttttgcttattgtgcaatatttcccaaacacgaacaaatatggaagcaacaattagttgaactatggatggctaatgggctcatttcatccaatgaaagattagatttcgaagatgttggtgatggtatatggaatgaactatattggagatcattttttcaggatattaagaaagatgaatttggcaaagttacaagtttcaagttgcatggtcttgttcatgatcttgcacaatctgtcacagaagatgttagttgcatcacagatgacaatggtggaactgttttgatcgaaaaaattcaccatctttcaaatcataggtcaaggtctgattcaatccacttgcatcaagtggaatctttgaggacttatctattgccacatcaacatggtggtgcactttctcctgatgtattgaaatgttcttctttgcggatgcttcacttaggacaaagggaagaattgtcatcttcaattggcgatttaaaacatctaaggtacttgaatctttctgggggtgagtttgaaactcttccagaatcactatgtaaattgtggaatttacagatattgaaattagacaactgtcgcaatctcaaaatattgccaaacagtttgatactcttaaaatatctacaacagttatctttgaaggattgctacaaactattaagcttgcctcctcagattggcaagttaacttccctaaggagtttaactaagtactttgttagcaaggaaaaagggttctttttggcagaattgggagcattgaagcttaaaggagatcttgagatcaagcatttggggaaagtgaaaagtgtaaaggatgtcaaagaagccaatatgtcaattaaaccactgaataagttgaaattgtcatgggacaaatatgatgaagagtgggaaatacaagaaaatgttaaggagattcttgaagggctttgccctgacacccaacaacttcagagtttgtgggtgggaggatataaaggtgattattttccacaatggatatttagtccttctctcatgtatttaaggattgaaggatgcagagatgtaaaagctttggatgaggctttacaacatatgactgtcctgcactcgttatccttatactatcttagaaacctagaatccttgcctgattgtcttggagaccttcccttgcttcgcgaattggctattgctttctgttccaagttgaggagacttccaaccagcctacgccttcaaactctaaaaacgctgaggatttggggttgccctgacttagagatggaaacaagacatgactcgtcaaaagtagctcactttccagaaattagagtcaacggttatcttataaaagttatatttagtccctaa

SEQ ID NO: 30834 - DNA, 268 bp, Glycine max
  Peptide Sequence Number=SeqID_147612
atggtactccaaaccccttggacatttaaaaggcacgtcagtgcttatgggaaccctgctgccttatgcatgcagctgccagcagcatctacatactattccaagatttcttcacaagtgatccctgtcttactggaccttcatgttgtagaattgtcctcttctcatgagccatcagaacctactggagctaataaggatattggaactagcgaacttactccagaagttagttccaatctagaacatcttgacagaatcgaattag

SEQ ID NO: 30835 - DNA, 402 bp, Glycine max
  Peptide Sequence Number=SeqID_147613
atgaagagctcgaaaaagaagaaagggaaaggaatgagagaaaaacaaatgatcctacaacagctgatgttcctactcaagaaaagggagtttcgactaaggaaacaaggaccatcaaacctgccagcaacattgattttgagaaagctgttaagaactccagaaaaatggcttttgaggaatgttttgaagcattccttgagattttttaacaatgcttatgaagaaatcaaagcctccgcaaaagaagatagggagaaattggcgactgccagaaatgaatgcaaaaagttgaaagagttggtcattcagtatgaagctcctctaacccaagcagaaaaatctaaagaggagttagaaaacaacttggagatattccatctgcgaaggaatcaaatataa

SEQ ID NO: 30836 - DNA, 1212 bp, Glycine max
  Peptide Sequence Number=SeqID_147614
atggggatgattgtgaccacaaagtacatatcacattcaaaggaaaatgaaggaagagacctgtatctttcatcaacagctacactctctttctccaccgtaactcacacttccggcgacttctccgatcgttttccggcgaaacctcaccggaagccatggccagagaatgagcctccgccgatcgccatgtcggtctcctgctccaactgcttccccgacgacgacgactccttccttctctgcggcgaggactcctccggaatcatcgattcctcgccggagtgttcctctgacctcgattctcccccgccttcggaggcggaggcggaatccatagccggattcatcgaagacgagcgcaacttcgtccccggatttgaatacctcaacaggtttcaatctcgctctctcgacgcttctgccagagaagaatcggttgcatggattctcaaggtgcaggcttattacgcttttcaaccactcactgcttatctttccgtcaactacttggatcggttcttgaattctcggcagttgccgcaaacgaatgggtggccactgcaacttctctctgttgcctgtttgtctttagcagcaaagatggaggaacctctagttccgtctctgttggaccttcaggtagaaggtgccaaatacgtatttgagcccaaaacaattagaaggatggagctacttgttctgggcgtgttggattggaggctaagatcggttaccccatttagcttcctcgatttctttgcgtgcaagttagattcatctggaacttttaccgggttcctcatttcacgtgctacacaaattatcttgtctaatatccaagaggctagctttcttgcgtattggccatcatgcattgctgcagcgtccattctccatgcagcaaatgagattcctaattggtctttcgttaggcctgagcatgcagagtcatggtgtgaggggcttagaaaggtagagaaagttatagggtgctaccaattaatgcaagaacttgtgattaacaataaccggaggaaaccccctaaagtgttaccacagctgcgagtgacatctcggcccatcatgaggtctagtgtctcatcattctcagcatcatcatccttttctccttcatcctcattgtcttgtaaaaggaggaaattaaataactctttgtgggtagatgatgacaaaggaaactccaaatga

SEQ ID NO: 30837 - DNA, 369 bp, Glycine max
  Peptide Sequence Number=SeqID_147615
atgaccacttccggaagaaggtcttccggaagttacgaaggccaattctggaagaagtgcttccggaaactacttccggaagaccttcttccggaatttgcattcgtaacttccagaagaagttcttccggaatgtataatggtataatattaaatgatttaggtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtggagtgaatgaaccacatgtcgattgttcaaatgcttttaatacatctcag

SEQ ID NO: 30838 - DNA, 530 bp, Glycine max
  Peptide Sequence Number=SeqID_147616
gagacgacgcatcctggcttgatcccggagctcctaccgaaggagcgggagggccaagcaatgccggcaacggtgctggtgcagtgcgcttcttactcttctttgtcttcttcttggacttgggagcaagaacctcaacgctaggtgctaccacgggggtcagagttgtcggtgtcagtgcaagggaaaagctcaccggaacaggcgttggtggagaactcactaaaattgacgctggtggcgagctcacaagtgtcacagcaggaggtgtagtcgtaggaggagtggccacgggaggtgtggccaccagaggagtggttgttggagctagagcaacaactttagatggaggagatgctatcgtgggagatgaaacaggaggggttgcgattgcagcattaggggatgaagctggtggagatgaagtgggagaagcaacaaacacaattgattttggtttagaaggggttgtggctgggatgctatcaacacttttttttaaatataaatatttaaaaataaaaatttga

SEQ ID NO: 30839 - DNA, 1259 bp, Glycine max
  Peptide Sequence Number=SeqID_147617
aagaagaagaatttgatgatgatgatgatgaagaagaagggatgcttccgttggatgacatgaacaaatggttcgagaagaagccgaggggttttggagaagggaaagtgtacgacacttcggttgaggataagctgctcgaggaaatgcgccagagtagaatagcgcaggctgaaaacttgacgaagcttaagagcaatcctgtgaagcatgcttcaaacgaaagtgttcaaaagaagaaagattcagaacttgttccaattggaggtcgagtgtgcttggtgaacctaccaaagaaaaagaacatccataaagatctgaaatcagccttgcaagggattcctggcataactaatatagtcccagctgttactggaaacaagaagacgagggacccaatctgcaagggttttgcatacgttgatttcgagtgtgaagaagatgcaattaggtttgttgagttatacactggacaagctattacttttggtaaaattcagaagcagataaaatgtgagcttctaaatgtacagtcttcatcttcttctctgaaattaagcaaaaaccttaatgctgctccgcaacttgtggcccgctttgaagaagtttcaaatgaggattctaacttggatggttctgcccttagttcctgggatgaggccaactcttcagatgatttggatgacctggactatcagatgaatggagaagaacaggaagatgatgaggacaatcaagagtctgtctccactttgggggtggatcatgatgatagtgtggaaatgaggatcgatcctgaaatttgttctcttccctcagagcaggttgacagaaaccatgcagctgagcagaagtcatctgccaaggttaaacaggagaatgcccgtaagaaaaaaccaacttccaaagatagagacaaaaaagttttaggtgttcctggatcctcaagaaggttaaagatcagggaaaaggctgttttaagtgacgttttctccaagagtatgttgcctggggacgtgtgtgagaaggttgatagagtgtgctcgatggcttctctcccaatggaggttgctaaatggctaaatgctaattatgattcatcgtggaaaccaaccaagcttagggtggaggtggtgcaacttgttactggttattgcagtattaatcatcctcttcatttcttagtgcaagatttcagaaacttgtctcagctctcggaggggtttatcatcaagcatatcccgagagatcaagattaa

SEQ ID NO: 30840 - DNA, 390 bp, Glycine max
  Peptide Sequence Number=SeqID_147618
atggggttaccactggatcttaaggagagatccattgcttggggctaccctgcagcacttatatttgaatacattatgggaatctggagtgatctctatagagaagctaaagctttccagttccattggcggattaagtgcaacctgctggaacaaggtttaagtcagcttatccagtgcaggttgaagcagcaagcagaatctaaaggattccggtttgatgatacaaggttgtttccatctactcagccttctggaggcaaatggggtgcaaaaggtagtgcaagtttaaaattttatactgaaaaggagatatttgatttcctggacttaccttggcttgaaccacatgaagaaatctctaaatatgtgaatggtttgcaagtttga

SEQ ID NO: 30841 - DNA, 1374 bp, Glycine max
  Peptide Sequence Number=SeqID_147619
atggctgagcagaggcaaaacaacgtccacgttcttgttctgccataccctgcccaaggccacatcaaccccctcctccaattcgcaaaaagattagcttcaaagggcgttaaagccacagttgccaccactcactacactgccaactccatcaatgcacccaacatcacgatcgaagccatctccgatggcttcgaccaagcgggcttcgcccaaacaaacaacaacatgcagctcttcctggcctccttcagaacaaacggttccaggaccttgtctctgctcatcaaaaaacaccaacaaactccctctcccgtcacctgcattgtctacgactcctttttcccgtgggctctcgacgtggccaagcagaatggcctttacggagccgcctttttcacaaactcagccgccgtctgcaacatattctgtcgcattcatcatggtttccttcagctccctgttaagacggaagacctccccctgcgtcttcctggtcttcctcccttggattctcgctccctcccgagtttcgttaagtttccggagagctatcccgcttacatggccatgaaattgagccaattctccaacttgaacaatgcggattggatcttcgtcaacacctttcaagcattggaaagcgaggtggtgaaaggcttaacggagctctttccggcgaagatgatagggccaatggtcccttctagttacttggatgggaggattaaaggggacaaagggtatggagcaagtctatggaagcctctagctgaagagtgcagcaattggttggaagcaaaggcgccgcagtctgtggtgtacatctcctttggaagcatggtgtcattgacagcagaacaggtggaagaggtggcatggggattgaaagaaagtggggtgagtttcttgtgggttttaagagaatctgaacatggcaaattgcctcttgggtacagagaattggtaaaagataagggtctaattgtgacatggtgtaaccaacttgaattgctggctcaccaagccactggctgctttgtgacacattgtggctggaattccaccctcgaaagccttagcctcggtgttccggtggtgtgtttgccacagtgggctgaccagttgcctgatgctaagtttttggatgaaatctgggatgttggtgtgtggcctaaggaggatgagaaaggaattgtgaggaagcaagagtttgtcaagagtttgaaggttgtgatggagggtgaaagaagccgagagattagaaggaacgcccataaatggaagaagttggctagggaagcagttgctgaaggaggcagctctgataatcacattaatcagtttgtgaatcatttgatgaatctgatatga

SEQ ID NO: 30842 - DNA, 444 bp, Glycine max
  Peptide Sequence Number=SeqID_147620
atggccctcgcaaaattgaaatgctgcaacctgatacccaacaacttcagaagtagttttcatggctctggaaagtttgtttctcaggaagctgccaaacctaacaaggatttgtggattgtcagttgcaaagaggtggaaggtttgcatgaggctttacaacatattactaacctgaagaagttaagattagagtctcttccaaacctagaattcttgcctgattgcattggaaaccttcccttgcttcgccaattgcatatttggaactgtgacaagttgacatgtcttccaccaagcctaagtctccttagcagtctgaaagaattaatgatttggggttgccatcccgagttagagaaacgatgtgagaaagaaatgggagaggactggccaaaaatagctcacgttccctgtgttgaagtgatttcatggaggcagtga

SEQ ID NO: 30843 - DNA, 1434 bp, Glycine max
  Peptide Sequence Number=SeqID_147621
atggctggggctgttcttgaaattgcgcatgaaaatttgaagtcttgcactacaatgattagagatcaaagggatgatggactcttactgggtttcgatggagacatggaaatgtttgacagcttgttcactgcaatcaagccttattctcaaatttacgagctggatgacatcttggactattgggtcaatcaagtattgcggttgaagcaccaagaagtcaagtctaatctactagtcaagttgcaaagctctttcttactctctttgcatccaagtcaaggcggacttggaaaaacaacacttgcccaactcatcttcaatcatgggatggtagtcaaccactttgagtcaagaatttgggcatatgtttcagaaaatttcgatttgatgagagtgacaaaagatatcattgaagcagcatctgggtgtgtctgtgagaatttggatataggcctactacaaagaaaacttcaagatctacttcaaagaaaaggatatctacttgttttggatgatgtgttgtctgagcgttcaaaggttgcaatagttatgggaacaatgcctcctcatgaattatcaatgctatctcacaatgcttgttgggaattgtttaaacaccaagcctttgtatcaaatgaggtacaagaggtagggcttgagcgtatagggaaggagatagtaaaaaagtgtggaggagtgcctcttgcagcaaaagtactaggaggattagaattccttaatgcctgcccttacattaagttacttgcttttaccattaaaagtcagacaatgtcttattgtgcaatttttcccaaagatgaaataataaggaagcaagagttaattgaattttggatggctaatgggatattgaaacagatgaatttggcgaaatcacaagttgttgctgaagaggaagaagggttatgcatggcagaattgaaactactgaagcttaaaggagatcttcacatcaaacatcttgagaaagtgaaaagtgtaatggatgctagcaaagccagcatgtcaagatataatggtgttcatttcccacaatggatgtcttctagtccttctctcaaatatttagagctagaggatcgcaaagtctgttcacaactaccagagttggggaaactactttttcttaagactatgcatgtatataacatgattcatgtgaaacacctattcgaggagtcttatgatggtggagtagttttcatggctatagaaaatctgtcactggagaagttgccaaacctaacaaggttatcaagggacgatggagaaaacatgttcccgcacctttccaaacttgaaattaccgaatgtcctaagttgtcaggtttccctagccttccatctattaatgatctacatatacaggggagaggactggccactcatagctcacatccccattattag

SEQ ID NO: 30844 - DNA, 138 bp, Glycine max
  Peptide Sequence Number=SeqID_147622
atgcaccggagagaagttcctatggagaaaggtacaagtcttcctatggagaaaggtttcaagatcctgttgtttcctatcattgatagtctaggaaaccccttaagaatttttacagtttttccttcaacgatttaa

SEQ ID NO: 30845 - DNA, 207 bp, Glycine max
  Peptide Sequence Number=SeqID_147623
atggcggaggatggcggtgcacgatggatgatggcgacgacaatcaacaaagagtttgatcggtggattatgatgtggaaggctgaatgtgaatactgcatggccatggaagagacaagcaatgaagaaaatgagtgcaggtgggacctacggtggtggctctttattgcagaaaatgttaattatagaatgaatgacaagacataa

SEQ ID NO: 30846 - DNA, 171 bp, Glycine max
  Peptide Sequence Number=SeqID_147624
atggttgtcctcctcggcaccattgacgtcggcaagttcaacactgcggagatagacttcgttgcagatccaccgtctacagataggactgtcaaagttctagccgatgagggtgcaccattgccggaaatcatctttggtgatgactaccggtggtcggcggcggaataa

SEQ ID NO: 30847 - DNA, 366 bp, Glycine max
  Peptide Sequence Number=SeqID_147625
atgttcaccaaaattgccatatacaaagcagggatcatcccagtcatgtatcgccgtgtcccatgcaacaaaagtgggggtgtcaagtttgagatgaaagggaacccttattggttgttggttttgttgtacaatgttggcaatgctggtgatgttactcaagtcagcatcaaagggtcttcaaacactggctggcaatctatgtcacgtgtttggggacaaaattgggttactgggtctaatttggtaggacaagccttgtcgtttcaagtcactactagtgatggcaaaatgttggagtttgataatgttgccccttccaattggcaatttggacagagctacgagacctaccaaaatttttag

SEQ ID NO: 30848 - DNA, 458 bp, Glycine max
  Peptide Sequence Number=SeqID_147626
gagattcagcttttaccaaattcgcctatgatggacacggcaaatctaccatggtgtagccttggtaagaactttttccttcacatggtagaagatactcaaagtttgaagttaggagaatggtggctttgcaacaccacttgtgatcttgagccaggagcacttgccatgtggccaagtttggcaatagtggaaccaaaccaattcaatgaattagctattgggcttgatctccttaacaagccttttctttgggttgtacgtccaagtaatgagaataacaaggttggactgggattagaccaggatgagaatggattaataatgaagggagagataaggaagaaggtggagcaactgcttgggaacgaagatataaaagcaagatcagtgaagctgaaggaattgaccgtgaataactttgacgaaggtggtcaatcttcacagaatatcgaaaa

SEQ ID NO: 30849 - DNA, 1347 bp, Glycine max
  Peptide Sequence Number=SeqID_147627
atgaccatccctcactttcttcttataccatatccagttcttggccatgtgaatccccttatccacttgtctcagattctagtcaaacatggttgcaatatcacttttctgaacacagagttcagccacaaaaggttgaacaacaacactggttctggttctggcctagacaacctcaagacatcagggataaagtttgtgacactccctgatggcttaagccctgaagatgatagaagtgaccagaagaaagttgttctctcaatcaaaaccaacatgccttctatgcttcccaagctcatacatgatgtcaatgctttagatgtcaacaataagatcacttgtttggttgtcacattgagcatgacttgggctttgaaagttggccacaatttgggaatcaaaggggctcttctatggccggcatcagcaacttcattggccatgtgtgatttcatcccaaagctaattcatgatggggttatagattcatatggggttcccatcagaagacaagagattcaactctccccaaatatgcctatgatggacacagagaactttccatggcgtggccatgataagttgcactttgaccatcttgtgcaagagatgcaaactatgaggctaggagaatggtggctttgcaactctacttgtaaccttgagcctgcagcgtttttcatatcaccaaggctcctaccaattggtccactgatggggagtgagagcaacaaaagttcattctgggaagaagacacaacttgtctggagtggttagatcagcaactacctcaatctgttgtgtatgtttcttttggaagtatggcagtgatggaccccaaccaatttaatgaattggctcttggacttgatcttcttgacaagccttttatttgggttgtacgtccaagtaatgacaacaaggtaagtattaatgaatacccacatgaattccatggaagtagaggcaaaattgtgggttgggcgccacaaaagaagatattgaaccaccctgcattggcttgcttcatgagccactgtggttggaattctactgtggaaggtgtgtctggtggcatacctttcttgtgctggccatttgccaaggatcaacatgttaacaagtcatatgtttgtgatgtgtggaagattggacttggattagacaaggatgaaaatgggatcatttctaagggagagataaggaagaaggtggagaaactgcttcttgatgaagacataaaagcaagatcattgaaattgaaggaatcgactatgaacaacataggcaaatttggtcagtctacaaaaaatctagagaagtttatcaactgggcaaagtaa

SEQ ID NO: 30850 - DNA, 1764 bp, Glycine max
  Peptide Sequence Number=SeqID_147628
ttcaaggacatgtgaacccccttatgcaattctctcagcttttggccaagcatggttgcaaggtcacttttgtgcacactgagttcaaccacaaacgagccaagacttctggtgctgacaacctcgagcattcgcaagtagggttggtgactctccctgatggtttggatgctgaagatgacagaagtgatgttacgaaagttcttttgtctattaaaagcaacatgcctgctttgcttccaaagctcatagaagatgttaatgccttggatgttgacaaaaagatcacatgtattattgttacatttactatgagttgggctttggaagttggccacagactgggaatcaaaggggctcttctctgtccagcatctgcaacttccttggcttctgttgcttgcatcccaaagctgattgatgatggcattattgattctcaaggacttcctaccaaaaaacaagaaattcaactctctccaaatatgcctacgatgaacacacaaaactttccatggcgtggctttaataagatattctttgaccatcttgtgcaagagctgcaaacttcggagttaggagagtggtggctttgcaacactacttatgatcttgagcctggagcattttccatatcaccaaagttcctatccattgggccattgatggagagtgagagcaacaaaagttcattctgggaagaagacacaacttgcttagagtggttagatcaacaacaacctcaatctgtcatatatgtttcctttggcagtttagcagtattggatccaaaccaatttggagaattagctcttgcacttgatctccttgacaagccttttatttgggttgtacgtccaagtaatgacaacaaggaaaatgctaatgcatacccacatgattttcatggaagtaaaggtaaaataattggttgggcaccacagaagaagatattgaaccaccctgcattggcttgcttcattagtcactgtggttggaattctacccttgaaggtatatgtgctggtgtacctttcttgtgttggccatgtgccactgatcaatatcttgacacgtcatatatatgtgatgtgtggaagattgggcttggactagacaaggatgaaaatggaataattttaagggaagagataaggaagaaggcgaatcaactgcttgttgatgaagacataaaagctaggtcattgaaattgaaggacatgatcataaataacatactagaaggtggtcagtcatcaaagaatctcaacttctttatggattgggcgaattcggcagtaattgatcacaacaaacttaaggaattagctcttggacttgatttccttgacacgtcttttctttgggttgtagggccgagtaatgataacgaggtaaacaatgcatactttgatgaatttcatggaagtaaaggcagaattgtaggttgtacaccacagaagaagatattgaaccaccctgccatagcttgtttcattagtcactgtggttggaattctactatagaaggtgtatgtggtggcgtacctttcttgtgttggccattagcccaggatcagtttgttaacaagtcacatatttgtgatgtgtggaaggttggattgggattagacaaggatgagaatggattcatatcaaagggagagataaggaagaaggtagagcaattacttggtgatgactgcataaaagcaaggtcattgaaactgaaggaattgaccttgaataacacagtagaaggtg

SEQ ID NO: 30851 - DNA, 1107 bp, Glycine max
  Peptide Sequence Number=SeqID_147629
atggatactcctcaattcaacgcttcttcctctaacatttccccttcaccttcaccgcaacaaccatcacctcccattccagttgcttatcagcctcaatcccaacctttatcatcctcttctgcttctcttcctcctggtttgcctgatgcgccatacaagactcgcttgcaatctttcactcaaaagtgtaatatatcacttcctatgtacataaatgttaacgaggggcgccaacatgatccaaaatttaggtcaacagtatgggttgatggaatgaaatacacttccccaaatactttctctcgcctaagagcggccgaggcggatgtggctagaatggctctagagaacctacatgtaaaatttaaaacaaaagagcgccctgttactcatgagaacactactttgtcaaaatctatcttacatgaatatgctgctaagctgaagggtacaacatacgttggtgatgcagctagaagcaaaaaagaggctgaacagttagcagcacgtaacgctattacgtcaattctagatggtgctacctcagggctactatatgagacaataaagtcgaaatatagtacttttggtgcagtcagatcgaccaaatcggaatgcattaatgctagttcagcaaccgtcaaacatgtaccatccctggttgcagttcctgtggctgctaatgggaatgagacaaaagttgcacttcctgtgccttccttcaatcaggaatgtcagatgcgggaacatgtatcatccgttcaagccatcaccattactgaagttccaaatttgaatctccttccaggcccagaacagtctactgctggtgtttcatgtgaactgtccattggcattggttctggtgcactgtctattggtgatgggtcacgtgaactgtctgttggtgatggttcaggttcaaaaaagcggaaaaggaacaagtcaaaggctaataagaagttgacaattaaggcattttctttgagcagaatcgcttcttattcagtgccacaggagcatgtgaaagtgattaatgatcattttggccttctgcataggcagcagcatagccgggagtcgggagagttgtatagaatatag

SEQ ID NO: 30852 - DNA, 384 bp, Glycine max
  Peptide Sequence Number=SeqID_147630
atgggagctgttctgttgcctgatgcagcatttggaatatttccacgtttttccattgttcccaggcaccctttgatctgtagaacaacttctactacatcaattagaaagagttacaacttaatcatgctagagaaagagaaaaatggatttaacatttcattttattttcagggtcactgggcattcccacaggataagctcatgcaggaatatgcatatattttgactcatcccggaactcctacaatattttatgaccatttctacgattttggcatccatgatgtaatgaccgagttgattgaggctcggagacgagctaggatccattgtgggagctctatcaagatatataccatgcaaacaatgaaggttatgtag

SEQ ID NO: 30853 - DNA, 462 bp, Glycine max
  Peptide Sequence Number=SeqID_147631
atgggtgtttcggaaaaagttttccaaagtgactatcctggaagcaaaaatagtcgtttcaaaactgactttccaaaaacagatccacaacgtgaatatgaaacgttgaaacgtacttgtgacatgcaaaattggaggagagagacttttgctttgaatcccttgatggttgtgggaagaagacgtgagttggagaagaagagaaaaattggaaagcaaggtgccctacgggaagaagagaagaacggatggaagtcactgcatctgcggttgttgcgggagaaagaggaagaaaggatagacgggttttttaaaaaatggaaggtgcaggattcaagtcctcatcacaagaccaatggctttgaaaactattttagcccacgagttccattatcatctccatatccaccatcatcaaaccctgagcctggatatggcagtgaccacagcccacaaatgtag

SEQ ID NO: 30854 - DNA, 1704 bp, Glycine max
  Peptide Sequence Number=SeqID_147632
cataagatccaagatgaattaataattgctcgagaaattgtcataaatgatgcagagtcttctgttcgctacaagttgacaaaacgccaaacacaagaggagatccagaggtgcactggtgccatagttataactaggggaaagtatcggctgcctaatgcaccacatgatggagagaagccactgtaccttcacatctctgcaggagctcatataaaagagacagcagaacggattttagctgttgatcgtgctgctgcaatgattgaagaaattctcaaacaggtgcaaaattcacagtcaatttcttccgtcacaccttccgctttggttaatggagtgaagatgctgagtacatgcgtgtttttgggctttgatgctgatccttcattgaacattgttgctcgtatacgtggaccaaatgatcagtatataaatcacattatgaatgaaacaggagcgacagttgtactgagaggacgtggttcaggaaacaatgaatgcttgaatggagaagatggacagcagcccctgcatctgtttttgtctagtaacaatgcgaaaagtcttgaagatgctaagcttttggctgaaaatcttttggatacaatctgtacggagtgtggtgcttcaagtgctgttccacctccacagcaggcatacactgctgttccacctccccagcaggtatatagcgctgttccaccaccccagcaggtttatagtggcccttctttgttgaagcagattcctgctgccatttcacccccacaagtttatagtgctgttccacccccacagcagttgttgactggagttcagagttctggaattgacctagaggcaggtgccagcctaatcactagttcaatgtcagcagctggggtcttgacaccggttcctccagcttccttggttggagtgactggtgtcactggtgccctcactttggggactacaccccaatctataagacatttaagctctgggcctcaagcaaacatgactggttatactcctccccctttagtatcaggtggtactagctatattggatatggcggattatatcctcaagctacccctttgcaacaagttgcccttgccttgagacactcacctcctgttgcatcaacagttgctcccacaacatcagcatcaaacagaggatccaagtcaaccttaagctctgatcttgaaaaggagaaacggccgcctcagagacgaaagtttcaagaattgccagttggttcaaaagacacaacaaaactcaatcaggtttgtggtatggttaatgtctccaaattgactgatttgatagcaatgaatctccccactggtgggatggaaagattgcaacctctaaaaactaatgaacaatctgatggtccggttgtgaggaatatatcaacaatgcctgcccctaagaagttggttcagccatcatccaatggaatgccaccacctctactaagaaccatgcccccaccaccacctccacctaaattttgtggtccatctgaagttaaagtacaggccaagaacaagactttgcttaagacaaaatctgatgcagttcctgatactttggtcaagctaatggaatatggagaggaggatgatgatgatattgattctagtgaggaatcacttcctcatgacgccggagcaactggggttcaaaagcctttctgggctttatga

SEQ ID NO: 30855 - DNA, 351 bp, Glycine max
  Peptide Sequence Number=SeqID_147633
gagttgtttacgcatagggaaggtattaacatcccatgcgcctgtcacaagggacgaaagcctttaatcgagtgtgcacaactcaacaagggtgttgcccttgctcctacgtatcccaggaaaaagccatttggggtaggggatgctcgcccaggtgagccagaagctagcttaggcgagctagggtccagaaaattccaaaaaaatagccaattcacccttttccttgtggtttttgttcccgaatctgacaatcaaacatcaattcaagcgatccctcgaccctgcgttgcaaccggtgccaaacaccgtgatttagtcattaatgatgaaaacatcacacctggatga

SEQ ID NO: 30856 - DNA, 288 bp, Glycine max
  Peptide Sequence Number=SeqID_147634
atgtgtgtgccctgcagtcgcttaccatcattagcacccaaggcaaaaagttcaaggaagtatttacgaagtataaggctaagacaagaaagagggcttcgaaccattgggcgaatcgagctggcgtatggtcgaatcgaagtcagggcaacaagatttctggacttagcgcaatttctgacaaaacttcacaaaattagttcgacttcgagcgacatggataaccgttctaaggagcagttatgtgcatgcaaggtgtacgtagcaggacacttggcattaggatag

SEQ ID NO: 30857 - DNA, 2082 bp, Glycine max
  Peptide Sequence Number=SeqID_147635
ggggtgtattggttgtggagaaggaagtgttgaggttgattttggagttgaaaaggagtccgagcctgtgattggggagctggaaagggaggagaatttgattgctgcagttaggcatattgtgaaggcattggggccaaataagacccttactagtgatgccaagaaaattctggcagatcttggcactagattgtcctccatgtccatacgtagtgagaaggatgaggggaaacaagggcagggggaggatggtggtgatgatcatgatggcagtgatgatcttcatgatgattatgatgatgatgagggtgttagtgctattgaagaaaggcttaatgtgattcaggagaagattatgagatgggaggaagatcagtccatgatttgggatttagggcctatggaagcatctgagtatcttaatgctgctaatgaagcccgccggttgattgagaagttggaaagtttgcatttgaagaaagaggatcaagagtacaagtgtatgcagagggcttatagtgttcttcaaacagctatggcgcggcttgaagaagaattcaggaacttgcttatccagaacaggcaacgttttgagcctgagtatgtctcttttcgctccaatgaggaagatgctgctgatgagaactccatagtctctttaggtgacgaattagttgaggaatcacttcaaagagatagtgtcagcagagcttatgaggagcatatcattgatttggttcatccagccgtgatcccggatctcaggtgtattgcaaacttgctttttgcttctaattatgtccaggaatgttctaatgcttatataattgtccggagggatgccttagatgagtgcctcttcattcttgaaatggaaaggctaagcatcgaggatgtcttgaaaatggagtggggtactctgaattcaaaaatcaaaagatggatttgggctgtgaaaatttttgttagggtgtatcttgcaagtgagaggtggcttagtgaccagatttttggggagggtgagcctgttggtctatcttgttttgttgatgcatctaaggcttcgatgttgcagcttctgaatttcggtgaagccatgtccattggccctcaccaacccgagaaattgttccgcgttcttgacatatatgaggttctacaagaccttatgccagacattgatgctttgtattcagatgaggttggttcctcagtaaaaattgaatgtcatgaggttctgaagagattaggcgattgtgtgagggtgacatttcttgaatttgaaaatgccattgcaacaaatgtatcatcaactccttttgtaggtggtgggatacatcctttgaccaaatatgttatgaattatcttagagcccttaccgactacagtgacatactcaatctgcttttgaaggaccaagatgaggatgccatttcgctgtcacctgacatgagccctggtacagaagaagataacagaagccagggatctccaagtagagtttcctcaatggccctccacttccgatcaattgcttcaatcttggaaagcaaccttgaggagaagtccaagttatacaaagaagtctccttgcagcacttgttcttaatgaacaacctgcattatatggctgaaaaggttaaggggtctgaactcaggctcgtacatggagatgaatggattcgaaagcacaactggaagtttcagcagcatgcaatgaaatatgagagagctagttggagttccattctcaacttgcttaaggatgagggagtttttgttccgggtataacttcggtctcaaaaagtcttgttaaagagaggctgcgaagcttctaccttggctttgaggatgtttacaggatccagacagcttggattatccctgattttcagcttcgtgaagatttgcggatttctatatctgtcaaagtaatccaagcttataggtcgtttgttggaaggttcagttcgtacacaagtgacaaaatcattaagtacagtcctgatgatttagaaaactaccttttggatttctttgaaggatctcaaaagttgttgcaaaatcctcataggag

SEQ ID NO: 30858 - DNA, 174 bp, Glycine max
  Peptide Sequence Number=SeqID_147636
atggaaccaatgaaagagtggcctactacgagcacttatataaaaaatggagggattaaaagcaaaaagatgcagaaaatacgaaaaaaagatgaaggtttgagcatcagccccagcccaagacgcgctcagcgcgcagcatgcgctaagtgcgaaaactggtacttgcactaa

SEQ ID NO: 30859 - DNA, 396 bp, Glycine max
  Peptide Sequence Number=SeqID_147637
gattttagtcattggtctggttatgatccatgtacggaaaagtatgcagagatttactacaacaggcctgatgttcagaaagcactccatgccaacaaaaccggtattccttataggtggactgcttgcagcgaggttttgaatcggaactggaatgatactgatgtatctgttcttccaatttatagagaattgatagctcacggaataagagtttgggtgttcagtggggacgtggactcagtggtgcctgtcacagcaacaagatatgcccttgcccagcttaagttgtcaactaaaataccatggtatccttggtatgtcaaaaatcagctgctgcccgtacttaacttcattcacccttgtgaagcggaactacgttttggcccaacataa

SEQ ID NO: 30860 - DNA, 440 bp, Glycine max
  Peptide Sequence Number=SeqID_147638
atggtgggatacatgcctttgagttttgcaggtctagtgtttgcaggcgagaggatcgaggtgggcctaaggggaaaatttgattatgctgctttgacgagttctagcaataggaggcttggggcaggtggagcaaagaaaaaggagagagacgcccacatcgggactgcagtacccacatggccaagctccccacagaccccttacaaccccatgtatcagtatcccccgcaccaatataattacttggctaatatcgacggaaggcaaaggagaagaggagaggggatgcaccatccactagggaataagacatggaagaaggagcttcaccaccaagaatgtgccttggatcagaagcttgaaggggatgttttaatggaggaaaagaaagagagaacaggggatcacaaaattgaaggaataaaagagggagagaa

SEQ ID NO: 30861 - DNA, 1145 bp, Glycine max
  Peptide Sequence Number=SeqID_147639
ggacgcatttgtcagtggattgggaagacgaaaagtcaaaaaaatattatgacaaatatgctcttatgctgacaattcacgttggcaatcatttgagtgaaaaatgtatccctccgtgtcacgttttagaggcacttttggctcctggttcagaactttggatgttcaatgagggagctctacttttttggctaaaagctatgatttgtcaactaagtcctacatgtgaccaaatcgccaaaagttgtagctctccaacaacaactcaacttgcattcttatatgtttcttatggcctcatggccattggaactgatggtgtaaaggcctcttccttagcctttggaatggaccaattatgcaggaaggaaaaagatgcagcaatcatagagagctacttcaattggagctatgcttcaggcttagtggcagtcctatttggaatcactattttggtttatcttcaagaaaatctagggtggaagcgatggaatgataaggacaggtttattgcagtgatgggtgtaaaaggaaaaccaagttgcaatgcgagaattccaatccctttaacggggataacgacaggtttattgcaattccaaacatggcgttacctaaacatgcacaatctgtgggttcagggaataattgggatgattgttagtgtggttgtggacgtggttgttggcattggtgttctcttggcccttcttctgtatgtcaagataaggcaaagaaagagaatggttagagcagtggagggttcattggtggcattcaggtaccaagatttgcaaaatgaaacgatgaatttctctgagaaattgggagaaggaggatttggttctgttttcaaaggaacattgggtgacaccagtgtggtagcagtgaagaagttggaaagtactagtcatgtagagaaacatttccaaatggaaactactaaattagggaaacacaacaatatgctgccagaggagacaattgtggcgctgccagaggccaagtgtgtagacggagtgacacaagcgcaaatagatggttgtcagcgaacactaggaaactccgaatacaggcgagaaggaaatagaagtcactatgaaaaaggaactttctttcgcaaacacaaccaagacatggcatag

SEQ ID NO: 30862 - DNA, 423 bp, Glycine max
  Peptide Sequence Number=SeqID_147640
atggaagatccgactccacctaacttagatttgacaaagaaagaaggacgaggagacgatgtgtgtgagaagagacgatgcggggagacgatgtgtgaccagttaaagttccaccaccaccgttgttttagatctgactatgtgtgtgagaacttttcaatgttgatggtaggggcaacaaatggaagagacgatggtttgaaaacaactattgtggaaggagatgcggtggaagagacatgtgtgaacagagattgtgttccttcgagggctcttttggcgatgagtggtcgtatgcgagaactaaaaagcatggaagtttggaatactctcatgtgttggatttcaagcttgaatagtgaagataaacagtcaccgatagaggaagcatttcaaatctgggttttgttttttaagagatag

SEQ ID NO: 30863 - DNA, 651 bp, Glycine max
  Peptide Sequence Number=SeqID_147641
atggaggttgcctacacttgttctgatgagaaggatgctcagaataaggaaaagaagaagaaaaaagaagaagaaggaggaaaagaaagaataaaaaaaaatcttcacacctactcactagtcttatttatcaggagtgggaagagcctgaagtctagggctggtgatcaacttcctcaaatcggtaaggaagaagctcaaaaagctaagacatccatccttctaagggtgtggaaactgctaaagttcaaaactccttggcttggagaaaggaagtatagagaatggagaaggaaaaaagaagagccttctcagaaggctgaagaggttactactgatgctcagaatgcaccaaaggtagaggttggtgacaggacccctgtgggggctatgaaggatttagtttttaacactaaaatttttagaaatctcttcaactctccccttattaacacctcagttaaaattgcttgtggccttggccctatcttaggcgaaccttttacattctctatccattttcctcctcttcctacagagtcaatcgcaaaagaaccttctaggattcaaaaggatgttccccatgttcacatcccaactcctcatgttgatggtactactattgttgctatagccttatatctaggttag

SEQ ID NO: 30864 - DNA, 477 bp, Glycine max
  Peptide Sequence Number=SeqID_147642
atggaacctaaggagattgcaatttataaagaggctatgctccaatttgtcattaaagcatctctcaaagaccatgaggattatatagttgagacaaatcctagtgtagattgtgtctatccaaaaccagtgtttactgatgatgacaaactagttgaatttgcatggtcgcaagaaatagatgcaaacaaactcagatgtttggaagaagtatttggtgctaaagagtctgtatccatggaagacatggttactaagatcaacaagccactaaatggctatttccttcaagaccattgtctccacctccacagattgcacctactgagctcgatgttaacgtcagattatatcctggcttcaaaggtcatagagtcttggagtgacggacttgtaacaggttctagaaggagaatgagaaataagacaattttacaaggtagcctcgctcaagtgaggtataggttgctcaagtaa

SEQ ID NO: 30865 - DNA, 225 bp, Glycine max
  Peptide Sequence Number=SeqID_147643
atgttggtctgtaactctgcctatctttcagcaaaatacaaagacatgaatgcaactccatgctctgttgcaaattggatcctttcaagttcatcaagctcaactctccttacctcaatcttagagcaacaacttcctctttgctcaaagggggtgaagccaatttgggtgagggttgagaggtatgaggtggaaggtctaaaaagggtgaatgtcgaggggtag

SEQ ID NO: 30866 - DNA, 129 bp, Glycine max
  Peptide Sequence Number=SeqID_147644
atgacactgctacaacagcaaggatcttcaacttataatagttcacaagtgaatcagattgtcacaatgactggttctggtcatgcacttataggatgtacagaccctatagatgattggtacggttga

SEQ ID NO: 30867 - DNA, 423 bp, Glycine max
  Peptide Sequence Number=SeqID_147645
atgaccaaagcctatacaaaaactacgctctgcaaatcaataagtaaggcattgcccccgggaatgatcaagcaattattactctttcatccgtttggcaggttttattattttaatataacggctcacacaatcagatctgaggatccgcgaacaaaacaactcacaaagaacaaattacacaagaatgcaaatggagaattgcgaagaaactcacatcatagccatcataacttgtttgagatcgttctcgacattccgcatgttcgcgacggattgcgcgcagaatatgaatgcaatccaagagctcagtttgtactgatttcacaaacaacagaaaagaaagaaagaaagagtgttaatgtgtcgaaacgaagattgtgttgtgagatcgatggcgaagaggtgctgcgaaactcatag

SEQ ID NO: 30868 - DNA, 264 bp, Glycine max
  Peptide Sequence Number=SeqID_147646
atgatcacaagtaggcaccgacaaaagggcgttgggaaggctaccaaacaaaggcagaggcatgtggtactgttcacctcgatgagggcctatgcaagcaaaaagatgtgcgtgagaatgcgttggtggttcttcaagacactgtcaatggcacagtgtagatcggtggaaggaagattcgtgggttattggctagaaaggttttctttaatgggattgataacaaactactttggacctcctagacccggcaaacaaagttga

SEQ ID NO: 30869 - DNA, 312 bp, Glycine max
  Peptide Sequence Number=SeqID_147647
atggatgaagccagacctacggctacctctacacatccttccataattattggcaaggatgagaaaggaaataatactccagaaaagaagtatagagctatgattggttccttattatatttaactgctagtagaccaaatattgtgtttattgtgtgccttcgtgcaagatttcaatcttgtccaaaagtttctcatgttactaatcatggcctatggcttaagaaagagtctgattttgatcttgtaggctattgtgatgttgattttgatgaaacaaagcacaattgccctaccaacctcagaaactga

SEQ ID NO: 30870 - DNA, 882 bp, Glycine max
  Peptide Sequence Number=SeqID_147648
atgcaagaatgtctgctccacaacaagaggaaagtgttgtggtttttcgacagtggatgctcctggcatatgactggagacaaaagaaaattcctcaacctcgagaagagaaagggtgaagggtttgttgcttttggagataaaagaaaaaccctcatcaaaggtgtagcatatagaatctacagtttgagaactcaagttgtagaaaaaagtattcatgttgtgtttgatgaacatgataatacacttgagaagagaaggattacagatcaacaagaagaactagaaagaacaaggatcaacaaaagaactaatcaattcattaagaacaagttctggaatcttgttccccctcttaagaatcaatcagtgattggaaccaagtgggtgttcaaaaacaagctcaatgaagaaggagaagcgattagaaacaaagctagactggttgctcaaggagataatcaacaacaagggattgattatgaagagacctttgcactagtagcaagactagaagctattagaatactcttagcctatgcagcacacaaagacattaaactgtatcagatggatgtcaaaagtgcctttctaaatggattcataaatgaagtttatgtgaagtacccacttggatttgaagataaggaaaaacctcaacatgtgtacaagcttgttaaagctttatatggattgaagcaagctccaagaccttggtattgtggaagcaatgctttccaagtttattttgatgatgtcaaagactcaagtcaagaatcaacagtcaagcaagtttcaagaatcaaagattcattcaatcaaagcaagtttcaagaatcaaagagtcgttcaatcaaagcaagtttcaagaatcaagattaa

SEQ ID NO: 30871 - DNA, 255 bp, Glycine max
  Peptide Sequence Number=SeqID_147649
atgaaggtgaaagaatatgcaacgaagcacattcaatctcaatacaagaataaacttcatcatttacatcaagcttatcttaaagaaaaggatagaccaaaattcgtatcttggaattggctaattaaaaacaagttgaattgttcaaaatttcaggaaagaagcttaacaaacaaagctaatcgaagcaatcaagaaataaaatcaattattggcacaaaatcaatcaagcaaaagacatttgaaatggattga

SEQ ID NO: 30872 - DNA, 366 bp, Glycine max
  Peptide Sequence Number=SeqID_147650
atggaatcttcgttagcaatgagatgttcatctcggtttgatgtttgcgtttgtggtagttgtgaaggtggcgtaaagggggatgaaggatggttttgttggtcaaaggagggacacgaaataacagttgagcaacttgttcagttgctcgagcagggagtaggggtgggtaaacgggctcaagtccttggactgacccgcggcccggggaccggcccgtttgacccgcgaggtccgtggggcgagggtggactaatttatttggtccgtgtaagaagcggggcggattggcctggtccgctaccaatgcgggcttatgcgggcaggccttacacggggcgggctggcccgcttaccctcccctag

SEQ ID NO: 30873 - DNA, 693 bp, Glycine max
  Peptide Sequence Number=SeqID_147651
atgaaggatcttgatccgctcaaatatttcttgggcattgaggttgctcaatccacttcgtgtattgccatttcccagaggaaatacgttctaggcattcttattgagattggtatgcttaactgtcgtccatgtgacactgccatggattccaacatcaaacttcttctgggtttgggggaatcactagaagacctggaaaaatatcacagacttgttggtggactcaattacctcattgtcaccaggtcaaacatcacatttgccataagtgtggtaagccaattcctcaatgcctcttgtgatagtcattggcatgttgtcatgtgcatccttcaatatatcaagaatgcatcaggttgcagactattatatgaggaaaaggatcaccatcaagcaggagatctacctctggtttttgtgttcttattggaggagatgaatataaaggattggatgaaggaggaggcgtgggtttgggtcaagattgttactagtatgtggtcaaaggaggttcttcccagatgggttgcataccatgaactagtactcacaaccaaggaatatatgagacaggtgacggagttaaagccagagtggttggtggagatagccccccacaattaccagcttaaggatgttgaagactcatattcgaagaaaatgtctcgtggagcaggacgtgcatcgtag

SEQ ID NO: 30874 - DNA, 267 bp, Glycine max
  Peptide Sequence Number=SeqID_147652
atggaggaggttgaggttggtctcgttgatgagtgggtgtcaccggcgatgtgtcacacatcggaaaagtggtgcgcgtgggagctcgcgcaacgacatatggtagcgcgccggacatggttatggtcaccggagaagggtgatggtgatcgaaggttgcatgtcggaaaaagggagacactgttgctgtcaaatagtagtagagagtgcatgcactgttttttgcgaagctacatgtacgaaggggaagggattgaagaaccataa

SEQ ID NO: 30875 - DNA, 579 bp, Glycine max
  Peptide Sequence Number=SeqID_147653
atggaaacatcccaagctagatttaaagccaatcaaaactcaattcaaaatctggagattgaggatggcaagagttactccatggaaaattgttggtgggagaaagagttacaaccttacaatcaatatgaagaagaaagaatttctaaccttgataatttgttgatgcaactcatggaaacatcagaagctactcaacacacaattcaaaatctagaaattcaagttggtaagctagcaaaacaagtggctaaattacccttggtcacaagggaagaaaactttgtagaggttgaagcttatgaggaaagtcttgtagaagagcatgattcaagagaaaaagacgaaggaaaagaaagcattctccaagtcaatactcctcctcatcaactgattggcaaggaagaaaggcttggagaatgtgataaatgtttaagtgtcattctctccttgaacaccaacacttctcttgcaatggtatggaaggcattttcgggatacatgagtttcatggagtctttgactaagaagcaaaaattcaaggaagatgtgttttatgtgacattcatgccaccttga

SEQ ID NO: 30876 - DNA, 519 bp, Glycine max
  Peptide Sequence Number=SeqID_147654
atgggcgcgcgcttcatcatgcgtgcggcggtgaaacagccggccggcgtgctgtcgttgtcgctgatcgatccgccggtttccggaccgggccggcgtctctatccgggtcagtggccgtggtatgaagattccattcgcgacgcgcagcgcggcatggatgctgaagccatgaagcaatactgcccggcctggagcgatgaccagcgtcagctgcgcgccgagtggctgcatacctgctatacgccggccatccgtcgcgcctatgacgattttcaccagctcgatatccatcaatatttccctcagctgccggcaaaaaccctgctgatggtggcaggcaagggcggcgtcattcaggcggaagatgaagccgaaatccgcgagctgctgccgaccattgagatcagccgggtagccggcgccggtcacatgatcccgtgggatgattttcacggcttcttcaacgcttttggcaccttccttggcccctcactgactccggagacgcagccatga

SEQ ID NO: 30877 - DNA, 791 bp, Glycine max
  Peptide Sequence Number=SeqID_147655
atgtttcatgcgcatacggctggagtggaaggtaaaccgctccgggcgaatcagctggcgcgcctgcagcatggcgggaatttcggtttccatggggccaaggaaggtgccaaaagcgttgaagaagccgtgaaaatcatcccacgggatcatgtgaccggcgccggctacccggctgatctcaatggtcggcagcagctcgcggatttcggcttcatcttccgcctgaatgacgccgcccttgcctgccaccatcagcagggtttttgccggcagctgagggaaatattgatggatatcgagctggtgaaaatcgtcataggcgcgacggatggccggcgtatagcaggtatgcagccactcggcgcgcagctgacgctggtcatcgctccaggccgggcagtattgcttcatggcttcagcatccatgccgcgctgcgcgtcgcgaatggaatcttcataccacggccactgacccggatagagacgccggcccggtccggaaaccggcggatcgatcagcgacaacgacagcacgccggccggctgtttcaccgccgcacgcatgatgaagcgcgcgcccatcgaatggccaaccaggtgatagcgcgtcagccccagcgcatccgcgaaggcgttgatgtcatcggcgcagctctccatgccgtaatccagcccttcaccgctgctggagagcccgcgaccgcgcacgtccagtacccaggtatcaaaatgctgcgcaaaaacttccgccacaaaaccccaggtgatcgccgggctggtgatacccg

SEQ ID NO: 30878 - DNA, 1095 bp, Glycine max
  Peptide Sequence Number=SeqID_147656
atggccaatcaaggagattgggtcccagttatggatgtgttagctttgctaatttttggggtcgtcctctttccaaacgtggatggtttggtggacctagcagcaatcgacgctttccttgcataccaccatagcaaggaaagtccggtggtagctgtcttggcagatttatttgacacatttgaccgaaggtgcgaaaagagtagcacacggatcatctgttgcttgcccgccatctgtgtttggttggtttcgcacttgttccaacaagacacaaggcatccatgtccgctcctgagccatcgctcgtgtactgaaaataggagaatagattgggaccagcttttggctgggataggaggtagaacaatcaattggttcccccgatggaaggaaggaaaggaaggagtccttttctcatgtggaggatacccaaacattccgctggtaggaacgaggggttgtattaactacaatcccgcgctcgctataagacaactagggtaccccatgaggggagcaccgacggaagaaagcatgtctcctttccttgtaagggatttcggcgcacaaaatttcaaggctatacaaagaatccataaggcatgggaaaccccgttaaagaaagatcaagaccttaggggcattcgtaatggcatcattggtggattggctcaccaagttaaagtcgtcagcgaagagagttttgaagcaccggaagaggacgaagaagtccaagctctcaaaagcgagttaggaaaggcgaaacttgccaaggagaagttcaagttggtcgctacacacattcggaaggagtgtgccggattacgggaagagaatgcaactaccgcaagagcccttgaacaagagaccaagagggctcgcaaggaagagtgtggccggaataaatttcgtggagctctgtggggtagcaatagtgaactcaagctgcgaagggaagagagggaccagtcgcgagcacatagcatggttctgaaagaggagttagttgcctgttcaaggtccaaaagaagcttgtctcagcgtttatgcgagacggagaccaacatgctagctatcatcgccaagtactaa

SEQ ID NO: 30879 - DNA, 390 bp, Glycine max
  Peptide Sequence Number=SeqID_147657
atgaggtggtcggcgaggagagagattcaagtcttgagcacatgggcgaggtcgaatcgaagaagctccttgacgtcgacgacgaagcactactatggccacacagtctttgcctccgcaaaacgtggcattttgggtctcggaagccgggttccaaaggaaggcgccaccaacagcttgggagtgaaagagaaaggggttgaaggatggggaagaggtgatagaggagaagaggaacctgtggggtcggggtggagggatgtagaggagggagaggtcgaagccagggaacttgacggagaggagtttggcggtgacgacggagcagaagagggaggcaagggtttggaggaagtgggggtgagagtcagagtgagagagagggtttaa

SEQ ID NO: 30880 - DNA, 513 bp, Glycine max
  Peptide Sequence Number=SeqID_147658
atggattgtcaaacttggggaattgaaggagttggagaatttgatgtgtttgaattgattaaagtgggttcaactagaggtaaggtggcagaaggaaaaggtgatataaggctaggatttggtgcaacaaagattgaaggaaaatctatttcacgaaatttgacatcacaactcacaaaaaaggataagatttatgagtatgatgtacagttgcataacataaacaatcaaaaactcgcaagtgatcaagtgatggtggacgattgtagagtttttcaaatggtagatgatattgaaatcataatgatcatgtcacagcaagaatatgacgatgctttcgcttccacaaccccatattgttgtggggtgtatacgcaacacatgggaggagttgctgctagcgtgtgtcacgaaccgccatggcttcaaggactgagacctcatcgccatggaggtccagtcgcgcaccacgcggcttctcaccatcgcgcgctaatgggagcagaaatttga

SEQ ID NO: 30881 - DNA, 313 bp, Glycine max
  Peptide Sequence Number=SeqID_147659
atgaagactagaatgggctcagaagggtccgacgagtggactgatgtcggtctggcgggattccgacgccaggaaggcggcatatggtggccacgcgcaagaatgagcgacggcgcgtgcaccaaaccctactgtcaccggagaaaagtggcggcgaacggcggcggtgcagcgatggacgacggcgtgggggatgaaaagtattggccattgatgcccgcattgccttcatatgagtatggaagggagcatcctggtcctcgatatagcagtttaattcatggtcaaaatcttagagatgttgtcataacag

SEQ ID NO: 30882 - DNA, 333 bp, Glycine max
  Peptide Sequence Number=SeqID_147660
atgtgctccacgcttcgttacaatgttgttctcattgttggtggcggtgatggtggttcttctctatgtcaggttctggtagattttccttcaatctttgttgcaccaaatcctagccttatatcaccttttcctacatttgacaccatggatcattggtctacaattaagccaacccatcaacctcaacaactagagccatcccataccaatgaatctgagttgcctatcaatacacatgaaacaccttctgccaccttacctctagttgaacccactttaatcaattcaaacacatcaaattctccaactccttcaattccccaagtttga

SEQ ID NO: 30883 - DNA, 516 bp, Glycine max
  Peptide Sequence Number=SeqID_147661
atggaagaggggacacaaaggtggcacactgtgtttggtggaggctcggatttgggtgttttgggttcgcatctggacaaagatgatgtttattgggcggatctggctggtttggtggtgttggaggtgggtgttcgccaagtaggttccgatctggctgatggtggaggtgtgggagtcgggaaagaccgtggagtcgccgacctcgtcggaaggagaagagagaggtggcggaaggagaagatagagagatggaggttttgcgggcattccttgaatgggttgcgcgacacaaaagtgagagagcttcgagtggcacatgatggtagtgcgggagaggtagtgagagggcatcatcacgatgggcttggtctgagagtgaagctttgtcgcacgagaaaagggtatgagggtgttctcactagtgagatagattcgagtggtagctttgatggtggcgctagagatagctttgacagccacactgaaatgaaggtgacaccatcatgtgtttag

SEQ ID NO: 30884 - DNA, 306 bp, Glycine max
  Peptide Sequence Number=SeqID_147662
atggagatggataacaagcaaggatctgaagagatgattagatttttatgtgtcaaccggtactacaacatgtgtttgaatgacctacttgcacttggtggtgggggtaattatgctttatgcttagaagaagatttgttatctggaactagtgggccttctgacacatttggaaacaaatgtctagctcatagtccagagtttgagttgaagaatgttaagcttacgaagttaaaacaaattattaagtggctttcatccactgctggctgcagctcaatcctatatatatattttttgcattag

SEQ ID NO: 30885 - DNA, 218 bp, Glycine max
  Peptide Sequence Number=SeqID_147663
gttactattcacttcctaattccaaagttggaagatgttttcgtgatgaagatttaagagctgatagacaacctgagttcacccaactagatatggaaatagcctttactccttacaaggatatgttaatgcttaatgaagaatcaattagaaagtcaccagtagatggaaaaccaatgcttctaacacccgaggaatcaattttcaagtccaagtaa

SEQ ID NO: 30886 - DNA, 402 bp, Glycine max
  Peptide Sequence Number=SeqID_147664
atggatcactttgcagcacatgaagagcaacttgcttcacagagaatgaggcagaaacttgaagaagtaaatgtggctgctcaaactaattttgtccctgtccaaagccatttacattatatagtccagaaaacatattttaagtgtgcatatgagtgctttgatagaagcaaaagccaggaagaaataagcagttgtgtcgaaaagtgcagtgttctttctaatctgcaacatacattggagatggcacagtttcaggagaggttgaatagatctctgagggtgtgtcaagataagtacaaggcggctaggctacagaataaaaatgatgctatgaaagatttggtttcctgtgctgagcggtcaatccagaaagcatcaagaggcttactttggaattag

SEQ ID NO: 30887 - DNA, 336 bp, Glycine max
  Peptide Sequence Number=SeqID_147665
atggcttccaaacctcgcagtgtagaagagatcttcaaggactatagcgcccgaagaatcgctattattcgtgcactcactcatgatgttgataaactatacgggctctgtgatccaggtgaagaggaagttccaccagagctccctgagccaactcttggaatcaattttgctagggatgatgtgagtcgcagggattggatttctttggttgctatgcatagtgattcgtggttgctttctgtggccgatccaactcttcggttttttacaacattcattttacattggtcgatcaataatcgacttaaaaagaacacagtgggaatctcgtaa

SEQ ID NO: 30888 - DNA, 458 bp, Glycine max
  Peptide Sequence Number=SeqID_147666
gaaaaacctgcttgtttcttcttggatggagaaccgctgcgttgaagaatgtcgaggtcaatgaggccaagagacatgaggccaaggcggccgtcgagggagccggtgtggaggcaacctgctcccagatgaggccgaggatgggctcgttggtggagatgggtgggagaccgaggtactcagtgtcgacgtggtcctcagcgggggcggagacacggaggagccaggagagggcggggatcatgcatgctgaagacgcgtttcatgaggggtcggagctcgcgcgggccgcttgccggagcagccaggccaacttctctgtcttggccacatgcctctttcgctgccttggccacttggtccgccagttggatcggctttgccatcacgagaagtctaagagttgcttcactatgttcacttcttcatggatccaagttccaaagtccaacttgtga

SEQ ID NO: 30889 - DNA, 390 bp, Glycine max
  Peptide Sequence Number=SeqID_147667
atgcatatgtgggggcatggatcacagtacagaaaagggcctgaatctctgaggggtacccaaccaacaggttgcaggaacaacattgatcacccaagagcaaagcccctcaaagacttcagaaccctccaaacacactacaagaggaagcatgggattaagcccttcatgtgcagaaaatgtggcaaggcctttgccgtgagaggtgattggagaacacatgagaagaactgtggcaagctttggtattgcatctgtggctctgatttcaagcacaagaggtcccttaaggatcacatcaaagcctttggaagtggccatgcagcttatgggattgatggctttgaagaagaggaagagcctgcatctgaagtagaacaggatcgataa

SEQ ID NO: 30890 - DNA, 402 bp, Glycine max
  Peptide Sequence Number=SeqID_147668
atgcaatttcaaggagcaaatgatagaatacatgaagcaggccgtgtaggaagacaatgtcgaaaactatgcgaggagatttgggtcgtgctggatgatggtggccatagtccggcctccaacagggacgcgactgtggcctcaaggcccaagaccaagccaaaggacggtgaaggcagtggtgaggacgaggaccccgagcaggccaagcttcaggttgggctcaactcggccatcgtaagggagaagcccaacgttaagttgaacgacatcacaaggttgtctcctttggatcaggaagccatagttttgcctccttttgtgatagtagtagttcgtctaagacccgatgtttggaatatgtttgttttaatgtctctgagttcaacatggagcaattaa

SEQ ID NO: 30891 - DNA, 453 bp, Glycine max
  Peptide Sequence Number=SeqID_147669
atggccatcatcatacatgaaaggtccttgttagtacctaatgcaaaggggacaacatgcaaccaacaactagaaggagtcagtggtactgaccatactcatatttttcaagttccattcatattagagtcaggaactctccttaaatggatctcaaggttggatgtgtggccttatctagaaacttatgtagaggatgttgccagtgaaattgccgctgagttacaagggtatcctgatttcatcattggaaactacaatgatgggaatcttgttacatctttattggcttataaaataggagttgcacaggaaaaaaacccttgtactaatgatcttgacctatggctagaaaagtatgctgaattagcccagaggtacatgcaagtcgtggtggatgagattgtcttcaacaatattgatccactgaaggcagttcaactatccctctaa

SEQ ID NO: 30892 - DNA, 2976 bp, Glycine max
  Peptide Sequence Number=SeqID_147670
atgttcgtgttttttctgctattcctctgctttctctctcctcttccgcactctctctctctaacccaagacggtctctttctcctcgaagcaagacggcacctttccgacccggaaaatgccctctcctcctggaaccctgccgccaccaccccatgccgttggcgcagcgtcacctgcgaccccctcaccggcgccgtcacctccgtgagcctccccaacttttctctctccggccccttccccgccgtcctctgtcgaatcgcctccctgaccaccctcaacctcgcctccaacctcatcaactccaccctctccgccgtcgccttcgctgcgtgccgcaacctcgtcttcctcgacctctcccagaacaaccttgtgggccccatcccggactccctcgccggaatcgccactctccagcacctcgacctctccggtaataacttctccggcgcgattccggcgagcctcgcctcactcccttgcctcaagacgctcaacctcgtcaacaacctcctcaccggaacaataccctcttcactcggtaacctcacttcattaaaacaccttcaactcgcttacaacccgttctcgccgagtcgcataccgagtcaactcggtaacctcaggaacctcgaaacgctttttctcgctggctgcaacctcgtgggccgcatccctgacactctcagtaacctctctcacttaacgaacatagatttttcgcagaacggaatcaccggtcacattccgcagtggctcacgcgcttcaagcgcgtgaaccaaatagaactcttcaaaaacaaactctcccggggagttaccccaaaggaatgtcgaaacatgccgagtttaagattcttcgacgcgtccacgaacgagttgactgggacgattccgaccgagttatgcgagttgccactcgcgtcgttgaatttatacgagaacaagctcgaaggggttttgccgccgactattgcgcgttctccgaacctctacgaactcaaattgttcagtaacaaacttattgggacattgccgagtgatttggggagtaactcgccgctgaaccacattgatgtttcgtttaaccggttttccggcgagattccggcgaacatctgccggcggggggagtttgaggagttaattttgatgtacaattatttttccgggaagattccggcgagtcttggcgactgcaagagtttaaagagggttcggttgaagaacaataacctctctgggagtgttcctgatggggtgtggggtttgccacatttaaatttgcttgagcttttggaaaactctctttctgggcaaatttccaaggcgatttcgggcgcttacaacctgtcaaatttgttgctttcgtataacatgttctctgggtcgattcctgaggaaattgggatgttggataatcttgtggagtttgctgctagtaataataatctctcgggaaagattccggagagtgtggtgaagttgagtcaattggttaatgttgatcttagttataatcaactctctggagaacttaattttggtggaattggtgaattgagtaaagtcactgaccttaatttgtcacataatatgtttaatggaagtgttccaagtgaattagcaaaatttcctgtgcttaataatcttgatctttcttggaacaatttttctggggagattcctatgatgttgcagaatttgaagctcactgggctgaatttgtcttacaatcagctttctggggacattcctcctctttatgccaatgacaagtataagatgagttttatagggaatcctgggatatgtaatcatctacttgggctttgtgattgtcacggtaagagtaagaatcggaggtatgtgtggattttgtggtccacgtttgcacttgctgtagttgtgttcattattggggtggcatggttttactttaggtacagaaaggcgaagaaattgaagaaggggttaagcgtttcgcggtggaagtcgtttcacaagctcgggtttagcgagttcgaggttgctaagttgctgagcgaggacaatgtgataggaagtggagcttctgggaaggtgtacaaggtggtgctcagcaatggtgaggttgttgtggcagtgaagaaactgtgtggagcacctatgaatgtagatggaaatgttggtgctaggaaagatgaatttgatgctgaagttgagactctggggaggattaggcacaagaatattgtgaagttgtggtgttgttgcaacagtggggaacaaaggctcttggtttatgagtacatgccaaatgggagtttggctgatttgttaaagggtaacaagaagagcttgttggattgggtcacaaggtataaaattgctgttgatgctgctgaggggctttgttatttgcatcatgattgcgtccctcccattgttcacagggatgtgaaatccaacaacatattggttgatgcagagtttgtggctaaagttgcagattttggagttgccaaaatggttacaggaatcagccaagggacacggtcaatgtctgtgattgcaggatcctatggctacattgcaccagagtacgcgtacactctccgtgtgaatgagaaatgtgacatatatagctttggtgtggtccttttggagttggtaactggaagacccccaattgatccagagtatggtgaaagtgatttggtcaaatgggtttcctccatgttggaacatgaaggactagatcatgtgattgatcctacattggactccaaatacagggaagaaatcagcaaggtattgagtgtggggcttcattgtaccagctccatcccaataactcgccccacaatgagaaaggtggttaaaatgcttcaggaggtaacaactgaagttcccaaatctagaagtgtaaacggtggaaatgttccatgttcctatgaaggggcatctcatgctatcaatgaagtgtag

SEQ ID NO: 30893 - DNA, 363 bp, Glycine max
  Peptide Sequence Number=SeqID_147671
atggatgtggaagagaactacaataacaacagaacccttcttcatcaccttcaccccaaagaggaggaacaagatcaagaagatggtcctgatgaaactgtcactgttgcacttcacattgggttgccaagccctagtgctgctgagatcgcttctgtgctttcttcagcttgttccacagaccaagaacaacaacaacaacaacaacaacaagatgggttcttgtctaacagactcaacaagggacagtactggatccctacaccttctcagattctcattggtcctactcagttctcttgtcctgtttgttgcaaaaccttcaacagatacaacaacatgcaggtcagtgtactaacataa

SEQ ID NO: 30894 - DNA, 858 bp, Glycine max
  Peptide Sequence Number=SeqID_147672
atgactcagtgcagtgactctgaaaacaatcatcataacatcatagtggagggacgaaaagatagcttaatcagaacttgtcctacttgtggtcaccatatcaaatgccaagaacagggtggtggaattcatgacttgcctggactgcctgctggagtgaagtttgatcccacggatcaagagattcttgaacatttagaagcgaaggtgcgatctgatattcataagcttcatcccctaattgatgagttcattccaactcttgaaggcgaaaatggaatctgctatactcatccagagaagttgccaggagttagcaaagatggcctgatccggcatttctttcacaggccttccaaggcatacacaacaggaacaaggaaaaggagaaaggtgcactcagatgaagatggaagtgagacacgttggcacaaaactggtaaaaccaggccagtctacaacattgccaagttgaaaggttacaagaaaatccttgtgctttacacaaactatggaaagcaaagaaagccagagaaaacaaattgggtcatgcaccaataccaccttggcagtgatgaagaggagaaagaaggggagctagtggtctccaaggttttctaccaaacacaacctagacaatgtggttccctcatgaaagattcatcagttcctcctgggaaacatatgaagggtcaaagtgtgcatgttgaggtaatgaataataacaaaaacagcaacaataatgggtatgttgagtactaccattcttcaaatttcatatcttttgatcaaggagggcaaaatgctcaagtaatttctcattttcctgtccatgaaggtgctcctttcattccttga

SEQ ID NO: 30895 - DNA, 354 bp, Glycine max
  Peptide Sequence Number=SeqID_147673
atgtccaaaaaaatcgatagtaaataccaattttgtagtaaagaatgcagttgtgatggagggagactaattggtgtcagagaaaatgatgttgatgaagaagcagttggtggtgtaccagctggtgtcataaaagacattgttgacatttttgagaaggagaccaagaccggtgttggtggtgaatacttgtataacatgttgatcttgagcgagaacaatgaagtaaaaaaggagaaaggaaaaagaagaaggaaggaaaaaataagaagggtctcacaaaaggattcaaggataaagagaaaatgccctgtcattgtcaagtctttgagagtcttggtgcaaattgcatag

SEQ ID NO: 30896 - DNA, 2997 bp, Glycine max
  Peptide Sequence Number=SeqID_147674
ggatggctcatcaattctatggatctaaagttggtgagcaactttattagatttttgacggctaaggttgtttgggatagtattgctacaacatactttgatagcggtgatacatcacaagtatatgatctcaaaagaagagtgaccagactcaagcaaggtgacagatctattgaaacgtattataacaacctacaaggactatggagagagatcgattttcgtcgaccaaatcctatgttgtgtgatgctgatattcagagatataatttaattttgcaagaagacagagtctataccttcttagatggtcttgatgatcgtcttaacaagattcgagcagatgtacttcagatgcaaccattcccaatggtggaacaagcttatgcactggtccgaagagaagatttaagccattctgtggtgatggtaaatgaagatattgcatcaggaggtgctatgctttcaaggagagggcataaacctcaacaccgattatctcttcagatgacttcaaatggcaagccaactaccaaatctcaatcacaaggagaaggagaaggatgcaaacattgtggaaatatgaaacataccaaagagacatgtttcaaactacatggttatccagattggtggcatgaactcaaggaaaagaaaaaacgtgaatcaagtggaggaaacaattctggtcgtgcagcccttgtgagcgtagagcctcaactatctcttatcacacaacaagaatcacctagtggccatgcttctcaaaacgattcaggtaaccaaggttcttcttattcatactctaaacaaggaaaccgtgataattggatcattgactctggagcaactaaccacatgacatttgatctgcatgacttttctaaaacctctcaactgaatcggacatgcattgacaatgccaatggagtaacttatccagtgatagtggctggaacatttgatttttctccttctttctctttaccaaacactttacttgttccatcactttttaacaaattgttatctattggtcaagtgactaaggagttgaattgttgtgctataatgtattccaacttttgtttgtttcaagatattctcaccaaggagattattggtcgtggtactaaaagggaagggttgtattgcttagatgatttcagttatgagctatttacaaaggtcagtgaatcagacttcaagtgtgaagccagtattcaagctaagagtcatcgtgtaccttatccaatcagtttgaataaatgtgatacgcctttttctatcattcattccgatgtttggggtcctgcccctattaatattccttttggtgttcgttggtttatcatgtttattgatgatttggtgactgctgtgtacttgatgaatcgacagccatctcgagtcttgaactataagactccacttcaagttctagcaaaacatgtgacattaccatatgttctcatgcttcctccaagaaagtttggttgtgttacatatgttcacattcccaaaaatcaacgaatgaagttagatctatgtgttgttcattgtgttttccttggtcatggagctcataagaaaggatattgctgttacgatccagtcacaaggcgtctttatacaaccatgaatgtcacctttattgaatcagagaatttctttactttccaatcttcccactcctctcgtcagggggagatgatgagtgaagagcagaattggaaagattggccaggttttgaagcttcaaatgatgtaggggttatagcagaaattgaagaatctgcagaaactgaaagtgaacagcctttgcttgttgaagcagaaactgaaattctaaactctcctcaaaacatttctattggttataaattacctttcaggcataattgggggcaacctcctaatcggtattcaccggatcatggaactagcaactatcctaagtggatccaagcaatagaggaggagatgaaagagttacaagagaataacgcttggtcacttgtgccattaccagaggggaagaaaatagtgggatgtaaatgggtgtttactatcaaacataaggcagatggatcggttgaaagatataaagcgaggagtgtggtttgtaagctgaaaaaggcattatacatattgaaacaatcccctagagcatggtttggtcgatttagctttgcaatgaggaaacatggtttcaaacaaaggcattcagatcatactctcttcttaaagcatcaacaagggaaggtgacaactctaataatctatgttgacgatatgataattatagggaatgatgaaaaggaaatctctagactacaagagcatttagcaactgagtttgagatgaaaaatcttggagggttgaagtattttttggggataaaagtagctcaatcaaaacgaggcatatttctatcacaaaggaagtatgtacttgacttactatcgaaaactggaatgcttgattgcagaccggctaatacaccacatctgcacattcaaggttatactgacgcagattgggcagggagtattagtgacagaaaatccacatcaggttacctcacatttgtgggaggaaatcttgtctcttggaggagtaaaaaacagaaggtggttgctctatctagtgtagaagcggagtttagaggtatgactaaaggagtgcgtgagcttctctggttaaaaaggttagtagaagaagtcatatgttcaactcaagatacaatggatctattttgtgataataaagcagccatagcaatagcacacaatccagttcaacatgatcgcactaaacatgttgaaggggatacacattttatcaaggagaagctcgaagacaagataatccagtttccttttgtaaagtcagaagatcagctaactgatatacttacaaaggttgtctctagcaaaatatttcacaactcacttgacaagttgggcattgaagatatctatgcaccaacttga

SEQ ID NO: 30897 - DNA, 387 bp, Glycine max
  Peptide Sequence Number=SeqID_147675
atgacgggattctttggtgcaatgtttttaaatcaaagtatgggggctgaaggggattgggaaattcagatgtttttttgggctttggctgacaagtatagcaggttattcacaaattcttgtaatccgaatgccctggtggctgaaatgggatattggttgggagaaaatgttactattggatggggctgcaagtaccctcccaaacaaacaatgttatttttagaggggccaatgggaattgggaagctgtgttgtgtggccgcatgggatctggcaaaacatagagcttgggcatggattaatgcgaaagggaaaggaagaaaattctcttattgtgaatgggagatgaatcccagggcttgtttgaattgtttaacgttatga

SEQ ID NO: 30898 - DNA, 1116 bp, Glycine max
  Peptide Sequence Number=SeqID_147676
atgcatgacgacgtcgtggacgccatgcgcaagggtggcttctacacaatgctgtttcccaaggaagtcggcggggccgaactgcgcccaatcgatgccatgagattaatgtccgcgctttcctatgcccacgcatcatcgggctggtgcacgatggtcaacaatatggaaggtaccaccatggcgatctacctcgacgacgaggggattgcgaatgtcttcaaggacggcgtcgacatcactattgcaggcaatggcgtgccgcgcggctttgcccgcaaggtcgatggcggctacatgatccgcggcaactgggcttatggaagctccatcttccacgcggaatggattcattccggctgcttccttctcgatcccaaggacccgagcggaaaggcacttcttaaagacgaaaccggcgcaccgcagatcatcgtcgcacatcacccgcgctcgacgatccagctgcttggcaactgggatgtgctgggcctgcgcgccacgggcagcttcgactacacgctggcaaccgatgaagacctcttcgtgccggattcaatgacctatagtttcacgcagtccgcaccgaagcgcggtcagacacagggccatctcgggctggcgggctacagcgccctcacccatacaagctgggccatcggcgtcggtcgccggatactcgacgaacttgccaaggtgatccgccagcgacaggatccattcggcaaaagtgcagacagcgccagcctgcggttccagtttgccaatgccgaagcccgttaccgggccgcacgggcgctggccatggaaacatgggaagacgtctcgcagaccaccgcatccggcggcgtcccgtccctcgaccagatgacgatggtgaagctctcgctgcgctatatgcacgacatcgtttcggatgtggcgacattcgcgcatcgtgcggctcgtggagcctcgctgcacaacacggccatgcagcgcttctatcgcgatatccattccggcacccagcatattttgctcgccgaccagatcgtcgaggaatgcggcaaggggctacttggcctgcccggccccgatgcgcgatggaccgttttcggcatcagcgaaaactga

SEQ ID NO: 30899 - DNA, 189 bp, Glycine max
  Peptide Sequence Number=SeqID_147677
atgggttcttctttaagctataaggttcgaactatgattgaagttccaagggatgcactagttgcagatgaggttcctcctgttcctgaagcaatagctggagctattggtgtctcacctgtgagtgtgggattggatggaacaacagctaagaagaaatctgattctattttagcaagggagtgttga

SEQ ID NO: 30900 - DNA, 321 bp, Glycine max
  Peptide Sequence Number=SeqID_147678
atgtgcaaagaatacaaaggcacaggtgtcaatcggtactactacatgtgtttgaatgacctacttgcacttggcggtgggggttattattctgtgagggtggatcaagttcataccatgtcacggtgcatattgtcacatgttttggcttttgcacttgtttctgcgttgagtgtcttcagctgcttggttaacgttgcacaagctcaatctgcaaacaccaccactgatccttccgaaggtttgaacttttgggaattttctcagtttcaattttccaggagattcagagaaatagctaactcttcatcatcaacatag

SEQ ID NO: 30901 - DNA, 366 bp, Glycine max
  Peptide Sequence Number=SeqID_147679
atggtgaaggagtgggacttacagagctcgaatccatcgaggaggaacatcaagggaagcaatcacagcaagatcaatttcaacgtcgagcgtagccagcgatttgagaagcacgagtatggctatgtagaattcgtagtccttcggcgtacctacgataggggaatgggggcggaggacgaatgtggagtggggggcggtggtggtaccagggagaaggtggagaaatgtaatgggaagaggagagaagaggagaagcagaagatagctagcgagtggggagaggaacagatgccagctgggaaagaaaaggaacgagcaccacatttgcggaaagaagaggaacggatgcgaggggcgagttaa

SEQ ID NO: 30902 - DNA, 345 bp, Glycine max
  Peptide Sequence Number=SeqID_147680
atggaaacagggaagcatgatgagactgaagatgagaacaaactggatggggaaaagctgattgaggagagatccaaagaggtggaaacccctaaagatgatccgaaaggaaatcaagaggcgagaagattatgggttgacgtgataagtgagaatcgaaatccaacaaaaggaaggatgatgtcttatgtggcaccgaaaatggtagagggacaaattgaaatcgagattgaggatgaggacatcgaatctgaaattagatattgggaaaatgccctaatcctatatgtgctggggggtgacctcagtatgaatacgattaagaatttcatggagagaaactag

SEQ ID NO: 30903 - DNA, 261 bp, Glycine max
  Peptide Sequence Number=SeqID_147681
atgcaaaaaccctcatgcagtgttggtcaatcaccctcatgcaaaaaccctcatgcagtgactcaaactagcttatattgcatacaaataacatgcgatgatgatgaagagagatcaagtctgaaagcaagcaggggctgttctcgttcttcaacgtgccaaggctgctcaacttgttactgtgaagggtgcatcaagtgccgctttgaggattgcaattgccaagaatgcagagactttatgctatatgctaaaccttaa

SEQ ID NO: 30904 - DNA, 1086 bp, Glycine max
  Peptide Sequence Number=SeqID_147682
atggaagtggtggtgatgaagggtccttatacaataagaagcatgccggtggtacttaaagagtggagacctgattttagtctgaagcaggacatgctacgaaccataccgatatggataaaacttcccaagctcccgttgtatctttggggcgaacgaagccttaacaaaattggcagtgccattggtacacccatggttactgatgaatgcactacccacaaactcaaagtttcctatgccaggatgttagtggaggtcgacattactagaaaattggtggaagaaattgctatcaaggataaagatggtcggaaaataatgcaacccattgagtatgaatggaggcccaagttctgtgataaatgtcagaagatagggcatcaatgtggaaatggggtcaagaagaaaaaatggcagcctaagcctcaacaggagagaaaacatgaaatccctgttgaggtctctacaccaaggaaagaaacaacaacgagtaaagctaatggagatgaaggaaagacatggattagaactactaaagatgatgaagagatgtggactaaagtgagcaaagcttcaaaggatagaggttttgaatggcccccaagccttcgatcggggaccatgattacttcatggaatgtaagggggcttaacaaggttggaaagctaagggagataagctcccatctcctagagcttcagccagaaattgcaattttgatcgaaacaagagttaaagaaaataaagatgctaatgttagagagaaacttcggctaaatgggaattatcttgataactatacttgtcatgcaaatggtaggctttggatccattgggacttaaatagggtggatgtgaaatgtgttagtaggactagccaacttatacactgtggtgtttatgatgtaactggaaatttcaagttttggctaactgctatttatgcaagtaatgcattggatagaaggaaaattttatggaaagatattgagaaaattcatgagactcatcaaggggcttggtgtgtggtgggtgactataacaacgtggccaaggcccaagacagaattggcggaaatatg

SEQ ID NO: 30905 - DNA, 1616 bp, Glycine max
  Peptide Sequence Number=SeqID_147683
actatacaaaccgttcaacaaaaactgtagttactttgatacccaagaatgatgatgctaaatgtgtgaaggattatagacctatcgcgggttgcaccactttctacaaaattatttccaaaatcctaacagctaggttggggggagttctacaagatgttattagtcataatcagtccgcgtttgtgccgggacagaacatccacaaccatattatgcttgcgtatgagttaatcaggggttacactaggaaaaatggtacaccgagatgcatgatgcaatcgaatctgcagaaagcatacgatatggtggattggagggccctggaggatgttatgcaagagataggcttgcctaggactttcacaaactggattatgactacagtgaaaacagtttcctatagcttcaatattaatgggcagatgacagaagatatgcaggcgtgtcgaggtatcaggcaaggggatcctatatctcctttgctatttgtgatcatgatggaatactttaataggatgtttgacaaaatgcagcagaaccctaattttaaccatcatgcgaaatgtgaaaaaatgggcataacacacttgacatttgctgatgatgttctcttattttgtaggggagattctaaatctgtggacatgatgtttgacactgttcaaaacttttcagatgctacaggtttggtaattaatctgacgaaatgtaagattttttttggtggtattgatgatgaaaccaaaggagttattaagaggactacaaattttaaagaggggcattttcctattaggtacctgggggttcccttaacaagtaaaaagctcaccatcacccattatttgcctcttgttgagaagattgtgtgtagaaccaggcactggacaacgagattactcagtcatgcagggagaatacaattagtaaaaaaaattgaagcaatctacaaatctttcatttggactggctgtagtgaggtgaagaagaaaagtccggtggcctgggagactgtgtgcagaccgaaatgtcaaggaggactggatattataaacttgactgtttggaatcagagtattatgcaagttgatagccagagtcattggtcttggatgttcaacaatattttggatcaaagagagaaagtcaggctgaaacaggaatggaataatcagatgcagagggataaattctcgatgaaaaccatgtataacctgctgatggataaatctgattgggtaccatggagatttctgctgaaccataacattgcaaggccccgagatatagagaatttatggttgacgtgtcatggtagaatggccacaaaagataggctgaaaagatttggaatgatcaaagaaaatcaatgtagtttatgtaaggagtctgaggaatctattgcccatctgttttttgactgcaaaataacaaaatccatatgggagcagattcttaaatggattgaagttactcatgaacctaaaacttgggatgtagaactcaagtgggctattcgagaaactggaaagaaagggtggaaagctaaactcctgaaactctttacgaggtgtggttatatagaaatgatgaagttttcaagaataatgtga

SEQ ID NO: 30906 - DNA, 1867 bp, Glycine max
  Peptide Sequence Number=SeqID_147684
cttgaatactttccaccttgctggtcgaggtgaaatgaatgtgacacttggaattccacgcttgcaagaaatcctgatggctgctgcacgtgatatcaaaactccatttatgacatgccccttgagacatgataaatctatgaaagatgctatttgtctcgctgataagttgaagaagattactgtagctgacataattaagagtatgaaagtttctgttgtaccagtaacggttcttggtggtcaagtttgcagtatatataaacttgtgatgaagctatataaatctaaacagtatccagaatacactgatattacccttgacgactgggaggaaactctaagggttaactttgttagagagttggaggatgccattcaaaatcacatgacattgctttctaaaattagtggcataaaaaaattcaagactgatccacaatcaaattattcaaacagctctgaagatgctcacagcaatggatcagaatctgagaaaaaaggtcaaaataatgatgacgacgatgaagatggtggtggtgttgaagacactgaagggtatgaagatcttggatcagatgcacaaaagagaaaactacaaggtactgatgaggttgattatgaggatggtcctgaagaggaaacacatgatggtgagctgtcagaggaaattgaaggtgatgaggatggcagtgatgttgatgccaatgagaattataacaatgtgacagatgctaataattctgaaggacttgaaaaaccctccaagtccaagactattgatgaaaaacaaaatttgaaacgagaaaagaaaaaatctgaaccaacaacaaaaaaatatgacagggcaatttttgtggaagccaaagggaagcattttgagatccactttagatttactggtgaacctcacattttgttaactcagattgctcagaggacagccaagaaggtttgcatccaaaattttggaaaggttggtgaatgtaaagctattacatgcaaagaaagtggagtaatctactatggtaaagatggcagaaaaaggattgagatttcagcctcagagaaagaacaaataccagcacttcagacatcaggggtacattttaaaacattttgggagttggaagatgatctggatgttaggtacatttattcaaacaacgtgcatgctatgctaaatgcttatggggtggaagcagccagggagacaatcatcagggaagtgcagaatgttttcaagtcttatggtatatcagtaaatatccgacacttgacactcattgctgactttatgacgcacactggtagctatcgcccgatgaacagaacggggagcatagcagactctacatcccctttcatcaaaatgtgttttgagacggctggcaattttattgttgaagcagcttatcatgggcaagtggacaacttggagacaccatctgctagaatttgtcttggtttgccagtgaagatgggaactgggccgatagcatcaacacctagacaatgggcagctacaactgttgctgaggatgttgaccatgtgggtcatgttgttgacaaggttcatgaggaccctcatgtaggtgctaatataaaggattttccagatccacctaagtttctcgttcactcaacatctatgccacaaccacttgcatttgtagctgttgatgcagacatgcttcgacatgcaatgataccagaaagcttggaacacatgatcaacatgaggatggccactattggaacagatgcatacactctgcctgagcactatctaagattagccagagacgaaggagcgatacaaatgacaaagatggtggaggacgaagacgatgatagatgggattga

SEQ ID NO: 30907 - DNA, 468 bp, Glycine max
  Peptide Sequence Number=SeqID_147685
atgatgatttcactattcggttttgctggagaaaagataggtactagggggtgcatatggttgtacacaagattcggacatgaggaggcgaaacataaggacctgaaaattcaatatgtagtagtacatgatcacacctcctacaacatactcctcaatcgtccatctttaaatactctaggtgccataatgtccacccctcacttggctatgaagttctcctcagaaaccaggtccataataatagttcacgcagatcaaaagatggctaggaaatgctacatggcaagcatgaaaatagctaacatgtcgaggattgatccaaccttccattgtcataggatttatgttaacccacaaggaaatacatgcaaatctcaacaagtgtcaggccattttagaaatgagaagtccaaagaacttgaaggaagcacaatggttagccggcctgatagcctccctatctag

SEQ ID NO: 30908 - DNA, 699 bp, Glycine max
  Peptide Sequence Number=SeqID_147686
atgagtgagggtagtgaacaaacacctagcatggatagtttcttatacctccatccgagcgagaatccagtagttactctcatctccccggttttagattccactaactatcattcatggagcatatccatgataacagccttgagtgctaagaataaagtaaaatttgtagatggaagtgcacctgaaccgccaaagatagatcggatgcatgctttcagcaactctgattgggctgaatgtagagattctagatgctccatcataggtttttccatctatcttggccactcacttatttcttggcgctcaaagaaacaatctactgtattccacagctcctccgaagctgaatatcgagctttagcctcaacaacctgtgagcttcagtggctcacttatcttcttcaagatctccatgtttcttttgtccaactggctattccttattgtgataataaatcaacaatacagatagcttctaatcaagtgtttcatgaacgcactaagcatattgacatagattgtcatatcgttcatgagaaagtcaacagtggtcttctaaagctccttcttgtttcctcttccatgcaactcgccaacatttttactaaagtcttatctccatccatctttcaaggtctttgttccaagctgggaatgatgaatatacattcccagcttgaggggggctcttaa

SEQ ID NO: 30909 - DNA, 384 bp, Glycine max
  Peptide Sequence Number=SeqID_147687
atggaaaaatctcttttgattgtagaagaagcaaacttatcatccagatctttttctggaagagttagtgatgataaagctaacagaagtggaaggaagggtatggttcttccttttcaacctctatctctcacatttgatgagatcaaatattctttagacatgccacaggaaatgaaaaagcaaggagtttttgaggaacgtcgagaacttttgaagggtgttagtggtgtctttaggccaagagtactaacagctctgatgggtgctattcaaggagttcctaagatcaaagaaggttataatcctgcaacctggatgttggaagttacatcagcaggcatagaagcatctcttaagatatttcaaaccaaaggctattga

SEQ ID NO: 30910 - DNA, 528 bp, Glycine max
  Peptide Sequence Number=SeqID_147688
atgtttgatcaacaggcagctgtgtctccagcaaaacctccagaaagcccggatcatgaggtcgatgatcccctgtatctgatgatattgaccatcccacgactgtttgtgttcggggtgtttaatcaaaacttctcattgtacataaagcatgaaaatctctctgaaattgcacatagtggtcaatgtctcagcatatctgttatacagttgtggattctgcatctgactgagacaagtatgcaagcggggagttacgatgtgtatggattcctcgagccacagtccattcagagatctgggcaatcgcaatttgaatcgaaaagttacatcaagagttggatgcagagttcaaaacatggtgtctattttggaacctacctgaatggtgctttgaaagaacttgatgatactccacaacctaaatccaaggctgctgctagtgtaatagacaaaaaggaagcactgagtgcgctattacgtcatgcactagatgtccacgataatcttaggaactttcaggaataa

SEQ ID NO: 30911 - DNA, 321 bp, Glycine max
  Peptide Sequence Number=SeqID_147689
atggataggaatagggggagcaaggggtgcaaaaagagaatgagaaggagaaagctgagaagattgaggcacacaaactacaaaaggtggagacaggaatcaagactcttgatggagttagaagaggaaggaaacaggcctcaacaagggaaaacaggcacagccaaaggtttcaaggaattgaaaatcaggatccttgttgaaaagagtccatcaaacaactttggaattggaattgggattaatccaggtattggaagccctggcaaaaccagaggagtagggaactggttgaagtgtggcaagatcaaaggtgagtga

SEQ ID NO: 30912 - DNA, 318 bp, Glycine max
  Peptide Sequence Number=SeqID_147690
atgaatgcattttacggacacgagagcccggaaaattatctcttcttacttgcgcacttgggggcgcagtgccccatgtgtacaattaagaaggtgatatggaccttccggcttcccgtgacaaaggacgagaccaacatacaatgcatgctagagataaaatgcgggagtgacttgatttgcacaagcttttggagtagaaacatgggaccaactcattttatttcaaaaaaagaaatcatatctagtcaagccgagaagcccatgaatctcttcgggggcggagtaggtgtctgccatcgccttggccttggctaa

SEQ ID NO: 30913 - DNA, 465 bp, Glycine max
  Peptide Sequence Number=SeqID_147691
atgaaatactttgtaacgaggaaacaaaattttcccaaggttgagttccaacattgcatgagttgcaggaaggagcacaagctacgtcttaagagcaaaccgaatactaagaactaccaagatgctttgaccaacaaatcttggacatgttatccttggccttatcaaaagctcccttcgatactcctgccaacgaacccaaagcctcatagtcacggccacaggtcctcccaccctaaagcctcaccgtcccttcctcaccctaacccacaccaacttgtaccagcaacttgcatacaaagccaacgcctccatctacacgtgcttcgtttcccctttattatgattaattctgagtttgaactcaatgggaatgaagaacatctcaagcttcaattaacaacctcgatggagaagcagtcacaatctatagaatttaggtttggacttaattgtaaaaactaa

SEQ ID NO: 30914 - DNA, 630 bp, Glycine max
  Peptide Sequence Number=SeqID_147692
atgacaagcaatcttaactcaagaacaagctcagggatattaaagaagctactatctgaaggaatattgaaaccttcaggaaaaaattgtatttctcttatgactacatctggagctaagggtagtatggtgaatttccagcagatatcttctcatctaggccagcaagagttggaaggaaaacgagtcccacgcatggtttctggaaagaccttaccctgctttcctccttgggattgttcccctagagcaggagggttcattattgatcggtttcttacagcccttcatcctcaggaatactactttcattgcatggctggtcgtgaaggggtgggttcctcaacggcttggcttgagtgcttatcaattggtatcaaagctgccgccgagatgttggctctcaagggaggtgctatgattgggacatgggaattatgggggtgggttacccaaatgcttgggtgcttatcaattggtaacttagttggttgtcaatgtctcgaaaaagtttacctatggaggagcactgctatgatagggacttgggaattatggggtgccgatgtcgcacatcgagtagtatgggatgcttggtggggtattaagtgcttggttcttcccccttaa

SEQ ID NO: 30915 - DNA, 471 bp, Glycine max
  Peptide Sequence Number=SeqID_147693
atgacctctttgctccgcaggctagttgatactgcagtcaaaacatctcggagtggttacctgcaaagatgcctaatgaaaaaccttgagtgccttaaagtttgttatgatcatactgtccgtgatgcggatggttcaattattcagtttcactatggagaagatggtgttgatgtccatcaaactagctttatcaccgaattcggtgcattgtcaactaataaagaattggtttttagcaactattgccgtcaactagacagatccagtccatatattaacaaattgcctgaggctcttgaaggaaaagcagaaaaattctcgaaacagagaaatcttggttctatggagcaagcggatttcttaagattgatggagcataagtatgtctcatgtcttgctcaaccaggtgaaccagttggtgtattagcttctcaatctgttggagaaccggcaacgcagatgacgtaa

SEQ ID NO: 30916 - DNA, 2622 bp, Glycine max
  Peptide Sequence Number=SeqID_147694
atggactatacgacgccgctttggggccctttcgatgacaagtctctttgtaagtcgtgtggtcaaacttctaaacattgcccaggtcattttggtcatattgagctcgtttcccctgtctacaaccctctgatgttcaatattcttagcaatattctgcaaagaacttgtttcacttgccatcattttcgggcccccagcaaagaggttgatattcgtacatcccaattggagctcataatgaaaggggatattatcagggcaaaacgtttggaatctattatccctggaaaaagtgtggattcttttaatccagatgaatccatacatccaggtgatggagatgagagccagtgttatagtgctgagcaactgggagaaaattggacctcccttcaatttagtgaggcaatgtctgttctaaggaaattgctgacgaaaaaacataagaaatgtcaaaaatgtggagctaagaatcctaaaatcagcaaaccgacctttggatggtttcatatgaatgttctctcagctgatgaaactagagcagataccattagatctgtggaaagtgaaacaaccaatgatgatatatctttaggtggtggggatactacagacgtagaagatattacctctgcagggactgcaaaaagagataaaagaaaaaaagagaaattgtcttacaagcttgctgaacaaaataaactttctgggtctttgttaccttcacaggttaaaggtattttagagcttttgtgggaaaatgaagccaggctctgttcttatattaatgatattcaagatcagggttttggaaagaaagccggtcactcaatgttctttctagagaatatttttgtaccaccaatcaaatttcgtcccccaactaaaggaggtgataatgtgatggaacatcctcaaactgttttgttgactaaggttttacagtgcaacatatccttgggagatgcccatctaaataagtcagatccctcaaaggttctaagccggtggatggatcttcagcaatctgtaaacatgctattcgacaataaaactgcttctggcaagagagatgtcgctactggaatttgtcaattgctggagaagaaggaaggcatctttcgccagaaaatgatgggaaagagggttaattttgcatgtcgctctgtcatatcaccagatccttatttagcagtcaatgaaattgggattcccccttattttgctttaagattatcctatcctgagagagtgactccttggaatgtagtcaagttaaggaatgctatccttaatggtcctgaatcccatcctggtgctacacattatgctgataaagtatcaatagtcaagcttccaccaaaagggaagttgctttctttgacctcaaggaaattaccaacctcaagaggagttattttgcatcaagggaagatatctgaccatgaatttgaagggaaagttgtgtatcgccacttgaaggatggcgatgttgtgcttgtcaatcgacagccaacactccataaacctagtataatggcacatatagttcgtgttctaaagggggagaaaactgtacgcatgcactacgcaaactgtagtacatataatgctgatttcgatggtgacgagattaacgttcattttccacaagatgaaatttctcgggctgaagcttacaatattgtaaatgctaacaatcaatatgtgaaacctacaagtggggatccaattagagctttgattcaggatcatattgtaagtgctgctcttcttacaaaaaaggatacttttctaagttatgaagagttcaatcaactactgtacagttctggtgtatccatggctgggctaggctcattttatggcaaacatgggcagaaagttttcatctcaaattccgagagtgaaatgtttctgtttcctccagcaatatggaagcctgagcccctgtggacaggaaaacaggttatcagtgcattgctatactatatcaccagaggttcaccaccatttactgctgagaagaatgcaaaaatcccgtctaactttttcaagactcagatcaggaagggaaaaagatacaccgaagatacatcaaaaaagaaggataagcctgatgaggataaattattgatatataaaaatgatttggtgcgtggtgtagttgataaggctcaatttggtgactatggtatgatacatacagtacaagaactttatggatcaaatgttgctggcaacctactttcagcattaagtcggttattcactacctttttacagatgcatgggttcacatgtggagtagatgatcttatgttaacagaaggaaaggatgttgaaagaatgaatcaactcaaaagttgtgagataattggtgacagtgttcatcgtgaattcattggagtgaagaatagtgacaatataggcacccacaccattgacgacatcttgaaagaacaacccctgacgtgccttttcagtgagctaaatacacctgccctggaagcttttccagcacatgacggtgcatctttctgccattttggcagcacttcctgtgtagtggtcacccatatcgaccactcctatccttggagtttcatccccatttga

SEQ ID NO: 30917 - DNA, 1132 bp, Glycine max
  Peptide Sequence Number=SeqID_147695
cgtttgatggatcaagaaagtctgttatcggggaggttgatttgcccattacaattgggccgtttgttttccaaattacattccaggtgatggatatccaagccgcatacagttgccttttgggtaggccgtggatccatgaagcgggggccgtgacatccaccttgcatcaaaagctgaagtttgtcagaaatgggagattgatcactgtgagtggagaggaagccttgttggttagtcatttgtcagctttttcctttattggtgctgatgaaacagaaggaacctctttccaaggcctgactgtagagggtaaaaagccagagaagaatgaagtatcttttgctacttggaagagcgcacagaaagtggtgcaggaaggaacaggtgaaggatggggaaaagttgtgcagttgctggagagtaaaaaccgtgaaggactgggatttgctttttctgcaggatccgcaacgaacagtgttggatcaagctccattactagcaccttttgtagcgccgggttcatcaacaacccgccagaagccaatgctgtcttggaagatgctcctgaagagatagtgcttgcatttgtcacacctggaaaacttgttcgcaactgggacgcggttgacatcccttcagtggttcatgcatcaaaactaggcatttatgagcccgttgaacataataaccttgcaccctctcccaacttcgaatctcctgtctacgaggctgaagaggaggaggatgatgaaatcccggaggaacttgctcggttattggaatatgaaaagaaaaccattcggcctcatgaggagttagtagaggtgattaacttgggaaccgaggaagataagaaggaagtcaagattggggcatcgcttgaggcaactgtcaaacgaagggtgattgaattactcaaagaatatgccgatgtgttcgcatggtcgtaccaggatatgcccggcttggatccccgtattgtggagcaccgtttgcctttgaggcccgaatgcccaccggtcaagcagaaattgagaagaactcgccctgacatggctctcaagatcaaagaggaagtacagaagcagatcgatgcaggttttcttgtcacatcagagtatcctcaatg

SEQ ID NO: 30918 - DNA, 902 bp, Glycine max
  Peptide Sequence Number=SeqID_147696
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcagctacggcaccgtcacgctcggcctcgagcgtgggctcatggtcaacgcgacgctggtagccgccgtcttccagatcggcgtcgtgctcgtcatgggacgcctcagcgagcgcgtcgggccgggacgcatgacccttctcggtggcctcgtcaccgccgcagcggcgttcccgctgttctggctcatcgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 30919 - DNA, 594 bp, Glycine max
  Peptide Sequence Number=SeqID_147697
atgcttaatagtaagaatgcacctacattaagggtttctgaggagtataaagatatccttaccacctattctcatgataaaaactcttcagagcataaacaagctgcattatttatcaagcaaaagctggatgcagcgaaatggtatattgatgcaatcaaccagcgtcaaaataccttattgcagacgattacggctattgtaaagtttcagaaggaatattttattaccggagatgaaaaatctttaaaaccgatgattcttaaagatattgcagatatcacaggttttgatatttctacgatttcaagagtagtaaaaagtaaatatgctgatacaccaaacggtattatttatcttaaagacctcttttctgacagtttaacgaacgatgatggagaagaagtttctactaaagaaattaaaactcatcttcaggaagtgatcagtaaagaaaataaaagaaagcctcttaccgatgatgccttagtggttatcttaaaagaacagggatataatattgcccgaagaacaattgcaaaatacagggaacaacttaacattccagttgcaagattaagaaaagaactttaa

SEQ ID NO: 30920 - DNA, 681 bp, Glycine max
  Peptide Sequence Number=SeqID_147698
atgggtagccagcatgtcggtgttttctatgatggaattcaattgggaaatgcacaaaacggggttatcgatctgggaaagttttcgctggatgatatcggagaaatttcattatacaacggacagaaaagtgagatctttcagcctgcaaaagattttggatcttccggctcaatttatctccaacccaagactccttatttttccggaaataaaaaaacgaatcttgtacttagaataaaaaacagctcaatcgatcttttcaacccgtcatttcgattggagcaaaagctttcagataaaatttccgcaagtttcagctccgaatttatacagagtgacggacaatataaatacaaataccagaaaaaacgccccgatggtactatagccaatgatacaattgcaacaagatatgattcttatattactgccaaaagatttgagaccagcctgcagggaaatctgaataatggagactggaatgtccggggctacggatatatttcagatcgtgggattccctcagcaattgtgaataatggttttaatccgaaaggacaaaaattacttgatagaaattattttgttcaggctcacctgaggaaaaaaatatttccaaaatttgagactcagctcaaagctaaatttgcctacgactatacccggtatatggatacg

SEQ ID NO: 30921 - DNA, 473 bp, Glycine max
  Peptide Sequence Number=SeqID_147699
atggatggcgctaaagcgcgcgacctatacccggccgtcggggcaaggaccaaagccccgatgagtaggagggcgcggcgggtcgctgcaaaaccccagggcgcgagcccggggcggagcgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaaca

SEQ ID NO: 30922 - DNA, 498 bp, Glycine max
  Peptide Sequence Number=SeqID_147700
atgaaactggccaaatacaagtggagaaggacgaaggcccaagtggagaaggacaaagcccccgagtggagaatgatgaaggcccaagtggagaaggatgaaggcccagaggcagagacactatcaagactattaattacttatcaaggtaatccttgtggcgtctaccctgacttatctttcttcaccggaagtggcgtctacccagacttatcttccctcaccagaagtggcgtctaccctgacttatcttccttcaccggaagtggcgtcatccaaaccttcattgcctgtatcaaacgatccgctcctactcaggttcacatcatctggtcaggattacatattgatgattgcaacctgatgaatctggtattgcttcaagttgaacgactattacaagccaatcaaagatcacttaaagactatcattgtaggccatatcctaagaacgcaaatttactaacacatgcaaacaatggcctcattttgtcatag

SEQ ID NO: 30923 - DNA, 771 bp, Glycine max
  Peptide Sequence Number=SeqID_147701
ggtttcctcggtgcgctgaacgacacgccttacagctacgatccagagaaagccaaagcgattctgcagaaggccggtctgaccaacgtcagctttaagctctctaccagcaatcagccgccgtaccttgatatcgcgcaggcgctgcagggcagcttcgccaaaggcggcgtgaaggtggaagtgcagccgggcttaagttctgaagtctccacccgcgtgaaggcgcatcagtatgaagctacgctcaacgcctggggcgcggattatttcgacccgaacaccaacgccgcgtccttcgcatacaatccggaagatggcagcaaaaccattgcttaccgttcagactggcacatcccggagctgagcaaacagacgctggcggcgacggccgaagccgacagcaataagcgcgttgcgctttatcaggcgatgcagcgcgaagtgctgaagaactcgccgtttcgaagtaatggcagcgtcagcgtcatcggccgggttcgcccggccactctggcagcgcttcagccgcctcgtcaccagcctgctgtcgctgctggtgacgctggtgggtttgttagcgtttaccttcatgctgtcgcacctgtcgccagtcgacccggtgcagcaaatcgccggcgatcacgccagcgaagccacctatgctcaggtgcgtcacgacctggggctggatcagccggtgctggtgcagttctggcgctatatcagccatctggcgcagggcaatctcggcctgtcgcatctcactaa

SEQ ID NO: 30924 - DNA, 1083 bp, Glycine max
  Peptide Sequence Number=SeqID_147702
atggtggaagctagagtaatagaggcgcaacaagatcactgttgttgtgggggctatagccagctcctcatcattcacacgtgctttctaacggtggcgcaccagaggggtttaggttcaggttcggggaagttcttggcggcggaacaaggcggcgatgaggaaacggaagagagtactgtaggttcggttccgagccatgtggtctctgcagcttcggcccaaaccaataatcagtgggtcccggcaagtggttctccaatgatgtcacgttttatgaatgctccttcctctccaggattgtctcctctgtttggcgttggccacaagagagcccgtgaagacgacacgggtgcgggtgcaagtgtgggtcttggtgttgttgcagcagcttcttcacaaacacaagggaatgaaagtggcggcggcgagaggaggaggagatacagaggagtgaggcagaggccgtgggggaaatgggcggcggagattcgcgatcctcacaaagcggcgagagtgtggcttgggacattcgacactgccgaggctgcagccagagcttacgatgaagccgcattgaggttcagaggtaacagagccaaacttaatttccccgaaaatgttgtacaggttcaacctcctcctccgcttccaaatttaccggcaagtgcggttgctggttccggttccggttcggttgtgacaggttttgcgccgacggtgatgcaggggacgcggtttcaggactcctctgattttctgagagactattgggggtattctcagctgctgaggagtacaggggagttccatggactcgaccactggttctttgattcgcaaatggcagcgtttcaatcttctttgccgtcttcgttgttgccatcaccgccgccgccggcgtttctgccttcctctgcttcgtatcctctgttttcttctagccagcaaatggggattttccggccgccgggagagcagggtcacggcggagaagacggtggtagcgggtcggggttcacagagcttctaccttcgacttggtcagataccagtggctatcctcctccaccacctggttga

SEQ ID NO: 30925 - DNA, 546 bp, Glycine max
  Peptide Sequence Number=SeqID_147703
atggcctgtgaacatagatggaattttgatcttcatttcagtccttcgctcgaacaacaggcatgtggcagacccctaccagcattaaggatgcatgtctggactattgaactcactcaggctctgctttgtgatcctaaaccactgatggttccacctattgcagcaatacaccttccttcttgtggtttccacatgaccattttaagaaaggtcgggcctccattacaatggtctgtcgtcctagttggccctggctttcacgacaagtatgttgccgagccatggtaccagtttcttgttgaaggtgattctgttcatggagacaaacttttattccattacagaagtcgtgaggatatttgggaaatgggcccatcaaactgcttggcagcaatacggttttcggctgcatttcgtgtttccaaggacaaagatacttccttcgaggtggatgtcattggacctatccattggcagggccgtccaaggtcggttctggcaaccggagacacatctttacagccaatgtcactgaacacatga

SEQ ID NO: 30926 - DNA, 882 bp, Glycine max
  Peptide Sequence Number=SeqID_147704
atgacggttacaatacaaccatttgctctgatgtcaagtaacaaggacattattactttgaaggatcctcatactgaagagttgcctcagtacatacatataaatcagaatgagttttgcatacgaaggcataagaagcagaaggaggaggatattgctatatgtgaatgcaaatatgatgctgatgaccctgacaatgcatgtggggatagctgcctgaatgtattaaccagcactgaatgcacccctggttattgtcattgtgatatattatgcaaaaatcagaaatttcagaagtgtgaatatgcaaaaacaaagttgtttaaaactgaaggccgtggatggggtcttttggctgatgaggatattaaggcaggacaatttgtcattgaatactgtggagaagtaatatcatggaaagaagccaaacgtagatcccaggcttatgaaaatcaaggtcttaaagatgcatttatcattttccttaatgtgtctgaatctattgatgcaaccaggaaaggaagccttgctagatttataaatcattcctgtcaaccgaactgtgagacgagaaaatggaatgtgttgggggaaataagagttggaatatttgcaaaacatgatattcctattggaactgagttagcttatgattataattttgaatggtttggtggtgccaaggttcgttgcctctgtggtgcactaaaatgttctggattccttggagcaaaatctcgaggttttcagtcaactattttttctaatgttgggaaaactatgagcaggaggatacttatctatgggaaaatgatgatggcaggttgctatgatcagatttctctactgtcattatacatgtgtgtgaaacctagactataa

SEQ ID NO: 30927 - DNA, 300 bp, Glycine max
  Peptide Sequence Number=SeqID_147705
atggtgtccttgactgagaaaccaaagttccacggaagcagaccacgaggggggccgactaagggaacggtggcgatgcgattccggtgccgagacggtggcgcgtggacttcacgcgccgaagatcgcacgggacaaggacggcgcgtggcggcgcgcttcccagggctgagtcacgcttttcaaggcgagcctaaccctaatctcgtcagagaaatgtccaccggaaatgacggcggcggcggtggacgacggcggcgggcggcagacgacacctgctctgatgccaacttgaactga

SEQ ID NO: 30928 - DNA, 1392 bp, Glycine max
  Peptide Sequence Number=SeqID_147706
atgagtttctccaatcataggttggagcttttctctttacatgccttaaagaaattcatatgtggagggaggttggtattcgggcccgatgcgaggtccctgtttgtcaccttgttgctgattattgttccagttatcatcttttgtgtatgtgtagcaagccatctccggcatgaattttcttcgtataattctggatatgctattttagtggtggctattctctttactattcatgtccttgtggttctctttctcacttcatcaggtgatccaggcatcgttccaaggaatccatatccaccagaagaagagtttcgttatgattcttcagtttctgttgatgctgggggagctggacgacaaacgccaagtcttcagttccctcgaacaaaagaagttgtagtcaatggcattgctgtaagggtgaaatattgtgagacttgtatgttgtatcgtcctcctcgttgctcgcattgctccatttgcaacaactgtgttgagcgttttgatcaccattgcccttgggtgggccaatgcattggtctgaggaactatcgttacttcttcatgtttgtttcttcagcaactattctgtgcatctatgtgttttccctctcggctttgtacatcaaggttctgatggataattatgacggcacagtttggaaagcaatgaaagaatcccctgcttctgtgatactaatggcttattgtttcatctctttgtggtttgttggtggactgactggttttcatttataccttctaggcacaaatcagcctctttgcatatgcaagggtaaggctgcgtacaacatccctcccccataccttcgcatagcgaagagcctctgggcaatggggttattgcctcttgtcttgcagactacctatgaaaatttccggtacagagctgacggaaggatcaatgtttttaaccggggctgcttaaataattttctggaaatgttttgcacaaaagtaaagccctcaaggaacaatttcagggcatttgctcgagaggaggtaccaccgagaccgcgggctccgatcattccccgggatcgtgatgacttgggcggagatcgccgccctaaggttgaagccgatcttgatattggtgaagacctattgaagatatcacagcgcaggaacattgaagaacttgacgaggacattcagggcagagggagcaatggaccacccggcaatacatctgaacctgactcaattatgtcctcagatcatcgagctcccacaattcgatccgatgctaggcacttgagttgggaaaggagtggaaactgggaaattgcacaagatgtccttgccaattcaaatgtcacagaaagcagaaactatgtgacttcaaaggaaatgcgccaatga

SEQ ID NO: 30929 - DNA, 1155 bp, Glycine max
  Peptide Sequence Number=SeqID_147707
atgtcctcccttttaaacggactaggaggaggcttgaattttatccagagcatcggcgccaccctcactgtcagcctctcccctccatgtcccaggaatcaacccaagcatgccaccgttgaaggcttcgacagcgtacaagcattgcgcaccatgcacggggtcagcgacgcaggggcgagttcggagcaacgccgccgagttggatgcggattcagaccaattatggtggtcgtactggagaacggggagctcgagctcgacgacgacaaggacgtgggggaaggagatggaggcgcggctaaaggggatttcgagcggggaggggatttcaccaatcgaagcaccacatcaattggatgcggcagtggtggtgacagtggttgtggggcttcctctgcggtgggggagatgccgttggtggctgcggaatccggtggcggtggtggtgctacatgttaccccgctggcaatgacgacggggacgagggtgagataggtgagctaggcctcgcgcttgaaggtcatgatgtaagcgaagacagcagtgaagaagggggtggtggtgccgacggcctggttgaaagacaccgaaaggtagcggagggagacattgccgaaaacgacggagacgcagaagacgaggttgagggcggcgatcttgaggaactagagttcggaacggatggtctacatggggaccatcttgagccaggcgatggcaacatagctaaagagggagtaggcggtcatgtggcacatggtgaggaagatagaatacttgaagccatagttgctcagaaggtacttgttgaggagcagtaccccaatgttggaggagtaccacgccgacaccagtccgatccatgttaccctgctggcaatgacgacgccggtgactttgacgaccatgaaggcgctggtggagtcgaggtcggaggttggttcatcgaggaagagcatgatggggtcgtggatgatgtcggtgtcgatggagatacgacagcgttcgccactggagacgctacggtggccctcgtcgccgatgaccaaaggagggagaagctcagaggagagagaggggtgccatgtcaagggatcagtgctaaaatcctcatcgaatacttttctcaagaggatccatgcaacgtatga

SEQ ID NO: 30930 - DNA, 249 bp, Glycine max
  Peptide Sequence Number=SeqID_147708
atggtgtacaaggtagagatactattagttgggtgggggatccatcgggttaatattgtacttgctgagcatataaatggttgtaggggggataatatgtcagaggaaagaccttataggaagaagaatcataagcttgtccaaggatatgggcatgaggggagtgctactgcggcatggaagctgggatttcgatatgtggaggttgagtcagactatgctaatgctggatatcttgaactcctgtga

SEQ ID NO: 30931 - DNA, 660 bp, Glycine max
  Peptide Sequence Number=SeqID_147709
atggtgaggacctttgaggtcttatgtcctttcttcaatattcaacctattgtgctggtgtttttgtacttctttcagatgaagttgataggcaagattggttgggtctccttgaacagcgtgtccaagaagctgttagagtttgactcgaacgtctttcattgtttcaaggactgtttcttcaaggtcctttcaattgagaagatccatcgacttgagacgaagagaaagaaaggtctatctattttttttagttattcaattaaaccaatgattggatccgagttaaccaagccttgtgacttccagtcaaaggaatgtgtttgtgtaactgttgccacaataaccaagttcttagttgccaatggttggatacatgagggttgtccaaagttgtgtaacaagaaagtggattgcgagaaatttccatacacctgtcaaggtcgtggaagtaaaagtgcaacaactgtggccagttggcaggaaggtgaatttgatccaaagggcattccaaaggttattgataggacacttggggaaaatttagcttttaaatttaagcttcctggaattgagcctgaaatgtcatattcatttgtgaagaagagtgatgatttagtttatactgttcaccaaatcagcctttctggtgttgtataa

SEQ ID NO: 30932 - DNA, 795 bp, Glycine max
  Peptide Sequence Number=SeqID_147710
atgacatggaaacgtcaagctgtggcaatagcaatcaatgctggctgctgtgggctagtgttgtactcagttgagaaaattcctgtatatgattctgcagaggatgaaccggtgtcaaattttaatggacgaaccgaaccctctttggatgttatagttaaagctgagcaattatcggagtccactgctttccatgttcagccccttgattcagttcagatgaaagatttagatgttaagaagattaaaactgatgtagcagacgaggatatgaacttttattcacaggatagtgaacataccctttctcaaaagaatgcaatatcacatatccgaagtaatactgcaggcagaaactattgccttggacctaggtccatgtctaccaaaagatcaagggcatataatggtggaaggttcaaaaatctcatagagaagaagatcgatgttaagtttgctgctgccctcctagcatccaaggaagcacaagaggagatttttaattgtgaggtctcttccatgcagaaaatgaaggatgatgctacatctgctcttgattccttatatgatgaaatacggcctgccattgaagaacacgagagggatagccaagacagtgtatccacgactgtagcagagaagtggatacaggcttgctgcctgaaattaaaggcggagtttgacctttactcatccattgtcaaaaatgttgcttgcactgcgcaaagggcatctggccaagtaaaacctactgaagttgataacgaaaacgaaattaagctcctgacaggttga

SEQ ID NO: 30933 - DNA, 219 bp, Glycine max
  Peptide Sequence Number=SeqID_147711
actcaatgatggaggatgcacgaacaacgctaggcaatcaattcgtggggctccagactcgatgggctccggactcaatgatggaggatgcacgaatagcgctaggcaatcaattcgtggggctccggactcgatggtggaggatgcaggaacagcgctaggcaatcaattcatggggctccgaataagatctgaatttaggaccgaatggtccaccgg

SEQ ID NO: 30934 - DNA, 132 bp, Glycine max
  Peptide Sequence Number=SeqID_147712
atggcctttgctttggcgagtcttgcctttcctagctctgtttttagagcttggacttcttcatcctcttccggagcttcgaagttctcctcgttgataactttgaacttggagagccaatctaaccctcat

SEQ ID NO: 30935 - DNA, 243 bp, Glycine max
  Peptide Sequence Number=SeqID_147713
atgaacaagaaggatcgtctaggattaaaccttgatgggaaattggcaagattcaagggttgggcggtggctagtttcctgggtctttataaggttaagtggtggctaaatagaaatatagaaatggttataactcaagctacaaggctccaaatgaggaacaaggttgaagatgaaatggtggaaggaaagaatcactctttccagcgagggcaacacacaaaggatgtgaaagacctttga

SEQ ID NO: 30936 - DNA, 186 bp, Glycine max
  Peptide Sequence Number=SeqID_147714
atggagaagctaagagtgtgtaacatctatgtatcacaatgggaatatggaacaattcaacatgaggtgaaagctcaaaaaatgggggaaaaatctttcttagagaattcttatatgattctaaagcaactagactctgcagctacattggttgaatggattagaaagcaaaggcaaaaattttag

SEQ ID NO: 30937 - DNA, 303 bp, Glycine max
  Peptide Sequence Number=SeqID_147715
atgggtttgaacggtgttcttcttggaaacagacctgcgttggcggctcgcgtggctagtggagcagatctggtggtgcgagctcgcggcggctacttcgtcggcgctgaagagatcaccggtgacggcagcgcatgtcggagagtggtcgtggaagacaccgggagggagagtacggagaagaaggaaggaagaccgagttttgatgtgagaaggtgcacaataaaattgtacaccaaaattaatctgaaggctgataatagtggtccaccaaagatcacttatattcatgatccaccgtaa

SEQ ID NO: 30938 - DNA, 219 bp, Glycine max
  Peptide Sequence Number=SeqID_147716
atggagctacatgagcttccaccaatgttattggtttttaatcaacccggtcctcattttgacaaggagttgacccgctggttaactgatgaacaacacaaatcagcccatgttcatgtgttgatcaattgtgttattgagtctagatctgtggttggtcagacgatgtgtactcaggatcaacttgtcaatcttgagtctagatctgcatctcaatag

SEQ ID NO: 30939 - DNA, 393 bp, Glycine max
  Peptide Sequence Number=SeqID_147717
atgcctttgctaaatctttcagaatggaaaaaggaaacgcttgagaagaaaaaatcacatgatttgaaattgcaattgatatctcataggaaaattgatggtagaatctataatttacctaaggtttctgaggtagttgcattgatatctggtgataggaatgaaccattgaacatggatattattctacagttgcaaaatgggaagttacaaagaatcaatgaactacatgctagctatcttgctccattggagcttgtaggcctaggatcttcttcatcaatggattcctttgcttcttggaagatgaatggcagcagaatggagaaggaagagagagaggagatgccacttcaaggagaagatgagtctagaagaagctcaccaccatag

SEQ ID NO: 30940 - DNA, 429 bp, Glycine max
  Peptide Sequence Number=SeqID_147718
atgaaggttcatgtcgctatgtggatgaggaacatggtattggaatggagggaagggtactataatggagacattaagacaagaaagacagtccaagccatggaattggaaatgaaggctgataaaataggactgcagaggagtgagcaactgaaggaactgtacaagtttcttcttgcaggtgaagctgatccacaaactaaaaggccttctgctgcattagctccagaggacctctcagatttggagtggtattacttggtttgcatgtcctttgttttcaatcacaaccaaagtttgcctggaagagcactagaaattggtgacactgtctggttatgcaatgctcaacatgctgatagtaaaattttctctcgttctttgctagcaaagggaaaatttcacttatattcgcttaggtctttctag

SEQ ID NO: 30941 - DNA, 1257 bp, Glycine max
  Peptide Sequence Number=SeqID_147719
atgtcagctatctgtgggcttcctatccttgagtgtgtttattgtctggcttgcgctcgttgggtttggaagaagtgtttgtacactgcaggctatgagagtgaaaattggggcctggctacggcacaagaatttgagcctgtgcctcggatctgtcggctgatcttagctgtctatgaagacgatattcgtaaccctcaatgggctcctcaaggaggttatggcattaatccggattgggttatcttgcgtaaggactatgacgataaccaaggtcgtgttactccgtacatgatataccttgatcatgatcatgctgaaatcatactggctgttagtggactcaatttggggaaggaaagtgattatatagttttgctcgataacaagctgggacaggcggaatttcatggtggttatgttcataacgggttgttgaaggcagcagggtgggtttttgatgctgaatatgagattctcagggaactagtcgcagaaaatccaaattatatgctaatatttactgggcattctctaggggctggggtggtggcattgttgacaatgctagcagttcataatcgagacaaattggggatatctagaaacaagataaggtgctttgcaatagcctctcctcggtgcacttctctcaacttggctgtaagatatgcagatgtgatcaattctgttgtactacaggatacttgcacactggaggagaagaagcttagagatccaaggcgtctgtatgcacctggccgactctatcacattgtggagcgaaagccatttaggataggaagacttccacctgtcgttaggacagcagtacctgttgatgggaggtttgagcatttagttctttcttgcaatgcaacttctgaccatgccatcatttggatagagagagaatcccgacgggctctcgatttaatgcgagataaagatgagcagcatatggagatcccagaagagcagaagatggagaggcatgaatctatagcccgagaacacagtgaagagtaccatgcagcccttaagagggcagttgctttggatattccacaagcatattcaccttcattatatggaacatttaatcaaattgatgttggggaggattctggaagatcaagtgtcctaggttcctccttgtctcacaaaaaacgagcacaaaattggaatgaatttgttggacgcctgtttgatgtggatgattctggtcatatggtgttcaaaaagacatctccataa

SEQ ID NO: 30942 - DNA, 199 bp, Glycine max
  Peptide Sequence Number=SeqID_147720
atggtgatggaggagcaagaagaaaacgtaggggaagaaggagaagaggctggaaatttctggaggaaagagagagaagccataagagaagaaaaatctggacctttttggatgctgaaatcttgcctcgatttgcgtgtcgtctctccggttccagttcttcacgtttctctgcacctgtcggggcccgttttcaaag

SEQ ID NO: 30943 - DNA, 522 bp, Glycine max
  Peptide Sequence Number=SeqID_147721
atggacaaacttcacaaaatcaacatgcaaggtcgaactgacaaaaattgggctgaaaaacatgcaaagtggataagtggatcgtcaatgaattttgaaattggtcaatcctcaaaggaaacaaacattgtgcaaccagaatgtaatcctgcatacacaccaattccccccatgatagattacattccacccacatacacaccaattcgcaccatgacggattatttttttcctagtcctttgaacatggactacactccaccaattgtccaaccagatgatttcttgagtaatgtttttggaactgattgtggcacgtcaacatcagcttgtgaatacatgcatagcctacagaacgaagtgggtaaatttactccaccaagtttcaatttgatgtttagccaagatgttgaagagaataatccattattgcatgatatatcagatcaacgcccacatcgaaatccaggacgtaatgggaggcgtcctccatgtggaacaggacaccattatggggattaa

SEQ ID NO: 30944 - DNA, 870 bp, Glycine max
  Peptide Sequence Number=SeqID_147722
atgttcaacattttttacaacaacccaacactaccatttgtggagttatttgccataatttctgacaacaataacccactaagcaaccaacatgactcaacctccaatcttgaggacctatcaaatgaatacgagacttattgggtcaaaaaccatggtagtgatactgactcctcttctagactggaaaaaagtaacatgtttccttcccacaaaacaatattcaaacgagtttacccacttctagagcaacaagtagcatggaccttgctttacagcaaaagcatgagaagaagtagcagaagcagtaccaatttccttctatttttcttcttgaacagccagagaaaaaatcttggtaatggaaggaaaagtatccatagagaggatctggccctgaatcaaagagtaggcttcattgagacccatcaagaaatgcatagcatactcaagcatattcacatcaagttgtgggatcttcgacacctagataggaggctgaaaatagaatatttggacctttatttgatccactggcccatcaatgtgaagcctggggattgggaaactccatacactaaagatctaataagtgcatttaacttaacgggtgtttggaaacaaatggaagaatgcaagaaactaggccttgcaaaatcaataggtgtcagcaacttcacttgcaagaaacttaaagatctactctcatttgctaccattcccccatctgtcaatcaaggtataatcataactgcattttctcctctgggagccaagggggctagttggggttccaatgtggtcatggacagtgaaatactcaaggaaattgcaaaggcacatggcagaactattgctcagcacaattaa

SEQ ID NO: 30945 - DNA, 240 bp, Glycine max
  Peptide Sequence Number=SeqID_147723
atgaagaacgaagaacgaatgataaacaaacgaagaataaccgaagaacaaacaacgaacggtgtaggaatcgatcacggatgcgattcagaacaaaacaaagcatttgggttgaaggtagctcccctaggcgagctgagctcagccaggcgagttgataacttcattttgaagcaaccctgctcgcccaggcgagctggttacttcattatgaagttatctaggtggctcaggggctaa

SEQ ID NO: 30946 - DNA, 1143 bp, Glycine max
  Peptide Sequence Number=SeqID_147724
atggagcatttagatgatggaaaagaatcatcaaatagtgtcaatgaaatagaagccactaattccctacttatctgtggccttccagatgatctttctcttatgtgcctagcaagagttcctagaaaatatcattctgttctgaagtgtgtctcaaagagatggagggacttaatttgcagtgaagagtggtatcattatcgccgaaagcacaaacttgatgagacctggatctatgctttgtgcagggacaaatcaaatgagattttctgttatgttttggatccaaccacctcaagaagatattggaagctccttgatggtcttccacctcacatctcaaatagaaaaggcatgggctttgaagctttgggaaataagctattcttattgggtggttgtagtgggtttctagattctacggatgaggcttattcatatgatgcatcctcaaattgttgggttgaagctgcttccttgtcaaatgctagtgacttctatctatcttacaacaacaacaacaaagtcttaccccaccaattgaggtgctactttgcttgtgaagttttggatgaaaaactatatgctattgggggattagtttcaaattcaagtgataattcttgggatacttttgaccctttgacaaagtgttggacattccatatagatcctaatattgcttctgatattgaagattcagtggttcttgatgggaagatatacacccgatgtgccagacatacggatgtagctcctcatgcttttgctgttgtatatgaaccatcaagtggcacgtggcagtatgcagatgctgacatggtttcaggatggacaggtcctgcagttgttgtttatggtaccctttatgtgttggatcagagtttgggaactaggttaatgatgtggcataaagagagacgcgagtggatacctgttggaaagctttcacctttgcttactagaccaccttgtcagcttgttgcagttggtaaaagcatttttattgttgggaaaacgcttagcactgtggttgtcgatgttggtgatttggggaatgagggtcaggtgatgatgggttcttctatacctggattattatcggatttcaatgtaataagttgtaaatgcttgtcaatctga

SEQ ID NO: 30947 - DNA, 1098 bp, Glycine max
  Peptide Sequence Number=SeqID_147725
atggagcatgtagataaaggaaaagaatcatcaaatagtgacaatgaagtagaagccacaaattctccaattatttgtggccttccagatgatatttctcttatgtgcctggcaagaattcctagaaaatatcattctgtcctgaagtgtgtctcaaagagatggagggacttaatttgcagtgaagagtggatctgttatcgccgaaagcacaaactcgatgaaacctggatttatgctttgtgcaaggacaaatcaaaggagattttctgttatgttttggatccaactgaccccataagatattggaagctcgttggtggtcttccacctcacatctcaaaaagagaaggcatgggttttgaagtgttgggaaataagctattcttattgggtggttgtagagagtttctaggttctacaaacgaggtttattcatatgatgcctcctcaaactgttgggctcaagctacttccttgtcaacagctaggtacaactttgcttgtgaagttttggatgaaaaactatatgttatcgggggaagtggttcaaattcaagtgatcattcttgggagacttttgaccctttgacaaattgttggacatctcagacagatcctaaaattgtttctgaaattaaacattcagtggttcttgatgggaatatatacgttcgatgtgccagattttgtgcaaatcctcgtgtattttctgttgtctataaaccatctagtggcacatggcagtatgcagatgatgacatggtttcaggatggacaggtcctgtagttgttgttgatggtaccctttatgtcttggatcatagtttgggaagaactaggttaatgatatcacttaaagaaggacgcgagtggatacccgttggaaggctattacctttgcatactagaccaccctttcaacttgttgcagttggtaaaagcatttttgttgttgggagagtgcttagcactgtggttgttgatgttggtgatttggggaatgaggatcagtttcctgcagtatctccttgccctgctctattactcccaaaatttatgttcttcgtaattgctcacttggctttgcaatcttga

SEQ ID NO: 30948 - DNA, 270 bp, Glycine max
  Peptide Sequence Number=SeqID_147726
cctgtggagtggatactacctacacctactccatatcaactagttgagccgattcaagtaatagaggtgtcatcctctgaagaggatcctgaagaggacccagaggagttaccccctgaacctgctatggacgcctttgacttacctgaggatgatgaagacccactccctgatgttgattctctagaggatatcatgtcagcatctgaggcagactctacagaggagagtggccctggagggacagcgaatagtgaagactcttcatag

SEQ ID NO: 30949 - DNA, 327 bp, Glycine max
  Peptide Sequence Number=SeqID_147727
atgaccataatttgtccctgcgtgccatcagacttgatcatctccggatggcgaaaaggtgtgcggatgaccataatttgtctccgcatgtcatcgggcttgccgcctctggatgacaaaaaggtgcagaatgaccataatttgtctctgtgtgccatcagactcgatcgtctccggatggcaaaaaggtgtggaatgaccataatttgtctcttcatgtcatcgggctcgccgcctctggatgataaaaggcatagaatgaccataatttgtctctgcgtgccatcggactcgatcgtctccggatggcgaaaaggtgcggaatga

SEQ ID NO: 30950 - DNA, 174 bp, Glycine max
  Peptide Sequence Number=SeqID_147728
atgtctcattctcaaggatttttcaaaggaagtttggcagcaagcaatggcagctcgtggtggccaccggtggtcgtgagttgtggagaaggaagtgttaggatctcacttagcgagcttgtctcactaagcggaagtctacttttcgcgcttagcgcgagtattcgcacttag

SEQ ID NO: 30951 - DNA, 369 bp, Glycine max
  Peptide Sequence Number=SeqID_147729
atgttctccaacagtttcaagccacaccaactcactctgaatagttttgaaaagggtggagatggaggtggcccttcagaatgtgacaaccagtaccattctgatgacacaccggtaatcgcactttccactggatggttcaaaaataggagtagatgccttcacaacatcaccatcagtgcaaatggaaaaagggtggtggccatggtggttgatgagtgtgactctaccataggatgtgatgaagatcatgattatcaacccccttgttccaacaacattgttgatgcctccaaggctgtgtggggagccttaggtgtgcctcacaatcagtggggtggattagaaattacatggtctgatgcataa

SEQ ID NO: 30952 - DNA, 201 bp, Glycine max
  Peptide Sequence Number=SeqID_147730
atggagaagcaggaatgcatctccacacagttgcacgtgaaaactcttgagattaaggagacgaacatcacaatcacagggaataaggagatccgagaggcccttgagcttcaaggtgacaattgtggtgcaggtgaacaagttgacgcagaaaagcatgcttgtacggttcacatgttcaacttttctggctacgactga

SEQ ID NO: 30953 - DNA, 1242 bp, Glycine max
  Peptide Sequence Number=SeqID_147731
atgtaccaaaaacccagaactcaactcaaacccacatctctctcttctctcttcaccccaaaatgccttctcaatcagaaactccttctcctcccatcctggaagcccaacaaaacctacaagcccctcaccatcttggcctccttccctcccgggcccacctccggcccggcccaaaccctaatctcgctcctccgctccatcccggactgggccgacgccgtgcaggagcgcggcatgcagaagaagcgcgccctctacacccaccagaactggcgcgaccaccgcagctccctccgccacctccgccacgtcttctccagcctctcctcccgcgtcatcctctccctcgtccctcccgttctcttcttcaccgccttcgccgccaccatcgccgcctacaacgaggccctcctcctccacctcctcccggacttcctccccctcctccgcgcctcctccctcccctaccagctcaccgccccggccctcgccctcctcctcgtcttccgcaccgaggcctcctactcccgcttcgtcgaggggaaaaaggcctggaccatcgtcatcgccggaacccacgatttcgccagacaagttgccgccgtcgtcgtcgacgacgacggcggcaacttcgccatcaagcacgcgctcttacactacatcattgccttccccattgcgcttaagtgccacgtgctgtatggttcggatgttaggagtgatcttcagcatttgctagaagtggatgatctggcggtggtcatgaattcgaagcaccggcctcgctgcattattgagtttatatcgcagagcatccgtttactgaaattggaggagtctagaagaaatgccctggaatcaaagatgacttgtttccatgaaggtattggcatatgtgaccaacttatgggtattcccattccattggcatatactcggttgacctctaggtttcttgtcttgtggcatttgacactccctatcatactttgggatgattgccattggattgtggttcctgctacctttattagcgccgcctctttgttttgcattgaagaagttggagttctcatagaggagccgtttgcaacacttgcacttgatgatctctgccaaaaggcacagaaagatatccgagaagcaattgctaccggaaatttaattcatgcacgccttgttgcaaagcaaaatagccactctgaagagcattcaccgaatggctggcctaactcctag

SEQ ID NO: 30954 - DNA, 1629 bp, Glycine max
  Peptide Sequence Number=SeqID_147732
atgggtattcagtgctccagactcatcccgtgctgtgtggattcacaagttaaggcctctgttattgaaactccagatgctgaaattgaggatagtagtgaggtcagtaactggcctacatttcgtgaatatacacttgagcaactcaagaatgctacatctggttttgctgttgagaacattgtatctgaacatggagagaaggctccaaatgttgtttataaaggaaagctggagaatcaaatgaggattgctgttaagcggtttaataggaatgcttggccagatgctcggcagtttttgactagtgccaatgaaccatctgtggtaaataaaccacatattggtaacatgcaagtatgcctaaagcttaaaattgtgtctgtacatactttctttcaatgggctgctaataatctaagatttttaggtttcattgtttctgtgaagctaatggaggaagcaagatcagttggtcagcttcgtaaccaaaggttggcaaatttgcttggttgttgctgtgaaggagaggagaggttgcttgtggcagaatatatgcccaatgaaacacttgcaaagcacctttttcattgggaaacacaacccatgaaatgggcaatgcgactaagagttgttctacatcttgcacaagctctagaatactgcacaagcaaagggcgtgctctctatcatgacctcaatgcatatagagttctttttgatgaggatggtaatcctaggctttcaagttttggtcttatgaaaaatagcagggatgggaaaagttatagcacaaatttggcatttacccctccagagtatcttagaactgggagagtgacaccagaaagtgtaatatatagctttggaacccttttgcttgaccttctcagtgggaagcatatccccccaagtcatgcccttgatgtgattcgtggaagaaatcttcagatgctgacagattcttgtttggaaggacaattttcagatgacgatggaactgagttagtacgcttggcatctagatgtttacagtatgaacctagagaacggcctaatccaaaatcattggtagttgctttggctcctcttcagaaggaaacagaggttccttcacatgtcttgatgggcatccagcatagtactacttttgcttcattatctccacttggtgaagcatgctcaagaaaagacttgactgccatacaagaagttctggaaagtattggctataaagatgacgaaggagtggcaaatgagttatcatttcacatgtggactgatcaaatgcaggacacattaaattgcaagaaaaagggagatgttgctttccggcagaaagattttagactggcaattgagtgctactcgcagttcatagatgctggaacaatggtttctccaacagtctatgcacggcgcagtttgtgttatctcataagtgacatgcctcaggaatctctgaacgatgcaatacaggcacaaatcgtttccccggtatggcacatagcatcttatcttcaatctgttgccctcacaggacttgggatggagaatgaagctcaggcagcactaaaagagggcacaacaatggaatccaagcggaatgcaactcccaagcaaaaatga

SEQ ID NO: 30955 - DNA, 138 bp, Glycine max
  Peptide Sequence Number=SeqID_147733
atggctctcaacccaatgctctcgaccctgcatagcagcttgggttggattgaccttgggaagtgggaacaaacattcctgagagacttggtagccactttagttatagctcttgggcaattttggatccattggtag

SEQ ID NO: 30956 - DNA, 1542 bp, Glycine max
  Peptide Sequence Number=SeqID_147734
agtagctctttccacaagaagatttcacgtgcaacaaaacgcagacctgccgtgagcgacaacactatgcaagcacagtgtccgtcactcccagattgcactcttcaagtgcccagattctcaatcagtgccactcctccaaattttgcatcttttctgagcccctccaagtgtgctggttccaatggagaaaatgatgacgatgatgggttttacatcagaagatgtgttgagcttgcaagaaaggctgttgggttcaccagccccaatccattggtgggctgtgttattgtaaaggatggcaaagttgttggtcaaggcttccaccctaaagcaggccaacctcatgccgagactgtccccaattgtgatttaggccgcaacatcaaggtttttgttgggagatgggattgtcaggtgtttgctctgagagatgctggtgacttggcgcaaagtgcgacggcttatgtcagcttggagccttgtaatcattttggcaggactccaccttgcactgaagctctaattaaagccaaagtgaaaaaggttgttgttgggatggtggatccaaatcccatagttgccttcaaaggggtggaaagattgagagatgctggaattgaagttgttgtgggtgtagaggaagagctctgcaagagcctcaatgagccctatattcatcgcatgttgaccggaaagcctttccttactttgcgatattctctttctgtcaatggaaactttatggacttacttggggatggagttacagactgtggtggatactactcaaggttattacaagaatatgatgcagtggtaatctcttcttccttattcagtgaaaatttgtcagtgcctgcatctcaagaacctggagccaaccaaccaattcggattatattacataaagatcctagttcttcaaatcaaattccactagccatcaatggcgttactcacaaagtgataatttttacagacaataaaacagtaacagctcctgaagtggctcaacaaggaattgaaactgtagctctggatcaaataaatctggatgtgatcttggattattgtaatcgtcaaggattatgcagtgttctgttagatattagggggagttttggtgagtttgaagatcttgtcaaggagggtatcaagaagaattatattaacaaatttgtcacagaaattttgccagtttggaacggacatactgagccagatcctctacacacattgaagagcttagagcaaggagcagaagtgtttttggtaaattcacctgccttaattggtttcttcttcaaccttgctcttaactggcctgatgctcggcagtttttggtaaattcacctgccccaattggaagtgctgaacgatgcgatgcaggcacaagtcgttccccggtatggcacatagcatcttatcttctatctgttgccctcacaggacttgggatggagaatgaagcccaagccgcacttaaagacagcacaacactggaatccaagcggaatgcaactcccaagcaaaaatga

SEQ ID NO: 30957 - DNA, 342 bp, Glycine max
  Peptide Sequence Number=SeqID_147735
atggagatagaggagatgcaacaagggttgctaaggctttcaagaaatcatcaccaaggatatgtaaatactggatcaacaacaattgtgtacatggtgaacaatgccttaacgaaacttcaagaacataagaaggttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgttcaaggagtagtacatgcaaactga

SEQ ID NO: 30958 - DNA, 183 bp, Glycine max
  Peptide Sequence Number=SeqID_147736
atggaacttagtaatggaaagggcccatcaagggtgaatcttggttgtgtcgaggcttaccaaggacgggccttggattttgtaaacccttatggatcagcaagcgcgaaggttgggtttgatgagtcttgcgtgcagtgcaagtattgtgctcttacatacacgcctcttacaaagtggcag

SEQ ID NO: 30959 - DNA, 318 bp, Glycine max
  Peptide Sequence Number=SeqID_147737
caatttggaatcaatgagaaacctgaagcctatgctgcaaatatttataatagaccccctcagcagcaaaaccaacaacagcagaataattatgatctttcaagcaacagatacaatccaggttggaggaatcatccaaatctgagatggtcaaatcctccacaacaacaacaacaacaacaacagcctgcccctcccttccgtaatgctgctggtccaagcaggccatatgttcctcctccaatgcaacaacaacaacaaagacaacaagcaactgaggccccttctcaaccttccttagaggagttagtgaggtaa

SEQ ID NO: 30960 - DNA, 186 bp, Glycine max
  Peptide Sequence Number=SeqID_147738
cgtctttttgctaatggagatgacgctaaagaccttacatggcatacaaatggcaaaaactgcgatggaatgcgaaaatacatgatgttgtacatgatgatatcaagcccaagacagccaggaaatgacattgatgtttatctaagttcgttgattgaagacctgaaaaagttgtgggacaaggag

SEQ ID NO: 30961 - DNA, 825 bp, Glycine max
  Peptide Sequence Number=SeqID_147739
gagggctgcacgccctggcctggagaggcttggaggtcatcgcctttagagggcttcacacccttgccttcagaggactacacgtcctcgccttcagagggctacacgtcctcgccttcagaggactacacgtcatcgccttcagaggactacacgtcctcgccttcagagggctgcacgccctcgccttcagaggactactcgacttcagaggactacatgtccttgcctttagaggatagcacgtccttgccttcagaggactgcatgtcctcatctttagagggccacacgccttcaccgtcagaggactacacgtcctcgccatcaagggactacacgtcctcgcttcacaggactacatgtccttgccttcagaggacaacacatccttgtcttcagaggattacgcgtcctcaccttgagtgggcagcacgccctggccttgagagggctgcaagtgcacgccttcagagggctccacgcactcgccttcagaggaatacacgtcctcgccttcagagggctacacgccctcaccatcagaggacttcccgtcctcgccttcagaaggctgcatgccctcaccttcagaggactacacgtcctcgccttcagagaactacacgtcctcaccttcataggactacatggctacacaccctcaccttccgaggactacaagtcctcaccttcagagggcttcaaaccctcgccttcagaggacaacacgtcctcgttttcagagggttgcacgccctcgccttcagaggactacacgtcctcgccttcacaggacttcatgtccttaccttcagaggatag

SEQ ID NO: 30962 - DNA, 168 bp, Glycine max
  Peptide Sequence Number=SeqID_147740
atggagaatctcttaatggatttgcaaatcgaagttgtggtcattgggcaggatgttgctgagcagcaacatcatccatatctgggtcagggtggtcatgctggtgggcatgatccttacctgtctccctacagcggtccgggtgaaatcctaccccggtatgcataa

SEQ ID NO: 30963 - DNA, 246 bp, Glycine max
  Peptide Sequence Number=SeqID_147741
cctgctattatgattgatgctagtagcaatgaagagaaatcctattataaagttttgaaaaaatctaacagactcaacctaatgttcatgagaatgactattgcagacagtattaacacaactctccttaagagcgataatgctaaagtgtttatggggttagtggaagagcgctctcaaacaactgataagtctcttgctgggacattaatgagttcagtaaccaccatgaagtttatggttcac

SEQ ID NO: 30964 - DNA, 168 bp, Glycine max
  Peptide Sequence Number=SeqID_147742
atgcaagattcaaagagggatctgtacataggagcctacttgaatgggccaaacaactacctcaaaggaataattaccagtgctttgaaagcacatgacgatactccacaaagcaagtccaaggctactgctaggtggattgttgttaaaacagaaaggaagcactaa

SEQ ID NO: 30965 - DNA, 300 bp, Glycine max
  Peptide Sequence Number=SeqID_147743
atgacccaagagctggtagcccgcggagacaccttacggttatccgcacctcgtcattcagtgaccccaagtgtgattgatgagcagaggccaatgtggtcatctgtgcccattccggagatgtcggcatcttctggtggagactttttcaagtctcacaagatacgtaggagcaagagccttgcttttgtcgaccaccccacaatctctgtcatactgactctgaggtcatgtgacacgcagagacaaattatggtcattctgtacccttttgtcatccagaggcagcgggccagatga

SEQ ID NO: 30966 - DNA, 210 bp, Glycine max
  Peptide Sequence Number=SeqID_147744
atggatatctgcgaagatactgacattcctgtaatattgggaaggccattcatgttgactgcaagctgcatagttgatatgggaaggaggaagttggagttgggttttgaagatcagaaaattgattttgatttatttgttgaagacaagcctgctccagaacaaaatgtttgcttacaagtaatggaaggacgtcaagaggttctgacg

SEQ ID NO: 30967 - DNA, 189 bp, Glycine max
  Peptide Sequence Number=SeqID_147745
atggttacgcgatccgtgaaattccgtaatgtgacggaaaccaaaagaaagtattgttacgcaatcccaatcagacccacttgggccttccagattcttcctccagaaggcggttgcttttggaggaagcaacctggctcgcctgggcgagctgggtggcatgctcctcctctattttgctataaatag

SEQ ID NO: 30968 - DNA, 237 bp, Glycine max
  Peptide Sequence Number=SeqID_147746
atgggacaccataggtttgtcatactttttggtaggaataatcaatatgaaaatacagaaaaagtgatcaaggggttccccatgaaccctaagagaataaagttcatttctgagtggcccactccaccaagtgttgagggaaggagcccagagtatgaagaacctcgggatttgaggtcaactcctttccaaggtggagggaatgatgcaatcctaccccgcaagggcattgggtag

SEQ ID NO: 30969 - DNA, 226 bp, Glycine max
  Peptide Sequence Number=SeqID_147747
atgccaatctccccctgcaaaagtatcagttggtctgtgttgtcccgacatggccccttaggggccccggaaaattccaccggggccccgggttttccagctcgggttaggggcctttatcagtcctccggggtgttggtacccccccccccccccccgacaaggtcacatcatcatagggattgtgcccgcaagacacctagtggacccgaagaaggccaacagg

SEQ ID NO: 30970 - DNA, 279 bp, Glycine max
  Peptide Sequence Number=SeqID_147748
atgggggggccgcccatacttcccaaatctttgcctgccatttgctctttcatggccttcatgtcggccttcatctgctcttgcaccttctctacttcacccattattctagctctagcacaggaaagaatgcaatgggcaatgcaaccaatgaaaagcatggatgacatggggttgaatcaatttagatttttcaacatggttcatgacatcttggtcaaggtgaaactggaagtaacaaggacatcaacagtcctaaatgtgtttggcagtaaatga

SEQ ID NO: 30971 - DNA, 288 bp, Glycine max
  Peptide Sequence Number=SeqID_147749
atggtagagatgatggggagagttaacctagggttaaaagtgagaatggtagtgatgacttgtaggatccaatttgagcaaaattggatgagggcaagagggatttcgaaaatctgccctattatgcagaaaattgctgttgaattgtgcaacagaatttttgttcttgtgcagaaaatgcttgtgcattgttggttatgggaaaggtggtacatattgggttctgggcattttctagcagatcccaacggtcaaaatgtagacttatgtactagggacctccagtaa

SEQ ID NO: 30972 - DNA, 197 bp, Glycine max
  Peptide Sequence Number=SeqID_147750
gtatacacatggctcaggaggaggatgcttctacagaccagatcccagagccatccccagtacccatacctgatgatgccacaccatctgcaccagcacctgagttagagcagcctatctctcaggattcaccagttgctcaggtgttggaccttaatgagcatgcacaggagcaaccacaggagcaagacatttaa

SEQ ID NO: 30973 - DNA, 228 bp, Glycine max
  Peptide Sequence Number=SeqID_147751
atgagagtcgtcatcacggaaagggcaggacggacgaaatcagtgtcttatctttgctttcctcttatctctgatgagagatacttgacaccctttgttgcacaatatgtgaagtcccgagacgtgccgaaaatcaaaagggagcaggcttacgcgatccgtgaaaattctgtaatgttggagcaacctagcttgcctggccaagctgagctcgcctgggcgagctag

SEQ ID NO: 30974 - DNA, 212 bp, Glycine max
  Peptide Sequence Number=SeqID_147752
gtggttttgttcgtgctcatgcacttagcgcacttctgaaccgcttagcgcgcattagtgaatttcggcttagcgcggcttttctcgctcagcagatagaccgaagcggtgcgcttagcgggatggccctttgctcggtgaacaaacacagctcatccttcttccagattcttcctcgcgctaagccggggattgttgcgctcagcggatag

SEQ ID NO: 30975 - DNA, 717 bp, Glycine max
  Peptide Sequence Number=SeqID_147753
atggaacggccgatcttgccgaagggcttgcccgaggacattgaagacaagaaggccgttgcccaggcatggttccagcatctgcgcgacaccatcgtcgcctccttcgaaaccctggaaaacgaactgaccggccccttgtccgatcaggaaccgggccgtttcgtccagaaagactggctgcgtgacaatggtgaaggcggcggcggcaagatgtctatgatggaagggcgcgtcttcgaaaaggttggcgtgcacacctccaccgtctacggcgaattttcaccggaattccgcaatcagataccgggcgcggaagaagacccgcgcttctgggcatcgggactgtcgctcatcgcccatccggtcaatcccaatgtgccggctgtgcacatgaacacccgcatggtcgtcaccaccagccactggttcggcggcggcgcggacctgacgccggtgcttggccgcaggcggacgcaacaggacgccgatacccagctgttccaccgcgccttcgagatcacctgcaaccgccatcccgtggcggactatccacgatacaagacgtggtgcgacgagtatttctacctgaagcaccgcgacgagccgcgcggcaccggcggcatctttttcgactggctgcatccgcaagagcaaaatggcggctgggacgccaatttcgccttcgtgcaggatgtcggccgggccttcaatctg

SEQ ID NO: 30976 - DNA, 255 bp, Glycine max
  Peptide Sequence Number=SeqID_147754
atgccgcctctagcaggtgtttgcgccgcgcacaaattcgactcgccaagtcagcgtgtcgacactatctttaaagacgtaggtgccagagggagcgcgacagcgccggcggcgaacaaaagcgtgagggcatgttcgtgcggcaaacgttttgtctgggacgcgaagaagcccgcgccaaggcccgagaatggttcgacagctttcccaaggccgcttactggactgaagtggaaagctggcggcagctggaag

SEQ ID NO: 30977 - DNA, 255 bp, Glycine max
  Peptide Sequence Number=SeqID_147755
tgcctagcgctgttcgcctatcctccaccctcaaatcttattcggagccccatgaattgattttcattcatgcatcctccaccatcgagtctggagccccgcaaattgattgccaaaagcatgttcgcctatcctccaccctcaaatcttatccggagccccatgaattgattgttattcatgcatcctccaccatcgagtctggagccctgcgaattgattgcctagcgttgttcatgcatcctccaccatcga

SEQ ID NO: 30978 - DNA, 726 bp, Glycine max
  Peptide Sequence Number=SeqID_147756
atggaaagagtagcaaaagtggtcaagatcttggcacaagagttagaccgagtgaagcaaaacaggaatggggtggtagggataccaaggcagtgcttagaggaaagggccaaagctttggcggatcaaggaaagtggacttcattcgttgatattctagcactattggtgttcaagatcgtactctttccaaatgtggacgggctagtagatttagcagcaatcgacgcttttcttgcttatcactatagcaaggaaagcccagacattgctattttggccgatgcctatgacatattcaacctgagatgcgaaaagagcaatgcgagaattgtctgttgtacacccgctctttatgtatggttggtctcccacgttttttgtcatcagggtagacatgtctgtcccttacaaggttatcacatgtgtgtcgagaaagaaaaatcaaattgggagagactcttggcaagtatggtaggagcgtccgttagttggttcccccgatggaaagagggaggggctggagttttgtgctcatatgaaggattcccaaacatccctttgatgggaacaaggggttatattaattataatcccgtactggccataagacaactaggctaccctatgagaggggcatcgtcagaggagatcatcgtgccttttgtcgcacagggtttcagtgaaggcaatgcaaaaatgcttcagagaatccaaaaagcatga

SEQ ID NO: 30979 - DNA, 495 bp, Glycine max
  Peptide Sequence Number=SeqID_147757
atggcagaggtcaccacagaggccattgcctccctcgcccagtattatgaccagccggaggaagttgaagcaccggaggaagacgaagaggtgcaggcccttagggtagaactcgagaaagcccaaacagtcaaagaaaggttcaaatcagtagctcttaagatccgaaaggagaatgccgtagggaagaacatggccggaacaaattctgaggggctctgtggggcagatgagctgaaggtttgcctaaggtccaagagaagcttgtctcagcatttatgcgagacagagaccaacatgttagccatcaacagcaagtaccaagaagaattaaatccagccatggtccacgagcacaaagtggcggacgagtatgccagagtgtacgtggaaaaggaggctaggggaagggtcatcgactcgttacatcaagaggcaacaatatggatggaccgctttgctctaactttgaacgggagtcgagaacttccttga

SEQ ID NO: 30980 - DNA, 140 bp, Glycine max
  Peptide Sequence Number=SeqID_147758
agccctccccacctgagccatttatttttgaggctgatctagagccatctcctcaacctgagccagagccatctgcacagtgccagaccttgcctatttctcaggatccaccatctgcacccagcattggacctgaatga

SEQ ID NO: 30981 - DNA, 255 bp, Glycine max
  Peptide Sequence Number=SeqID_147759
atggctgccagtgaccacacaattttgcataatagagttcatattcctaccaagaagagtttattggagctttcatcacaagatgccttgttggccctaaataagttgttgtccaagaaacttgaagctttaaccgaaacactaagttgcacactttgtggtggagctcatgggccaggcttgtgtattcccactgaagaaacatctcatgaagttaattacatgggaaaccagcctagacaaactttaatgtag

SEQ ID NO: 30982 - DNA, 306 bp, Glycine max
  Peptide Sequence Number=SeqID_147760
atgggccccgacgggtgcagagaaacgcgaggaattggaaccagagaggcggcacacaaaccgaggcaagatttcagaatccaaaaggtatgggtggacttcttctcacttgaaattcgtgggtgttgggtttttgggagctatgatggaaaactggtagagatgatggggagagttaacttagggttaaatgtgagaatggtagtgttgaaagcttgggcagagcaaatgagaccttggggacgtcaggtgggatgctatttcccaaaaccaagcttgactaatcccgacccaaccagggcatag

SEQ ID NO: 30983 - DNA, 162 bp, Glycine max
  Peptide Sequence Number=SeqID_147761
atggatacgagcttgaagataggagaagatgagtggagggagaaagagaaaaggagcacgaaattgtatgcctcaaatgaggggatgaacgaaaatgcaaaaaacgaaagcaaaaatgcacaaatggaggcttacagctgctggaaacgagggctcccgtaa

SEQ ID NO: 30984 - DNA, 291 bp, Glycine max
  Peptide Sequence Number=SeqID_147762
atgttggcaagcgtatggcgggtaaagcccgaagacgtcggaaggctcgcggagctacaggagcgggtgcgccgttcccgcgctcagggtccacgtatcagaggcagcaccgagatcaagatcgtgaaagcctgcttcaaaggcacgtttcccgctggcccgatctattcctcgatctatatgaaaccggcggaaaacgaagactatattcccacatcgcttgatgcggatctggtcaagctgttcggggcaaccgcggtcaagtcgctgatcacaccttgtgaaggctga

SEQ ID NO: 30985 - DNA, 285 bp, Glycine max
  Peptide Sequence Number=SeqID_147763
atgggtccgggctccgacgcaggaaaaccgcttttccgcaagaacacgctggacgagatgaccgtgggtcggaccgaaaagcccgtgaggggcgcggtgcccgataagcccgcgaccgaacccggcaagaggttctccccgctgctggaaggccagcccgaacgcgccgcagacgatctgcggccgctggtccgtggtaagatcggcgccggttcctatgaagatgccggagagcagaagcgcaaaagcaggaccaagggcaagactggccgtccgggccgctga

SEQ ID NO: 30986 - DNA, 855 bp, Glycine max
  Peptide Sequence Number=SeqID_147764
atgcgggcgccgttatcaccacgatgcgccatagcccgaccgagtcgggtgtgctggcgaaatccgcctcaggcgcgctggaactcatcccctatattcagatcaccaatctcgccgatgcgctgggtgaactgcacaagctcggcttcttctcggtcggcctcgattcggaggggcccgccccgattgaacggaccttcagcggcgaaaaaatcgcactggtgctgggcgccgaaggcaagggcctgcgccagaagacccgcgagaccgtctcggcgctcgcccgtctcgatatgccgggagcgatcaaatcgctcaacgtgtcgaacgcggcggccatcgccctttacgcaacgcagcaatttctgggcaaagcgtcgtcctgacgcttgcccttccttgcgaaatcacaaagcgcatcgcatgctgcgcctttgtcattcgcacggagcacatctcaacatgaccgaccagaccatcaaaccgaccggcgagctgacgctcagaacgctcgccatgccggccgacgccaatccggccggcgatattttcgggggctgggtcatgtcacagatggacttggcgagcggcattcgtgcggcagaacgctctcgctgtcgcgtggtcacggcggcagtcaaggaaatggcctttgaactgccggtgaagatcggcgacacgctgtccatctataccgatattgcccgcgtcggccgcacctccatcacgctgacggtagaggcctgggcgcagcggtcgcgttacgacaagctggaaaaggtaaccgccggcaccttcatcatggtggcgatggacgaaaacgggcaaccgacgcccattcctccggcggagtag

SEQ ID NO: 30987 - DNA, 303 bp, Glycine max
  Peptide Sequence Number=SeqID_147765
atggcgaggacgtgtagtcctctaaaggcgaggacgtgtagtcctctgaaggtgagggcgtgtaggcctacaaaggtgaaggtacatgaccctttgacggtgaggacgtgtagtcctctgaagttgaagattgactgtccttttgaaagaggtgataattcatgcaacctcatcctatctttttgcaaatctctctgggaactccctcagagtgttcgtttgaggtttatgcatggggcctttcattgccccagtgtagggcttagaggtaccaattgttgtcttgttttcacaacctcgtag

SEQ ID NO: 30988 - DNA, 252 bp, Glycine max
  Peptide Sequence Number=SeqID_147766
atgcagccatgttgcaagatcgagaattcaatacttgagtcgaccgatcctacagagcttgaatctcaatttgtgtttgttaccactgatcatgatcgttcaatgcttgactcaagtgagcctatagagcttgaatctattccattgacaccaactaagcgcgtatcttctgatgagttcgatgatgagccaaaaaactttcagatttcacctgccgaagtttcctccaacaaattagccaagcattcttag

SEQ ID NO: 30989 - DNA, 297 bp, Glycine max
  Peptide Sequence Number=SeqID_147767
atgtggtttgaaatctcgaggcattacaattatattaagtgtaatattgaggccatgcaaaatgttgagaacgaagctaatgcggttatcatacgcatgcgggtgaatagtgtgcatgaaaatgtcattggttcacgtgcattagaatctcgatgcgtgaaagtaccacaattgttcttaacgtgctttggaatctcgaggccttacaacgagacaaattataaatgtgctttggaatttcgaggcattacagttaccttaagtgtatttgtgcttgcaaaaatgaacacagtttaa

SEQ ID NO: 30990 - DNA, 368 bp, Glycine max
  Peptide Sequence Number=SeqID_147768
atgttagtctttgggcgtcaacaggctcgtttgcccctggttaacgaaaggcttgtttgcccctggttgatgaaaggtgcagataaccataaggtattccctgcctgtcacctgcctccatgggtcaggatgacaaaaggtgcagaagacgatgttagtctccgcgcgtcaacaggctcgtctgcccctgataaccacttggggtatttccgcctgccacctgacttgacggaagttatctttgtacggataaccgcttggggtatctccatacgtcacctgacttcgcgagtcaggatgacagaaagcgcaaaagacgacgtaaatctccgcatgtcaacgggctcgttggccgcgattgacaaagg

SEQ ID NO: 30991 - DNA, 279 bp, Glycine max
  Peptide Sequence Number=SeqID_147769
atggcaagagggactcttcccactgcaaaaggcaagggttgtgattgttgcaagtttggtggaagtgttgattttgatccgcccgctaagccaattctttgccttactgagccatgcgttgagcgcaaaagttcatggctaagcgcgtacaagattccggaagcagatgagttgtcaatgatgcaatcagtgggaatcaattcactaagcgcaccgcttgaacctccatgtcaagcgagcattactggcgctaagccaaatgtcacttacacgcactaa

SEQ ID NO: 30992 - DNA, 330 bp, Glycine max
  Peptide Sequence Number=SeqID_147770
atggagtcaagtgacgtgcgggggcaccttatggttatcagcacttttcgtcaaccaggggcgaacgagcctgttgacacgcagagactaacatcgtcttctacaccttttgtcatcctgacccatggagtcaggtggcaggcggagataccttgtggtcatcctcacctttcgtcaaccgaagcgaatgaatccgacagtatcaggatgatgttgagacattcaagcccgacgacgcatgagattcttctttgctgggcgcgggctatcaagttcgatggcatggggaattgtcatggttgcccaactttatcgctttcaagacactga

SEQ ID NO: 30993 - DNA, 345 bp, Glycine max
  Peptide Sequence Number=SeqID_147771
atgacggtgtacacaccaccgacgttgacatactaccaaacaacgtcggtggtgagcccgccaccgatgttgacaggaaacaaaacaacgacgggtcttgtgaacccgacgttgaaatggaccaaaacaacgacggtggtgcgcccgccaccgatgttgacaggaaacaaaacaacgacgggtcttgcgaacccgacgttgaaatggaccaaaacaacgacgggttgtctaatatccactgacgttgtattcttgcattacaaagacgggtcctatgatgaccgatgtcgttgttgtcgacatacaacgacatctggaacaaagacggtgtggggcccgtcgtag

SEQ ID NO: 30994 - DNA, 405 bp, Glycine max
  Peptide Sequence Number=SeqID_147772
atggagttgccaactgtcgcaacctacccttcggcgggagggcaaggcgagactcaaaggagcgtcttccaaaaaggaaaacgcgtgggagtcgccactaacatttatttgaggaaaacgttagaaaaaccaaaaagaggtttgcgtattttgaaaataagggttcgggagttgtttacgcatgggaaatgtattagcatcccacatgcccgtcacaagggacgacagcctttaatcgagtgtgcaaaacatgtcttcgacaagggtgttgcccttgctcctacgtatcctcagataacttgcggcactaacaatcggttaaaacttactttacaagaagaaaatggattactgatgatagaagaaggagatgaagatgcacaagacaagaaagaggacccctaa

SEQ ID NO: 30995 - DNA, 246 bp, Glycine max
  Peptide Sequence Number=SeqID_147773
atggcacagaaaatcatttggttaacctttcttgtcttcctaattttacaacacaactttggcacaatggaagcatcaagaaagctcatccatactcaccctccaccagctatacctaggagtccacaagctcctgcactttggtacacccccaatgatgaggatggtggtcatgatgcttttcgcccaacgtgtcgtggtcatagccctggtgcggggcatgataacccacccactaaaccatag

SEQ ID NO: 30996 - DNA, 432 bp, Glycine max
  Peptide Sequence Number=SeqID_147774
atgacgacgatgaagaacaagtacgaagaatgtagcaaatatgcatggggagctgctgtacttggttttctatacagagagatgtgcagtgccactgattataaaactaaatcaatcggaggtaggtgcatcttactacaattgtgggcatgggaacgatgtccaaccttggctccaaagaggactccttcccaaatagaaaatataccactagggcacaggtggctgcgacgtggaaaccaacatatcggcaatgatgatgtgaaagtttttcgtcgcaagttggatattatgaaacgtcatgagtttgtgtgggagccttacccatcaaccgttatatcattgttgcctcccgtttgtttagtcggaactctcgcgtggcgaaagacaaagatgtttgttgacccagaaaatgcaaagatggctacattg

SEQ ID NO: 30997 - DNA, 541 bp, Glycine max
  Peptide Sequence Number=SeqID_147775
tgtgaatgaacaacatgttgattgttcggatgggttcaatacttctcaggtgtttgctacccgagatgatattttgcaatgtgcccaatcagttgctcatgaaaacggatttgtgacggtgattatgaagtcagacacaaacactggtattagaggaaagacttcatttgtgttaattggttgtaagaggagtggtcaatataggtctaggaagaaagattttgttagaagagatactgggagtaggaaatgtgggtgtcccttcaagcttcatggaaaatcagtggttggagggcaattgactatggatgaaaagacaattattgttaatatgacaaagtcaatggtcaaaccaagaaacattctgctaacgttgaaggagcacaatgtcaatagttgtacaacaatcaaacaaatatacaatgcaagaagtgcatattgttcttccattagaggaagtgatactgaaatgcaacatctaatgaagcttctcgaacgggatcaatatattcattggcatagattaaaggatgaagatgtg

SEQ ID NO: 30998 - DNA, 405 bp, Glycine max
  Peptide Sequence Number=SeqID_147776
atgcctataggttggacctcccagaagagtggagctgatattgaggaggaggaactaacagatttgaggtcaaatccttttcaaggggaaggggatgatacaatcctccctaggaagggaccagtcactagagccatgagcaaaaggctccaagaggattgggctagagttgttgaagaaggccctagggttctcatgaacctcagggaatcaaccaaaaaacacaaagggggtgtattttgtgaaaaaagggttgcaaatagcaacaaggcccacttgagccttcctgagggttccaaaagaaggcagtgccttctggtggaagcaatcgtgctcgcctgggcgagctgggcggcaaccacctccctcttttctcctataaataggggaaagagggcagagtaa

SEQ ID NO: 30999 - DNA, 496 bp, Glycine max
  Peptide Sequence Number=SeqID_147777
gcttgcagagttgggcattgaggcccggtcaggttttaaatcccatggtgaagggagtacacagctttcaggttctatccaattatcatcaatagaatcattctttggcaaggctgaggcaaagactattgctgacattaacaccatctctgaagaaattgtttgtgtcactgttggcacaattactaggattgttctggacaatcattcatggtgttatacagcttgcattcagtgccataaaaaaagtgatgcagagatggtgccctttacatgtgcatgcggcaaatacaataaggaagttgtgcttaggtataggcttgaggacggtgatgttgatttgaatgcttcaccccaagcacttgataagctgctgggttatgaacttgctttcaagataaaggtgcaacccaagttcaggaattctgttgttttgaagtgttcagatgactcgagcttaataaatgctgtgatggatatgctagctgatgctgag

SEQ ID NO: 31000 - DNA, 375 bp, Glycine max
  Peptide Sequence Number=SeqID_147778
ctggtagcacctccagactctatcccttctgttgaacgatttaatgaatgggtagcctggcctgggactcaacctccccttcacagggaagacgaaggtctcatagctcagtccctgatcagaaggaagagggtagttgaaacacaagaagccgcaaccacttctaagaaatctcttgaggccagttctgagccttcaaaaccagtggcaaatacgacttcaattcagcaggcagcagacccctccactcctgaggatcaaactacaccaatcctgtctccgaacacctctccttcagctacccctgtgcttcgcttaacagatgaggaggatgttcagacaccggatactcaggacagatcacaagatttttaa

SEQ ID NO: 31001 - DNA, 99 bp, Glycine max
  Peptide Sequence Number=SeqID_147779
atgatggtcattctgcgtcttgtatcaaccgagaggagcaagttcgacagttccgctggcaggaaggttcactggccaaaaggtgtttcgctcgaatga

SEQ ID NO: 31002 - DNA, 231 bp, Glycine max
  Peptide Sequence Number=SeqID_147780
atgaagttcttcacaatcaaccccaggtggaagatgatgaggaagaagcctgacctttttcaccaatcacaaccacatagcttgaattacgaagtagtccaatatccagtggggactctctttaaagggatgagtttcttgacaaaacaagatgtacaaaatgctttgcatcagtatcatggcatcatacatccttgcctccaagcagtgggaaataagaaagctatgtga

SEQ ID NO: 31003 - DNA, 321 bp, Glycine max
  Peptide Sequence Number=SeqID_147781
atgtatcctctacttgtaccacaaaggatgcaccctccaatgtgttgggacaaagaattctcaggcgatggtgtgtggaaggtcaaagggaaggttcctcgtcaagtgaaaagtactaccttcatgcaaacaccctgttgccatggctatagtgtcgctggacaacatcaccttgacttccaaaaccttggatgctatagtcttcttgttgaaaaactcaacatgcctccaaaaggttctgatcaattcagggtgtatggtttatggctcattaacgaaatgcttggcaccacaaaagagcaaagtctcattgagctttag

SEQ ID NO: 31004 - DNA, 288 bp, Glycine max
  Peptide Sequence Number=SeqID_147782
atggtgtgtgcagctaaaggcaataaaggaagtaaggagttggtgcttaataaaggggattgggtcttggagaggatcaacaaaaatgcttataggctagacctaccaaaggagtatggagttagaaacaccattaacattacggatttggttctttctgcaggtgtagctgattcagatgatgaggggtttacagatttgaggacaaatcctcttcaagagggaggggatgatgcaatcctcccaaggatgggacccatcaccagatcccttgctagaagactctaa

SEQ ID NO: 31005 - DNA, 1248 bp, Glycine max
  Peptide Sequence Number=SeqID_147783
atggatgaagactttaagcacaccctaatagccaagggctcaactgttgctaaacaacaaaattttagcaagactaacataaaagctatgaaggttgccttagaacaaggtctaaaagaggcttctttggtggacataaatgctatcaacgaaaggaagcataataggctagctaaagccattgctgatgaagaccaaggcctaagtgagactgatgacgaagatgaaggtcttgtacaagtagcctttcaaaagaggaaaacgagggtaaccaaggccaaccctaagattggtgataaggaatgggaagtttcctttgctgagaacaaggaagatctagcttcatcatcatcatcatcagatagtgagtccacagatgacactcctatctctcccctccaagatgctcaaaggattcctctagcattcattaacggtaatcctacacttgagacctcatactctaagtttgtactttgtgcacctgttgcaagggagatagcctttaagactctaccaacagatgcaatagttcatcttcctcctccacaatggacttgtccaatgcaacccaacattatcaagatgtctccttattactttgcacttggtactcaacaatgggttcatccatcaattgaagtatccgccacacaagcaaggaagaagcagattcacactcttaatatttatgatgctaggactttctggaatcagattgtgtggatggactctcaaaaagcctccacttctggttatgatggaagtggtaatgttgagcatcgtaacatcgttcaagtattatgtcctattaggaattaccactttgatgatgcttgcgtctacttcacaaaggttgctaacaactacttgtttattcaacatcttgtcaaacttcctactattcaatatgacaacacttataatttgaagaagatgattgaagaccagatgttagctcatgtgactcagctccatgaagctcagcaaaagaaaaaggctgaagaacaagttgttgctactatgaaagaagatgttgcctcggtccaagctaaagcatctaaggttgtggacgacaccattgtatgtggggttatcatcgattttaccaacactggcgtcatagaagaaactcttgaggcatctaatacaactataactgatgaagttgaacacaacgctctaaaacccgtgtccaatcacagtggagaagtggcaacatgggattggtaccaaatttgcctatga

SEQ ID NO: 31006 - DNA, 132 bp, Glycine max
  Peptide Sequence Number=SeqID_147784
atggctgaagtctccacggaggccattgcctcccttgcccagtattatgaccagccgttgagagatcctaggatgccctctagggggaaggaaaccatacctcttctcaggattctatccctctttagctag

SEQ ID NO: 31007 - DNA, 718 bp, Glycine max
  Peptide Sequence Number=SeqID_147785
atgggatcaagtcaaaggccttcgcttaaaaagaggttctatcaagtcaagcgacaagctttttgcaaagcttatggtaaaatctgggacctagccatgatagaagtctctacagaggccattgcctccctcgcccagtattatgaccagccattgaggtgcttcacctttggggacttccagctatcacccatgaatttccaagatagtccaaatctcggcgtaggaattagaccacaggaagcaagtcgaaaatggggtagtcagaataccgagaaaatatttggagcgatcgacgcttttcttgcctatcataaccacaaggaaagcccggttgtcgctatgctagccgacctatatgacaccttcgaccgaatatgtgaaaagagcaatacaaagattgtttgctgtacttcagctctttacgtatgggcgaattgggatcaactcttagcaagcaaagaaggagcatatgtcaactggttccctcgatggaaggaaggaagaaccggatttcttatttcatgcggaggatttccaaatgttcccttgatggggacgaggggttgcatcagctacaatcccgttcttgcaataagacaacttggctaccctatgagaggggcgccactagaggatgagctcgcgcctgacaaagagctcagagacaatgggcccattggtggctaccgtgagtggttgaaagcccacgtgcaag

SEQ ID NO: 31008 - DNA, 393 bp, Glycine max
  Peptide Sequence Number=SeqID_147786
atggtgggctacacaccttcaagctttgctgatttagttttcgccaacgaaaggattgaagtgggtctgaaaagaggcaaatttaatcatcctgcttggacgaatgagaaaactggggcaaatgaagagggtgagaatgaaggagaaacccatgttgcgactaccgttcctacatggccaagtttcccaccaacccaacaatgtcattactcaaccaataacaacccttctccttacccaccacccagttatccacaaaggccatccttaaatcaaccacaaaacccacctaccagacaaccaatgcccaaacaccacttagcgaaaaccaaaaaggaattttgtagcaaaaagcctgtaggattcaccccaaattccagtgtcatatgctaa

SEQ ID NO: 31009 - DNA, 162 bp, Glycine max
  Peptide Sequence Number=SeqID_147787
atgacaggtttatcattactgtctttgacctttggcagttggtactgtattgttggaggtatactagaagttgtatctaatccttggaggtttatactaggaaactggttttgtgactcagatctagataaccttactggaattgaccgggttcttacctag

SEQ ID NO: 31010 - DNA, 255 bp, Glycine max
  Peptide Sequence Number=SeqID_147788
atggaacgagatgagaaaagatttgaataccgtttctgctgttcttcgaaagaaaacaatgcggaagaggataaggagggtggaattggtgctatttcaatcggtgaaatcaaaagaaaattgaaaaagaagaagattgcaagttacgagagtcgatttgatgaagaaatgagtaagataggaaggtttgaaggtttgagaatggaggagcgtcgcaagggggaagaggctgtgcaggggtttctgaaaaacgtg

SEQ ID NO: 31011 - DNA, 813 bp, Glycine max
  Peptide Sequence Number=SeqID_147789
atggcagaatcatcaaagaaacgtaagggttcatccgcctccgcttcagctcagcgcatccacagcaccaattccaccctccttatcctcttccgcattgttttctttcgaagaacagcagaaacggacaacactttgatttctgaggtttttgggataaaaatggtcattgaccaatcccttttccatgacttaaaccaattgtccagtgacggtgtaccatttgaaggtacactaaatgacgattggaaatttgatttctctgcacatgatgcccgccagttggtttgcaccaaccatgcggatatgaccggacgcctccttgccggttcattggcttttgaaagccgcatccttcattatcttattgtgcggattttacttccacgatcttccaaccttgcccaggtttctaaggaagatcttgttatcatgtgggcctttcatactgggtgtcaacttgactgggcacatttagtcagatatcgcatgcataaggcattgcgattaaatgctcctttgccatatccacaccttgttactctcttttttcgccattttcaaattcctcttgattctgaaccttatgttccaatcaagagatcctttttaattggtgctgctgttattgcttctcttggttaccgcaaaaagcatgatggctcttgggtcaaaaaggctgctcaacccgctgatgatgaaggcaacctaccaactgaagatagttcctctcttcagaaaatattctcaattgtcacatcttttcatttggttcttgaatggctatcaaaggcctatatatatgtgacttga

SEQ ID NO: 31012 - DNA, 129 bp, Glycine max
  Peptide Sequence Number=SeqID_147790
atgagtgagatacgaaggtttggaggtttgggaatggaggaacgtcgcaagagaaaaggggctgcgcagggaagtctggaaaatgttatatttatagagcaggacgcgtggccatctgttctagtgtaa

SEQ ID NO: 31013 - DNA, 186 bp, Glycine max
  Peptide Sequence Number=SeqID_147791
atggggaaagggtggttacggtggcgccttctggaagatctgtttcgggttcttccggaacttccggaagaacgtgttctggaagattttcggaagaagggttcttccggaagcactttacggaagaaccccttcttccggaaagtttccggaagaactacttcttccgttgtgtatgtttactaa

SEQ ID NO: 31014 - DNA, 783 bp, Glycine max
  Peptide Sequence Number=SeqID_147792
atggatgaaatagaggaagtgaaagagtggatgaaggccgacatggaggccatgaaagagaaaatggccataatgatggaggccatgatgagtatgaagaagataatgaaggtcaatgcggctgcagttgccgttaccagcgccgttgctgaggtggacctgactcccccatctaccctcaaccaaataaatcatccaacctcggatatggtaggtcagggaggcaaagagttgggaaatacgggcggcccccattttgtgcaagttcagagcaagcatgcattcccaccatatgacttgcctcccaactatacaccactcaatgttgcacacactctcgatgaaaatgtcgacaactccgcacccatacccattgagagccaacaaccccaatttgataatgcacatgtctctcaacccatgggggagacacatgaagcaccccgagaccataatctagccgacttcaaacctcatctcgaatatgtcattgaggggaaagcaattggtagtgtacccctgccaaacactttggagggccctcaattttgcccacaaccacaacccttgcattttgcggtgggaagagtccctcttgctatggtggaaaggggaaaatttgatcatatagaggaaaggctgagggccattgaaggaggcgaagattatgcttttgctgacatggcagagttgtgcctaatgcttgccgtcgtcatccctcccaagttcaagatgccggatttcgataagtacaagggactacttgccccaagaatcacctga

SEQ ID NO: 31015 - DNA, 609 bp, Glycine max
  Peptide Sequence Number=SeqID_147793
atggtcattgaccaatcccttttccatgacttaacccaattatccagtgacggtgtaccatttgaaggtacactgaatgacaaccggaaatttgatttctctacacatgatgcccgccagttggtttgcaccaaccatgcagatataaccggacgccttcttgccggtttattggcttttgaaagccgcatccttcattatcttattgtgcggattttgcttccacgatcttccaaccttgcccaggtttctgaggaagatcttgttatcatgtgggcctttcataccgggcgtcaacttgactgggcacacttagtcagatatcgcatgcataaggcattgcgattaaatgctcctttgccatatccacaccttgtcactctcttttttcgccattttcaaattcctcttgattcagaaccttatgttccaatcaagagatcttttttaattggtgctgctgtgattgcttcttttggttaccgcaaagagcatgatggctcctgggtcaaaaagggtgctcaacccgctgatgatgaaggcaacctaccagttgaagataattcctctcttcttcgaaagcttttggacaagttcgatggtctttag

SEQ ID NO: 31016 - DNA, 249 bp, Glycine max
  Peptide Sequence Number=SeqID_147794
atggaacgagatgagaaaaggtttgagtaccgtttctgctgttcctcggaagaaaacagtttggaagaggataatgagggtggaattggtgttgtggatgcgctgattgcaattggtgaaatcaaaagaaaattgaaaaagaagaggattgcaagttacgggagtcgatttgatgaagaaatgagtaagataggaaggtttgaaggtttgggaatggagggacgtcgcaaggaggaagaggctgcgtag

SEQ ID NO: 31017 - DNA, 2174 bp, Glycine max
  Peptide Sequence Number=SeqID_147795
gccggggcgcagcaggcgggggcgaagaccgaaacgccggccgtcaatgaggcggaggtggtggccatcgccgtggcccagggccgggatccggttgccgcgctgaaggcggctcacgacaaggcggatggcgataaggcgaaagccgccgccgcgaagccgccggagaacggcccgctgggcaaactgccggatccggtgtatgtgccgctgaaggccaaagcgctggaggtgatgctggcggaccagctgagctggattaccgcctggcgcaccgagcgctttgccagcccgcaatacgccgataagtattatcagcgcaaacctttttatcagcaggcgctgaatgagcagaccagcgcgctgccgtcggcggcggcgcccgcggaaagcgaagggccgcgagaagtgccgtttatcgataaggatcgtctggatcgcgcggcgtggggctatgactttgcccataccggtatcgtggcgctgctgggccaggtgctgctggatgtgatccccaccacgcagaccaaccagcttggcggtccgctggtggcggcgcaggagtcggaatatatccagatcaagaaaagcggcgatgcccggcgggcggcgctgatgggctcgccgacgatgctggatttttacgataactacgtgcatgacacgctggctaaatataatcacgacccgctgcactcctcgttttcccacggcgcgaacggatatgaaagatctgaatacggtatcgggcgtgctggtcatgacggcatgagcggcgctgatatagccgtattaaaccacggacctgatgccatcgtttcggtgcaggttgatggctacggagggcccagggcgaatccctacggtggcggtggcggattctgctgcgtgatggtgcctgatgtctggcgcccggggctgacggcaaaaatcacctggacctccgatcctaacgcatggatagacccgaagcacatccctgatgatcatgcgagtcattaccagcgccacgggccgattaccgtgcccattgaacgctgggaaaaaggtgcggatagtccgttcctgcataccacctggacagccggggtatccggttccccagtcgccaccagactggaagcaaagagctcagaaaatacttatcaaacatatcagggaggaaattgtatgtccgataccgcagactccacgttaagtgctctgaaggcgcttattgcggccttccagaccggtgccaccccggtcgctgtcaaaacctccaccgcagaagcggccagtttaccgccgaattttcccgggccggatgataaaaagggagaaaagcctgccgataactctgtgctacagaaagccgaatacaacgagcgcggccgcctgccggcgagcagaacgcaggccgaaggcaactatgccaggcagtatctggaaggatatgtcggggaggagccgatgaggtgtacgggtcacgacacatcaatgataaagcatatccgtattttgcccggcgggctggcggtgctggccgccgtttttctctgcctgctgacggcctgtcgcgatcacagtcgcgacgggatgagcggcgctgatataaatgtctataaccacggtccagacgccattgtttctatgcaggttgacggctacggcgggccaagggcgaatccctacggcggcggcggcggcttctgctgcgtgatggtgcccaacgactggcgaccgggcctgacggcaaaaatcacctggacttccgaccctaactcctggatgaaatcgagtgagatgccggacgattatgaaactcactatcagaaacatgggccgattactgtccctatcgaacgttgggagaaggggccaggccttgcggatagtgcgttcctgcatcccgcctgggcagccgggctacccgagtccacgctgaatgccctgaaggcgcttattgccgcctttcagaccggcgccaccccggtcgcggtcaaaacctccaccgcggaagcggccagcttaccgccgaagtttcccgggccggatgataaaaacggagaaaagtctgccgataactctgtgcagcagaaagccgaatacaacgagcgcggccgcctgccggcgagcagaacgcaggccgaaggcaactacgccaggcagtatctggaaggatatgtcgggga

SEQ ID NO: 31018 - DNA, 643 bp, Glycine max
  Peptide Sequence Number=SeqID_147796
atgttgctgcaaaacgcctcgctgaccttgcaggcgccggttgaccagggatttggcattaagatccagcaaccggtgcgcgttcttcagggagtgatcacctcttttgaacggctttccaccgcaaaagaggaaacgcgctacgccttgacgttacagccgcgtctggcgctactgtcgaagagccatcagaaccggatttatcaggatatgtcggcgccgcagattgtggagcacattctcagaacccgtcaccagatgcgcggggaagattttgtctttcaactggcgcatgaatatccgcgccgtgaacaggtgatgcagtatggcgaggacgatctgacctttatctcccgcctgttgggtgaagtggggatctggtttcgctttaccgccgatacccggctgaatattgatgtggcggagttctacgatgaccagcaacactacgagatgggactgtcgttgccttcggtcgctccctccgggcagcatgacggtgggagcgaatcggtgtgggacttacagagccgacaccacgtggttgagcgttcggtgtttactcgtgactataactaccgtaacgcgccagaggatatgaatctcaacgtcaatgtcagccgtggcgatagtaccacctacg

SEQ ID NO: 31019 - DNA, 216 bp, Glycine max
  Peptide Sequence Number=SeqID_147797
atggatcaagttgatccgcatgatctacggtacaccagaatgcacacccaacacaaatgcgtacctcgtatgccaccgacgaccatcgcaacactgaacaccggtaccttcacattcatcgaacctaagcgttgccaaggaaccaaagaaaatatggcaccgaagagagaaaagcaagaagaagaatgcacaaaaatggctggtgtggttttttaa

SEQ ID NO: 31020 - DNA, 657 bp, Glycine max
  Peptide Sequence Number=SeqID_147798
atgtctgagttgtttttggacagcttaatgcttatcacatactactactccatatgtttccttttggatcccaaactcctagaatccaaaattactgaaagattgagactgctcattctttgttcaccatctaacccaacaggatctgtctaccctaaagaattacttgaagagatagctcggattgttgcaaagcaccctaggctcctggttctctccgatgaaatttatgaacacataatttatgcaccagcaactcacatgagttttgcatctttaccaggaatgtgggacagaactcttactgtgaatggattttctaaggccttttcaatgattggttggcggcttggatatattgctggtccaaaacattttgttgcagcatgtggaaagatccaaagtcaggttcttttggtagcagaacaaggaacagaaccaacatcaatttatgaaagaaaatatgaatacatacaaaatagagatgttgcaagattgaatgggcagctagtagtttcacgagcttttagagacaaaaacctcaaaatgcacttgcgatctgatcctgacattcactatactgacattaccccagatgttgagcttttgatacttgctagtgatggtctatggaagtttaatgagccttatacatga

SEQ ID NO: 31021 - DNA, 252 bp, Glycine max
  Peptide Sequence Number=SeqID_147799
atgtatgatagtattatgtctgaagaagttgatatgaatgttgaaaatgagggagatgctggcgtgaaagtagaacacgttgattgctctgatgcctttaatacttcccagaggaatgatttggcaacttgcaaaaggagtgctgaatataggcctaagaagaatgatttggcaagaacatgcactggcagtagaaaatgtggatgcccgtttaagttgcatgcaaagccagttttaggaggagaaggatga

SEQ ID NO: 31022 - DNA, 294 bp, Glycine max
  Peptide Sequence Number=SeqID_147800
atggaggaagtcattgttgttgtgtattatgatggtgatgtggtatcaatttctgagggggtattgtttgaatgtcctaatggttctaaattcattaaaattagtgaggaaatgtcatttgttgcactaaggaaagcagttatggatattgtcagaggtgatagttgtgttgagtatgactgtatgaagctaaaagacgacaataaagtaggaaagatgattttcatatttttacagtttagttctaaaggttcaatcgagttgtatgcaatggttgaccaatctttagaataa

SEQ ID NO: 31023 - DNA, 1620 bp, Glycine max
  Peptide Sequence Number=SeqID_147801
atgggtccggctcctattcaatcatttgcattgccagcaatgcttctcttctcaatgatcatcataccccagcttgcactagggggcattacccggcactaccattttgatataaaataccaaaatgtatcacgactatgccacacaaagagcgtggtcacagtgaatggccagtttcctgggccacacattgtggctagggagggtgaccgtcttcttatcaaagtgactaaccatgttcagaacaacatctccattcattggcatggcattcgacagcttcgatcaggttgggctgatggacctgcctatgtgactcagtgccccattcaaacaggccaaagttatgtctacaattacaccatttttggccagagaggcactctcttttggcatgcccacatttcatggttaagatcaactctctatggtcctatcatcattcttcccaagcaaggagctccatatccctttaccaaaccttacaaggaagttcccatcatctttggagaatggtggaatacagatcctgaggcagtcataacacaggcattgcaaacaggtggaggaccaaatgtgtctgatgcctacactattaatggtcttccaggaccattgtataactgttccgctaaagatacattcaagttaaaggtcaagccagggaagacataccttctccgtttgatcaatgctgcactcaatgacgaactcttcttcagcattgcaaatcacaccctcacagtggttgatgtagatgcaatttatgttaagccatttgacactgacactattctcattgcccctggacaaacctccaatgttcttctcaaaaccaaatctcactatcctaatgccacattcttcatgagtgctagaccatatgcgactggccagggtacttttgacaactcaactgtggctgctatccttgaatatgaagttccaccacattttgttcactcaacaacttcagtcaagaagctttcactcttcaagcccatcctccctgcccttaatgacacttctttcgcaacaaacttcgccaacaagcttcatagcttagcaagtgctcagtttcctgccaatgtaccccagaaagttgataagcactttttcttcacagtgggccttggcacaactccctgccctcaaaatcaaacttgtcaaggacccaccaatgcaacaaaatttgcagcatcagtgaacaatgtctcttttatacaaccaaccactgcacttcttcaagcccacttctttggtcaatccaatggagtttactccccttactttcctattagtccattggttccatttaactatacaggcactccaccaaacaataccatggtgagcaatgggacaaaggttgtggttcttcccttcaacacaagtgtagaactagtgatgcaggacaccagcattcttggtgctgaaagtcaccctctccatttgcatggctttaacttctttgttgttggtcaaggttttggtaactttgatccaaagaaggaccctgcaaacttgaatcctgttgatcctgttgaaaggaacacagttggtgtcccatctggtggatgggttgctatcagattccttgctgataatccagtgttatag

SEQ ID NO: 31024 - DNA, 141 bp, Glycine max
  Peptide Sequence Number=SeqID_147802
atggagggcaaggagccaacactcaatctcgaggatgagtgcgcttggagttttcgcactagggtaggtgttagagatgactgctttgagtctaggacctttccctttatatgtattgatctagctaggcctaggctttag

SEQ ID NO: 31025 - DNA, 2337 bp, Glycine max
  Peptide Sequence Number=SeqID_147803
atggctgagagacgatccaaaggactttgttatttttgtgatgaaccatatagccccaaccatgctttaactcataagaaacttgagattcatgttctggaggtgagtgatactgaggaggagattgtagatcagtttgacaacacgcaggaagatggtagtacttctttggaccctcaaatatcagttaatgccctgactgacattcctatcttaagtgtggcagtagctgatggagctcgggtaaacattacttctactgttaagcagttttcttggatacttcaaaacactggatttacctcatatatgcttcttatacccttgggttgttgtgatgtggtgttaggaattgagtgtttagttactctgggggacattacctggaactttgataggttatcgatgcagttttatgtccaaggggctaatcctattaataagaggccctacagatatgctaagcagcaaaaagatgttattgacaagttggtgcatgattctcttaagtctagtataatacaaaaaagcagcagtccttttgcaagtcctgttgtcttagttggcaagaaagatggctcttggagactctgtgttgactacagagaccttaataatcagacaattaaggacaggttccctattcctgtagtagatgatcttttggatgagttgcatgggtctaagatgttctccaaaattgatttatggttaggttataaccaagtgagaatggagaacaatgatatccacaagactgcatttaagacacatggagaccactttgagtacttagtcatgccatttggcctaaccaatgcactagccacattccaaggtctcatgaataatatttttcaaggctacctgagaaagttccttttggtgttttttgatgacatcctagtatatagcaaggatttacaacaccatctctctcatttgcatatggtattgttgactatgagaaggaattccttgtatgctaagaaatctaaatgttactttggtgtagaaagagttgagtatttaggccattttatcacaaaagatggtgtgtcatctgaccctgcaaaaatcatggctatcaagaactggccaataccaacatccttgaaacagctgaggggatttttgggacttacaaggtactatagatggtttgttcgagggtttggtgggattgcaaggcctttaaccaacatgttaaagaaaaataatttccactggtctgacgaagcaaaagcagcatttcaatccctcaaggatagtctaattcaatcaccagtatttgcattacctgacttctctaaggtgtttatggttgaggtggatgcttcaggttatggcattggtgttgtgctgatgcaaaatcaccatccaattgcttttatcagcagagtcctcaatatacaacaacaattactttccacatatgaaaaggaactattagcagtagtctttgcagtccaaaagtggaggcattatctattgaatactcactttattatcagaatagaccacagaagcctgcagtatatactgagccaaaggttgacgacatccttccaacagaaatggttggtgaaattgatggaatttgatttcacaattgaattcaaacagggaagaaaaaatttagcagctgatgccctatcccgacaggaagccgtagattgtcaaacaatcacaactctcatactggaaagcaacatgttgaacaaaatcatacgctcttggcaggctgatcctgacattcaaaaattgatccaagatttgaaaaccgatgcttcttcacataaacatcatacttggaaccataatgaactcagaaggaaagaaagattggtagttgggaaggatcttactttacggattgatttgttacaatggatacatgttggtcctactagtggccactcaggtagggaagccacattgaagaggttgaaatcagttgtatattggagaggcatgaccaaggatgtcagagtttttgtgctcagctgtgaagtttgccagaaacgtaaatatgacaaatctgcctatccgggtttgctacaacccttaccaattcctgagaggatatggcagcatatcaccatggattttattgaaggtctaccaaattccaaaagaaaacaagtgatctatgtggtagtggacatattaaataaggcggcccactttatgtccctggacaatgtgttcaagttacatggttttccagactctataaccagtgacagggaccctatctttgtcagccaattttggaaggatttgatggcctttcaaggggttcagttacaactctcttcagcttatcatccataa

SEQ ID NO: 31026 - DNA, 387 bp, Glycine max
  Peptide Sequence Number=SeqID_147804
atggagccacctatgttgggggttgaagaggaatgtcacagcaatgaatctggatggaccatgtacatagggtcccccagagacgaggatgcacaacattgtgatgatgatgatgataatcatagcctagaagaagattattatgattatgaagcagcagcagcacaacattgtgatgttgaaagtgacgattccatggcttctgatgcatcttctggcccgagtaaatcaaaggagcaagtgaagaagaacaacaagtattgctcagaaaaaaaggtggaaaagaaaaatgagatcatggctttcgccaatagcatggataaggctccagcagcagttcagaacggcagcaaagtcaagccatttatcctctttaaacaaggctaa

SEQ ID NO: 31027 - DNA, 195 bp, Glycine max
  Peptide Sequence Number=SeqID_147805
atggcttcctatggtggtgagcttgttcttgactcatcctctccttgtagtggcatctccaatcacctttcctccttctccattccgctgccattgatcttcaaaaaacaaaggactccattgatgaagaagatccaagggctacaagctctacatggagctacattatgtggttctgtcatttttcagtcataa

SEQ ID NO: 31028 - DNA, 550 bp, Glycine max
  Peptide Sequence Number=SeqID_147806
atcggctcggagaagcttgagccttcagatcagatgattcagaatctgactcatgatcgccatagtcgggagaacaagattcatatttgttctttgaatgtgacatggtataaaaggaaaaaagggtttttttggagtgaaaagaagaaggagctaaaggtaaaggtaaatcagatgggacctatgataacaatgaagggtgtcgaaggggaggaagaggtggatgtgcatggtcatggaaggaccaaccggagacgcgctacggtcagagtcgaccgtgtcggaaactttctcccaccaccgaaaaacaacttctcagcgacactagggcactttggtcccctcaacgtcatggttgatgtcttcttctccgtccttgatgtcgtcggctatgagatagtctccatcattgctagggaaacccaaatcttggtggtggttttctcggtgcctgtatatgttggtggtggtgatggttttcttgatggttgtagtttgggagccactgcatggaggtttaatttacagtggggggagaaagagaaggagg

SEQ ID NO: 31029 - DNA, 2863 bp, Glycine max
  Peptide Sequence Number=SeqID_147807
ttaactttggacattgctcatggtaagaactttgttgatagaatttctaatgactctacgttgtatttggaaagctcatatgttgggttagaacatgcaaacatgcagccaagagcaagtgttggagatggttttcgagtaagtgcctcaagtactcctagtaattctagtggtggatctgaaccagatgacatagactcatttcatgctgtttatatatggggggaggttttggcaaatggggtttcacctgatgggattggaactcaaatcccttctaagacagatgtattgatccctaaggctttagagtcaaatgttcttgatgtgtgtcacattgcaactggcgcacatcacattgctatagcaactaggcaaggacatgtttttacttggggacaagaatcagggggaagacttggtcatggaattgataaagatttttcctctcctgttctagttgagtttctagaaggcaataattttgaatttgttgcatgtggagagtatcatacaagtgctttatctaaatcttttgaactttatacgtggggtgatggaacacataatgttggacttcttggacatggttctgaggctagccattggataccaaaaatggtaaatggccctttggaaggacttcaagttgtgtctattgcatgtggcacatggcattcagcattggcaacctcaaatggaaaactttttacctttggtgatggggcatttggtgtattaggccatggagatcaagaaagtgtgtggtatccaaaggaggtacaactattaactggactaaagactataaaggttgcatgtggagtttggcacacagcagctattatagaggttgcatttcaatctggttcaaatagttcatcatggaagcttttcacatggggagatggagacatgcatcggttgggtcatggaaacaaggaaacataccttcaacctactcgtgtcgctccacttatggagtataatttccaccaagtagaatgtggtcacaatatgacaattgctctcactacatctggtcatgtctttaccatgggaggcacagaacatggtcaattaggaaatcctatgtcacttggaaaaatacctactctagtccaagataagttgcttggtgagtttgttgagaaaatatcatgtggagcacatcatgttgctatcttgacaaataaaagtgaaatatatacatggggaatgggtgctaatggaagattaggacatggagatgtagaagataggaaatcccctacattggtgacattgaaagcaacaacattgactccaacaccagaaaaacctcatcgagtgtgcgataattgtaatgttaagcttaaagttgttaatgataatggtgcctccaagttagatagaaaagtcactccttctcatcattccataaatggaaatgaaagattgggccaaggaacaataaggtctacaagaactctcttgtctcccatcactgaaccaattaaataccttgagataaagaatagtaatccaaaaaacaaatttgattctacttcatttatacgagcatctcaagttccatctcatgtacaattgaaagacattgcatttccaagttcacttagttcttctcaaagtgttttaaagtctactatacctcttgctagtccaccacgaactccaccaccacataccaattcagggcccatatttacaaacacaagaaaacaaagccctacacgtcttgctagtcctagatactttggaagtcttaacaacaatttaagaaggacaaatgatgctttgaatcaagaagtttcaaagttacaaaatcagattcaaagtttgaagcagagaagtgacatgcaggatgtggaaattaaaaagcttaacaaaaaagttgtggaagctattgccttttctgcagtggaatcttctaatcatggagtaacaaaagaattttttgaatctactgtttatcaggaaataactgagaagctgccacaaaaaattccagaaagtaaaactttaagaatcgtgcttacacaagctgaagattttcttaaaggaattgtagaatctaaaacatcttcatcatcaaagttggagtctaagcaaccaaatgcacctgatataccaaatttgaataatggctcttctaatctacaaaagaatagagttgaagaaaatgtggatattgcaggagtcaatccttgtcaagatgaagggaaattccttgaagaaagtaatatatcaaacttgcagccaaagaaacaaaatgcacttgatatagctaccttagatggtgtttgttccaaactacaaaaacaaagaatacaagaaaatatggaggctaatggagccaatccttgtcatgatgaagaaagtttccttgaagaaagcaataagtcaaagttggactataggaaacaaaatatacctacttcagatactagcacttcaaaaatgcgagaacacaaactagataaaaatgttgatgatgtagaacttgactcttgtcaagatagagaaattttacttgaagaaagtagtgagacaaatttggacattaagtaccaaaatgcgcctaatatgcttgcctcaattagtgacgtttctgaatttcaagatgataaactagaggaaaatgttgaggttgcaagagttgatccatctcaagcagaaggacatatccctcaagaatgtaatgggtcatttgcatcaagtgtttgcaaaataatgccttcacaaaactcatacaatgattcaagatcaatggacacttcaagactcgggaaacaaggagagatacaagttattgaaaaatttgaacgtggtgtttatgtgatactcatgttacaatctgatg

SEQ ID NO: 31030 - DNA, 616 bp, Glycine max
  Peptide Sequence Number=SeqID_147808
atgggtgaagtagaggaggtacaaaaacaaatcaaggctgacatggaggccatgaaaaagcaaatggccatagtgatggaggccatgatgagcataaaggagataatggaggtcaatgcgactgcaatagccgctaccagcaccattattgaggtggacctgaccccccaaatatatggtaggtctggaaggcaaagagttgggaggtacgggcggccctcatttagtgcaaaaaacgagcatgccttcccgccatatggcttgcctcccaactatacactacccaatgtggcgtacactcctggtgaggatgtcaataactttgctcccatactcattgaaagccgacaacctcaaactgatcatgcacatgtctctcaacccgtggggaaaacacatgaaataccccatcgcaatctagccaacttcgagcctcgcctcagatatgccactgaagggcaagcagttggtgatatacccctgcaaaacactttggaggggcctcaatttcacccccaaccacaacccttctatggaaaaatagtgtgttacacacctttaagctttgcggatttggtcttcaccggcgaaaggatcaaagtgggtctggaaagag

SEQ ID NO: 31031 - DNA, 222 bp, Glycine max
  Peptide Sequence Number=SeqID_147809
atggtgccatttgttttcaatgttgaaatcacccagcagggaaagttcaaaggtgacacagaagaactcactcttgatggaagtgttgattggcatggtcgcccagcaatcagagccaaatctggcagatgggttgctggaaccatcgttctatcgagagagatacgtctaagtatagttgctgatgataggggtgactcgtggcagaagttggagccgtag

SEQ ID NO: 31032 - DNA, 1581 bp, Glycine max
  Peptide Sequence Number=SeqID_147810
atggggcaaaataatgctgcagctgcaaacagtgtgagcaaatggactggcacagtttacatcttctctctagtgggtgctttcctaagtgattcttattggggaagatacaaaacttgtgccatctttcaggtcatctttgtaataggtctagtatcattgtccctttcatcatacctctccttgattaggcctaaaggttgtgggaatgaaacaattccatgtgggaagcattcaagcttggagatggggatgttctacctctcaatttatctcattgctttagggaatggagggtatcagccaaatattgccacatttggagctgaccagtttgacgaggagcactcaaaggagggttactcaaaggttgccttctttagctacttctacctggctttgaaccttggttcactcttctcaaacacaattctaggctattttgaagatgaaggactgtgggctctagggttctgggtgtctgcaggctctgcttttgccgcccttgtcttgtttcttcttgggaccccacgatatagacacttcaaacccagtggcaatcctctttcaaggttcagccaagtccttgttgctgcatcaaggaaatggagagctcaaatgacatcaaatggagaggacctatatgtcatggatgaaaatgaatctcccaccaatggcaacaggaagattctccacacaggcgggttcaaatttctggatagagcagcgtttatatctcccagagatctagaagaccaaaagagtggggtttacaacccctggcgtctctgccctataactcaagttgaagaagtgaagtgcatactaagacttcttccaatttggctctgcaccataatatactcagtggttttcacacaaatggcttctctttttgtggagcaaggggctgccatgaaaactacaatttccaatttcagaataccacctgcaagcatgtctagctttgacatcctcagtgtagctgtcttcattttcttctaccgtcgagtgattgatccacttgttggaagacttaaaaagaaaagttccaggggacttactgagcttcaaagaatgggaattgggcttgttatagctgtaatggctatggtttcagctggaatagttgaatgctacagacttaagtatgcaaactcaggatgcccccactgcagtggcacaagctctctaagcatcttctggcaaattcctcagtacgcacttattggagcttcagaggtttttatgtatgtaggccagttagagttcttcaatgctcagacgccagatggcttaaagagctttggaagtgccctttgcatgacgtccatctctcttgggaactacgtaagtagcatacttgttagtatagttatgaagatctccaccgaggatcacatgccagggtggatccctggaaacttaaatagaggtcacctagataggttttatttcctcttagctatcttgacatcaatagacttggtcctttatattgcatgtgcaaagtggttcaagagtatacagttggaagggaaatatgaagagaatgatatgcctggtagctttaaagtctaa

SEQ ID NO: 31033 - DNA, 291 bp, Glycine max
  Peptide Sequence Number=SeqID_147811
atgaaaattcaaatacatgagaaattaaaaagcacattccaagacatgcataggaagttgtggagcactttccaagggcttagaattggatactcctgggaacagatatccaatggagatgatggggtggggcctgtagctcagaggattagagcatgtggctacgaaccacggtgtcgggggttcgaatccctcctcacccagaactggccaaaaaaggaaaagatttttccctttgagggtaagaaaatcatgatcgggctagcggacccaaaactatggaacttgtga

SEQ ID NO: 31034 - DNA, 282 bp, Glycine max
  Peptide Sequence Number=SeqID_147812
tattgcacgcctaggcaggcgcaaggtgatggaccacaggccgcagacgcaccgccaccacctcatcaggctgatcctgctaggtcattaggcatggagcggtatctacaacacttggttcgccagcaggcggccaaccaccaggggcagatgcagatacatgagtctctctaccagcttagcctcagtcagcagggccagggtttcattccttttgggtgccctactccagatcagtttagggctgaggtcgcatggcccggatattggcccgaggcttag

SEQ ID NO: 31035 - DNA, 654 bp, Glycine max
  Peptide Sequence Number=SeqID_147813
atggatacaaaaagcgtgccaagcttgaatgatggcaacgtgaagaagaccaaaggtcgacaaaaaatcgaaatgaagaagataagcaatgagcgttaccttcaggcgactttctcgaagcgccgcaccggaattttcaagaaagcaagtgagcttgccaccctctgcgacgtggaccttgctgtgatcgtcttctcccccggtaatcgagttttctccttcggcagtccccatgttgattccgttatccaacgctatatagctcatgccccaactcctcccaccctcgaccttaatgaacccttctgcaccatggatgagcgtgggctccacgcgcacctcgactacctggcgaatcggttcaccagggagaagaagcgcgaagaggatttgaatcgtttgttggaggtttcaaagaatcacttttggtggacctcaccgattgaaagcatgaacaaggcccaagtcgagaactataagaaggccttggaggacctaaagacacttgtcaataaaaaacgtggaagctcctcttcccatgttaatagcgctgtgcctatgcaaaatcctatgggtgtgattgatgggacaatcttgtgttaccgtcaatttaatgacattcaaagaaatggacctactcctgggttattttga

SEQ ID NO: 31036 - DNA, 432 bp, Glycine max
  Peptide Sequence Number=SeqID_147814
atgcttcaaaagactcgtccttatgtgaaaggatcaaataaaacccatgtaaatctggagaagtcatcaactatcacaaatccatatctcttcccacccacgcttaagtgtcttgatgagggtatttctgttatctctaaaagctatagaccctccatcctttctcttatcaaggctgaggaattttcttttgtctccagtcatatgcctggagcatccactatccaagaaccacaactttttactcttgatgtcgagcagacaatcttgcatcagaaagtagcgagcgaggcgaggctcacgggtgcgttttccataagaggaaaatgcgcggagtcgccaccaacgtttattgaaaggaaaacgttagaaaaaccaaaggaaactggtcatgcagaatattccagattcgggagttgtatttacgtttga

SEQ ID NO: 31037 - DNA, 454 bp, Glycine max
  Peptide Sequence Number=SeqID_147815
ggtgtttttgtgtggtggagatgatgatggtgatggtagtgatgtcaacaatgacgataaagataccagtgatggtcatagtggcagtggcaataataacgacgatggtggtggagttggcattagtggtggtggcgatgttgatagtggtggcagtaacgacatggtgttggtaaccaatagtagcgatggtggtggtcatggtggcatcaataatggtggtggtagcaatgtcagtggtgtaggtggtagtgatggtggtggggtgattgtgatggtggggatgaaggtgatattgttggtagtggtagtgacaatgacgatgacagtgacattgatgattgatggtggtggtgacaattatggtggtggtggtggctacaatattggtggcgacgatggtgataataacaatgattatggtggtgataacaatgctagtggtgtttggtga

SEQ ID NO: 31038 - DNA, 510 bp, Glycine max
  Peptide Sequence Number=SeqID_147816
atgccggtgctgtttggtcgccagtgcgtcgccccgctgctgatagacctggcgcaggaacaccccggacttgagctcgaaatgtcattcatcgaccgcgtggtggatcttgtcgaggaaggatttgatatggcggtacgcaacggcacgctgcaggacagcagcgttctggtcgccagaagactgggagaacaccgcatggtgctgtgcgccgcgccggagtatctgcagaaaaaaggcgatctgcgacgcggcgctggccggacacggcattgcatggttgccctgctggatggccagccgggaaattcatcagggaaaactcgtcccgctgttaaagcaggcaccggatgtgcgcttcgacgtgcatgcggtctggcaacagacgccgcatctgccgctgagagtcagaattgccgtcgatacgctcgccagccgtttaccgtcagtgctgtcgcaggaaatgcctgcgcccataaaaaagccgcgctaaacgcgcggcctgagtaa

SEQ ID NO: 31039 - DNA, 489 bp, Glycine max
  Peptide Sequence Number=SeqID_147817
atgattgagggcagtgccttgggcggcggttttgaagcagcgctggcgcaccacttcattctggcgcagaacagtgcgcgtatgggcttcccggaaattgccttcaacctgttccccggcatgggcggctactcactggtggcacgccgctccgggatgaagctggccgaagagctgatctgtgaaggggagtcgcacagtgcagagtggtatgaaacccgtggtctggtcgacaaagtgttccagcctggtgacagctaccgcaccacgcgtaccttcatcgatacgctgcggccaaaactgaatggagtccgtgccatgctgaaagcgcgacagcgcgtgctgcagctgtcacgggcagaactgatggatattactgaggattgggtcgactatgctttcacgctggaaccgaaagatattgcctacatggaacgtctggtacagctgcaaaatcgtcacagcgcatcactgcgtaaagccggttag

SEQ ID NO: 31040 - DNA, 1824 bp, Glycine max
  Peptide Sequence Number=SeqID_147818
atggcggtgcccctgacgccggctcaggccagtctgctgcgtgccatgacggtaattacctccagcatcaacctgaccctttcactgcacggctcgccggtgccgatgcactttgttggccgtaaagtcaatcagtccacctgggctggcactgcgtccgcctggggcgatacctcgtcggtggcgcgcgatttaacccttggcctctccttcgccgaacaggtggtgtctgaagcgaattcggtgatcgtcatcctcgatcagcgcggcaacattcagcgttttaaccgcctgagcgaagagtacaccggcctgaaagagcaggaagtgattggccgtaatgtgtttcagctgtttatgaccaaacaggaagcgcaggcgtcgcgccgcaacattgccggcttctttcgcgacggcaactcctacgaagtggagcgctgggttaaaacccgaaaaggtcagcgactgtttctgtttcgtaataagttcgtccacagcggtagcggaaaaaatgaaattttcctcatctgttccggaaccgacatcacagaagagcgtcgggcgcaggagcgcttacgcgttatggccaataccgacacggtgacgggcctgccgaatcgcaacgctatccatcagcaaattagcctggcactggagctggctaacggcagccagaccggcgtggtttacctcgatctcgacaatttcaagaaggtaaacgatgcctacggccatatgtttggcgaccagctgctgcaggcggtgtcgctggcgatccttagctgtctcggcaaggaccagacgctggcgcgcctcggcggtgatgaatttgtggtgctggctgagcacaccagtcaggcggcgctggaggcgatggcctcacgcattctggagcggctgcgtcagccgttccgtatcgggctgatcgaagtctacagcggctgctcgattggtatcaccctcgccccgctgcatggtgaagatcgcgaaagtctgattcgtaacgccgataccgcgatgtaccacgctaaagagaacgggcgcggcaaattctgcgtgttcgccagcgagatgaaccagcgcgtatttgaatatctgtggctggataccaatctgcgcaaagcgctggagcaggatcatctggtggtgcactatcagccgaaaatcgatcgcgacggcgaagtgcgcagtgccgaggcgctggtgcgctggaattcacctgaacgcggcctggtgccgcctggcgatttcatctcttacgcggaagagtccggactgattgtgccgctcgggcgctgggtgatgctgaacgtgctgcagcaaatcgttaaatggcgcagcgaaggcatttacctgcgcgtcgcagtgaacgtttccgccaaacagctgatcgaccagagcatctacagcgacctgaaacaggcgctgagcgaagcgggcatcagcgagtgtccgatagacatcgagctgacggaaagctgcctgatcgagaacgaggccggtgcgctgaagctgatgaaacagtttcaggagttaggcgcacaggtgcatctggatgatttcggcacgggctactcttcgctttcccagctggcgcgcgtgccgatcgatgcgattaagctggatcaaatcgctggtgcgcgcgatcgttgccgtggcgaaagccctggatttacaggtcatgccgaaggcatcgaaaccaaagccgaagagaagtttgtgctgaccaacggtgtcgatgggcgtcagggttattattatgcgaaaccaatgcccgcagagcagctcgggcattggctggctaagcatcctgcccgcgtttaa

SEQ ID NO: 31041 - DNA, 336 bp, Glycine max
  Peptide Sequence Number=SeqID_147819
atgggggaaatgcctgccacccagctcgcccaggcaagctcagctcgcccaggcaagctcagctcgcgcaggcgagcaaggtggcttcctccagaagcaaaccgccttctggaggaatcttctggagggcccaagtggaaccttgcggattacataatcatcccctttttgacttacggaatgttacggaacctcacaaattgtgcaacgatgcttccttttgagttccggcatgtcacgaaacttcacgaattgcctcacgatgggtgccaagtacctcaaaatggtcaaatcaaagttgcatgccaccaagcaaaggtccccggacgaaattag

SEQ ID NO: 31042 - DNA, 633 bp, Glycine max
  Peptide Sequence Number=SeqID_147820
atgtctcacgactgtcccttcacaggcttacggaacgctccgctaccacgcacaaatgtgcatccacagcttcggtgtatggctttagccccggtacattttcggcgcaaagacccttatttagaccaatatgggttcggtcctccagtacgtgttaccgtaccttcaacctgctcatggctagatcacttggtttcgggtctaatgcatcgaactgaacgccctgttcagactcgctttcgctgcgcctacacctaccggcttaagcttgctcgatacactaagtcgctgacccattatacaaaaggtactgtttcactcccctcgtcggggtgcttttcacctttccctcacggtactggttcgctatcggtcatgcacgagtacttaggcttggatcgtggtcgacccatgttcagacaggatttcacgtgtcccgccctactcaaggacttctgctattctacgtgtacgggactatcacccacttcggtcgagttttccaactcgttccacttcattcacaaaagccactggcctggtccgcgttcgctcgccactactagcggagtctcgtttgatgtcctttcctctgggtacttagatgtttcagttccccaggttcgcttctaa

SEQ ID NO: 31043 - DNA, 657 bp, Glycine max
  Peptide Sequence Number=SeqID_147821
atggatataggaatcggacaagcgattggactcgagactgtgataagtctagagaccgtgatcaggatagggatagaagataatgtctggaacccagaggaagatagaattgaaaatgaacaagaacatagcaggggacatgacagagatgtggatagagaacacagcatagatttgaatatagtcaggaaaatggataggaccagtgatcctgatagaagttttgatgaggataaaaaagatcagtcaaggagaaacaatgacttgaatgtttcaaatcaacatagcatggatctttcgtcagattcagctggtactcacaatgatcaggtagaagctcaattagagaggtcaactcaacagcttgatcaactaaaaaaggaggtttctcagatggaagagggattggaagagaaaagactccatgttaaggaattacaaaagcaatctaagaaactggaggatgcactgatcaatgcaaagaaaaactcttcatatcatcagatgcagttgatgaagctgcataaatgttttctgcaagtaaatgattgcacagaaggactaagaactaccgaaaaagaacttcaggtttgtgtcttaacaccacataattctgatttatatacgaatttgcaaagtatgtcctgtgttttttaa

SEQ ID NO: 31044 - DNA, 333 bp, Glycine max
  Peptide Sequence Number=SeqID_147822
atggttaatgtttcgcaaaaaaaaaaagtacaggttagctcgcctgggcgagcaacccctgtacgaaaatataaaaggggtggagggggaacattttcttcacccaaaactcttccccctcacttcaaaaacccccaagctcacgggaactacgagaacaacagcccccaagcttccattgtcgagtttttgcttcccttttcacgctttaattcactccccacaagcctatgttgtattctgaagcaatggggcatgccacattgcccccattctcttgcaatttatgtccaaacgtgcgcacaccaagtgttcggtgaaatgccccaatga

SEQ ID NO: 31045 - DNA, 501 bp, Glycine max
  Peptide Sequence Number=SeqID_147823
atggcgtcgttgctacatttgcctatcgtaagggcgttccatacctttgagctactttatgtcgacgacattgtcgatatgttggtggaattactcgagagtggcacttacgcttggggcactgtaacacttgtgcatatgtatgataatttaaatgaggcgtcaaagagcacagtgaggcaacttgcaagatatatcactctattacaggcactacctgtgtcgacgtatcgcaggcgtctggacaaactaacccctgatgttgtgtactggattccaaatggtgatcaccgttcatttagagaatttgaggttatctccttgttttccggccatctcagatggggtcccttaacagtcattcaccgacctaagaaggttgtacgacaatttgggtacatccagactattccaccacatcttgttgtgccttcagcttctgttgaagaaatggatgctaaatggatgcagttcggtgactacattgcacatgtagggtaa

SEQ ID NO: 31046 - DNA, 165 bp, Glycine max
  Peptide Sequence Number=SeqID_147824
atggcgattatcagcacaactatcacaataattgtcatcatgaccaacatcattgccatcaacatggctgtcattgccgttgtcgccatcgtcattatgttggtaacaatgatggtgatcatgatgacaatcatggtgatagttgtgatgatgattttgacgtaa

SEQ ID NO: 31047 - DNA, 141 bp, Glycine max
  Peptide Sequence Number=SeqID_147825
atggaaacatcccaagctagcttcgaagttaatcaaaactcaatccagaatcaggaaattcaggagcatatggttaggtggatgactatagagaatcccatgctagaggacagtgaaacacaatgctctggtaggatgtga

SEQ ID NO: 31048 - DNA, 1320 bp, Glycine max
  Peptide Sequence Number=SeqID_147826
atggaaggagaacacgacgactcacagaagctttcgttgttttacgaatccggtatatactacttcgatgattcaaacgccgttttcgtcgaccccgttcgcgttctcaatcgttcctaccaccgtttcaccgtttctccttctacctactattcccgtttcttcaaatccccaacaacccccaactccgtctcctccaccgttagttcctctctcagaaaacggaaacggaaacccaaagagcctccacctctgaacgaaagagaactaattgctctacagcgtcaccaggaagcgaggcctttgttgttggcggcacacgagtgtttgctgaaatcaactgaactgttgaatgttttgaaaactttaaagagtgaatcgcgttgctcgaagaaggagtgtgagggtggtcaacaacactctttcgttgacctgggacgggggtcgcctcaacttgaggtaacactaagtttacgtgttagtgacgctgacactcacctgcccccaaacgagttggaagattcgcttagtgtgcaatgctgtgaacagaaggtgctacctgcattcaataatttggttgctaatgacaccaaggatgatgcggtggctgaaattctggacaattgttatatagtgcctcgggagagttgcttttacatggtattacctgtctgcctgtatgatcttatcaatggcaacccagttgctgaaattctttggcatttcttagagtaccttttgtgtttagctcacgctgattctggtttcaacctgatagtggtggatccaccttgggaaaatgccagtgcccaccagaaatcaaggtattttttatcccttcctattaagcaactcactcatactgaaggagcgattgtagccttatgggtgaccaacagagagaagctgcgtagttttgtcgagagagagctttttcctgcctggggagtcagctatgctgctactttttattggttaaaggtgaaacaaaatggatcctggatttgtgatttagatctcttccatcataggccatatgaatgccttatcttgggatatagtcctgggaaggtaaataataccgataaccaatcaaaatttaaacctgtgaagaatgatcgagtgattatgagcattcctggggatttctcaaggaaacccccaattggagatttattactggagtacgttcctgggctcaaaccttctcgatgtatagagttatttgctagagaaattatggctggatgggttgcttggggaaatgaacccctctactttcaagattctaaatactttgtcaaaaagatggatcaatga

SEQ ID NO: 31049 - DNA, 414 bp, Glycine max
  Peptide Sequence Number=SeqID_147827
atgcaattcgtccacgcgtcacatctatcactccactcgggtccacttcacacccctaactctccaccgattaatctcacccgtccaatcccaaatcttacaacgtggacgcatccaccacacaatcttcagtgcgactctccgcactctatcatttccccgcctgaaattgagctttatgagattcttcattcttccacgcatccagcgaagacaattggaggaaagcgcgatcctcgtgactcgcgacccctcgggtttaaatcccctgcgacgcagcacaggctactacttcaccatcgccggataaaatggtcgacgacggagcaacctcggcggcgacgagccggagaaagccgtcgtggagagaaagagaaaacaacaggagaagagaacggaggagaagagcaatag

SEQ ID NO: 31050 - DNA, 423 bp, Glycine max
  Peptide Sequence Number=SeqID_147828
atgacccgcaacaagaaaactgatcaaatgatgtttgagatagcaaaagaaattgctgacaagattgattccttggaagagctggcctcacagggaagttttgtcacccgtggatgtcaagatgtactaactgttgccattgggcgaccagaacaccctggtcatgttggtgcttctgttgctcgtgcaagcacaaaggagagttatgttgatccctcagggaacgacccaaacatggatgagttagagaaatatggactgcacggatcaaccactattcacaacatccctttgagaaatgatcaagtgaaggttggtgttgaggaagttcaagatgctcatgatcacattcctatacccactcaagaggataaacagggagctatgggactgaagaaacctacagttaggctgaatcttgat

SEQ ID NO: 31051 - DNA, 285 bp, Glycine max
  Peptide Sequence Number=SeqID_147829
atgtctagcgaggagtcgaccctccatcttgaggatgaatgcaattggaagtggtgcatacccaatgtgaccaaaggcgtggatcacttcctaggacatctttgttattcgtggatgcctgctgacttatgcttttgtgtagtttccacactaggcgggaagcctagtgatgtaagcttgcttgagaagcttctatggaggttggatctttcaatggtgattttcagccatggagttgcagcgaaagataaagaagaagaggtgagaggagacgtcatccactag

SEQ ID NO: 31052 - DNA, 445 bp, Glycine max
  Peptide Sequence Number=SeqID_147830
tacctacaaggaagaaccaacagaggatttagctctccataactacgaagcttcctttacaacaaagagaagagaagatgaaggattgaggaaatacaagtggtcttcacagagcaaaatctctcaactctttggaacttggacctttctctctctagaaaaccctagacatgtagaagcttcaagaaaaggtataggtggctttgtttatgcttgtgcacttagcgcaattctgaatcgcttagcactcattagtggatttcagcttagcgcgtgcttttctcgctcagcggatggactgaagcgccgaggagttttgcgctcagcggatggctcactaagccagaagattggcttagaaggaggtgagcttgttcttgactatcttctccttgaagtagcgtctccaatcaccgttcctccttctccattccgctgcgattga

SEQ ID NO: 31053 - DNA, 144 bp, Glycine max
  Peptide Sequence Number=SeqID_147831
atggccaaagataaccagccaatcccctcacgggcaatgatcttgagcagaaaataccggacattagtgagctcatggattgaaccattacaagaggaggctgaaattggctatgagattgattatatttctagggactgctag

SEQ ID NO: 31054 - DNA, 1213 bp, Glycine max
  misc_feature (319)..(319): n is a, c, g, or t
  Peptide Sequence Number=SeqID_147832
tgatgaagaacttcctgagagggggaggaaccacaatctggcgttacatatatcggtgaactgcaagtctgatgctctgtcgaatgtacttgtggacactggttcctcattgaatgtaatggccaaatccacattagatcaactttcctaccaggggccccccatgagaagaagcggggtggttgtcaaagcgtttgatggatcaagaaagtctgttatcggggaggttgatttgcccattacaattgggccgtttgttttccaaattacattccaggtgatggatatccaagccgcatacagttgccttttgggtagnccgtggatccatgaagcgggggccgtgacatccaccttgcatcaaaagctgaagtttgtcagaaatgggagattgatcactgtgagtggagaggaagccttgttggttagtcatttgtcagctttttcctttattggtgctgatgaaacagaaggaacctctttccaaggactgactgtagagggtaaaaagccagagaagaatgaagtgtcttttgctacttggaagagcgcacagaaagtggtgcaggagggaacaggtgtaggatggggaaaagttgtgcagttgatagagagtaaaaaccgtgaaggactaggatttgcttcctctgcaggatccgcaacgaacagtgttggatcaagctccattactagcaccttttgtagcgccgggttcatcaacaactcgccagaagccaatgctgtcttggaagacgttcctgaagagagagtacttgcatttgtcacacctggaaaacttgtccgcaactgggacgcggttgacatcccttcagtagtccatgcatcaaaactaggcatttatgagcccgttgaacataataaccctgcactctctcccaacttcgaatctcctgtctacgaggctgaagaggaggaggatgatgaaatcccagaggaacttgctcggttattagaatatgaaaagaaaaccattcggcctcatgaggaggtagtagaggtgattaacttgggaaccaaggaagataagaaggaagtcaagattggggcatcgcttgaggcaactgtcaaacgaagggtgattgaattactcaaagaatatgctgatgtgttcgcatggtcgtaccaggatatgcccggcttggatccccgtattgtggagcactgtttgcctttgaagcccgaatgctcaccg

SEQ ID NO: 31055 - DNA, 312 bp, Glycine max
  Peptide Sequence Number=SeqID_147833
atgggtattaaaggaaaaaaggaattaccgttaagtgaaggcaaaattataggaagagaagttcgtggtgatgcggataaagcccctcagcggcgaatgctcatagcatctacacgtagacaacaggaagttgcacctggtggtgaggatgttgagcatttggatcatacagctgacgatgtccatgaacagcctaaaaaggcaactgctaatgatgtaattactgatgccgagagattttctaggcagaccctacgacacatcagttttgatggactatgttcatcatgtggcaatgagagtttggaatga

SEQ ID NO: 31056 - DNA, 1545 bp, Glycine max
  Peptide Sequence Number=SeqID_147834
atgccatctaattacttttcaaggctcggagtttcgattcggagatcggttgtggggaaagaaggtcgaatccgggactctgctgaagttctcattgggcaagggaagttgtggtttggtagttctaagttttttcattctgtgcagagctcatattttgtggaactgcagcttctagttcggcccggcattgccttagcttcgagctctgagttagctggcaaaaggagaacattgtctgtagttgacacactatctcgaacgttttcggttccatctgtgtcggggccttcgtttcaggtctgtggataccacattggttctgcccttgctggacctgatcagttttcaagtgggaccaaatttaggattaagacaatggctgctcacttgcccagaatagtggttggcgaatcctgtttagataacccgactttgaagggtagttgccgttccctgtcaaccaagaatagctatagtatatgtttaagcacaaaattgaggaatggtggaaaagtgagcatgagtttgagaaaccatcagcagccagataacagtgcggtttatggatattttatttataatgctgccaagacctggtgtaattctcatccttacatgcagtcaggatctggagacttccatactttgtcatcttcgtgttactctgttgggcctgctcatgatgtgcctttcgacacttctgcccatgaggaacagttaagcagttctgcagatccatctgaacagaaaactccttcaggcaagacccttaagttgatatcaggatcatgctacttgcctcatcctgataaagaagaaactggtggagaagatgctcattttatatgttctgaggaacaagcaataggggtggcggatggtgttggtggatgggcagatcttggtgttaatgctggatattactctcgtgagctcatgtccaaatcagtggaagctattcaggaagagcccaaaggttcagttgatccagctagggtgctggaaaaagcacactcaagtacaaaagctaggggttcctctacagcatgcatcattgcacttactgatcagaaagacaatagaactggacataagggccttaatgctatcaatttgggagacagtgggtttatggtggtccgggatgggtgcaccatattccggtccccagtgcagcaacatgatttcaatttcacctatcagctggaatgtggtagtaatggtgatttacctagttctggtcaggtttttaccattcccgttgcacccggtgatgtcatagttgctggtacagatgggctgtttgataacttgtacaataatgagattacagcagtcgtggttcatgccatgagagccggattgagccctcaggtgacagcccagaagatagctgcattggcacgtcaacgggcaatggataaagacaggcagactcctttctcaaccgctgctcaagatgctggtttccgttactatggtggcaagcttgatgatacaacggtagtagtttcatatattactggctctggtgatgcataa

SEQ ID NO: 31057 - DNA, 780 bp, Glycine max
  Peptide Sequence Number=SeqID_147835
atggattccaattccaaaccttccgcaccaccacctaaccctaaccctaatccaccgccctcgaagaaacaccagagagacctactgagccacgtggaagcctacctcgcgaagcgcgacggcgtagacaagctcctcaagatttcgcgctacgccaccaaactcatcctcgcctcttcgctcctccaatccaaccctaccctctctcaccgcctcaaatccttcgaatccagcgtcggcgtgagccggaaggccttcagactcggcaaattcgttcaagacctaaacgctctcaaaaccactcatcctcattccaaacgccaacttttcctctccctccttgcctacggcggcgaaggtttctactacttcgtggagcagttcgtctggctcgcgaaatcggggctgatcgatcccaagcacgcgcgctttttccagaaattgagcgcgtgggcggagttcgttggttacttcgggagcgtggcgctcaaactcggggatttacaagagattgccaaggaggaagcgtgtgttgagtcgagcgtggagatcacgcgcttgagagggagtgggtgtgtggatgaggaagtgcggttggggaagttgagggagaagaaaatgatgaaaaggctttctgttgttcaggatttggcggatgcggttatggctttggatgatattttggatgggaaaggaccgttttcgaaaccggttttgatggctttggcaggacttttgtccgcgcttattagctctcacaagaattggatttcttgctga

SEQ ID NO: 31058 - DNA, 492 bp, Glycine max
  Peptide Sequence Number=SeqID_147836
atggagtgtatcttacatgttataatacttaattgttttcatatgtggaagtctgatctggaacagattcacaatctaattgctgcccatgctgattctggtttcaacctcatagatgtgaatccacctagggaaaatgctagttcccaccagaaatcaaggaaagatttccatctgaaagaaaacggatcctggatttgtgatttagatctcttccatcacagggcatatgaatgctttattttgggatatagtcctgggaaggtaaataatactgataaccaattaaaattcaaatctgtgaagaatgatcctgtggttatgagcattcctggggattactcaaggaaactcccaattgcagcatatttttgggctcaaacctccttgatgtatagagctatttgctatatagctggatgggttgcttggggaaatgaacccttctactttcaagatttgaaatattttgtcaaaaagttggataaatga

SEQ ID NO: 31059 - DNA, 300 bp, Glycine max
  Peptide Sequence Number=SeqID_147837
atgttttacaagtgggaagatgagaacaaaggtgttgatgaatttgagattgaagtgagtaaagatctccacgaccttacatctgatattatatccaaagtcgctttcgggagtaactatgaagaaggaaaagagatttttgatttactagaacattaccatcttgtctcccttgcaaacagaagtgtctatcatatgacaaaaactagaactctcaaatgggtttttgcctacgaagaaaaacagagaaagaaagagattagagaagaaaacctgcaaatcagttcaagtgttgattga

SEQ ID NO: 31060 - DNA, 433 bp, Glycine max
  Peptide Sequence Number=SeqID_147838
ggggacatggtggttaagggcaaaggaagaagaggggtgtagtggttgggggcaaagaaggggaaggacggtggtggttgggggtggaggaaacatgaagggagaggaagagaggaggaaacaagaaggggaggagaagaggaaagagaaatgtgaagagggaggaggaaacatgagagtgccatgggtcatcgcacgtccaatggcattgtgccacgacaccctcgagcgtgtgtgtctattctatcacaagtggtcacgcacgtatgggaaaactgttctgtattggcacgggtcgaaaccaaagctggtactatccgacccggatatgattaaggagatccttttgaaaacgggtgaatggtttgagaggatagacccgaatccttcggcaaccgttttatggagaaggagaggaatggactgtgcatag

SEQ ID NO: 31061 - DNA, 841 bp, Glycine max
  Peptide Sequence Number=SeqID_147839
atggttcatggtccatgtggaattttgaggcctgcatctccacgcatgaaggaaggtaaatgcagtcgattttatccaaaaaaatttcagctcacaactcttatagatggagatggttatcctgtggatcgtagaagaaacactggtcagacaataaccaagaatgagattataattgataatagatgtattgtaccctacaatccaaaattgctgaaaaaataccaagcacatataaatattgaatggtgtaaccaaaacacttctatcaaatatttattcaagtacatcaataaaggatatgataaagttacggctgtcatggttcatgatgacactagaacagttccccatgcaaacactctgaatgatgaaatcaaggaatatctggattgcatatacatttctccatgtgaatctacttggaggatctttggttttccaatacatggtagaaaaccttctatagagaggctacagtttcatcttccaagacaacatagcgttctctaccaagaccatgatgatattgatgatctcctctctaacccaagcatttctaaatcaaaatttatagcttggatgaatgcaaaccaagcttttgttgaaggtcaaagcctgacttattctgaatttgttacaaagttcgtgtataaccaaaaacaaagatgctggcaacttagaaaaaagggttatactattggcaagcttcaatgggttcccccaactacaggagaattattttatttgaggatgatgttgactgtctctagaggaccaatctcatttgaagatatcagaatagttgctggtgttgaatatcctacatatagagaagcac

SEQ ID NO: 31062 - DNA, 300 bp, Glycine max
  Peptide Sequence Number=SeqID_147840
atggtgggaacgaagcccaagcgcctccctcgcctcttgcgctccaaagcccattcctgcatttccgccaccttttcgataaccttcatgcccgcatccctccagcaagattgtgaaaagaataactttctatcccccaagataccactccggcaggaaaagatcaatatacttttgcttgtgcttgacagcgccaaagcgctcggcatagaatggggatggcctggcacgggcaaactctttgctccggggctggataatccaagcaggaggaaaatgctggaaagccaggccttttag

SEQ ID NO: 31063 - DNA, 389 bp, Glycine max
  Peptide Sequence Number=SeqID_147841
cgatttcgcgatcaagatagaccgagcggagctcgataacggtggtactttcaccgtttcgggtaaagcaccggtagggagtaaggtcttcctggagatctggagcgaaaagcaggtgcgtgcgtcctacttcgacagcaaaaaggatcctcagacggggaagattccgtacattctctacctttctaaagaagtgccggcttattaccagatagtcttgccagtggacgaaaagagcgagctagaagccatcaaggccgaggggaataagtggtccttaagcaagtccctgaaagatctgggagcggacgtagcctatcaggctcccgccaaaatcaagatcgatgcttacaaggcgggattcttggccagcgttatcggatcgcgcg

SEQ ID NO: 31064 - DNA, 576 bp, Glycine max
  Peptide Sequence Number=SeqID_147842
atgaagcacttcactgacaccctcatcagtgccaacataggtctagtttatgctaaatccctgctaagaaagctcacgggtggtagtgaattgccaagtaattgggatagaaatagagatactgatgatgcatcatctgatgctggtagctccagtgtgggtagtcaatccacagatgagctatctgaaatcttgtcacaggcagatgtctggctgggtcgtgcagagcttctccaaagccttttgggatcagggattgctgcttctcttgatgacatcgctgatggacagtcatccgcccgtctgcgtgacaggctggttgcagatgaacggtatagcatggctgtgtacacctgcaaaaagtcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 31065 - DNA, 186 bp, Glycine max
  Peptide Sequence Number=SeqID_147843
atgcaggaggtggatgtatccattcctgcctcaactgctgagacactagtggagaaggctcaactaaatatgttcaatgttactactcatgctccacctccacctatccaacttctaccaccaccactagtaagtgttccactaaatgtaacgacccgcctcgtcgctacggtatccgcactataa

SEQ ID NO: 31066 - DNA, 1479 bp, Glycine max
  Peptide Sequence Number=SeqID_147844
atgacagacccaggggaaggtttcgtttttagaaaggacaattttggttgcagtcaagcaaccagtaacacatctgatacctcatctgaggacgatattgatgttaatactattgaagaaactggagctagcagctcacaagcagtcccaactgtacattctcaacaatctgaacctaataacagggtaagtgacggacttgagatatcaggtgatcagatttgttcacaaggaaccatttgtgagaatttagatcggcaaggctcttctgctcatgtggaaacaagagatttggaatcatcttctagtaccaggtttgaaagagaagatggcactggaggaaatgttgatacgatgccaactgaagatccttctaatggccttactcaaccaagcttgcaaattgaagatacagaccaaggcaatatgcatgagttaagtgaggtacatactgagcaatctcagcggggtgatataattaatgatgaaagcgatatagttgatgatgtagatttgattgaatctattgctctggaaggggagcaacaggaagaagttattattgaaaatgacggaagtgtctggcatcaaagtgtggatgataatcagctcggtagcacaacaaatgaatggccccaaaacatattgggaggtgaagatggagaaaattctcgtatgcaggagcaagaagcccctgaagtgtggcaagaggatggtggctttcaagaagctgtggaaatttggttaggaggaccatctgataatgaagtagctccagttggtagaattcatggattttattttcctgaagatgacaatgtatacagtgttgagctcagggaattgctaagtaggagaagtgtctcaaacctccttggcagcagttttcgtgaaagtcttgaccagttaatacaatcatatgttgaaaggcaaggtcatgctcacgttgaatgggagctgcaagagacaaccccttcccccttggcagaacaagtctcacggcaacacagtagggatccaatagttagtcctcaggctactgttaatagctcacttgaccgacccttgccaccaacacctccgcctcagcctttatgggatcggcactcacgtcatgacaattggtcacagagtgacataaataatcagcgcttaggaattgagtgggatattgttaatgacttgagaattgacatggttaggctacagcaaaggatgaataatatgcagagaatgctggaggcctgtatggatatgcaacttgagttgcaacgctcaataagacaagaagtctctgcagccctaaatcgctcaactggttcatcagatgaccaagtggaattcatcacaggaatacatgacggtgtttcaacagacgataaatctaaatgggaatgtgtgaggaaaggactttgctgtatatgctgcgaaagcaatattgattctttgttgtacaggtgctattcagcctcactttga

SEQ ID NO: 31067 - DNA, 284 bp, Glycine max
  Peptide Sequence Number=SeqID_147845
aggatggtcctgtaggaggagctggaactaatggagatgtagaggtggaaagagctagaataagaggaatatcagaagatgaaggagcctcagacatcttccctttggctttgcatggtcctttgaaagtaacagcaagatcatcgaggttccagcaatttttcttcacatatgccacattaatggctggactgaggctctcaaaagtcaatgagtcagaagtgactcctctagccttgcacaaatcagtgataagtgtagggaaacctagcctagaggagtaa

SEQ ID NO: 31068 - DNA, 642 bp, Glycine max
  Peptide Sequence Number=SeqID_147846
atggcatctaggaagagaaaggcccatgcctcaacatcccaggcccgctatgatagatccagattcacatctcaggaggcctgggatcgttattctagtgttgtcattggcaggaaaatattacctgaaagaaatgtcatgctctattacacagagtttgatgaattcactgaagagttagagagaagaaacaggcacaaggagttaacaaattttatggatggcaacattgatgttgccattatgaaggagttctatgctaacctctatgacccagaggataaatcacctaagcaggtgaggttcagaggtcatttagtgaaatttgatgcagatgctttgaacactttttttatgacccctgtgatcatagaggagggggaaaacctgcctgcttactccaggtttagtcagctgaggccaaatccacaagaactggcagcccgattatgcatcccagggaagggatttgagcttaatgttgatggtaatgctgatgggctgcccctgaagattctgaggaagaatctgaccactcttgctcagacctggagtgttctctcattctccaacctggtccctacttctcacacatcagacattacactggacaaggccaggttgatttacggcattatctag

SEQ ID NO: 31069 - DNA, 252 bp, Glycine max
  Peptide Sequence Number=SeqID_147847
atgggtaagctttacgcagatgctccaaacgacgtagtcacgacttgcaatttcaaagcaaaggaaaattggaagcaggacgaaggtgaaaagcaattgggctttgttttctctcctttgacctgtgcaaaacacacaaatccaaaccagccggcgtggccacggcggtcagggctcaacggcgacggcccaacgatgtcggtggcaggggcctcgtacgacggaggcgtagctgcgagcgtgagtgagtga

SEQ ID NO: 31070 - DNA, 321 bp, Glycine max
  Peptide Sequence Number=SeqID_147848
atgtcatcattgaagttgacgatacagctgagtcaccattggcactggcgagatagtgcttacgtggagccagcagcattggcgaaacaggtgaggctagggcagctaggtcaggtgttgcagagtaggggcatagtggttccgggtggtttcgctaacatggctgacgagtttgttttgaaagtatctcgccattgctactggcgagaaaggtgcctacgtggcgcgcatgcatgcagaccaaacatagttgcgtataagaagcaggcttttctagaaatcttttcagaaagagtttcgcaagtgggagtggcggaataa

SEQ ID NO: 31071 - DNA, 297 bp, Glycine max
  Peptide Sequence Number=SeqID_147849
atggcactattaggtaacttctctaaaggaagcatgaccaactccatgactgatttctctattttaaaggcttttaaagtctccagtcactcgccaaaaccatccaaagtcactcaagttgcatggcatcccccttggtttactggcatttcttcgtccttggaagctgagcttatgggagctatgcatgttgtggaaatttcaaaatctaaaagtggtctacactatggctcgagtgtgactcatcctttgttgttttggctttcaaagatccttccattatgccttggcgcctaa

SEQ ID NO: 31072 - DNA, 324 bp, Glycine max
  Peptide Sequence Number=SeqID_147850
atggctttgattcgtagcaagacaaagaggatctcttcagttcataacgaagatgatatcttaactagtgtttctgatatagagcatgaagtgatgcaatcctaccccgcaagggcattggatagaagactccaagtagattgggccaaagatgcaaaagaaagccttagggttctcatgaaccttaggcatttgcttgctacacccccattcatcttctcctaccttctctccctctccctccattcatattctcctaccttcaagttcttatccatggcttcctatggtggtgagcttcttcgagactcaccttcttcttga

SEQ ID NO: 31073 - DNA, 276 bp, Glycine max
  Peptide Sequence Number=SeqID_147851
atggaagttgagtctataattcaaaagaagacacctcgaaacaaatcccatctcgtgagaaggttggtaaagttggagtacaaagatggccatagcatgattaagcacttaaacattttcaaggggctcgtgaatcaattgacgaagattaacacgaaaattgatgatgaattacaagctcttgtactccttatttccctaccagagagttgggacatgttagtagttactctaagtaactcagcccctaaagggaagctcggataccatcactga

SEQ ID NO: 31074 - DNA, 201 bp, Glycine max
  Peptide Sequence Number=SeqID_147852
atgaaaaacctcgtcagacggcaaagagtacatgacaagacaaaccatacattgggaaaccaatcagggtcatgttgttttgcgagaatgcttcaaccatgtgggatcggcacaaacttaaaggagcactcaaatcgggtgtatttacccccaagttctagacttcgaagaattcatcagggcctctcccttgtgatttag

SEQ ID NO: 31075 - DNA, 645 bp, Glycine max
  Peptide Sequence Number=SeqID_147853
atgctcgaaccgcgagaatctgatatacctgtcctgtttctggtcttggttgtgcttcccttggtggcttacatcttacttggaaaatggagtgaaaccactaagaagagagatacgataaatttgcttgcccatttggctgctgaagaagctctgagagctgaagaaatggttgtggctgatgtaattcctccagtgtctgcttcaaaaaatgaacatcatgtgtgcgctaggtgctctgttccagccagaactcgctgctccagatgcaaaattgttagatattgctttggaaattgtcaaataatccattggaggctaaatcacaagcaaaaatgccagcgactggaacctcctaaatcaagctcatttcctctggcagtttcagttgaggaacttggtcatgggagttacttttatgaaaatttgaacaaccagtacttaggtctctctttgaagcagactttaagggagagtgcacctttgcacataattgttggacccgataatctttctgattctggagattggagggacaagggagctgtcactgaagttagagaccaaagaaaatgccagcgtcctccatatcaagaacccctggattggccaactcggaaaagagtagctttgagatctgcataa

SEQ ID NO: 31076 - DNA, 630 bp, Glycine max
  Peptide Sequence Number=SeqID_147854
atgcaggagctggtgcaaatggaatgtagtagatgggcaagcaaagggttgaacataaagtacgaggaagttgcaacttgggatgaccaggatgcaagagatgtcactgattaccatttcattgtggaacaagaagtggggtcttgcacttacgccttctttggcttcaacggaattgctggtgtatggagaatttcgacgctgtatgagtctgaagggacttgcgataagttcgagctacagattttagcccccaacatattgcataagttaaatgcaccttctaagtacacaccctcgtttatggatctgccacctagggagaccatgaagatggacctacacaacaaaaaatccatgccatcgatgtctccaaagaagaagttgacggcaaaatttgctctgatgaagtcccggccactatcggagcaggagatcttgacggagagtcgtccagaaaatcactatcagttcttgaatgtgctcaagacttctttgacctcctcatctgagaaatccatcgccggcgaggctcctcagtcgaacaccaaagacggagcttcctctgcagttctctatatgttgtatttaccgtgtatcatcaaggtttgtccactttgttacccgtaa

SEQ ID NO: 31077 - DNA, 234 bp, Glycine max
  Peptide Sequence Number=SeqID_147855
atggcgcctcctattcatatgactttggaacacaaaaaccacgaaggattcaaggtggtacttcttgatgaacgccccccagacaggcgcctccactgtgcacgtgacatgtggcacgcacggctcacgagggagcagcagggtagcgctcctgacgcgggcgcgtctggtagcgtcctgccactgggcgcgactggtggcgtccctgctgcaggcgcgaccccagacacctag

SEQ ID NO: 31078 - DNA, 440 bp, Glycine max
  Peptide Sequence Number=SeqID_147856
atccacgagtcaatgagggaggggtcggaggtgagaaaggtgtaaatggtgtgggtgttgttgaatgtgacgtcatagaggttgtgcttgttgtaggggaggcagtggtccactacactgaagggggcgcaattccctctcaggttggaattgcacacaacatgctccttgcgcttagcgagacatcaaatgtagttagtttcaaaatcccaatggattctattctagaagtgttttggggctttattgctgagaatgaaaatgcaaagaaattttttgagaaaattgaacaatactttgccaaaaatgagaagtcggaggcaagtaacattttggctaaacttatctccatcaaacctgctcgtgcatttagatttgatctcacttcctgcacactttgggcaatcaaagtgagctataatactcaaaaggaaaaatga

SEQ ID NO: 31079 - DNA, 402 bp, Glycine max
  Peptide Sequence Number=SeqID_147857
atggttgacttgaatgagttgagtgtagtggaccactgcctcccctacaacaagcacaacctctatgacgtcacattcaacaacacccacaccatttacacctttctcacctccgacccctccctcattgactcgtggatctgcaccgcatcctcactgtgggcctccacgtcccctcttcgatctcaaagccagcggtcgcgcctctctttctccagctcgaagcccctcaagttctctagaacaataagagcagcagccgccgatgagaccatagaggcacctgcaaaagaagaggctgcattgtgttcccccaaaacgttaaagaaaagggtgccaagttgtgaatgtgaagaagaaggtgtgttgaggaaggaatcaaaggaatcttttgaagggtga

SEQ ID NO: 31080 - DNA, 444 bp, Glycine max
  Peptide Sequence Number=SeqID_147858
ggccccttgccttcccaacctgctcatttaccacccacaaatactaacaatcaccttgatattgaacccctttctctgctagattggaaatgggacacttctgcttcacctcccaccaaacttgtgttggttcaatggtctggtctggccctagaggacatcacatgggaagcttgggatgcactgcctgactcttataaccttgaggacaaggttaatttcccagagggtggtgatgttagcgatatcagccctgcaactagttcagctaatgctagcagacccaagagcaatgagttgagagagtggcatgggttggccatacttgtttacgacatcagcatcctcacactccatgggtgcatgtataacgctagctctcatggtcgttattggttgatggagagactgtccaatagaaaaagagggggactttttccttag

SEQ ID NO: 31081 - DNA, 432 bp, Glycine max
  Peptide Sequence Number=SeqID_147859
atgaaaaagacagttgtggtagttggaaaaggaagggtttttttggcggcaatggagggggaaccgagccagctgaagcgtgccgcgattgatgcctctgctggagctatctccggtggcatatccaggacagtgacgtcacctctcgatgttattaagattaggttccagatgttgtctaagcctatcttagtggttgttgtcaaatgtcaagtttatcggaccattgcagatattcagtgttgtaaacttcagtccgggatgtccattcttcaacataaggaagttcaactagagcccacatcttcatggactttactacgcaaggatttgtctacaccttcaaagtatactggcatgcttcaagcaagcaaagatatttttagagaagaaggcatatgggtaggaattaggctaacccattttctataa

SEQ ID NO: 31082 - DNA, 1329 bp, Glycine max
  Peptide Sequence Number=SeqID_147860
atgttcaataaacttctctatctgaaagatgtcactttcacagcaacatcacgttacccttttatccaccaccactccccattactatttcctctgcgtttctacacaacgaccacttcaaattcacactcattcgcggtatcctacctcatccacaattttgggttctcccctgaatctgcttccagaacttgtgactcctaccgcatttgttttcggaccccagaaaagcctgactcagcaatcaggttcctcagagaccacggtttctctaactcccaaataaacagtatggttagaagggtaccatggttgctttcctgcgacccttgcaaaagagtattgcccaagtttcaatttttactctcaaaaggtgtttctagctctacaattgttgacatagtgagtaagtcccctgcaatactgagtcgaagcctggagaatactatagtcccaagctatgatttggtatttagattcttgaaatctgatgaccacactatttcttgtttgtttggtaattgcatttactatggcagaagagattacatcgagcgcaacatcagagttttgcttgataatggagtgggagaaacaaacattgcaagattgcttcggaaccgttgtagggcggttttcacctctgatattcttaaggtggtggaggaagtaaaggatctggggtttgatccttcaaaatcagcttttgttacagcattgcttgccctaaaaagtatgagtcaaacctcgtggaaggagaaagttggcgtctataagaaatggggttggtccgatgaagcctgtcttgaagcatttaggaggcaccctcactgtatgttggcatccattgacaaaataaatactgtgatgaacttttgggtcaatcagttgggctgggattctttggaccttgtccgatctcccaagattcttgggttgagtatggaaaaaacaatcattccaagggctcttgttgtccagtatttagtcgcgaaaggcttgaggaaaaagagtgcctgctttcatatcccatttgctgtttccaaaaaggcgtttatggaaaagctatatcaactatcaagtgacaacttcaggatacagcattgtaggctagtgttggcttggggtgagccttggcacaatggcaagaggtgcaaaggactaggcaggattgttggtgtccagtggggaagtgaactcctattcatgcatactagttttagtaggtggcactatggcaaattggtaggaggtttggacaagagtgttgaaggttcatatagcaatcaaggcaatttgccacttcatttgcattttgggaactgctag

SEQ ID NO: 31083 - DNA, 132 bp, Glycine max
  Peptide Sequence Number=SeqID_147861
atggcatcaaagcctgctccaccagaagacaattttgagaagaaggccatgaaagctatgagagttatggaagatgtagtgtttagctctggtgatgaagtgaatttagattcacaggaagttgagatataa

SEQ ID NO: 31084 - DNA, 426 bp, Glycine max
  Peptide Sequence Number=SeqID_147862
atgacattttgggaattggctgggtgtgagcctaaattcaataaccttttcaatgatgccatggctagtgacactcaatgggtttctagtgtggtaattgaaaagtgcaagggcgtgtttgacctatcagagtcattggttgatgttggaggagggacagggactatggctaaggcaattgctaagtcattcccaaaactaaagtgtgttgtatttgatctcccacgtgttgttggtgacttgcaaggaactgataacataaaatttgttggaggagatatgtttgaagaagcatttcctttggctgattgcattacgttgaagtgggtattacataattggaacgacgaggattgtgtgaaattactgaataaatgcaaggaggcaatacctaaccacggtggggttattatcatagaggtttag

SEQ ID NO: 31085 - DNA, 816 bp, Glycine max
  Peptide Sequence Number=SeqID_147863
atggtgccgagatcatgtgacagaatggcctccatggacttctggaggttctccaaggcgtcattgtactgctctatatatatagtcctggagcactacgacgatcttcaacgaggccttcttgtgcttggtgatgacgaagatggtgaagttggcctggtaggagtagactttaatggtgacctcaaggacgctcatgaggttgaagttgtggctgaggaacaacgtgatggtggagatgcacatagtgtgatggcaaaggctaagtatggatgcacgaataatcttttgccttccattaacttgaacaccacttgttcaaacttatggggcactcttgaaagtctttccctcaagcttgttcttgcagaggatgttataaaaaaggtgggggaagtggtcaacttggaaggaggttgggattccaactatccgaaggaaatgctcccaatcgagataggtaacattatcttggctattcctcctccttgtagtatagcagtgttaaattctttgacttgggaaggctcaaaggatgaggacttttccttggcagtggcatatcaaactatcaccaatgggattgtgattcaacatgatcctctttgcaagatagtcctgcttgtccgatgtatggggaagttgagactgtcattcatgtcgtgtgtgattgtcaatatgcgaagattgtggaagcatatcatagctccccaagcttggaactcttttttccaaggggacttggaggagctggatatgaccatgtgcaagaagaatgatagtatgctcgaggacataattgctagagactcatga

SEQ ID NO: 31086 - DNA, 333 bp, Glycine max
  Peptide Sequence Number=SeqID_147864
atggcagatgtttctgagtgcgagagtaggtttgaggagcataaggaagggtttgctctattaggaacgattggttccttattagggtttgacgagaaccctaaggactatgtcaattgctctaccattcagtggcatcatgtctctgtttatcctcaaaaattgggagaccttctcaccaaacaagttgttgcttcgtatattatcacagaaggagttggggacacaggaagggaaatatggtttatggaaaatggtagaattgtgattgttcactattcacatctcaagcatttgtcaatttatggacttgtttcatgttaccataagtga

SEQ ID NO: 31087 - DNA, 756 bp, Glycine max
  Peptide Sequence Number=SeqID_147865
atgacaactccaaggaaagagaaaaagagagaggctcgaagagaagagaaggccgaaaaagcagctttgttagaaaagtctattgaaaaagagctattagaacgccttcaaaaaggagtttatcaacaaagtgatatatacaattatcctcttgaagagtacaataaagttcttgatatggagaaacttcaaattgctgatgaagaagaggatgaagaggaaccagaggtagaatatgtagaaggttatgatgaacttgaagaggaagaagacatggaggattttggtggttttgcaactctcaagtctcagggtgattttgacgatgatgaaaatgctgaaagcactgatgatgaagaggaagaagcaattgatcagagtagagcaaaaaggaaaatggcattatcttcaaagaaacttgagaagaatggccttggttctaaattaaagaagacaagggtacttgttgagaagttagctattaacaaagtgggggcgatccctggcacagcagtaaagttgtgccttgatgaccagttggtcatgggttctctaatatggaaacagcctctttgcatatgcaagggtagtgttgcatataatgaccctcccccataccttcacatagcaaggagcttcggggcactggggttgagcgtgaggacgctggtgaaagacagaggatggtacaatagttgcattcgccattgttatggacaggagaggaaaaatgctatagcagaatcggaattttga

SEQ ID NO: 31088 - DNA, 696 bp, Glycine max
  Peptide Sequence Number=SeqID_147866
atggagagacgcacaattgagggcttctctgagtctctctcgtcttgtgctgattccagcggagccgtcacacttcccctcttctacgtcgtcgttttgaaccccattgctccctctctccaattcaaggccaaagtgttctacattggctattttgtgatatttgtcaaggaaggtatgatgagagaaagtttcaagggcaagggtggatcttcttctcttcaatccatgaaggagaaggaaaaacacctggtggagaagattcaagggattttcaacagtcttcagtgtgcaagaaaggagggcaggggtaatgacattgtgatatttgaggagcagatgcatcagttgctccgagagtggaaggcggaactggagtctccggccaactccttagctgatggaagctttggttcatttcccagcgaactagcccaaatgttgctaggaactgaggagaaagatgatgctactagtccattgacaaaacctgtgccattgaagaatgagatccttacaaataacattagtgacatcaattttcagtattttcaggagggcctcactaaactcatcccacaaaactggcttttaatgtggggattaaataccacccttaaggctgcaattaaggaagtccccaaagaggccacaataggtgggctaggggtgactacaattaagacggcattctaa

SEQ ID NO: 31089 - DNA, 321 bp, Glycine max
  Peptide Sequence Number=SeqID_147867
atggatacattgctatgtgcaaaggacgtgatttcatggctttgtggaaacaagagaaattgttggagaagaaacgagagtaacggagatcctttggttcttgtggtggaaaacgatttgatgagggctacgtggtgtagaattgtggagcaggtggtgacgcgaagtgaaggtaaggccagacaaaggtgtggtgacacgaaggtgttgcggtggtggccggaggtgttgatgccgacaaaggtcacacgagacgaatgggccatggcgaagaggaagaagatatataggagcagagggggaagcttctggaggtggtga

SEQ ID NO: 31090 - DNA, 927 bp, Glycine max
  Peptide Sequence Number=SeqID_147868
atgggtcacaactctaatttgttgggtcagtttgatttatatcatgacctcaggcacaacacggaaatgaagaacaactcagaatcaactcaatttagtttagaaggttttgattgtagccaattctttgaagctgatgacaatgtgcagcatggagagaatattatacctaacattcttccaaatatctgccccccaccttctgctttcttagccccaaaatgtgccctatgggactgtttcagacctgctcaaggggtagaatggtgccagaactactgtagtagttgtcatgagctgttggcaaataacgagggtcttcctggcatgaccccaattttgcgaccttggggaattggtgtaaaagatggtcctttgtttgctgctgttcttgctaagacgcagggaaaggaagtgggcatccctagttgtgaaggtgctgcttcaactaaatccccctggaatgctccagagttctttgatctttcttttcttgagggtgaaactgttagggagtggctcttctttgacaagcctagaagggcatttgaaagtggaaatagaaaacagagatcacttccggattacagtgggcgtggttggcatgaatcaaggaagcaggtaatgaaggaacatgggggacaaaagaggtcctattacatggacccccagcctcttagttatctcgagtggcatttgtacgagtatgagatcaacaaccaggatggttgtgcattatacagactagaattaaagctggtggacaaaaagaaaagtcctaaaggaaaagtgaccaaggaatctcttactgatttgcagaacaagatgggacagcttactgctgctgttccatctactgatgatggacaaccagtcaagggaaaaacaaaggccaagtctgagaatgatgaatctcccaacaagtaa

SEQ ID NO: 31091 - DNA, 1335 bp, Glycine max
  Peptide Sequence Number=SeqID_147869
atgggtcaccaaaccgcattcctccacctatgcaacaagttagccattaggggccacaaaatctccttcatcaccccaccaaaagcacaagccaagttagaaccattcaacttgcacccaaattcaatcacctttgtcaccatcaatgttccacacgttgaaggccttcctccagatgcacaaacaacagcagatgtcacttaccctttgcagccacagatcatgacagccatggatctcaccaaagatgacatagaaacccttctcactggcctcaaacctgacctcgtcttctatgacttcacacattggatgccagccttagcaaagcgtttaggcatcaaggctgtgcactattgtactgctagctctgtcatggttggttacactctcacaccgtctagatttcaccaaggaacagacctaatggaaagtgatctcatggaacccccagaagggtaccctgactcatcaatcaagctccaaactcacgaggctcgtacctttgctgcaaaaagaaaggatacatttgggagcaatgttctcttctacgatcgccaattcattgcattgaatgaagccgatttgttggcatacagaacatgcagagaaatagaagggccatatatggattacattggaaagcagttcaacaagccagtggtagcaaccgggccagttattctagacccaccaactttagatttggaggagaaattttcaacatggcttggagggtttgagcctggctctgtagtttattgttgctttggaagtgagtgcactttgaggccaaaccagttcctagagcttgtgcttggtcttgaactcacaggcatgccattcttggcagcagtgaaggccccattagggtttgagacagtggaatcagcaatgcctgaagggtttcaagagagggtcaaagggagaggatttgtgtatggtggatgggttcagcagcagttgattcttgcacacccttctgtagggtgtttcatcacacattgtggatcagggtccttgtctgaggcactggtgaacaagtgtcagttggtgctgttgcctaatgttggtgaccagatcctcaatgcaaggatgatggggaccaacttggaggttggtgtggaagtggagaagggtgatgaggatggaatgtacaccaaggagagtgtgtgtaaagctgtgagcattgtgatggattgtgagaatgaaaccagcaaaagggttagggctaatcatgctaggatcagagagttgctgcttaacaaagatttggagtcatcttatgttgacagtttctgcatgaggcttcaagagattgtagagggaatttga

SEQ ID NO: 31092 - DNA, 558 bp, Glycine max
  Peptide Sequence Number=SeqID_147870
atgggtacaacaatgacgatgatccatcctccagttcaaaagtttaatgggtgctacaaacaagtaaataaacataggagaagtgaaagttcagagaaagatgttttggctaatgctcatatgatttactcacaagatacagatcaaccaaaactcgatgcaaaatttatgtcaaagtgttcaaaaagaacaaaggtttctgcttttggaaattactcgtcgtcttctaacccagagacacgcgttgaagtcgaagaatatgatatgtcattgccaatgtcttgcccaattggacaaaaagcagcaaaaaggaaaagcaaaggaaaagaatctcctaacactctcaatttatctggcatagaaaatgtaatgaaggacaaaaatatgaacatatcaaaacttattcagttaaaggaggcacaagaaaggcatctgcaagaacagaaacgacatatggagtatggaatcgtcatgaaggatacatctaacatgttcgaacagcaacgcaaagaccatgaaaagtattgtgaccatatcagaaaaaaactagggtattaa

SEQ ID NO: 31093 - DNA, 426 bp, Glycine max
  Peptide Sequence Number=SeqID_147871
atgaagaggaatgaaaatggaagatggagaagatgcgaggatactggggcagagcacgttgaagtagaagtcatcgggttgctggaggaagtggaactgctaggtggactacgcggcgaggacgtagcgcgggcagctgccgaagctgccgttgttgattctggcgacgccacgtttcggtgggtggtgttgtcgttttccgtcggcggtgaccttctagataaagtttccgccagagtttgtgacgaaggcgttgccacggtggttgacggcgacgtcattggcagcatcgatctattcgaaggggagagaggagaggaagaggcagcgacgggagcggaggtcgtaggcggcgagggcgttgaatggaggtatccgaggaggaagtgttgcagtggtgatggtgtgggtggtgttctggtgtaa

SEQ ID NO: 31094 - DNA, 156 bp, Glycine max
  Peptide Sequence Number=SeqID_147872
atgggaatgggaaagggtgaacggagtgagaatgaagatggaatgacaatgggaaaagaagagatggaaaaacccgggcaggacacgtggagggagggatgtgcatgcaatagaggcaaactaaaaacatttaagcttttgcacggtaaaaaataa

SEQ ID NO: 31095 - DNA, 1539 bp, Glycine max
  Peptide Sequence Number=SeqID_147873
atggcttccaacaacaacagcagcagcagcagcatcatcgtccaacattgcaactactcttcatatgacgtgtttgtgagcttcagaggaaaaaaattcgtacatttaggggatgacacaaggctgaagaaaggggaacgtatactatccaacctcatgcaagcaattgaggggtctcagatttttgtcattgtcttctcaaagaactatgctttttcatcatggtgcttgaaagaacttgctaagatccttgattgtgttagagtctccggaaaacatgttctgcctattttttacgatgttgatccatctgaagtgcgaaatcagacgggggattatgagaaagccttcgccaaacacgaagatagagagaagatggaggaagtgaaaagatggagagaagctctcacacaagtagccaatctcgctggttgggatatgaggaataagtcacaatatgctgagattgaaaaaattgttcaagagataataagtaaattgggtcacaatttttcaagtcttccaaatgatctagttgggatggaatctcctgttgaagaattagaaaaacttttacttttggacctaactgatgatgttcgcattgtaggaatttgtgggatgggtggaataggaaagacaactcttgctactgttttatatgatagaatctctcatcaatttgatgctcactgtttcattgataatgtaagcaaaacttatagacattgtggccaaattggtgttctaaagcagctgcttcatcaaactctaaatgaagaccttcagatatgcaatctttaccacgcagctaatttgatgcaaagtaggctacgctatgtaaagagcattatagttcttgataatgttaatgaagttgaacaactagagaaattagttttgaatcgtgaatggttaggtgcagggagtagaatcatcataatttctagagacaagcatgtcttgaaaaagtgtggagtgactgtagtctacaaagttcaactcttgaatggtgctaattctcttaaattgttctgtaaaaaagctttcgattctgttgatatcacgggagattatgaagagttgaaatatgaagtcttaaaatatgccaatgacctaccactagcaattaaagtactaggttcggttttgtctggtcgaagtgtctcatattggagaagttacttggatagacttaaagagaatcctaacaaagatattctggatgtgcttcgaattagttatgatgaacttcaggatttggaaaaggaaatatttttagatattgcttgtttcttctgtggaaacgaagaattatatgtgaagaaagttttagattgttgtgggtttcattctgaaattggaataagagccctcgttgataaatcactcatagataattcaagtggattcattgaaatgcataatttgttgaaagttttaggcagaacaattgttaaaggcaatgcacccaaagagccaggaaagtggagcagggtttggctccacgaagatttctacaatatgtcgaaggcaacg

SEQ ID NO: 31096 - DNA, 804 bp, Glycine max
  Peptide Sequence Number=SeqID_147874
gcaaaggctcaaattgcaaagaagaatgaaagatatgttaagcaagccaacaagaacatgaaggaagtggtacttgaaccaggtgattgggtttgggtacacatgaggaagaagaggtttcctaaacaaaggaagtccaaacttcaacctagaggagacggacctttccaagtactagagaggatcaatgacaatgcttacagaatgatattccaggtgagtatggaggcaaatgctttccaagaagaagggaatgatgagaatcctaaaatttcccaaatacagggacctatgaccaggagtaggactaaacagtcagtggataccctccaacaaatggtaataggcatacttaacaaggcccaagtggagaaggatgaaggcctagaggattgtcatcatcaaaaagggggagattgtggaagcaatgacttccaagattattttgatgatgccaaagaatcaagagttaagcaagttccaaagaatcaggcttcaagaatcaagtctcaaagaatcaagattcaagagcaattaagtttcaagattcaagattcaagaacaatcaagatcaagattcaagagaagaaatcgagaagcaacaggtacatctacataggttgtaatactgagaacaagagaaggtacatctcttggggatcagttcaagtggagggtacatccacttggttgttcaaagagaacaagggagggtacatcccttgtggatctttggcttgtaaaggattttacaaggttgaaagaaatctcaagaaccgttggttgcttggggattggatgtag

SEQ ID NO: 31097 - DNA, 2274 bp, Glycine max
  Peptide Sequence Number=SeqID_147875
atggtgggtcccattattcgttctctctggtcctccaccagaaaatccttctcttcttcttcttcttctttttctccctctcctcctttatcccactcgcgcttcttctcacgcgccttcgccgccgctcccgccactgcccctgccgcagcaaccaccgcctcctccctcgaccccagccgcctccgcaacctggccgtgatcgctcatgtcgaccacggcaagaccaccctcatggaccgcctcctccgccagtgcggcgccgacctcccccacgagcgcgccatggactccatctcgctcgagcgcgagcgcggcatcaccatctcttccaaggtcacgtctgtttcgtggaaggagaatgagctgaacatggttgatactcccgggcacgccgattttggtggtgaggttgagcgtgttgttggtatggttgagggagcgattttggttgttgatgctggtgaaggtccacttgcacaaacgaaatttgttcttgcaaaggccttgaagtacgggttgcggcctattcttcttttaaacaaagtagaccgacctgcagttagtgaggagacatgtgatgaagttgagagcctggtgtttgatttatttgccaaccttggtgctacagaggagcaactagactttcctgttctttatgcttctgctaaagaaggatgggcgtctactacatttaccaaggatcctcctgctgatgccagaaatatgtcacagttgcttgatgccgttgtaagacatgttccaccaccaaatgcaaacattgatgcacctttccaaatgctggtttcaatgatggaaaaagatttctatcttgggcgaattttgactggacgcatattctctggggttgttcgtgttggtgacaaggttcatggattacgtaataaagattctggtgctgaaaaaattgaagatggaaaggctaatattttcatgtctagatatcaatcatgtcctttatcaactgtttatgaaagaggatctgtggtgaaactgatgaaaaagaagggtacaaacatggttctaactgattgtgctggagctggtgatataatttcaattgctggcctgtcaagtccagcaataggccatacagtggcaactgtggagattatgtctgctttgcccacagttgaattggaccctcctacaatttccatgacttttggtgtaaacgactccccactagctggccgtgatggcactcatttgactggggggagaattggtgaccgattgatggctgaagctgaaaccaaccttgccataaatgtgcttccaggcttatcagaatcatttgaagttcagggaagaggagagctacagctgggtattttaattgagaatatgagacgtgaaggatttgagttatctgtctctccacctaaagtaatgtataaaactgaaagcggtcagaagcttgagcctgtagaagaagttacaattgaggtaaatgatgagcatgttggtttgataatggaggccttgtctcatagacgagcagaggttacggacatgggtcctgtttcaggaactgttggtcgaactagattgtgtttgacttgtccatcaaggggcctggttgggtacaggagtgtgttcagcagtgacacacgtggaactggattcatgcatcgtgctttccatgcatatgaaaaatttcgaggcccgcttggcaatgtcaggaaaggagtactggtttcaatgggttttggtacaatcacagctcatgcattgatgagcttagaagctcgagggactctttttgtaactcctggaatggagagtttggaactcctaaagataaatttagaagaggattttaccgcaaaagaattgtttgctatcaatctagctatgatttttcttcccaaaagcacgttggtattttattctcaaattgtggctaaacattttgaccttggattgaggcttaaatttattcccaaaaaacacgaggcgtatgatggaatgattgttggagaacattcacgcgatacagatcttgatgtaagaagtattcttagtttgaatgtcaatcctgtaagggctaaagaacttacaaatatccgtgctgctaccaaagatgataatgtgaagctgactccccctcgccttatgacacttgaagaagctatagggtatgtagcttccgatgaacttattgaggttacaccaaaatccatccgtttgaggaagaaataccttgatgttaacaagcgtaaagccatgagtaaaaagccaaaggaatga

SEQ ID NO: 31098 - DNA, 516 bp, Glycine max
  Peptide Sequence Number=SeqID_147876
atggacaacgaccgcgtctcccgccgcaccgaggtcctcaccaaccacctcctccgccgcacacccccaccctccgcccttctccacccccacccctgccttagctactcccccccggagctctccaacaccatctccttcgacacgcgtgagatgcgaaaactaatggattgccacaatctggaggagcgcgactggatcttctctctcatcctccagagccccctcttcaacccccgccaccgcgccggaagggtgttcgtctcccccgactacaaccagcccatggaacaccagcgccaggccaccatgaagcgcatcggttatctcctccaaaaaggggtcttccgaggatggctcacgggaaatggccccgaacaagagctcaggaagctcgcgctgcatgaggtcattgggatgtatgatcattctctcgcggttaagcttggcgttcacttcttcttgtggaagagtgttgtcgggaaaaagtgtcctccctatcattcgtggaaatga

SEQ ID NO: 31099 - DNA, 765 bp, Glycine max
  Peptide Sequence Number=SeqID_147877
atgggtgcgtacagagcggacgatgattacgactacttgttcaaggtggtgttgatcggagactcgggcgttgggaaatcgaacctcttgtctcgattcacgaagaacgaattcagcttggaatccaaatccaccattggcgtcgaattcgccacccgcagcatccacgtcgatgacaagatcgtcaaggcgcaaatttgggacactgctggccaagaaaggatggagaatgtgattcacatttttctcggatatcgcgcaatcacaagtgcatattacagaggagctgttggtgcactgcttgtgtatgatgttaccagacatgtgacttttgaaaacgtggagagatggttaaaggagcttcgcgatcacacagatgccaacattgtaatcatgcttgtggggaacaaggcggatcttcgtcacttgcgtgcagtggccaccaacgatgccaaggcgtttgccgagagagaaaacacgttcttcatggaaacatctgctctggagtccttgaatgtcgataacgccttcaccgaagtgctcactcagatatatcgcgttgttagcaggaagactcttgagatcggagatgaccctgcagccttgcctaaggggcagaccatcaatgttggaagtagggatgatgtctcagctgttaaaaactactcattgcaattgcaatacttgcacaaatacagtgctcagtacacaggaaaaggattgcaagaaattacacagcttgaagcactcctatttttcagctaa

SEQ ID NO: 31100 - DNA, 441 bp, Glycine max
  Peptide Sequence Number=SeqID_147878
atgaaactgcatgatctcgttcccgtcgggatgcaccgcgtgttctcctcaatgccgttgctctcaatgagccctgcggtggcacgtaccttcactgcctcgcgaaactcctcaaattacgccatggtgtgcgacacggatatttctagctttgatgtttctccaaaggtggcttggagtggggttgttgtggttttgggggtggtggtgatggtgaagaagaggggtggtggaagaaaggggttggaggaggaggaggaagatgggttttcggagaaggtttggcatggagggtttgagaatgtgtttcaaggggagttgagtgatgcttcggttgtggtgctaaagaggttggagaggccaaggggtggggagaaggaatttagggttgaggtgtccacaactgtgttccaaacacgtcttttttacctttttttataa

SEQ ID NO: 31101 - DNA, 192 bp, Glycine max
  Peptide Sequence Number=SeqID_147879
atgagggaagccgatgatggtatagagaggccggccaagtacaaaagtgagagaaaagagaagggcatactgggaaatggctccttggaaaggtttctagcaggagtgggattgaagggcaggggggggaggggggtgagagggaagggattgaatgtgagaactgagaggaaagagattgtgtggttctag

SEQ ID NO: 31102 - DNA, 633 bp, Glycine max
  Peptide Sequence Number=SeqID_147880
atgagaagagccttagatccaggattaaacactcctcatcagggagctagtgtttcaaattctcatgaagagggtgtaggtggaataggattttcaagtcttatcaacgaattgattaaaaaatccaatatcggtattctttgtcttttagaaaccaatgttagtgggaataaagctcgtaatattatcaataagttttctttagatatgtcctacgtggttgaagcacagggacaagctggaggtatctggtatttcacttctatctatgcaaggccacatgttcaatcatatagagctttggagacatctaagtcagtagcaaacaatcagatagcagatcagattgatggtccttggagcttatttggagatttcaatgttctactccaagaccataagcattgtggaggatcccagagagctttgttatgtggggatatggcttttcagaattttgtccaggactaccaccttatggataaaggatatcaaggggaagggaagaatcaaaagaattctcaggcggttagtcctttgaattctcttggaaagagagaagggagacacaaaagaattcaggcggttagtccttctattcttttggcaaagggagaagagaagaaaagatag

SEQ ID NO: 31103 - DNA, 775 bp, Glycine max
  Peptide Sequence Number=SeqID_147881
gagtactaagaaagtcaagacgaaggatagagatgaagtgcgagatgaggctatgttgatagtgaagctgagtgcgagaggaggctatgttggtagtgaagctgaggcaggcaaggtgactacacccacaaagaagtttatggagaaactctttgagatcaatggaggaatagtattcacagattttactagtcttatgaaagagatgattgatacaaaaaggcatctaggatatcaaatatacaattacaagtcaccaatcttaatgtacaagcttgatccatgtcctactattctgattaccctagaaaagtttaaggagcagtgtggatctaggaaaaaaatccctaatgttagtgtattagggaaacatgttgcttttagaatgattgaaaacaagtttcaaaagaagtgggctaaaaagagtggttcaaagcatccatttttcacggtgattgagaaggagggtggaagcaaatggggtggtatgcttaggataggaaaattaacatctatcccttttagaagtcattcttccaaaatctgtgtggagattgacctaggcagaaaacttgttcctcaaataaacgtgctacgtcatatcatcaaattggagtacgaggggctacattcaatttgttttaactacgagaagtatgtggaagtaaggaagaagaatgatgacgacaaccctaatgctgaggtgggatcaaaaccaactgtggcatccaatcatattgggggtgagtcagcagggttgtataggcttggatga

SEQ ID NO: 31104 - DNA, 312 bp, Glycine max
  Peptide Sequence Number=SeqID_147882
atgattatgaggggccaagacatttatagtagccaagatgaggctactacttttccttcctctagtgaaaatgaagaagcaaaaggggaagaatctagtgaagagatctacccacaagaagaaggacaacctttattggttaaggagaagtgtaaggaggcaagtgtctcctccaagaggaataatcaacatgaaaatacagaaaaaggggttcccataaactctaagagaataaaggtcattcctgagtggcccgctccaccaagtgtgttgaggaaacaagcccagagtttcaagaacctcgggatttga

SEQ ID NO: 31105 - DNA, 255 bp, Glycine max
  Peptide Sequence Number=SeqID_147883
atgtatccggaagaaattttaggcacagaaggaggaaggtataatggtataatattaaatgatttaggtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtggatataagtccaggatcgccagtaataactga

SEQ ID NO: 31106 - DNA, 294 bp, Glycine max
  Peptide Sequence Number=SeqID_147884
atggcggaaaaggctgacggagaagtcttccggaagacccaaccttttccggaaagtttccggaagaagtgttcttccggaagtaaccaaacgtcttccggaagaacacttcttccggaagacttccggaaaacgtcttccgggaactttccggaagaagtggttcatccggaagaattccggaagacgcgcacttccggaagaagtttcaaagttccggaagacctttccggaagaaccccttcttccggaatgtttctggaagaaccacttcttccggaagtgattttatga

SEQ ID NO: 31107 - DNA, 573 bp, Glycine max
  Peptide Sequence Number=SeqID_147885
atggctccgaaaaagctttccacaaagagatctaggagggacgccgcggctgaagggaccagtgccgccccagagtttgatagccaccgtttcaggagcgccgagcaccagcagcgcttcgaggccatcaaaggatggtcgttccaccgagagagacgcgtccagctctgggatgatgagtacacggattttcaagaagagatagctcgccgacgttggacgtcgctcgtcactcccatggctaagtttgacccaaatatagtcctggagttttatgctaatgcttggcccacagtagagggagtgcgggacatgcggtcatgggtgaggggtcagtggattcccttcgacgcagatgccctcagccagttcctaggtgacccactagtgttggaggaaggtcaggagtgcgagttcagtcagaggaggaatagggctaacgggttcgacgaggaggccattacccagttattgtgcacaccggggcagaatttcgcctggaccgctgccggggacgggtgcggatcatgcagggaaggtattagcaccccacgcgtctgtcacaagggatga

SEQ ID NO: 31108 - DNA, 156 bp, Glycine max
  Peptide Sequence Number=SeqID_147886
ggaatcaattcgtggggctacggacacgatggtggaggatacatgaacgacaatcaattcatggggctccgaataagatttgatgatggaggatgtacgaacagcgctaggcaatcaattcgtggggctccggactcgatggtggaggatacatga

SEQ ID NO: 31109 - DNA, 879 bp, Glycine max
  Peptide Sequence Number=SeqID_147887
atgactttattaattctttgtgctttcccgtttttcttccttaccacagtgagacataccgatatttcgatcttcccttttgctcaccaggttgctaatgtggaagaaaagagggaagatcttggtgaagttttgaacggtgatcgattagttgttgctccttacaaattggacttccaaattgacatagaacctgaaagtatctgcacaaagaggcttacaataaaagaggttgctcaattcagacatgctgtcttgaaggactatttctaccaaatgtactatgatgacttgcctatttggggtttcctaggaaaatttgacagtgaagacaaggatgatcaaactggggccatagtccatctcttcaagcatgtccattttgagattctgtacaacaaggatcgcatcattgatgttttcattcaaaatgatccacaagcagttgtggacctgacagaaaataaggaagtagaagtggacttcacatattctgccacatgggttgaaacagatactccatttgagaagaggctggagaaatactcacagacatcctcactgtcacataacttggaaattcattggttttctgtcatcaactcttgtgcaactgttctcctcttgactggattcctggccataattctcatgcgtgtgctcaagaatgattttgttaagtttactcctgatgaggaagcagttgatgaccaggaggaaagtggatggaagtatatccatggtgatgtgttcagcagcacttggaacaggaacccagctatttacactgggagctttgtttactgcactggtgatcatatatgcactaacgtctggcattgcgggctactatgcagcttccttctactacatgattga

SEQ ID NO: 31110 - DNA, 471 bp, Glycine max
  Peptide Sequence Number=SeqID_147888
atgtcgcttctctgcttcccctcaatactatctattttctgtttcttcagtttcgtaaccgccgccaccgagttcgacttcggaacgttaactttgggaagcctcaagctcctcggcgacgcccacttaaacaacgccaccgtcagcctcacgcgcgacctcgccgttccaacctccagcgccggcagagccctttactcccgtcctgtcagattccgccaacccggaaaccgttttccggcgagcttcaccaccttcttttccttctccgtcaccaacctcaacccctcctccatcggcggcggcctcgccttcgtcctctcgccggacgacgacaccatcggcgacgccggcgggtttctcggcctcagcgcagccgccgatggcggaggcttcatcgccgtggagtttgatacgctcatggacgtggagtttaaggacattaatgggaaccacgttggtgtggactaa

SEQ ID NO: 31111 - DNA, 522 bp, Glycine max
  Peptide Sequence Number=SeqID_147889
atggcaaaggcacgaactgttggagtagccgtggacttttctcctaccagcaaattagcccttcgttgggccgttgataatctcatcaacaaaggtgatcaaatcatcttgatcactgttcagcctccccaagctcatcacacccgaaaggagctttttgaggacactgctttggttcctctggaggaattgagggagttgaattttactaagcaatatgggattgctagggatcctgaggtcataggtatccttgacactgcctccaagactaaagggttaccatgggaagaaattaagtatggtgcaaaggcagtggcaaaggtgtactggggagatccaagggagaagttgtgtaatgctgtggaagatcttcacctggactctttggttgttggaagcaggggtttaggtcccattaaaagggtgttgttgggcagtgtaagcaagcatgtgatgacaaatgcttcttgccccgtcacagtggttaagggaaaacaatcttccaattcccgtcattaa

SEQ ID NO: 31112 - DNA, 414 bp, Glycine max
  Peptide Sequence Number=SeqID_147890
atgccctttgtttacttggggattccactaggggcttttctgaagaggattcgaacttggaaaccggcgctgcaaaaactaaagaggaaaatggctccatggaagcaaaaagtgaatggaggtctaggtttaaaaaatgtggagttgtttaataaggcgttaattgtgaaatggaagtggcgtctacttgaaaaggaaaagacaatgtgggctaaaatactaatagctaaatatggtccagtatggaggaaggtgaaaaaaggatgtaacaatgcttcaaatggaattttgggaggaaggtcgatggaattggaaatcacagtggaagagaagtttgagggaatgagagctagagttagaagtgcaattgatggccatgctaaagagagccaatttgaaggtggaaggaagtga

SEQ ID NO: 31113 - DNA, 1461 bp, Glycine max
  Peptide Sequence Number=SeqID_147891
atgaatctcgacgtggacaagtatttgaatgattttatgtatgtggggttctctgcttcaacgcaaggtagcaccgagattcacagaatagagtggtggagttttggctcgtcttttgcggcggcggcggcggtggcgcctcctccgccggcggtgagcttgatgaacccgacggagaattcggtgaagttcgcgcctcctccttctttggctccttcgcatagtgaagagaaagagagcaaaagcaaatcgtcttgccataatgggttgtgtaagcaaaacatgggagcggttgctggtgttgttactgctggggcatttgttttggctctttttgctggtgccttgatttggttttactctaagaagtttaagcgtgttaaaaagtttgattcacttggttcggagatcattagaatgccgaagcagtttagctacaaggagctgaattctgctaccaagtgcttcaatgcgaataggatcattggtcatggcgcgtttgggactgtgtataagggggttttgccggagaatggggacattgtagcagtgaagaggtgcagccattgtagtcaggggaagaatgagtttttgtctgagttgtctatcatcgggagcttgaggcatcggaatcttgttcggcttcaagggtggtgccatgagaaaggggagattttactggtgtatgacttgatgcctaatgggagtttggataaggctttgtttgaggctagaacgccgcttccctgggctcatagaggcaagattttgttgggtgtggcttcggcattggcctacttgcatcaagagtgtgagaatcaggtgattcatagggacattaagactagtaacataatgttggatgaagggttcaatgccaggttgggagattttggtttggcgaggcaaactgagcatgataagtcgccggatgccacggtggctgcggggacaatggggtacttggcacctgagtatcttcttacggggaaggctacggagaaaactgatgtgtttagttatggtgcagtggttcttgaggtggccagtgggagaagaccgatagagaaggatgccaatgggggtggtaaaggtgggattagctgcaatttagtagaatgggtttggagtttgcaccgggaagctaggttgctaatggctgctgatccgaggcttgagggcgagtttgatgaaggggagatgaggaagatgctcttggttgggctagcttgttctcaccctgacccattgactagacctactatgaggggtgtggttcagatcctcgtgggtgaggctgaagtgcctcttgtcccaagaaccaagccgtccaccggttttagtacttcccactcccacttattactgagtttgcaagatagtgtatctgactgtgatggtataatcaccatctctacctccacatcagagaacagcttcaatcttggagatatagtctga

SEQ ID NO: 31114 - DNA, 369 bp, Glycine max
  Peptide Sequence Number=SeqID_147892
atggttctgtcgaaaaccgcgtcggagaaagacgtctctattcattccaccttcgcctctcgctatgtccgcacctctcttcccaggttcaagatggcggagcaatcggttccgaaggaagcggcgtaccaaatcataaacgacgagctaatgctagacgggaatccgaggctgaacctggcgtcgttcgtgacgacgtggatggagcctgaatgtgacaaactcatcatggctgccattaacaaaaactacgtcgacatggatgagtatcctgtcaccactgaactccaggcaagtcccacactaattcattattttcaatcatcagagataaaattttcatttaatcaatttctcacatgcggttag

SEQ ID NO: 31115 - DNA, 1455 bp, Glycine max
  Peptide Sequence Number=SeqID_147893
atgcgaacaacttttttgaaaagtaatttgaagccctgtgccgggttaaaaaattttctgaaggattattttcttagatcaccatttttgaatctcaattccaaatatggaagcaatgttcctttgcttttgatgaattcattcaacactcatgatgacactcaaaagattgttgaaaaataccaaaactcaaatattgagattcatacttttaaccagagccagtatcctcgattggttgttgaggactttttgccattgccttccaaagggcatactgacaaggatggatggtaccctcctggccatggtgatgtcttcccatcattattgaacagtggcaaacttgatgcactattgtcacaggttgatcctagagctcaagttgtttctagtttgactggtaaagagtatgtgtttgttgccaattcggataacttgggagctatagttgacttgaaaatcttgaatcatttgatccagaacaagaatgaatactgtatggaggtgactcccaaaacattggctgatgtaaagggtggcactttgatttcttacgaaggaaggctcctggaaattgcacaagtccccgatgaacatatattcattattctcattgatgatataatgtttgtgatggtcaatgagttcaagtcaatagagaagttcaaaattttcaacacaaataatttgtgtttgacaataatctacaggtgggtgaacttaaacgcagttaaaaggcttgttgaagctgatgctcttaagatggaaattattcccaatccaaaggaagttgacggaataaaagttcttcagctggaaactgcagctggtgctgcaataaggttctttgacaaggctattgggattaatgttcctcgatcacgattccttcctgtgaaggcaacttcagatttgcttcttgtccagtctgacctctacactttggaagacggatttgtcattcggaacaaagctagggaaaatcctgaaaacccttctattgaactgggaccagaatttaagaaggttagcaacttcttgggccgcttcaagtcaattcctagtatcgttgagcttgacagtctaaaagtggctggtgatgtatggtttggagctggtgttatcctcaaggggaaagtcagcattgtatcaaagcccggtgtaaagctggaagttcccgacggtgttgccattgtagacaagcgcccctacgggcagtgtttggtggcggggataaataagtaccctgcgaagaagtcgcgcgtgaaggcgttggtgaagctcgtcaactaccagcacctcatgcccacgcgctacacgcttgacgtggacttgaaggacgcggttaaccccgacgttctcaacgctaaggataagaaggccactgctctcaaggagaccaagaagctgctcgaggagaggttcaaaaccgggaagaacaggtggttctga

SEQ ID NO: 31116 - DNA, 537 bp, Glycine max
  Peptide Sequence Number=SeqID_147894
atgttcaccaatgaccaaaggcaacaagaacgaactgggagatatggaacttccagagtggaattccttcagaaattggtgactcagtttcagaacacatctgaggatgaaacaagagagaaaattttagcaaatttggccaactttgcctatgatccttacaactacaacttcttgcgtcagcttaatgttttggaacttttcgttgactgcttaactgaacccaatgaaaagcttgtagaatttggtataggagggatctgcaattcttgtgttgatccggccaattctgcaattgtaactacgtttggtgggatacctcttataatccaatgtttatcaagcccagttaggaacactgtaaattatgcacttggggcactttattatatctgtaacgaatctaacaaggaggagattttaaggcccgaagttgttgatgtcattaggaggtatgcagccgctgaagaagttagtgtgagcttcagtaatctggctaaagcttttctgagtaaacatctggccgagaactactga

SEQ ID NO: 31117 - DNA, 222 bp, Glycine max
  Peptide Sequence Number=SeqID_147895
atggaggaagatgaagaaagggtgagcgaaaaagcgggtttcgcgagaatcgagagagaacacagaccttttgatcgcgcaatcgcgttggttttgatctggtggtgggtggaaaatggaaatgttgagattagagagaagaaaccaagtctagatgtgggtgcctcagcaaaccagggaaaaaaatataaacaccggtcggtggagacgatggatatttga

SEQ ID NO: 31118 - DNA, 570 bp, Glycine max
  Peptide Sequence Number=SeqID_147896
atgtacgctgccacaatgggtattgcgatcaagggccgaggttccacgtcccaccttgccgggcgctttgaaagcaccgtcagcgaggcggtggacgacggctgggcggtggacgagagcgaggagttccttgccccgcgcctccgcaccgaggtgcgtgccgagaccgcgcgtagcatcatcacccgcaacacctcgccggacgtcggcttcagccagtcggtaaatccctaccgcggctgcgagcatggctgctcctactgcttcgcgcgcccctcgcatgcctatctgaacctgtcgccgggcctggacttcgagaccaagctgttcgccaagaccaatgccccccagctgctgcgcaaggagctgtcgaagccgggttacgtgccgcagccgatcgcactgggcatcaataccgatgcgtaccagccgatcgagcgcaagttcaagctgacccgccagctgatcgaagtgatgctggagaccaagcatcctttttcgctgatcaccaagaacgcactggtcgagcgcgatatcgatctgcttgcaccgctggcggcggagaacctg

SEQ ID NO: 31119 - DNA, 292 bp, Glycine max
  Peptide Sequence Number=SeqID_147897
atgggaacaaatcaaactggaaaaagattctatcaagtcaagattaagggcctagatgtcaccaaccttaaggagttggggcggttgatgggacctctccaaatgcaagccttccgcaaggcgtacggaaagattttagatttaaccatagcggagatattcacggaagtcgttgggttcggcatgagagttggatcgtgtaaagaaaactcgaaacggcgtagtgggcctaccacggaagtacttggaaaggcaaggcaagggatatggcgaatcaagaggagtgggtccc

SEQ ID NO: 31120 - DNA, 234 bp, Glycine max
  Peptide Sequence Number=SeqID_147898
atggtaagaaccgctgttctgttagtattgtatatgcatagatctcccataggcaatttagttcctctggacttacaaattgaagctatgttgcgaaggaacagggccgagaggagaaggaaacttctgcaaaacagaacagttgcatccattcttgaggaggagactcatttctccgacttattatcacctgatttaccatcatcaagcggaatctgccactcaattacctga

SEQ ID NO: 31121 - DNA, 1108 bp, Glycine max
  misc_feature (13)..(13): n is a, c, g, or t
  Peptide Sequence Number=SeqID_147899
atgtatagttttntggaagataccggaataaaattccaaattgaaatccacagcgctcctgtttgggtgaaagtatggtatcttgatcctgaaattttccataccgcccctatgttttttctatcaacagatgtaccggaaaatgaccacgtttcaaaaacaatctgtcataaactatatgatgccaatgaatcgacaaagctggctcaatatatattactgggaaaaggaggtgcccaattactggacgaaatgaatctggaaagagatatttatcatctgaatgaagcacatgccctacccgctgcattttatttattaagaaaatacaatggagatttaagcaaagtaaaagagaaacttgttttcacaacgcacactcctgaagaagcgggaaatgaaaaacataatctgaaattatgttatgacatgtcttatttttcaggctttagtatggaagaagccaaaagcatagaaggagtagatgatgaacgtttcaatcattctctttgtgcattaaaaatggctaaagttgccaatggtgtttcacaacttcacggtgtggtttccagagcaatgtggagtaaatatcccggaatttgcgaaatcaaatcaatcaccaacgcccaggaatttaaatactgggcagataagcgcctctacaactccaaagatgaaagagacgatcaggcatttgattaccgtaaaaaatatttaaaaaagagactctttaaaatcgttgccgatcaaacaggaaatcttttcaatccaaacatttttactatagtctgggcaaggagatttgcaggttataaacgtgctgatctgcttttgcacgataaggacagattttacaagttattgaataatcctgaacatcctgttcagataatttgggcagggaaaccctatccaatggattattctgccatttctacgttcaatacactggtagaagaaagtaaaaatcataaaaacatggctgtccttacaggttatgagctttctttaagcaaatcactaaaacagggttcagacctatggttgaataatcccagggttccaagagaagcttcaggaacttcaggaatgactgcagctatgaatg

SEQ ID NO: 31122 - DNA, 699 bp, Glycine max
  Peptide Sequence Number=SeqID_147900
atggcaagagtagccaaggtaggtaagatcatggtacaagagttggaccatgtgaagcaaaataggaacgaggtagtcagaataccaaggaaacatttggagggaaagacgaagacattggcagatcaaggggaatgggcctcgtttattgatgccttcgcactattgatatttggtgtcgtcctttttccaaatatggagggattagtggacctagccgcaattgatgccttccttgcttatcaccatagcaaggaaagcccggtcattgttattttggccgatgtctatgacacggttttgttctcatgcgaaggatttccaaatgttcccttgatgggaaaaaggggttgtatcaattataatcccgtcctcgccataagacaactcagctaccccatgagaggagcgccattggaggaaagcatcacgcctttcatcgcccggggttttagtgaccccaatgcgagagtacttcaaggagctgcaagagaggaagaggctaaaactctggaggagagtgaggaagtgcaaaccctaaaggcggaacttgaaaaagcccaagtagtcaaagagaagttcaaatcaatggccatcaaagtttggaaagagtatgatgaactaagggacatcaatatggccatcgccgaagccctggaacgagaaaccaagagggcccgaaaggaagaacatggctaa

SEQ ID NO: 31123 - DNA, 345 bp, Glycine max
  Peptide Sequence Number=SeqID_147901
atgaccggacacgattggccattggattttttgtttcctacttacaggtacatagggacggatgcaagtggggatagggtcacgaccgaccgatcgttgccccttcccggcgctaaacaagcaaagaacatcgctgcaaggcagcccaagatggccccgaggaaacttgcctcaaagagatccaggaaggataaagcggccgaaggaaccagttccgctcccgagtatgacagtcaccgctttaggaccgctgaacaccagcaacgcttcgaggccatcaagggatggtcatttctccgagagcgacgcgtccagctcagggatgacgagtataccgatttctag

SEQ ID NO: 31124 - DNA, 1311 bp, Glycine max
  Peptide Sequence Number=SeqID_147902
atggcgatacaaggccaaaatgcatttactagatcacagggtggtcttccaattggagatgaaatatctttcaattctggtgtgcattctgttgcagatattccactacatgatcagttatcttgtggaaatgactatgccttgaaggttaggaaaccatatactatcacaaagcagagagagaggtggacagatgaagaacataagaagttccttgaagccttaaagctatatggcagggcctggcgacggattgaagaacatgttggcacaaagactgctgttcagattcgaagtcatgctcagaagtttttttctaagattcttcgagagtctagtgggaacagtacaaccttggaggagtcaattgaaattccacctccgcgaccaaaacggaagccaattcatccttaccctcgtaagctagttgagtttccaaagacaggaatttccaactcagaacacccactgaggtctaattctctgaagtcatcagattttggtcaagaaaacaattctcccaagtcagttttatctacagttgtttcagaaactgttggttcctccgattcagatacatctagtcgatgtttgtcaccagcctcatccattagtggtgtccccacaaacagatttccacttgctgagcccaaaacatcatttaaggaagaagggtctgcaccaagttcagctcatgatgagcaacctcctgtgaaactggagttttttcacaaagaaagtgtttctaccagagatgatgcaacagaagaatcatctggtcgtactctcaaactttttgggaccactctactggtaacagacacatgcaaaccttcttctccaacaacggagccgtgcaaaccaacacctgcggctgcaatgtatcttatgcaacttcagaatgtttgttcagatgttacagaaggtcatgcttctattgttccttggtggactcttccccacaatactccatttatgccactgcacaaggagccaaaagggaagcatctatattctaatcttggagagtttgaacataaagaagttcaaaaggaaggatcatggactggttcaaacactagttcaattgatgatggagataacactgaaaaatcagatgatcaagccaaaagtcatgtacatggttttagcaaaagtgaaactttaactatatctgagctaagggtgaggcctaaaacatgtggaaaagggtttgtaccatataaaaggtgcatggcagagagggaaaaccagtgctcatcagtatattatgaggaaagggaagagcaacgtattaagctttccttatag

SEQ ID NO: 31125 - DNA, 1113 bp, Glycine max
  Peptide Sequence Number=SeqID_147903
atgttaggggcggtgcagttggggctattagcagcgtgtgtggttctgtttgtgcctatgggcatggcagggtggcacttgagtcgcaacaaggttctcttcttcagtggcgcacttttcataactctcgcagttggggttcacctcacaccttatttcccttcggtttctgatttcgtcacatcggtttcctcgtcttccgtaaacgttgtcgtggacgatcgcgattcgtgtgtttccttgcttcacgagattgtctgggaggtgagaccaagaagggtgtttgactttgagttaaatgacaacaacaattccgtgaattacgacaagtcttggtcttggaagagatcaggttccgttgattcgtgtgagtttcagaggctcaaacggtacgacgtttcggttttgcttaatgggtcttgggttgtgatcgctggggactcgcaagctcgaatctttgcgctgtcgttgctgagtttggttctggaaccggagggtatggaatctgttaaagggtctttgttcaagaggcatagtgattaccacaccgtggttgatgagattggaatgaagttggatttcatgtgggcaccttatgtcaccaatttgactagtttggttgctgggtttaagaggaatcgcgtttatcccgatcttttggtgatgggttctggattgtggcatatgctgcacttcaccaatgcttcggattatggtttctctttggggcttttgaggagttcagttacttcattgctgccggtgtcatcggaatttggcaacgatgaggctgtggcggtttctgcatcggttagatcccctcacttgttttggctcgggatgccaactttggtgaactcaatgttgaatacaaaggagaagagggagaagatgactgatctaatgtggggagaatatgaaagagaggttcagggaagtggcatgttgaggcagtttgggggtccacttcaactggtggatatagggtcattgagtaggaattgtgggatcaagtgtacagttgatgggatgcattatgatggggttgtttatgaggctggagttcagattttgttgaatgcattgcttattgaatctcatcagaggctatga

SEQ ID NO: 31126 - DNA, 501 bp, Glycine max
  Peptide Sequence Number=SeqID_147904
atgagcaagcaaaagctgttgaattttttgagtgttgatatatcatttgtgcagttgcatttgtgttatggtccagttatcagtgattcagtgtgggagttaagggagtgggttacatgtaatttggaaacttatcgacgggtggcatcgaagcttaagcttggaacttttgaagatgaatatatggaaaatgttagttcagtcttgattaaatctccacaaagtccaggggatactgatgttacgggacaagtgaagactggtaggattcctgttcgtttatatctgtggactgtcaatgaggagtttgatgattttgaagatgctccacaaattgataattgggacaaagtctcatatatcaatcgacctgttgagatttataaggaagatgttgcatatggtaaagtgaatagtcatcatgttgtcaatggtgtccgggcaaaaagcagccataattttgtgaaggtggagtggtgggcaatagggaaagaaagataa

SEQ ID NO: 31127 - DNA, 666 bp, Glycine max
  Peptide Sequence Number=SeqID_147905
atgtcaaagggtgacaaggttgaggttttggacttctgggctagcccattttgtgcaagagtgaaagttgctttggaagagaagggggtgaactatgtagccagtgaagaggatttgtttggaggcaagagtgagcttctcctgaagtcaaatcctatccatcaaagggttcctgtgctcttgcacaatgacaaacctctagccgagtcttctatcattgttagctacattgatgaagtctggtcttccaacccactgcttccaactcttgcttatgatcgtgcccaagccagattctggactgattacattgacaaaaaagtatttgaaaccgggaggagtatctggggaagcaatggagaagagagagaagtgggcactagggacttcattgaagttttaaagcatcttgaggaagccctaggggagaagaactattttggtggtgatgcctttgggtatgtggacatcatagccattggtcactcggcttggtttttggcttatgagaagcttgggggcttcaaagttgaagaccattcaccaaaaatctcagcttggattaagaggtgtttgcaaagggaatctgttgccaaagttctgccagaccctgagaaggtctaccagtttgtccttcatttcaggaagatgttaggacttgaataa

SEQ ID NO: 31128 - DNA, 2532 bp, Glycine max
  Peptide Sequence Number=SeqID_147906
atggcttctgcaccagccttaaaacgcacagattctgttgtagataatatgccggatgcattgaggcagagccggtatcatatgaagaggtgcttcgctaagtaccttggaaagggtaggaggattatgaaacttcatcatttgatggaagaaatggaactagttatagatgacaaaagcgaaagaagtcaagttttggagggcattcttggcttcatacttagctccacacaggaagctgttgttgatccaccatatgttgcctttgcaataaggccttatccaggagtttgggaatttgtaaaagtgagttctgaggacctttctgttgaggctattacccccacagactacctcaaattcaaggaaagggtacacgatgaaaaatgggcaaccgatgagaactcatttgaagcagactttggagcatttgatttccaaattcctcagttaaccctctcttcttcaattggaaatggactccaatttacttccaaattcttaacttcaaagttaactgggaaattggagaaaacacaggctatagtggactacttgttaacactgaatcatcagggagaaagtctgatgataaatgaaagtctgaactcctctgcaaagctccagatggcacttgtagtggctgatgcattcctctcaggacttcccaaagacactgcatatcagaattttgaacttaggtttaaggaatgggggtttgagagaggatggggagatactgcaggaagagtgaaggagacaatgagaactctatcagaagtactccaagcaccagacccagtgaacttggagaaatttttaagcagcttaccaataatattcaatgtagtcatcttctctgttcatggttattttgggcaagcagatgtccttggcttgccagacacaggtggccaggtagtttacatattggaccaagtcaagtctttggaagcagagttgcttctgagaatcaagcaacaagggctaaatgtgaaacctcaaattcttgtggtaacaaggctcattcctgatgctcggggaaccaagtgccaccaagagttggaaccaatcagtgataccaagcactcccacattctacgtgtgccttttcagacagataaaggaatcctgcatcaatggatttctcgcttcgacatttacccctatcttgagaggtttactcaggcatccaagattcttgagttcatggaagggaaaccagatctagttattggaaattacactgatggaaatttggtagcatcactaatggctagaaaacttgggataactcagggaactatagcacatgctttagagaagaccaagtatgaagactcagatgtcaagtggaaagagttggaccccaagtaccacttctcgtgtcaattcatggcggatacagtggcaatgaatgcatctgatttcatcataaccagcacataccaggaaattgctggaagcaaagatagacctggacaatatgaaagccatgctgcatttaccctcccagggctgtgtagggttgtttcagggataaacgtgtttgatccgaagttcaacatagccgcgccaggagctgaccagtctgtgtatttcccttatacagagaaagaaaaaaggctctctcaatttcaccctgccattgaggaccttctctttagtaaagtggacaacattgagcatattggatatctagctgataggaggaagccaatcatcttctcaatggcaaggcttgatgttgtgaagaacttaaccgggttagttgaatggtatggcaagaacaagagactgagaaatttggtgaaccttgtcatagtaggaggcttctttgacccttcaaaatcaaaagatagggaggaaatggcagaaataaaaaatatgcatgacttaattgataagtaccaactcaagggtcaatttagatggattgctgctcagactaataggtatcgcaatggagagctctaccgttgcatcgctgacacgaggggagcctttgttcagcctgctttgtatgaagcatttggattaactgtcattgaagcaatgaactgtggcttgcccacttttgctaccaatcaaggaggtccagcagaaattattgttgatggggtctccggcttccacattgaccccctcaatggagatgaatcaagcaataaaattgctgatttctttgaaaaatgcaaaatgaatcaatcacaatggaacgtgatttctgcagctggattgcagcgcataaacgaatgctatacctggaagatttatgcaaacaagatggtaaacatggggaacatttataccttttggagacaagtgaataaggaacaaaaggaggcaaagcagagatacattcagatgttctataatcttatattcaagaatttggttaagactgtacctgttcctagtgatgaacctcaacaaccagtgggcaagcagccgagtctcaaatcacgtagcacgggacgttcacattccagattgcaaaggttaggctattacatagcacttattaattag

SEQ ID NO: 31129 - DNA, 1935 bp, Glycine max
  Peptide Sequence Number=SeqID_147907
atggcacctgttttgcctcccggtttcagattccaccctacagacgaagaacttgttgcttactaccttaaaagaaagattaatggacgaaagattgagttggagatcatacctgaagttgatctctataagtgtgaaccgtgggacttgccagggaaatcattgttgccgggaaaggatttggagtggtatttctttagccctcgagacaggaagtacccaaatggatcaagaacaaaccgtgcaactaaatctggatactggaaggccacagggaaggatagaaaagtaaattcccaggctcgagctgtaggtatgaagaaaaccctagtttattatcgaggaagagcaccccatggctctcgtacaaattgggttatgcatgaatatcgtcttgatgagagagaatgcgaaaccaattcaggcttgcaggatgcatatgctctttgccgtgtggtcaagaagactgcagtgattcctccaaaagttggggggcactatgttaatgttcccaatgcgaacaagattacaagcgatcaatcatcaagcattgaactatactctgaaggaaggcacgaagatttagatagctcaaactatttgatgtccatggatatttgctcaccctgcaacatgggaaatgatcagacttctctcacaatcaatagtgggatgacaagggatcttgagaaatggtcacacttctcatcacaagacccattatttagtcttccaacttcttcatcattttccaattttggagccatagcgtaccctccatccaaggtggatatagcactagagtgtgcaaggatgcagcataggtttgttatgcctcctttggaggtggatgacttccctcaagttggagtctcagagctgaaaatggcacaagcctccggttccatgcaaggaagctgcagaactgaaacagatatcttgcaggaaattctttcagttgctcaagtttctcaggaattaataaaccaatctagctactcacaagattggggtggcaatgataattatgctcctcgtgaagatgattttaccttcatggttggcactaattacaatcattcaaatgaaatgagctcaatgagatatgttgacaagacatgggaagatgcaataaacacaaggacaatagagatcggagatgtggatgaagaatttaaggaagagaggatggtagagaatttaagatgggttggaatgtcaagtgaagatttagaaaagatgcaagaacaaaagatagtcccaatagaggatatttcaagcttccaaacaaacagggaagaaaatgaggtgcaagaatctgagcaacaaaacaacaaggaacacaatgacactgaaatcaacgatttctcattgggcttcatcaatgacgatgaccctaacaagaacttcatagaagatggtaacatggacgattattcaagttctcctagctttgaggtcgttgaggaaataaaggtcaatcatggaatgcttgtttcgactcgtcaagtagtggagacattctttcaccaaatagttccttcacaaactgttcaagttcacctcatcaattcagtgatggcacacaatcattatgtggagaatgcagaggcaatgctaatgataatggagaaccaagggtctttattaaggaataaggttaaggcctatgtgatggggaagcttataaagccttccaagacaatagcaagtgcaattgtattcatctttgcatttgtgttgatgcattgtgtttatttgaaggaagaagtggaaatttggaatgagtcaaataatgaggtttggtttgttggtgtcaaaagtcatgatgagaaaggactgagtgcgatcttgaagaaaataggcatttttctcaccatatctttggctctttgtaccatgtgggctaaccagaatatgatagttaacccttga

SEQ ID NO: 31130 - DNA, 474 bp, Glycine max
  Peptide Sequence Number=SeqID_147908
atgctaaagatcaacaacacccataaaaccctaaagcccattttcttcacaccaaaaacccttgatttcgacaaacaccaaagtctattgcagcggttcaattaccctcttacttatcttcgcagcaacaacacctttcctctcaatgacgaaggcaattggtggtgtcacatggtgtttgaggaagaaggagaggattgtttgagggaggtggagaataagaacatgatccctatgcttatacttctgcttccaccggagttgttgcctcatagatctcacatcaacagatttgatgaattttgggttgttggtggtgttggatcgggttccatagtggttgctagggttgtggtgtgggttgtgatgtggagggtgatgagatgtagtcatgggttttgttggggtggagacaaaaaagtaggaggaggattaagggtaataaagaaagaaggatacatgttgaagccttga

SEQ ID NO: 31131 - DNA, 1260 bp, Glycine max
  Peptide Sequence Number=SeqID_147909
atgtctgggacattattatgggttgtttcctcccctggtttagaggtttcccattccagtgggttacttgattctattcggagtgtgaagttcttagattcctcaaaggccatgtctcgagattttgggtcgattagagcgaagctgggtaaggaaaagggatggagactgtgctctttgagtacagatatgaagtacacatgtgttggtcggtctggcttagaaagtgctagcaacttccctctgatagccaatgtgcttgtaaacccagcagcaggagaagtggctgtctcgtcagaacagaaggtctatgatgtggtgatgaagcaggcatctttggttaagaggaagttgggcgctgcgggtgaacttgatgcaaagccagatattgctctgcctgggaatttgagcttgttgaatgaagcatatgaccgttgtggagaaatttgtgcagaatatgctaaaacattttacctgggaactctcctaatgactcccgaaaggcgaagagctatctgggcaatatatgccttagctggtttgcaaaagcaatctactgttaaactctttcagtctagtgttagacatttccagatgtcaaaatctttgatgtccattttgataactgaagttggacagataaggtgtggtgtaggagaacggatgaacttgttgatggtcctaatgcttcacaaattacgccaactgcttagaaataggtgggaatcaagattggaagaacttttccaaggtcgtccatttgatatgcttgatgctgctttatcagatacagttgccaaattccctgttgatatccagccatttaaagatatgatagaaggaatgagactggatcttaagaagccaagatacaaaaactttgatgaactatatctttactgttactatgttgctgggacagttggtataatgagtgttccaatcatgggcatttcaccaaattcccaagccacaacagagagtgtatacaatgctgccttggccctaggcattgcaaatcagctaaccaacatactcagagatgttggagaggatgccagcagaggaagagtgtatcttccacaagatgagttggctcaagcagggctttccgatgaagacatttttgctggtaaggtgacagacaagtggaggaacttcatgaagagccaaattaaaagggcaagaatgttttttgatgaggcagaaaagggagtgacggagcttaatgaagctagcagatggcctgcactattttaa

SEQ ID NO: 31132 - DNA, 1470 bp, Glycine max
  Peptide Sequence Number=SeqID_147910
atggagcaggaacacccaaaccttgaaagcttcttatcatgggcagcacagcttggaatatcagactcaacaacacgcaccaaccaacctcagcactctctttcctcatgtttgggttcttctctatctgtctctcattttcctcattctggcgggagaggtttgggtgctgtgagagaccttaggaggggagagattgttctcagagttccaaaatctgctttaatgacaagagagactgttatggaagataaaaagctctgtgatgctgtcaatagacactcttctctctcctcagctcagatattgattgtttgcttgttgtatgaaatgggtaaaggaaagacttcaaggtggcatccttacctcatgcatttgccacacacttatgacgtactagccatgtttggtgaatttgagaagcatgctctgcaagtggatgaggcaatgtgggtcacagaaaaagccatgcttaaagccaaatcagagtggaaagaagctcattctctgatgcaagatctcatgtttaagcctcagttttttacatttaaggcttgggtttgggctgctgcaacgatatcttcccggacattgcatatcccgtgggatgaagctgggtgtttatgccctgtgggtgacttgtttaattatgatgcacctggaatagaaccatctggcattgaggatttagatcgtttgctatctaacacttccatccctgatactatcgtattgaatggagacaagaatattatggtagatgcagaacagcttgattcacactcttggagattaacagatggcgggtttgaggaagatgctaatgcatattgcttttatgctagggaacattacaagaaaggagatcaggttctattatgctatggaacttacacaaatttggagcttcttgaacactatgggtttctcctacaagaaaatccaaatgacaaagtttttatccctttggaacctgctttatattcttccacttcatggtctaaggaatcactctatatccatcacaatgggaagccttcctttgcactactagctgcattgcggctgtgggcaacccctcaaaacaggaggaggtcagttggacatcttgtgtattctggttctcgagtttctacagacaatgaaattttcatcatgaaatggctgtcaaaaacttgtgatgctgtgttaaggaatctgccaacatctcttgaggaagacactttgctcctcaatgcaatggacaatagtcaagatttttcaactttcatggagatcacaaagttagtgtcttccagagaggagacttataccttcttagaaacgcataatatgaaggatactcatagttttactgatatcttattgattgaaagaaggaagagaaaggatatatatattaccagaaatggcttgaataggaaagctagcctcatgcaacaggaagttgaagcttttgcatatgtctga

SEQ ID NO: 31133 - DNA, 1443 bp, Glycine max
  Peptide Sequence Number=SeqID_147911
atgggggcggataagcctggcggggcgttgcggttagcgcacgtgtttccagtaagaggcgttcaggcgccacatcaccaggaagaacaagagcaggaacaacatgacaccgacgcccagttgcacgcggaaagtctggacgggctcggccatccaggacatgaacgcggtcaggtcggcgacgtcgttgtcgtatgttgcggtttgggccggattggcggccttgaatttggcctcgaaggtggcatggccgtggtagctggctaccggctcggccttgaccgtggcaaaaccttgcgcatcgtacaccgtcgtgacccgttcccacgacttcggcgcgccgtccttgccttcgacctcgtgcatcgccaccgtcgtcagctcgcgcggaccctggcgttcccacagcgcgtgcggcatgccgacggccgggaagaccaggttgttccagcccgtggcacgcgaggtgtcgcggtagaacgtgcgcaggtaggtgtagatgtagtcggaacccgaggggccggcgttgacggatttggcgcgggcgatcacggacaggtccgggggcgtggtgccaaaccacttcttggcgtccttgggcgtcatggcgacattcatcatgtcgccgaccttctcgccggtgaacagcaggctttccttgatttgctggtcggtcaggccaatgtccttgagcttgttgtagcgcatcgacgatgcgctatggcagttcagacagtagttgacgaacagcttggcgccgttttgcagcgacgccatgtcgttgacgcggtaaggcgccttgtccagcagaaaagccgcgttcggcggcgaaagtggcggcggcacttgcttgaaggtgcccaggcggctccagaccggcatcaggaagaagaatgccaggtacagcagcgtgccgatctgcgacgtgatgttcaacggcggactgggcggctgcgtaccgatgtagccgagcaccaggaagttgaccatgaagatgccgtagatccacttgtgccacgtggggcggtagcggatcgacttgaccggcgaatggtccagccacggcaggaagaacaggatgaccacggtgccgcccatggcgaccacgccccagaacttggcgtcgatcacgcgcagcagcacggccacgacgatcaggatgccgggcacggcgatgcgcatgaagcccttcaggttgctcttgacgagcagcgcgatggcgcccagcaccgaggcgccggccagcacccacgtgaactcgtcggtggtggcgcgcagcatcgagtagaacggcgtgaagtaccacaccggggcgatgtgcggcggcgtcttgagcgagtcggccgggatgaagttgttgaactccaggaagtacccgcccatttccggcgcgaagaacacgatgaaggcgaacaccagcaggaagcccgcgacgccgaccag

SEQ ID NO: 31134 - DNA, 347 bp, Glycine max
  Peptide Sequence Number=SeqID_147912
atggtggaaaaggagagatttgatcatatagaggagagaatgagggctattgaaggaggcggggattatgcctttgctgacatggcagaactgtgcctagtgcccaacgtcgttatccctccgaagttcaaggtgccggatttcaataaatacaaagggactacttgccccaagaatcacctgaagatgtatacgaatctggaactttcccgagtccattcttggaagaacctaatggttgccttcattaggcagtatcagtacaattctaatatggctccggatagaatacagctagaaaacatgtgtaaaaacgagcataaatctttcaaagaatatgcccaaag

SEQ ID NO: 31135 - DNA, 795 bp, Glycine max
  Peptide Sequence Number=SeqID_147913
atgcagtcccagtttcagtcacaaatgcaatcacaaggacttgcactgcctcctaagcctgaggttggtccttcaactgctcgtgtcagcataaaggatagttgtgttgatccctcagggaacggtccagacatgggtgactcagacaaatacgggttgtacatcaaagaaaattctccccgcctggttgccctaggaagagtttatgagggatccacaaccgttcacaacatccctttgttgcatgatgaagtgaaggtcggtgttgaggaggttaaagatacagatgctcccattcatgtacccactgaagagggagctatgagaccagcaaaaccagcagataggccaaatcatgaggttatgtgggatactaccatgttcggggtgtttaatgaagactttcccttgtacataaagtatgaagatttgtctaaaatagcacacggtggtcaatgtctcggcatctctgttatacagttgtggattccgcatatgactgagttaagtatgcgagcggggaattccgatgtgtatggattcctcgagccacatgctttgaaaggacttgacgatactccacaacctaaatccaaggctggtgctaggtggattgttgttaaagtaagtgatttaaacaatgcttctacacaaaaaggaagcactgattgtaagtattacatgatgcactggatgtcaacaataatcataggaactttcaagaataattgggaagagtatttcaatgatgctagaccactggaaccaaagagattgaaggagctttgcatctag

SEQ ID NO: 31136 - DNA, 654 bp, Glycine max
  Peptide Sequence Number=SeqID_147914
atgaaggagggaggctcgcaaaagaagaagaagcaactcgcggaagacccaggcataactcgcggaagaggaagaggcagtttgcgggaaagcgcggaagaaggagaggaagaaggaaaatggcggaataagaaaagactggcaatctttgtcatggccaaaactaagtgtgcagaactgattgattttagcccaatatgtacaacagatgtgcaacttcctgctggtgggacatttgtaatagctcattctttggctgagtctcaaagggttgtcactgccgctaaaaattataacaacagggtttttgaatgtcatttagcatcaattgttcttggtataaagcttggaatgaaaccaagggaggcaattgtaaacattaaaacaatctctgatgttgaagggttatgcttatcgtttgcaagtattcataaatcttctgatcctgtccttgctatcaaggaagaaccatgcacagctgaagaaattgagaaaattactgatgaaaaactcacgtcaatttttagcaataatactatttatttgaatgccataaaagcttctgagcattacaagttacatcagagagctactcgtgtgtattctgaagccgagagagtacttgctttcaaggatattgtatccacaaattaa

SEQ ID NO: 31137 - DNA, 264 bp, Glycine max
  Peptide Sequence Number=SeqID_147915
atgtctgactttttggctcagagcaagaggcaagtgattgaagtgaacctccaactgccacgaaacttagggttgcaaacaggttggtcgagaccggtttcaactaagcaatttttggcggttggggtttttggaggcgcgcaaaagcgaggaattgtcttcgacgccttccaccaaatccatttgttgttgcattgtgtttgttcttcaagtatgcaaaaaatccctcatacgcatgcacgttgcatggcacaaattctctga

SEQ ID NO: 31138 - DNA, 1011 bp, Glycine max
  Peptide Sequence Number=SeqID_147916
atgtatggttttagtgttgtactatcttcagaagagttaaaggctattaagaacactcatggctttgttgtagcatatctagacagaaatgttaccatagacactactgacacttctgaatttctctccctagactcttccagtggcctatggcatgcctcaaattttagggaggatgtgattgtgggtgttattgacattggtgtgtggccaaagagtgaaggcttcaaagatcatggaatgaccaagaaaattccaaacaaatggaaagggagctgtaaggaagtatgggacttcaacacttccatgtgcaacttcaaactgattggagctagatatttcaacaagggtgtcattgaagcaaattccaaggttaaaatcaacatgaactcagctagagacaccttgggtcatggaactcacacgctttctgatgttgttgttgtcatgttcctcaagaatcttatgtgtagtagcaaaaacagtagtagcaatgatgaagttcctgtgcttgtgctaccatatgctccaccacttgctcggatggaacaagaagaacaagatcaagagcttgagcttgttgatgttatattcaagtatgaagaggaggaattagaaggtagagtgtacatctacttgggttgtaatactgataacaagaaatggtacatctcttatggatcagttcaagtggaggatacatccacttggttgttcaaagagaacaagggagggtacatcccttgtggatctttgcttgtaaaggattttacaaggttattggaaatctcaagaactgatggttgcttagggactggatgtaggcacggggtagtgttggttgtttcacaattgcagatccactatgttgttgatggaaaagacgaagttagccttgaacttcaagaagaacaacatggtcgtggaaaagatgaaactccaacggaggatgctcagactcgcggcagtgatgaaccccgacggcagtcacgaaccccagcggcgaagatg

SEQ ID NO: 31139 - DNA, 567 bp, Glycine max
  Peptide Sequence Number=SeqID_147917
ttcttccttctcaccaaagatgacaaagaagatttgagcaacttcgagattgtgaagagacctatgttggagttccaaagtgagaattgtaatgaaaccctttcaagcagttccaactctcaccattcacaaaaagaagagaagaaaagcaatcatcaacagatcatagaagagtgtcaacaacagatctgtagaataacaaaagctgattcagaatcaagtacttcaaaactcaaagaggaagatgatgaagaagagcaagaacaagaagatgggttcaaaactccaacatctttggaccacaagattcctttacctttacaatgccctcctgcaccaagaaaaacccaaccttctctgaaaagaaaagcatcttattacaacaaccactgcaactactgcaggcacccacttgatctctcaaaagagtcaaagatgacgggtgtcgttgcgtcgccacgaagagtgcatgagagtgagaacgagagcgtgagagtgagaacgagagcgttagagatgagtgagagtgagaaagagagcgtgagagtgagagatggttcaaagtga

SEQ ID NO: 31140 - DNA, 519 bp, Glycine max
  Peptide Sequence Number=SeqID_147918
atgctttgttggtctaggtataagttagttgtcaagatggaacagaatggggagaaggcgaacttccatttttgggatgcagtatgtatcaaaatatttggtaaaaatgcagatgaatgtcgtcaagagttgattgcgagtggtgatgagatcaaggtgttccctgcgtgtgttgatcaattgttgggtaaaacttgggttgtgagattcaaacaccgtatacagatgcaccaatcatccgtgttggattttagtgaacaggaacatcatatacagtcagtgatattcacgctaggtctacaggatgaacaatgtttaagcaacaagtcagctgctgttggtgctgcatcttcatcacaacaagattaccatcctacatcatctgaatatgatcctggaaatgctgcctttgtaactcctgcaaaaagaacatccgatcagcaaggaagtagtcagtttgatagtgacaacttcacagcatatgagctatcgaccaacaagcatataaaagctgagtaa

SEQ ID NO: 31141 - DNA, 895 bp, Glycine max
  Peptide Sequence Number=SeqID_147919
tcgatcgtgttcccgggcatccagggtggtccgctgatgcacgtcatcgccggcaaggccgtggccttcaaggaagcgctggaaccgggcttcaaggcctaccagcagcaggtggtgaagaacgcccaggcgatggccaacacgctgatcgcgcgcggctacaagatcgtctccggtggcacccagaaccacctgatgctggtcgacatgatcggcaaggacgtgtccggcaaggacgcggaagcggcgctgggcaaggcgcacatcaccgtcaacaagaactcggtgccgaacgacccgcgttcgccgttcgtgacctcgggcctgcgcctgggtaccccggcggtgaccacccggggttacgttgaacaggactgcgtggacctggccaactggatcgccgacgtgctcgacgcgccgaacgatgacgccgtgatcgcccgcgtgcgcgacgccgtcagcgcgcagtgccgcaagtacccgggaagggctctgaccccagcattggagcaaccgcgcatggatgagcgccacctcaagtatctgtacaccgcgctggcgcctggcgatgggtggcgcggcggcgacgatgctgctgctgatggggctgggccagttcggtcatggcacgctggcctcggtgacggtgatgccgctgtggggcctggccggcattgccggctgcctggcctggttgtggctcagtgcgggttttctgatgcaggggcgtgccgggctgcacgtgcaccgtctctggtggtggatgctgctggcgggcggtctcgccgccttgcccccgctggggctggcgctgtggtggggcgtcaccgtgcacgccgaaggcatcaccctgttgctgctgggcccgtcgatgctggtgccggctgcgatgctg

SEQ ID NO: 31142 - DNA, 396 bp, Glycine max
  Peptide Sequence Number=SeqID_147920
atgatagtgcatgctcacacgtcgtacaatatactcctcgaccgtccctcactcaatgccctgggcatagttgtttcaacctctcacctcacgatgaagttctcgccagacgtcgagaacatcataactgtgcatgctgaccagaggacgaccaaagaatgctacatgaccagccataggttgcatccttatacaagggaaaaagccttagaagtcatccactatgtggagactaggatgaaaaccgaagaggtggaggagctagagctcaattcgagaactaatgatgacaatcaagtgaagccagtaaaggagacatccaccttccagctaagacctaaggaagaacaagtcacttatttgggaaaccaactacttgatgacgaactctattga

SEQ ID NO: 31143 - DNA, 357 bp, Glycine max
  Peptide Sequence Number=SeqID_147921
atgggaattgttcctgtcacaaatggaccagacactaacccctatgtcgaagggttttttgctgtgtcgacgggtcttcttctgtgccgaagtgtcttctctaatgattctttgccaaagtctccagtgcttgcgagtttgaaagagctagggggaaggggaggtacctgcaaaaggcactccaacactcaactccctaagcccttttttggcctcgtccaaaaagaagggctttatgctgtgtcagaacgattaccattaactcctttgatggttacgcaccttaattggcactgtgtaatggttacatcacatgtatgctcaacttccaacattgggtactggaacgtctcgtga

SEQ ID NO: 31144 - DNA, 931 bp, Glycine max
  Peptide Sequence Number=SeqID_147922
gcaagcgagcccgttgacacgcagagactaacatcatcatctgcatctttgtcatcaagagacggcgagtcggatgacttgcggagataccttatggttatccacaccttttgtcagccagaggcaagcgagcccattgacacacagagactaacatcgtcagctgcacctttgtcatccaaagacggtgagtccgatgacatgcggagataccttatggttatccgcaccttttgtgaaccagaggcaagtgagcccattgacacgcagagactaacgtcgtcatctgcatctttgtcatccagagatggtgagttcgttgacatgcagagataccttatggttatctgccccttatttcaaccagaggcaagcgagcccactgacacgctgagactaacgtcatcatccgcacctttgtcatccagagacgaggcaagcgagcccgttgacacgcagagactaacgtcgtcatctgcacctttttcatccagagacagcgagtctgattacatgtggagataccttatggttatccgcacctttggtcaaccagaggcaagcgagcccgtcgacacgcaaagactaacgtcgtcatctgcatctttgtcatcaagagacgatgaatcagatgacatgcggagataccttatggttatccgcaccttttgtctgccagaggcgagcgagcccattcacacgcagagactaacctcgtcatccgcacctttgtcatccagagacggcgagtccgatgacatacagagataccttatggttatccgcaccttttgtcatcttgaggcaagcgaacccgttggcacgcaaagactaacgtcgtcatctgcacctttgtcatccaaagacggtgagtccgatgacatgcggagataccttatggttatccgcaccttttgtcaaccagagccaa

SEQ ID NO: 31145 - DNA, 417 bp, Glycine max
  Peptide Sequence Number=SeqID_147923
atgccttggtgtaccctagagacaacatatatgcttttggactatgtagaaatagtacctaggaaaataacattgaagctagcatacattaatggccatccatttgttttgtgtgatgtggagatctctaaccttgagtatacagggttgagcaaatggaagcgtgttataaagaagacatccagctggtggatgctgcaagatatggacataagttttctgttagaaggagccgggggaaatattatggccacttatttcgcagcaattttgcttatgctatcaacacataaattagtcacagaaacggattatattagagattatggcatcaaggatcgtgaccgagtttgtgctatagatttgtttaagagccagctttatctccctctagtgctttactcggattattggtag

SEQ ID NO: 31146 - DNA, 1164 bp, Glycine max
  Peptide Sequence Number=SeqID_147924
atgcagtactcggaagatccggcgcagatcaagcagtgggccccgctgctgatggaaggccgtgacccgaagcagaaggttgccgcgacctggatgccgctcggcaccgacgtcaacttcggcgtgatcacccgccagctgaccaccggcctgcagcgcagcccgaacttcagcctgcatctgaaccatgaagtgagcgcgctgcggcagaacgccgacaagagctggaacgtgacggtgaaggacctcaaggccggcaccgaatccaccacccacgcccgcttcgtgttcatcggtgccggtggcgccgcgctcaagctgctgcagatgtccggcattccggaatcgaaggactacgccgggttcccggtcggtggccagttcctcgccttccagggccaggacgtgacctcgcgccatggcgtgaaggcctacggcatggccgagaccggttcgccgccgatgtcggtgccgcacctggatgcgcgcaagctggacggcaagccggtggtgctgttcgggccgttcgcgctgtacagcaccaagttcctcaagcacggctcgtggtgggacctgtattcctcggtcacccacaacaacgtcggcccgatgctggaagtgggcaaggacaacctggacctggtgcagtacctgatgggccaggcacgcctgaacgatgccgaccgccaggccgagctggtcaagtacttccccaatgccaagccgggtgactggaagctggtcaccgccggccagcgcgtgcagatcatcaagcgtgatccgctgaagggcccggtgctgcagttcggtaccgagatcgtgaccgacaaggaccacaccatcgcggccctgctcggcgcctcgccgggtgcgtcgacctcgccgccgatcatgctggacctgatggccaaggccttcccggaccagatgaaggccggctgggaaacccgcctgcgcgaaatcgtgccgtcgtacgggcgcaagctcaacgacagtgccgcgctggtcaacgagatccgcacgctgaccagccagaccctgcaccttccctacctggaagtgccggtggatgccaacgcggcagcacctgcaccggccgcaattccggctccggctccggtcaaggaaaagcgcaacgccaacgaggaactgcaggcgctgtaa

SEQ ID NO: 31147 - DNA, 369 bp, Glycine max
  Peptide Sequence Number=SeqID_147925
atgtttaagggagaaacaggccaaaaacatgaaaatggagtgtatttagcaaagtggggaggaaacaacctagcttgcctgggcgagcttggcggcaacctcctcccccattttgttgaaaaatggcttctagggcttccacaatgctttcgtaaaattctcgaaaccctgggtaagccttttccacttaatattggtgggagtaaggacacaaaagaagaaaatcaagttgtcgcaatgtgcccttcgcgggcgagcgaaggcgaggctcacgggtgcgctttccaaagaaggaaagatgtgcggagtcgccaccaacgtttatttgtgggaaacgtcggaaaaaccgaaggaaaccggtcaaaatga

SEQ ID NO: 31148 - DNA, 531 bp, Glycine max
  Peptide Sequence Number=SeqID_147926
atgaggaacaaatcaaaccaagacatgcaagacaaatggtggaaggatttgaggaggctatgtggcgcggaatgtgaggacaaatggtttgataagttgagtgagtggaaattaggggatgggggatgtggggagttggacgtggagtttgtgtggcgcagaggttgctttgtttgggaggagtcacaagtgaatcagctgaaggctttacttgtccgggaaccaagccaggaaaatgaagaagcaactgaggaatgggtgtttggaggacaaattcttgttgcagatttggaagctatatattccaccgaaggttatattctttttgtatggaggctattccttaatagactccctactagagatagcctaaagaggaaaaatataaacctggatatggatgacaattcatgtgtgttttgttcgcaagttgaggaatctgcagaccatgcgttcatgaattgtaggaagatctatcccttatggaaaaaaatgctttgcttggctaagatgttgttctgtcctacttga

SEQ ID NO: 31149 - DNA, 2589 bp, Glycine max
  Peptide Sequence Number=SeqID_147927
atgcacccgtgccggatcgaggtcggccagggcctgggcgaggaagtcggcctgcttctggttgttgccctccaggcagaccttgtcgcctggctccagcagtgcgtgcagcagctcgcccacatcggtggcggcgacctcgcgtccccgggcccacggcgcggcacgttccaggcgggcctggcggctgcgttccaacgtatcccagctcgggttcatcgaccggcttccgattggtgtcgatgtaattacggcataattatgaagaggggtgcaacctgcagtgcagcaaaaagaagggcccgcacgaaggcgggcccattcaggattgcggtctgccgaccaacggtcagcgcccaccggtttgcgggtggctcagaacttccagcgcaggctggccgacacgaagcgcggttcgccgtagttgttgtagtccagattcgcccagtaggtcttgtccagtgcgttgcgcacgctcagcgttgcggtccagctgtcgctgatgcggtagttggcattgaactgcaccagcatgtaggccggctggttcaccgtgaccgtgccgcccagcgggtaggcgatgttgtagccctgcaccttgctctgccactgcaggccgccgccaacgctcaggcgttccagcgcgccgcgcagctgcagctgggtgttgagctgcaacagatccttcggcggattggcgtacagcaggtcggtagccgctcgggtgaccttgacgtgggtgtagccggcattgaccgtccagcccggcaggatctcgccgttgacgtccatctcccagccgcgcgccttggtgccgttgacgccgacgtaggcggaggtgccatcgctgagcgaaccttccggcacgcccatgtcgcgcaccgcgtagttgtcctgcttggcctcgaacacggcggcattggcggtcaggcggccatccagccactgggtcttgatgcctgcttccaggttcgagccctgcaccggtgccagcaggttctcgttgcggtccttgaagttctgcgggttgaagatctcggtgtagctggcataggccgacacgttcggggtgatgtcgtagaccaggcccacgtacggggtgacttcatcgctcaccttgtacgcaccgctggtgccggtgtaggcgcctgcggcgttgtacgagcggctgagggtttcccagcggctcaggcgcgcgcctgcaatcagcgacagcggatcggccaggcgcaggcgggtggccaggtagacaccactctgcgtggtcctggccacgcggcgcgcgccggtgcggcggtaggtcacttcggagatgtcgccgttccagctgtacacattggggatgtagtagcagcgttcgctgccacagcgcgcccagtcggtcgggtagttcagcgcgagggtattcgtcgtgccttccaggtccgaccactgcgcgccaacggtgaggtcgtgctcgcggccgaacaggtcgaagctgccggacaggtaggcatcgacattgcgacgggtgtccttggaatcgccggcggccgcgcgcaggaagatgcccgagccggtcaccgggtccgggttgccggtgccgtacaggcgcacgttctgcacgttgccacgggtgtaggcggtgttgatcttcagcagccagttgtcaccgaagcgctgttccaggttggcgaacgcggtgttgctctcgcgcttccagtagctccacttcggcgacagggtgatcgtggtgctgtcggtgacgtcgccttccagcaccgccatgccggccatcttgttctcgtcgtaacggtcgtaatacaggccacgatcggtataggcggcgaccacgcggctgcggaaacggccgtcatcggtcagcggcgcggtcacgtccgcctccatgcgccgatagtcccagctgccggcgctgaccgcgaacgaggcatcgaactccttgcccgggcgcttgcgcagcaggttgaccgtggccgacggcacgccggcgccactgagcaggccgttggcgccgcggatcacttcgatgcggtcgtagaaggcggtgtcgtattcctggttggtcgaaccgctgtaggtgggaatgccatcgacctggaagtcggtgatggcaaagccacgcgcgtagtacagcgggcgctgggtgtcatagaaggacacgctgacgccggtgacgttgcgcatcacgtcgttgatgctgaacagcgattcgtcctgcaggcgcttgaggctgatcgccgtggccgactgcggggtttcctgcagcgtgatcggcaggcgggtggtgctggatggcggagcggactgctcggcacggacgctgacccggtccagggtcttggcatcggcggcgccatcggcggcggcgaacgcgctgggcgcggccagcagggacagcgacgaaagcagggcagccggcagcagcgcgcggcggggcaggcggttacgcagggtcagggacatggtgggctcgaggcttggaagcggggaagggcggcagcagtcgtccagtacccggggcggcggcttcgggcacatcaggtccatctgggagggggcggtcactgcgtaggatgcaaatgtaaataa

SEQ ID NO: 31150 - DNA, 465 bp, Glycine max
  Peptide Sequence Number=SeqID_147928
atggctcgtatcaaaatccctcatcaaggagatgtagggaagatgatgatgaaaaagggatttaagaaaaacactagtgacaaaagtgactataagattaagcttccaccaaagcctccaaagagaaaggatcaactagagcctttttacccaaagatgactaaggaccagaacttgaagggaaaagagggtttagatgaagaattccctattagttcttcttccaaacctacttcctcagtgaagtataagaaaaaggatgcaaaggtagtagatctttcttcttctcaaggtccttctaatctagaagatgacaaggttgattccaataacaatgatccttcaaaccctattgttgaacaagaagtgcaacctgaagttgctcaccctgaaaaagaggagttgttaaatgtggatgaccttgcagtaattattcctaaacttctagttaataaagtcctttaa

SEQ ID NO: 31151 - DNA, 114 bp, Glycine max
  Peptide Sequence Number=SeqID_147929
atggtggttatgaggattactaggatgaaaagaaacttcttatggggtggaaatgaggattcttggtttgacaaaaaacttggtgtggaaagtgagttaggggaagaatattaa

SEQ ID NO: 31152 - DNA, 1494 bp, Glycine max
  Peptide Sequence Number=SeqID_147930
tcgaagccaccgccttcggtggcggcatcgtcattgcccaggtcaacgaaatcgtcgacaccctcccccgcgtcgacattcccgctgactgggtcaacttcgtggtgcaggcaccgaagccgaaccatatcgaaccgctgttcacccgagacccggcgcagatctccgagatccaggtgttgatggcgatgatggccatcaagggcatctacgccgagtacggcgtcaaccgcctcaaccatggcatcggcttcgatacggcggccatcgaactgctgctccccacctacgccgaatcgctcggcctgaaggaaaagatctgccagcactgggcactgaacccgcatccggcgctgattccggccattgaatcgggcttcgtgaagtcggtgcactcattcggttcggaactgggcatggagaaatacatcgcggcgcgaggcgatgtgttcttcaccggcgccgatggctcgatgcgttccaaccgcgcgttctcgcagaccgccggcctgtatgcctgcgacatgttcatcggttccacattgcaggtcgacctgcagggcaacagctccaccgccacccgcgaccgcatcgccggcttcggcggtgcgccgaacatgggctcggatgcacgcggccgccgccacgccagcgacgcctggatcaaggccggccaacaggccgctcgccctggtgaaataccacgcggccgcaagctggtcgtgcagatggtggagaccttccgcgagcacatggcaccggccttcgtcgatcgcctcgatgcctgggacctggccgagcgcgcacagatgccgctgccgccagtgatgatctacggcgatgacgtcagccatgtgctgaccgaggaaggcatcgccaacctgctgctgtgccgcacgccggaggaacgcgaacaggcgatccgcggcgtggccggctacaccgccgtcggcctcggccgcgaccgcgcgatggtggaaaacctgcgcgaccgcggcgtgatccgccgtcccgatgacctgggcatctctgtgcgcgatgccagccgtgacctgctggcggcgcgttcggtgaaggacctggtgcgctggtccggcggactgtacgacccgcccaagcgcttccgcaactggacacactgcggtgcagtttccgcgcgatgcggtgctggtcggcgtactggcctcgggcaacctggaaatcctgctggagccggcggcgcaggacggcgcgatgacggtgcgcatcatcaccgccgcacagggcttcggcaacgtgtggcaagcggtgatcagcgacttcgcagagcgtcatccgctgcgcgatgtacgcatctcgatcaacgatgcgggtgcaactccggcggtggtcagcctgcgactggaccaggccgtggaaaccctgctcagtggagatgcacgatgaaccggacgcagcgccacagttactacgaagccgatgcgcgcgagcgcatcgccgggttgatcgacgcgg

SEQ ID NO: 31153 - DNA, 2693 bp, Glycine max
  Peptide Sequence Number=SeqID_147931
atggcttcgcacgataagtctaccctggatcgtattgaagatgcaatagcaaaactcgtagccagccaaattcaggtcactgataagcttgaggacttgctcctccgcctctcgaacctggaacacactgccaccacccactccccttcatcttcctcggccaacccccaccacacaaacagcatcatcacccctcccaaaatgaaactagatgttccttgtttcgatggctcggacccttcagggtggatttttaaaatttcccaattttttgcttaccactcaaccccagaatccgagagactcaccatagcctccttctacatggaagggccagctttagcctggttccaatggctttcccgcaaccaccaactcacaacctgggctagttttctcgaagccattgaggctcgcttttctcactccccatatgaagacccaactgggattcttttcaaattaacccagaagggcaccgtctctcagtaccttcagcaattcgaaacccttgcaaaccgaatcgtcgacctctccccctcccttctcctcagttgtttcgtttcgggtctcgaccccgacatacgacgggaggtgcaagccctccaacccctaacccttgtccacgccgcaggactagccagacttcagaaggaaaaattagccgacaatcgcagcgcgttttgtggccgcgccaccttcaccactagcccacctccacctcaaccccaaccaccacctaccttactcccctccacaacctcaacacatcccccgcctctccctctgctacccactccacccaagccccctcccttgcctctcaagcgccttactccggccgaaatggctctccgccgtgagcaaggtctttgctttaactgcgatgacaaattcaccaagggacaccgctgcgcctcccgtttctcccttctaatcgcggacgaagataaccctccagaaccttcagacccttttatacccaaccctaacccgagccccgaaaacccgaacccgcccaactcaaaccaacccgaacaaccccatgcccaaataagtttttgtgccctgtcgggccactctccgccggaaacactccgtctcctcggccaagtgtctcaccacgccgtcgtcgtcctcgtagacggcggcagcacgcacaattttgtgcagaatcgccttgttcgtcatctgggcctcactccacaaccaaccttccccttgcatgtccttatcgggaacgggaatgagattgaatgtcacacgatttgccccaatacaatgattcaaatccaaggatatacatttaccactgacttgcgtgtcttgcctatatgtggggccgatatcgttctcggcgtccattggttaaagtctctcggaccaattttaactgattacaccaacttaacgatgaaatttaatcatcagggagcacttatcgaactctggggtgacttagtccaagaccttcaagtggtctctcccccgcagctccgtcgtatgattcagacggattgtgtcagtgacttcttccacatccaggtctgttcctctatacacacttctcccaacacacccccagaaattcaatccctcttacacaaatttgagtccctgttccaaccaccatcttccctacccccatcccgaccgacaaaccactgcatccacctcacctcagcctcatcccatgtaaacgtaagaccttatagatacccttattatcaaaaatacgaaatagaagcccaagtttcagcgatgtttcagaccggcatcatccgcccaagtaacaacccattctcttcacttgtgcttcttgtcaaaaagcgtgatgggtcctggcggttctgcgttgattaccgcgccctcaacgcactgacaatcaaagaccgttttcctattcccacaatcgatgagttgttggacgagctcggcggcgccacctggttctcaaagctggacctcatgcaaggctaccaccaaatcttgatgaacgaagcagacatcaacaaaatggcgttcaggacgcaccagggacactacgagttcctggtgatgcctttcggcttatgtaacgccccctcaactttccaagctacgatgaacaacacctttgaaccttatttgcgtaaattcgttatcatcttcttcgatgatatactaatttatagcaagtctttcatggagcacctgaaccacttgaacaccgccttcgaggttcttcgtgacaataaattcttccttaaactttccaaatgctcctttgctactcagcaggtcgagtacttggggcacatcgtgtctcctcgtggtgtagaacccatggcagctaagattgaagcggtccaccaatggcccacccctaactctgttagagccttaaggggttttctgggactatcgggattttatggacaatttatcagaggatatttgtcaattgcggctccactgaccctccttttgaccaaggatgcattccaatggaatgaagcagctgataaagctttcaatcaactcaaggaagccttatgtcgtgccccagtcctccacctgccggatttctccattcccttcgtcgtcgaaactgacgcgtccgacgaaggcatgggggcgatattgtctcaacacaaccacccaattgcattcttcagtcagcaattttcccccaaacttctccgcgcgtccac

SEQ ID NO: 31154 - DNA, 1413 bp, Glycine max
  Peptide Sequence Number=SeqID_147932
atgcaggaaaataaggatccagcaattaagctcttcggccagaagattgccttccccggagaagccgattctcaagccattgccggcggcgaaaccgactggccgccggcgatggacgtcgacaaggacgaagaagactttggtattggtaacccagacaaagatgagaaagacaaggatcctcgagctgaaaaagttagtgagaaaacgaaagaagctgatcctcctccagatgctgcagactctaagacgtcagagggtattcagaacccaaatacaccttccatagacgaagaatctgcaaagtcaaaaaacgacaagtcagagaacgatcaacaagaaaacaacaacaacaaaacactgaagaagccagacaaaattctgccgtgtccgcgctgcaacagcatggacaccaagttctgctactacaacaactacaacgttaaccaaccccgctatttctgcaaggcgtgccaaaggtactggaccgctggcggcaccatgcggaacgtgccggtgggagcggggcgaagaaagaacaagaactcagcctcgcactaccgccacatcacaatctctgaagctcttcaagcggccagaatcgatgcccccaacggaactcatcttttgaaacaaaatgggagagtcctcagcttcggattagaccctccaatttgtgattccatggcatcaatccttaacctcacagcagagaaaaagggtactcttaacaacaacacaagaaacggatttcacacaattgaggatcagagaaacaaagacaaccacaacaataacaataacaacggtgatgactgctcaagtgcatcttcaattactgtttccaatgaggaaagtgggaaaagcacgtctcaagaatcgattatggtgcccaacagcaacggtttcatccaccaggttccatgcatttccactctcccttggccttatccttttccctcagcagcacctgctatgtgccctccagggtttcccatgtcattctaccctgcagcattttggaacattccatggtttccctcacaacactcacaccattctgctcctactccaaggtctcccagttccggtcctaattctccaacactagggaaacactcccgcgtcgtcgcggaaaaacaagaccatttgcaagaagaatcaccctccaggcagagaaacgggtctgttctggtcccgaaaacattgagaattgatgacccaagtgaggctgcaaagagttccatatgggcaactttagggatcaagaatgagtgtgtcactggtggtggcatgttcaagggattccaatcaaagaaagatgagaaagaccatgttgttgaagcctctccagtgttgagggctaaccctgcagccttgtctagatcccttaactttcatgagaactcttga

SEQ ID NO: 31155 - DNA, 306 bp, Glycine max
  Peptide Sequence Number=SeqID_147933
atggaaattgacaaaagtaaaggttttaggaaggattggaaattggaaaaagtaaagtttcgagaagaaatgaagattgaaaaaagtccttatcgccctcgagtagatttggaagatattgaagaatggtttcacactcatgatggtgaataccctatcatccacaaagaaaaacttccctgtggtcctgttactccaactctattggacattgcagctatcactggactcaaacctctagggaagactcttgcattgggtttatttgaagacacgatccaaagaagtgaaatcaaaatcgactag

SEQ ID NO: 31156 - DNA, 198 bp, Glycine max
  Peptide Sequence Number=SeqID_147934
atgtctcattttagagttagtgatattgtagcgacgaggcgagtcgttacaagcctaactatgacagcccttgggatcttggaggacctgggtggcacaatgaatgctcacttgaaggactcgtatcaccttgaggacaagggaggaggggttggaggctttgattacttatatggtgatgtgagagttattcgctga

SEQ ID NO: 31157 - DNA, 504 bp, Glycine max
  Peptide Sequence Number=SeqID_147935
atgaaaacgagacggataaaaggacctttcttggccggcggtgtcccatatttgggccttgacggtcttcttgtcgatgatgagcgttttggtctgaaactcgacgccaatggtggctttagaatcgacgttgaattggttcttggcgaagcgcgcgaggagctgggtcttccccacggcggagtctccgaccagcaccaccttgaacacgtagtcgatcttgtggttgtattcgccgtacaggaaggtggcggtgctgctgccgtcgttgtcgttgtcgttttgatgaaccatcgccttcttggcttcttctgcttctttgttagtttggtgtttcttatgatcgaggcggggttgaacccatcatcatttggtgaaagaaagaggaaaataacgacggtcgttttggttgggttgacaaagaatagaggaggcgtgaggaggaaggaaaagggtggtggcggtttgggttgggaattgggatggaccccttcgttcttcagg

SEQ ID NO: 31158 - DNA, 1005 bp, Glycine max
  Peptide Sequence Number=SeqID_147936
atgtccacctctgctagtggctcgacaacaccttcttctcctctgacccccacgtccccacctggtagtccttgccatcatttacctctccagcatccactccgtggagccaccatccctcgcgggggtgactttgtcctcaaccctactcactactttgtccaagaggttattggcattgatgagatcaatctctatcgctcttgggtttgggagtcctccggagaggaacaccaggctggagaacatgtactagcggattcggaacctcgctcaccaaaagaagcagatatgtcgaacgacttgtcgaaaggagagaaaagcaatctggtgagtgacttgtcgactcacggtggcgtcggcgactgcaaccgagccaagttgcccagaatcagttctgctgatgccatggagacttgggccaacagtcagaaagggaagaagctctacattgtgctcatcagaattcatagcctaatacgaggcgagcatatggagctgggacgtgattctgacacgggtggtcaagttaagtacgttgtggaacttgcaagggcattgggatcaatgccaggagtttatcgggttgatttgctaaatagacaagtgtcgacgccagatattggcggtgggcatgctgtctggcctattgccatccaaggacattatgcagatgtaggtgactttgctgctcttctgtctggcgcatcaaacgttccaatgctttttactagccactcacttggccaagataagttggaacaacttttaaagcaaggtcaactattaaaggatgaaataaacacaacttacaagattatgcataggattgaagctgaggaattggcccttaatggttctgaaatagtcttcacaagcactatacaggaaatagaaggacaatggcgcttgtatgatggttttgatcctgtatcagagcataaactacaagcaaggatcaggcgtaatatgagctgctatgggagattcatgcctcgcatggcg

SEQ ID NO: 31159 - DNA, 234 bp, Glycine max
  Peptide Sequence Number=SeqID_147937
atggattgtgataccacttcaagccttcttgaaactattaaagccatctttgagtctgctggaaaggatagggcagagggcactgtagatgcaagagcaaacttttttcagaaaaggagcaggcaagacaggcgactggggaacaaattcaatcttagtagcatcaaactaagaggccgagcccatgaagcaaaattgactgaggatcataacaggagaatgcttatagaatga

SEQ ID NO: 31160 - DNA, 387 bp, Glycine max
  Peptide Sequence Number=SeqID_147938
atggcgacgactttgtataaggtcagtctggccccggggagcgggtgtattgaggtaaatttacagctctgcctctgctccgaaagagcattctccaataacggtttcactccttctgtcgcgccgctgcagtgcatgcagctcatgactgtcaatttttacttttctatagtaacctgcttattcttttttgaagatataaagaaagatactttaccagctctaagagatatcagagagcaatgcatcaatcaacttgagcaaatgcgacctgaccacatgaggaggcttaacccaactccatataaggttagtgttagtgcaaaattatacgacttcattcatttcctgtggctcaatgaggcaccagttggggagctacagtaa

SEQ ID NO: 31161 - DNA, 246 bp, Glycine max
  Peptide Sequence Number=SeqID_147939
atgttggaagtgcaaaaaattcaacctagaagaacaccttttactagtatgatgcatctgcaggatcatgaagaagtgaatgactttcatgcgaggctatttgaagtgataaggcacatctgttttgattttgctttgaactacctaagtggtacaatcccaaaggagtggggttcaacaaaactaactaatatggaaattcccaaggagtttatttatgacttaaagttgattgaagttcaatag

SEQ ID NO: 31162 - DNA, 321 bp, Glycine max
  Peptide Sequence Number=SeqID_147940
atgtcactaaggagatgtgctactcatgctaacctggagaacgacgattatgacgatcatccaatctgggatgatgatgattctaacattgacgactacccctttgatgttcccactcaattatatcattgttgggaagtcatatttgaggtcgatatgcctagttttgatatcggcagtgaacttatttgtgacattgatgatgcgtttgatgatgttaatgaaaaccctgatgatcattgttgggaagtgggattcaagatcaatatgcttgttttggatgttgacattgctatggatgttaatgaagaacacatttag

SEQ ID NO: 31163 - DNA, 270 bp, Glycine max
  Peptide Sequence Number=SeqID_147941
atgatgctcttctttggtcttccgctaaaatgtctccctcatcggacttgttttctattacagaatccgaatgttttaatttgcacacccaactttactattggctcaagtaggagttgcaattttgtgttgaaagatcagacaataagtgcaaatttgtgcaagatcaagcacacgcaggtacacgcaaatttgtgcaaattcaattctaatccacctctatattccagctccaacagcaatgtcaatgacaacaactacaacaattag

SEQ ID NO: 31164 - DNA, 348 bp, Glycine max
  Peptide Sequence Number=SeqID_147942
atgctgaaactgatcctgatgcaaagcttgtgttgtcttgtgagaggggtcagaaagactttgaattcagagttatggcatgcttgtgcagggcctcttgtgtcattaccccaggttgggagccttgtgttttacttccctcagggacatagtgagcagcttctactagaagaacaacaacatcacaaattccaaactaccccaatcttccatatcagttgttgtgtcaagttcaaaatgtcacacttcatgcagacaaggagacaggaagtgagtgcagtaggagtagttctttcacacttaaattacagggatgctgattgtaatcaagcatttaatttttcttga

SEQ ID NO: 31165 - DNA, 297 bp, Glycine max
  Peptide Sequence Number=SeqID_147943
atggatgccgatgaaggtcgccggcgccgagaggataccatggtggagatcgaaaagaaccgtagggaagagagtttgcagaagaagagatgcgagggtctccaatcccaacagattccttcgtcacttcactctattgtaatttatttaacacagttactcttgtctcagtctgcgcagaatccgaatgttttaatttgcacacccaactttactattggctcaagtaggagttgcaattttgtgttgaaggatcagactataagtgcaaatttgtgcaagatcaagcacacgcag

SEQ ID NO: 31166 - DNA, 162 bp, Glycine max
  Peptide Sequence Number=SeqID_147944
atgagggatgtgaacatcagaagcatttggaggttttgttatgttgtgagtaaaattgaagaaggaagaaggaaaagagaagtgataaacacaaaaggagaatgctctcctttctccaaatcatcaattttgctgatgtggcagtttaatagtgtggagtaa

SEQ ID NO: 31167 - DNA, 657 bp, Glycine max
  Peptide Sequence Number=SeqID_147945
atgaagtgtgtggcgatggaagggcttatcgaagaggccaacgaagtgatcgaagcgacggaaaagaacgagatccgcgatgctgcgctgatagccgccgcgcagaaagttgaacactatgaaattgcggcctacggtacgctgtgtacgctggcagagcagctcggctataaagccgcggtgaaactgctggcggaaacgctggaagaagaaaaagacgctgatatgaaattaacggacatcgccgttggacacgtgtcatctcgtcgcggcgataatgtggtttgtactggctataccgtcggtaatatggtggaaagacagtgtcctgttgttatgactgatattgaaaactatcacgattggttgcgtgacgcgcacgctatggaaaagcaggccgaatcgatgcttgaatcgatggtcaaacgcatcgacagctacccggaattatgcacccgccttgagcagcatctttttgaaacccgtcggcaaattaccgtactggatgatattattgcgcgcaataatatttcccgctcggttcttaaagactcaatgagtaaaatcgccgcgatgggacaatctattggtggaatgtttccacaagatgaagtagtcaaaggtgtgatcagcggttacgttttcgagcagtttgag

SEQ ID NO: 31168 - DNA, 244 bp, Glycine max
  Peptide Sequence Number=SeqID_147946
atggtaagagctgaaataaataggcctaactctcaaaaacatgtccctagtggagtcgccaactgtcacaaccaacccttcggcgggagggcgacgcagggctcacgggtgcgtcttccaagggaggagaatgcgcggagttgccaccaacatttattcgaggaaaacatcggaaaaaccggaatgagtggtctacgaactttcatcgtgaaaggttcagaagttatttttatgcacggggaag

SEQ ID NO: 31169 - DNA, 587 bp, Glycine max
  Peptide Sequence Number=SeqID_147947
atgggtgatcaagaggagacacaggaacaaacgaaagccgacatgtcggctttgaaagaacaaatggcttccatgatggaggccatgttaggaatgagacaaatcatggagaaaaatgtggccaccgctgccgctgttagttcggctgctgaagcagacccaactctcctagctactgcgcaccatcctcccccaaacgcggtaggacgagaaaggagcacactggggcataacagcaacccccatttgggatacaaccgggtggcttacccatatggattaccgcctaattacacgccgccagtcatgcatgatgacgcgggggatgtcgatttctaccccccgatccccgtcaaggggccgacacccaacacattgcctcagcacaacctcacagcacaaccaatattcttgtccacaaaaggaccacccccggcggcggaagaaagaaggaaactcgatctcatcgaggagagattgagagttattgaaggctttggcgactatccgttcgtggacatggtggatctttgcttggtaccggatgtcatcatccccctaaaattccaagtacctgagttcaacaa

SEQ ID NO: 31170 - DNA, 709 bp, Glycine max
  Peptide Sequence Number=SeqID_147948
atggctaagttcggaagacctgctccagagattgaaggtcttgtggctgaaactggtagtttccatttgcccgtcagagaggttactatcaccttggatgacgtaacgttgttgctacatttgcctatcttagaggcgttccatagcttcgagcaatttcatgtcgataatattgtcgatatgttggtggaattactcgagagtgagacttacgcttggggcgctgctacacttatgcatatgtatgataatttaaatgaggcatcaaagagcacagcgaggcagcttgcaggatatatcactctgttacagcatttcccgtctattggttccgccctagctgccgaggattatgacaagatgagaccgcgtgcatgtcgatggacatctggcagggcactacccgtgtcgacgtatcgtaggcgtctggacaaactgacccttgaagttatgtgctggattccatatggtgaccaccgttcatttagagaatttgaggtcatctccttattttttggccatcttagatggggtccattgacggtcattcaccgaccgaagagggttgtacgacagtttgggtacatccagactattccaccacatcctactgcgcattcaacttttgttgaagaaatggatgctagatggatgcagttcgatgactacattgcacttgtaggggaaatttgtgtagcgtttggccaat

SEQ ID NO: 31171 - DNA, 354 bp, Glycine max
  Peptide Sequence Number=SeqID_147949
atgggggaggaggtttctgcccagctcgcccaggcgagccaaggcttcctcaagaagtttcctgatgcaccctccaaattgataacattacaaaagcctcagatgccatttttcaacaaaatgggggaggtggttgccgcccagctagcccaggcgagctcagctcgcccaggagagctaggttgcttccacttgaagcaagaaaatgtccagaatcttctagatgagcccagatttgaaaatttctatttagaccctcagtttgataagttcaccccctatttttgtattttttggttgttttctttccgaaacctcatggaactttacggatttgacgatgatgtgtgttaa

SEQ ID NO: 31172 - DNA, 99 bp, Glycine max
  Peptide Sequence Number=SeqID_147950
atggctggtcactttggaggcattccattggaggtgtttggctgtattcttgaagcaaacctaatctcagtgtcatactttggtcttgcaattttgtaa

SEQ ID NO: 31173 - DNA, 2558 bp, Glycine max
  Peptide Sequence Number=SeqID_147951
ttgcttcttgtattgtgcagggacattttgccagggagactttgttgcatgctaaagatatagaaactaaaactcagtgcaacgttgatgatagatttattagtcctgatggagaagatggggcatgctatcagagtcatgttggccgtggaatacatgaagatggtatggggaatggtctttttgatggaaaggatggtagagctagtacagatggtatgggcaatgggcttttggatcataaacatggatgttttaaaggaaatgagaaactaaaaggttattgtgatgatgaggatgtggaggttgatggagggaaagttggttactataaaaattcttcctcagaaagtggaagagagaaagatagaagatcaagatattcacattctcgtgatagatatagaagtcgatcaagatcaactggtcatgctacggacaggtctcattctggtagtatagtggaagaacatgctcgttcaaagagaaagcactctggtgaacagggggatgattcatatgctagtagactgaagactgactatgaccttgatgatgaaagaatgatggcaagcagaagggagagtagagatttggtggtggataaaagaagggaacacaggacaagttatcatactcaggaggcttggggtagggctaggagtagcgatagagatgttgatagagacttaaagatggaaaaagaacaagagaggagtaggaatagggaggtcaattgggtgcatagaagggaaaaagaacgtgagaggagttgtgagaggcacagaagggatgtagaaaaagataggagggaaagagaggatgatagggataggagaagagaaaaggaaagcgataggatccgtgagacagtgtttgagagggataggagaagggataaggaaaaagatcaaagtagagacagaacaaggggtgatgagagggtcagagaccaggagactgctgaacataatgataggagttggaaaagggataaaattaaggagagggagaagcgagatgatataaagaggcacaaggatagaggcaatggcatgggtaagtatctgtctcatgaggatgattattatgatgctcatgatagatatagaaggcgtttgaaacaagaagaaagagagtgccaccaagaaagaaaaagaaaatcctcgcacgtaaaggtttataattctatgggcagtaccctgatagatgatgcaaacaaactagagagaggggaggatgaacaagatgacttagatgagaaggttacattgcaattacctgatcaagaagaggaagatttcaatagggttaaagaggagagtagaaggagaagggaggcaatcttagagaaatacaagaagcagcatcaacaaatagaactaaatacagaaaatgaaggaaaagacagacaagctgtggagattcctcctagcattcctgatgctcttgatggtaagagtgatggtgttgatgatgtggaagttgaaacattattctcagtcaggaaatctcctgcggaaaatgggaatgttgcttctgataagatctctagtgctggtggccttggagagggctctcctaagagtgagagatcagatgacaagttttgtgatgatatatttggtgagacaccaactggagttcagaaatcaggtaaaggagaaggtttacggattgagaggggtggccttcacgacaattgggatgatgcagagggttattacagttaccatttcggtgaagtactttatggccgatatgaagtcattgcagctcatgggaggggtgtcttttcagcagtggtccgggcaaaagatcttaaaaatagtaatggtgagcccagagaagttgccataaaaattattcgtagtaatgatacaatgtacaaggctggtatggatgagttagtcatattaaagaaattagtaggtgctgatccggatgataagtgtcattgtgttcgtttcctttcaagttttaagtacaagaatcacctttgtttagtttttgaatctctccatatgaatctgcgtgaggttttaaagaagtttggtcgcaatattggccttaggctaactgcagttagggcgtatgctaaacaactttttattgcacttaagcatctccggaactgtgtacttggcttaccctatgatcatccgttggatatgtggtctgtaggatgttgtttgtatgaactctatacagggaaagttctttttccaggttttactaacaatgacatgctatggctccacatggaattgaagggtatttttccgaaaaagatgcttcgtaagggagcatttattgaacaacattttgatcagtacctgaattttcttgctacagaggaggaccctgtgacgaaaaaggctataaagcggatgattgtaaacataaagccaaaagatattggaacaatcatcagtggctctccaggggaggatccaaagatacaagaggttgacagtctcacaggcattgaatcacccattcatcactggcaagggaacaatgttgctgattttgactcccacaatgatgttcactga

SEQ ID NO: 31174 - DNA, 183 bp, Glycine max
  Peptide Sequence Number=SeqID_147952
atggatacctcagagccctacactggggcaatgaaaggcaccatgcataaacctcaagtgaacctaggggcagatcagaaattctcacctaataggttccctgctacaaggggcaccgtgcatgagcctcaagcgaacctaggggcagatcaaaagttcttacccgtcgatgtttttaaatga

SEQ ID NO: 31175 - DNA, 358 bp, Glycine max
  Peptide Sequence Number=SeqID_147953
atggctcgacgacagctaacgaaggcttacaatgatgatggagtccagtgtgacgcttgtcgaagatacgtcacgcgtcatgtgcatgaacttcacacaccagggcctttcgtggggttgcgtgcagaatgttttgagttggcagcgcatgtggacgacgtggtggcgagtagtcgtgtggtactattcactgctaagagaggctacctaaaagggaaaacaaagggaaaccttcaggataagagctccgatcacatgaaacttttgggtgagtcagatggtgtggccaccggttggtcagaaaatgcatcagaaatgttgaaaaataccaccagaaagcggaaacagatgaaaaagg

SEQ ID NO: 31176 - DNA, 390 bp, Glycine max
  Peptide Sequence Number=SeqID_147954
atgaagattgagccagggttggaagacgaagccaatccatccatgttcaaccacaacgctttcctccaccactatcactgtttggcaccctcaactagccaccaatcacgcgtcgagccaccgcggctgcgccaccgccaccgccaccgaagcagaaagtccgacgaagaaattgaatgcggttgcgaaattgctccggcggttccttttccgactccgccccgtaattctggcacgaattttcgcgtaatcgacgacgatgatgtcgaagaaggagaaattttcgaagacgacgacgatgtcgcgaaacagcacgcgcaatctgaagctgagcctggcgaaattgacccgaccggagatcgaggtgttcgatccgataacaaaaatctg

SEQ ID NO: 31177 - DNA, 252 bp, Glycine max
  Peptide Sequence Number=SeqID_147955
atgactgaagacattgtcgtcttcgaaatgtgtgtggattaccatgtagggcgtcttcgcgtgccatcggactcacagatgaccacttgggtatttcacctgccacctgactcttgggtcaagatcagtagatgttgtctttgtacggataaccacttgggtatttcctcctgccacctcactcttgggtcaggatcaacagatgttgtctttgtacggataaccacttgggtatttccgcctaccacctga

SEQ ID NO: 31178 - DNA, 1567 bp, Glycine max
  Peptide Sequence Number=SeqID_147956
ggctacatgtcctcgccttccgagggctacacgtccttgacttcagagggctacacgtcctcgccttcagagggttggctgcatgtcctcgccttcagaaggtttcacgtcctccgccttcagagggctacacttcctcgccttcagagagttgtaagtcctcgccttcggagggctacacatcctcgccttcagagggttgtacgtcctcgccttcagagagctacacgtccttgcctccaaagggttgtacgtcctccaccttcagagggctacacgtcctcgccttcagagggctgcatgtcctcgcctccagagggttgtacgtccttgccttcagagggctacacgtcctcgccttcagagggttgtacgtcctcgccttcggagggctacacgtccttgacttcagaaggctacgcgtcctcgccttcagagggctgtacattctcgcctttagagggctacacgtcctcgcctctagagggttgtacgtcctcgccttcagagggctacacttcctcaccttcagtgggctacacgtcctcaactttagagggctagacgtcctcaccttcagagggttgtacgtcctcgccttcagagggctacatatcctcacctccaaagggctgcacgtcctcgccttcaaagggctgcacgtcctcgcctccagagggttgtacgtccactccttcagagggtacatccttaccttcaaaggactacacgtcttcgccttcagagggctacacgtccttgcctccagagaactcaagttcctaggccacccccctaatattggggggccaactgtgcgagcacaaccaaaggaggaggcagggatcacgcccacaagacacccagtggactcgaagaagtccaacagggttctgggggcgaggcaccacaatagcccggggacggccagcaacgggcaacagacgcatcgccaccacctccagagtccacctcagctcatctacaaaggttggagcgttgcctacgacccgtggccgaccaagtccaaagccaaagtccaatggcatgcggagacgccctatacggtaatccacacacacacttttgctttcccgactcgtgagtccagtggcatgcagagacacccgatggttatccacccacccacttttgctaccccgacccgtgagtcaggtggcatgcggagacaccttacggttatccgcacctcgtcattcgaagaccccaatcaggtggtaggcggaaatacccaagtggttatccgtacaaagacaacatctgttgatcctgacccaagagtgaggtggcaggaggaaatacccaagtggttatccgtacaaagacaacatctactgatcttgacccaagagtcaggtggcaggaaacttcctgaggaagcctgggctcgcctgggcatgctgggcaacaacctccttcccattttggctataaataagggcaaagaggctgaccgaggtgctcccgtaacgcttctgagacgtttccgtgagcaattccgtgaagattttcatccgttcttcatgcgttcttcggtcttcaaccg

SEQ ID NO: 31179 - DNA, 198 bp, Glycine max
  Peptide Sequence Number=SeqID_147957
atgccacggcaaaacgacttaatgggttactcgttcgcaggaaaaaatcctaaaaggtttgacatgccttcgggatgtagcatagacggactcaaggatgtgatcaagcaagttgcacctcaatcaggtcattctgagtattcaaaaaaacttatcaaatttgaaataattgagctaaaactgacaatgacgtgctga

SEQ ID NO: 31180 - DNA, 357 bp, Glycine max
  Peptide Sequence Number=SeqID_147958
atgcatgattattcctttgtacctcaacacacaaatgatccacttcatcatactaataaaggctcttcagataacagtactaaaaatgaaggatatgttgatctacgtgaccattctgaaacatgtggatatagccaagctgctatgtggtatcaagaaaagacaaggaaaaatataaagcaagctaatcccaaacatagtctttgttgcagcatgggaaggatacaactttcttttctcaagaatcctctaatgcttttgcaaaaactactatgtgatgaaaaatcacacgaaagcaaaaattaccaacaaaatatgagagcttataatatgatgtttgcattcagctctccttaa

SEQ ID NO: 31181 - DNA, 219 bp, Glycine max
  Peptide Sequence Number=SeqID_147959
atgagattatttagtaacaaattcaaaatgagaaatagaaagattaaatttacaaccatagccgctattgccttttccgtcatttcatcccttttacttctccggtgctctctcccaccggtggcaaacatcatcctgcccagtttgcaactacagtgcggatacggtttcagtgacaagcatgaacctttgtttgtgggagcagaaggacaacagtag

SEQ ID NO: 31182 - DNA, 704 bp, Glycine max
  Peptide Sequence Number=SeqID_147960
atgggaagcaaagatgttcaagttatccgacaagtgggttgtttgaaagggaggagggaggggtgtgtccggagtacttctggtggatccaggaggatggtgtacatggagaggaataagaaatcgatacagacatgtgaggtgttcatgatgtggggcattatgcagcttctgaggaaggaaaatgtagatgagggaaatgagttggagaagagtggtcatgtccattcacgctctactaactcatgctttacttttcttcttgctttcaagcttgatcttctccttcatacccatggtgttgccgcaactgctcctcctccatctctgccttcctcccccgccactccacctccttctccccccatacgactcgccgtgtcaactcgtccccaccccccgagtcacaaaaatcgtctttgtcacaaccgcaccaaactccacaccctatgcctcgaattgacggccacgccagcttacggaaagatcctcgcggcgttccgcttacgcgtcaggcttccagcagtggagagcgcagccacgctcaggttcgacctttgtgtgaatgtctccgacttggcgaggccggggctgccgattcaaccggttcgacctttgtgtgaatgtctcatgctcagaggtactgaagtgtctcgtggttcaactggtttgaccttcaaccccaacaagcatctcaaagaaga

SEQ ID NO: 31183 - DNA, 435 bp, Glycine max
  Peptide Sequence Number=SeqID_147961
atgacgtcgccgttaccgtggccgtcaattcgaggcatagggtgtggagtttggtgcggttgtgacaaagacgatttttgtgactcggggggtggggacgagttgacacggcgagtcgtatggggggagaaggaggtggagtggcgggggaggaaggcagagatggaggaggagcagttgcggcaactggcgaaagaggaagatcaaacggtcaagagcacgaagaccgacagattgttcattcatagcgagcgtgctgaagagagagagagagagagcggcgtactgggaattgaaggggtgaacaggggaaatgagaagacggcccatgctttcaattatttaaaaaaaattaaattttccctcaaacaaagacgcttttttagtagtgagagaactgaccaccatgggtatgaaggagaagatcaagcttga

SEQ ID NO: 31184 - DNA, 351 bp, Glycine max
  Peptide Sequence Number=SeqID_147962
atggtgttgttcctttgcaaatggaaaaagagtagtgctctcaatgagaagatgagaagaaagacacatggtacttcatctcagttagagaaggagaacagagacaagaaaaacaagcagagagagaaatataatggtgatcgtgtggttactgctactagtgaatatcttgttattctccgtgaccttgattcagttaatcttatatctaatgagaacatgtggataactgatagtggtgctacattgcatgttattgccaggaatgagttctttacatcttacacaccaagtgatgggtacttgcaaaccaacataggaatgacgttgttgcttagggagtcaaactag

SEQ ID NO: 31185 - DNA, 483 bp, Glycine max
  Peptide Sequence Number=SeqID_147963
atggcaattttaggatacttgttaatcctagtgaaggttattactctttctattacctattgggctatgaaggctcacgtcagtaagctatggaaaatagttgacaacgttaatgaaagtgcaattgggaggaatactattgagtgtgttttctgtgatgaatatgtcaaagttataatagacttagtgagagatagcaatgttccttctccttttttggcaattcaacatagcagattgcaagccaaaattgttggatttatggataatacaccttggtgggagttagaaaatgaccatcgattggtagaatataatgacacaagacattaccaaactgaagtcagtgttccactaattccaaggtgtcataccctaatttcgtctggggaccattgtttgttggcatgcgactttcgcttgatcacctcaaaatgtttaacacccatagttgtggaatctgtaaagttccgagatgtttag

SEQ ID NO: 31186 - DNA, 261 bp, Glycine max
  Peptide Sequence Number=SeqID_147964
atgaatgatgatgatgatgataacgaagtgacatcccagcgagatgcacgtcgatcgaggatcaaggcacatgcgatgtgtggtcatgaagatgaagtggattatgtgggatgttcgatcatatcgttgcttttgtgtgaggcaattgtgcccgtattggagaggagatcgcgtcctcaaagcaacaagagaccacatagtggtatctgggggatgatcgcatggcatgatcgtcctatggggtttggcgttgagtcatga

SEQ ID NO: 31187 - DNA, 1038 bp, Glycine max
  Peptide Sequence Number=SeqID_147965
atggagaggctcaccgtgtacttcattgacatgctacagggtctgctagaaggtttcgagggtgtgcacatccaccgcgacgatcatcatcatcatcatcaaaatgacaccctcacgacgttccaattgcttcatgacatgattcaatcaaacattgttaatatccaatgcgaggaagaagttcaagacgatgctttggagcatcgcgacggagaaggggttgccgacaaggacgaagacgaagttgaagacgatgtgcttaaattcgatgctcataagcatatggaacctctactggcgaaaaatccacctaacctagcttctgactgcttttcttccaacctcatttctgcattccagttgcatgttccgcaacctaaccaagatcctgcattttcattctctggtgtacagaggttgtcacctgtgttggtagaagaacctcacttcacttgggctccaaggattaacattgaaatgatattgatggatgagaaggctcataagattgttgctcaaattaaaaatgttgatcctggtaagtggaatgatgttgttaaagtggaaatgaagtatgattttacactatttgatgatgtttttactagcagtgctaatcctgactacttaatagatgttatcggggagttacttgatgtattgcaatggagccttgatggaaaacccaaaaagttggtcttcattatgaaggataagtgtggaaccattgtcaattgtactctatgggaggatttcactttcatgctgaaagattatttggacaaacatgaaaatggaccggaaggtgaatttgatccaaaggacattcccgaggctattgataggatactgggcaaaaaatttgcttttagatttaagggtatgctgaacaatactcagtatcctgtgtcgcaaatatcagaggatgaagatctaattatgttattattgaagagacttcctacatatgagcttgttgaaattgagcctgaaatgttagatttgtctatgaagcagagagacgatatatcctatact

SEQ ID NO: 31188 - DNA, 306 bp, Glycine max
  Peptide Sequence Number=SeqID_147966
atgaagaagtaccatatcgttagcagcaagggtgctgccattgttggcaacaaacctccaagagaaaaaacagtgttaatgcccactcaatggctcggcagaacaagcaaggaaaagtatacaggaaagaaaggaaggatccagaaggggacagggaacatttaccctgctgtaatggcagacatcaaagacaactctcctgctaaaacagatccaacaacaatggtggccaagagtcttgagtttgatcatggtgactccttgcttgcacccttcaccccatgtaaattcaagcaagcaaattag

SEQ ID NO: 31189 - DNA, 231 bp, Glycine max
  Peptide Sequence Number=SeqID_147967
atgatgacaatgtcagtggttgtgatgttggtaatgatggttaacgatggtagtgtccgaagcgacggtggcgccaatgtggtggtaggggtgtgcaccatgaagaggagcaaggaaacaccaaaactcaagtttgttcgcttagcgagttgttggtcacttagcggggaagaagttgaagagtggaagacacatggcagctcaaagttgggttctaaagaggcaaagtga

SEQ ID NO: 31190 - DNA, 345 bp, Glycine max
  Peptide Sequence Number=SeqID_147968
atgaaggtagcgatcataaaggtagtacttgggtctacaatgaatcatgttgagggatgttggattggtgaagaatttgcaacttcagaaggtggaggaggtggtgttcagtcatcgtctagattctcaataggcatgcataacttcttgatggtccttctcttaggtctaaggacttcttcaactgtgtgcttcactcttggacacttgggaattggtgcatcaaaggtaggcaacttcagcttcttggatgttggtgcttcaatagggttctcttttgttacacccattgatctcttgtcatatataacattacatgtgggtgaaaacgaactacaagagtag

SEQ ID NO: 31191 - DNA, 408 bp, Glycine max
  Peptide Sequence Number=SeqID_147969
atgcatcgctgtcacccaactcgtgtactcccaacagtcatccaacttaaaagcgtaaaaccattgtgttctgggagttccagtggcagtagactcgttcatctatttgatggtttatgcgaagtctggaagctcacctatacaatcaacatcttttcaaaatgtcatggtgcagttgtgaccaagttgtcgtttgattctgacgtcggagatgaggatgctaactcgaaatatttcgaggagcctttatctgccactgagtcatctaggaccatgctgagggagactcacactttcctaccagggaatggatgtcttccagtgctagagactggtttggaagaggtgacattgtctgaggcagtgcttagggcagatgaaggaagacacaaaggagattccctatga

SEQ ID NO: 31192 - DNA, 234 bp, Glycine max
  Peptide Sequence Number=SeqID_147970
cgatgtgaggacgaattagttattaagttgctagggaagaagatagggtgcggtgttatgaaagataagcttaatcattcatggtgtttatcaaggggatttgatacatcattagaggattggaagttgtttgaagaattggagcatcgtgccagtgcaccaatgcatgcccagtgcgagaagccaagttggaagccagttacatgtttgctaagcgtgtgtttggaggcttag

SEQ ID NO: 31193 - DNA, 252 bp, Glycine max
  Peptide Sequence Number=SeqID_147971
atgtcaggatttacacgcaattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaaggggtcttcgtcattggaagtgcggtagacaggctttgtggttga

SEQ ID NO: 31194 - DNA, 297 bp, Glycine max
  Peptide Sequence Number=SeqID_147972
atggaagaagattcctctcaggctatcccatctaatcacatcaatcatattatcaaggccaccaaacccatcaagtcaacctctaggcccttggaagatgaagctaaggatgatgaggtggtgaccttaggggagaaaaatgttgcaactttgaagctgaacccacagtctataatggagaaagcatgcacttgtactaatgaggaggatactcaaaaaaggaagaagaaaagaaagaaaaagaagaaagcaaagaagggcagtgatgcaatcctaccccccaagggtatcgaatag

SEQ ID NO: 31195 - DNA, 3339 bp, Glycine max
  Peptide Sequence Number=SeqID_147973
gtacgcgcaggggaccttctgagggtttctgaactccaacaagaagcttcatccattaagcaaggttctctctctgtgatggaatacttcacgaaactgcgggtcatatgggatgagattgaaaacttcaggccagatcccatatgcacatgcactgtaaagtgtacttgcttggtactcaacaccatagctcaacgaaagcaagaagatcgcgtgatgcagttcctgcgagggttgaatgagcagtatggcaatatacgctctcatgtgttactgatggatcccatacccacaataccaaaaatcttttcgtatgtggcacagcaagaaagacaactaggtaacaattctttatcgagtttcaatcccgaaccaaaagaaatatcttccattaacgttgttagaagtgtttgcgaattcagtggacgcactggccataatgaaagcgtctgttacaagaaacacggcctacctcccaattacgatggaaaaggaaagggttacggcacgaggaaaacatgcacttactgtgggaagcttggacacacaattgatgtttgttacaagaaacacgggtatcctccaggattcaaattcaacaatggcaaagcaatagctaatagtgtagtggcaactgaagggaaggccacagatgaccaaatactatcccaagaatcacaagaacaggttcgtttttcatcagagcagtacaaagcacttctagctttaatacaacagccgtcggccggaacctcagcgtccattaaaccacaggttgcctctatttcgtcttgcaccaataacgatccaacagctgattccactctcaccaaggttaagtatcctcttcactctgttttatcctattcccgcttgtctcattctcataaacactttgtcatgtctataaccgccataactgaacctcgtacctatgctgaggcctctagccacgactgttggattaaagccatgaaggctgagttagatgctcttcaacagaaccacacttggattttaactccacttcctccacataaaaaggccattgggtgtcgctgggtttacaaagtcaagcataacgcagatggaagcattgaacgatacaaagcgcggctagttgccaaaggatatagtcaacaagaaggtttggattttcttgatacgttttcacccgtagctaaacttactactgtacgcatgcttttagcccttgctgctcttcgaaattggcatcttagacaactcgacgtcaacaacgcttttcttcatggggatctccatgaagaagtctatatgaagcctcctcctggactcgttatggatgatcctaaccttgtttgccgtcttcaacgttccttgtatggacttaaacaagcaagtaggcagtggttcacaagactttcatcatttctcctctcacaaggctttcgtcagtcttcagcggatcactctcttttcttatattctcacactgataacactataacagctgttcttgtttatgttgatgacataattttggcaggagataaccttaagtttatcattcatttcaccaaactcctcgatcaaacttttagcattaaggatctgggcactctgaagttcttccttggactcgaggtagctcgttcaagtcatggcatacacttatgtcagcgtaaatatacactagacatcttgtcagactcgggtatgctcggttcacgtccagtctctactcccatggactactccaccaagttaagtgcttccctgggcacaccattatcaaaaaccgctgcttcatcatacagacgactaatcgggcgtctcatatatctcacgaacacacaacccgatattgcgcatgcagttcaacaactaagtcagtatatggcaaacccaacttctactcattctcaggctacctatcgagtcttacgctatctcaaaagttctcctggttcaggcatgttctttgctgctcatggtgacctcactctcaaagcattcagtgactccgattgggcaggatgccgagatacgcggcgctccatcactgggttctctgtttatcttggggaatctctcatttcttggcgatccaagaagcagtctacagtgtctcgtagctcctccgaggcggagtaccgtgtcctggcttccactacatgtgagcttcaatggttaggctatcttcttcacgacttccgcgttccattccttcaacctgccacactcttttgcgacaatcaatctgccattcaaatagcttcaaatccggtcttccacgaacgaaccaaacacattgagatcgactgccatattgtgcgggacaaagtaaacacaggcttactaaaacttcttcccgtttcttcttcaatgcagctcgcagacattttcacaaagcctctcactcctgctatctttcaagggcatgcagtatttggtcactttgcacgtgatttacgcttatctttctctctctatggcacaatacctttattaacaggaggtactctaccacttcctcttccaaggcctccagagccatccatcagcaccaccactacaccaacaagaagaggagggactccaccacttcctctccgaaagcctctgatgcgctccctctccctctgtacctcaccaacaccatcttcttcatgctcttcttcttcgtcgcaacaaacaattaaatcaaattcagagagagataatgagaaaattcagggttggttctcgcggcagagtagagaagaggaggtgaagccggtgtcattgttgctcgtcaattggaactcctacgcatccacccaaacctctgaagattcatccactttccccttcgatatcaaatccgccattaggtctgccaacgacattgtttctgacactttcaacgtgtcgagtagatttgcaaggctccaaggtattcagtatgctatagctgggaagaatgcttatttgagattcacttgtagcacgagtgatgccatggggatgaacatggtttccaacggggtgcaaaacaaacctgctgcagtgaattggatcgagggacgtgggaaatcagttgtttgcgaagcaattatcaaagaagtggtgcaggtgttgaagaccaacgtgtctgccctggtggagcttaacatgctcaaaaaccttgttggttctactatcgcaggtgctcttggtggatttaacgcccatgctagtaacattgtttttgccatctttatagccactggccaagatccagctcaaaattttgagagttcccattgcataaccatgatggaagccatcaatgatgggagggaccttcacatcttagtgaccatgccctccattgag

SEQ ID NO: 31196 - DNA, 261 bp, Glycine max
  Peptide Sequence Number=SeqID_147974
atggcaggtggaggggttgcttacacgttgaaagtgtcagaaacaatgtcgttggcagacctaatggcggatttgatatcgaaggggaaagtggatgaatcttcagagagggagagggagcgcatcagaggctttcggagaggaagtggtggagtccctcctcttcttgttggtgtagtggtggtgctgatggatggctctggaggccttggaagaggaagtggtagagtacctcctgttaataaaggtattgtgccatag

SEQ ID NO: 31197 - DNA, 1002 bp, Glycine max
  Peptide Sequence Number=SeqID_147975
atgatgaagtggggcgtcaaaggccaagtccttgctaatttcgtggttgaacttacacaagcaccccttcagcagatcgaatcttccccgtgtgtgttgttggtcaatggcgcagttaacaaggtaggtagtggagcggggatagtattggaaggtcccgatggggtcgttgttgaacaatctttgaagttcaacttcagcctaacacacaatcaggccaaagatcctcagttggccaaatacttagagaagatcaaggagttagctcagttgtttggtagatttgagcccgaccacctgctcagggccaataatgataaagacgatatactgtcaaagctagggagctcgaaaaagcatggcctaccggttgataaaatggagggagcaaaatgcatcaaagaggctactaggtatgtacccattaggggaaaactttaccatagaggccttagtcaacccctcctccgatgcttagctctcactcaggcgacagtgattgtcactgaagtacatgagggggtagaggcaactgataaagtgatactaaatgggttaaagacacactttcaacaagctcgggagtcatgggttgatgaagtccatctggttttgtggtcatattgcaccaccctacactcatcgattcacgaggtgccattcaccttggtatatgggacaaatgccatgatcctcattgaagttgtcaaacccatgtttcaggtagacacatttgaagaagaaaggtttgacgttgatcgcctagttgatttggatactattggtgaaatgcaagggctcaacaaaattagattgccaacaagttacctcccaaatgggttagcccttattgaattagccaagcaattggcctataagctttgggcattaaccgaacaaagaaggctagctcagacaaaggtgtcaatcttgttgggatcttatccagccagggtcaaatttaggggtgccgaccttgtcgagatgcctaagtctgactag

SEQ ID NO: 31198 - DNA, 858 bp, Glycine max
  Peptide Sequence Number=SeqID_147976
atgggcgcacatatcggtcatcataaatgtcatgccaccttccgccagcacagcattgaattccgcggtttgactgcgctgtttggccatatggggctggagctggatccactcaccgtggatgagaaagagcgcgagggatatcgccactatgccgccttgcacaagcagtggcgtgaggtgatccatcgcggtacccagtggcgcgtggatatgccggacgccaccacgatggcgcagggcatcgtgagcgaagataagacgtacggactgtttatggtcagccagctcgcgatgccggattacaccttgatgatgccgctgcgtatgccggggttagaagccagcgcgcagtaccgcatcacgctgctcgatcacccgaatattcagattacgggtgagggtgggcacaccatgcgcaggctgccggtgtggatggacgcgccgcaaacggtgagcggtgagtggctgatgcaggccgggattgcgctgccgattctggatccggaaaccgccattctgattggcgtggaacgcgtcggcgggctgtacatcggctttgttttctcggcgggatcgggggcgattgaggcctatatcgaacgcgtaagccgcaacagcttctttgaatacggcaaggcgcgcatgttcggctgtcttggctgggggctgtgcgcctcaacggggggcatcctgttcggcatcgatccgtcgtatgtcttctggatgggttcgggggcggcgctgctgttgatgctattgctggtggtcgcgaagccgaagcccaaccagacggcgcaggtaatgaacgccactgggcgccaaccagccgcagattacagccagaaccgtctttaa

SEQ ID NO: 31199 - DNA, 258 bp, Glycine max
  Peptide Sequence Number=SeqID_147977
atggaggatccagagatgagttatgagcaagtggtgcagcacctgcccttcctagccctaatgcccactttttgccttttctcgatcttaatggtaaactcacttgtagttcaagtacagacttcggttcagcttttagcacattggattgctcactctccgtctagcaagaatgttgctaggtgcacccagcattctataaaaatgacgaaattgtccttgcttggttttcttcttacggatcaagttgatccgtaa

SEQ ID NO: 31200 - DNA, 351 bp, Glycine max
  Peptide Sequence Number=SeqID_147978
atggttttgccaattaggcacgttgccacgtgcgtcactcagtccttggttgctaggtctctttcctccgaggcacgacttagttacatgagcattttggcgcccgctgtggggaacgatgaaactattcttgtcgccctttgtttctgcctatattcctttccgatgacaaggccactcagaaaatcagcaatgaatttgaggaatgatggtggggacccctcgatgctggagcagatggaatacatgaggaggcagatggcacagatgaaggacataaggagggagaatgttgaagtaagaatggaaaatgcagaggcgaggagggtggacgaagctcttcatgcctag

SEQ ID NO: 31201 - DNA, 1050 bp, Glycine max
  Peptide Sequence Number=SeqID_147979
atgcaggaagagttgtcagctaatggaggaccgctaggatccgaggggtacacaactcctcagtctcaagtgcgtaagcacaaaggaactaagacaaagaatgtgtgtaagcacgaagaggctaagggaaagaggcgatcagatgtaagagcatattgtgatgcgtggggtgaaaactttagggacgtgactccttggtcgaagaaaatgaaagtgatttttgacaaagatcttatggcggtgacgacggttcgaaggcaaaaacattgccgaaaactaggctttgttgtgccaaaggaaaaaggtacactttttgctaaatctcaaagaaacactccaaaatcattctcgtgtttccttcttgtggtggtgaaagtgatttttgacaaagatcttacggcggtgatgacggttcaaaggcaaaaacattgccgaaaactaggctttgttgtgtcaaaggaaaaagatttgattctttgggatgggcaggagaagaagcgaaaccattattgggtcaccatggagataaactatgaaaccctctatttgtgggccaaaccagaggttgacaaacaaaaaatcaataaaaccgcttgggtgtcagtgaatagtgttggcggacgaggaatattaacattattcaccacgtcgtataaaatttttaaagatcgactcttccaagtaaaggctatagaagaaaatgtggaacttttggatggtttcccaaaccattggacaagtagccttcgtaactatggagggtacaatctagaggccctatcaacatccgaccaatgggatgttgaagaaatgaaacaactaactttattcactaccatgtttaaatcctcccgcatcattgagttagagtatcggtcagtggatttaagagtatttattgaacaaaccacaaagaaaagtatgaccccatttaagcacaaaatggctcgacttcttgcgaagaaagagaaggttgataagatggcggcggctaccgccattgttgctggggtgctacgaccaatgcggttggcaaatcctcgacgctaa

SEQ ID NO: 31202 - DNA, 525 bp, Glycine max
  Peptide Sequence Number=SeqID_147980
atggcgggagtgagggagcaggaccagtatatgccgatagcaaacgtgataaggatcatgcggaggattctaccggcgcacgcgaagatctcggacgacgcgaaggagacaatccaggagtgcgtgtcggagtacataagcttcatcacggcagaggcgaatgagcgatgccagcgcgagcagcgaaagacggtgactgcagaggacgtgctgtgggcgatggagaagctcggcttcgacaactacgcccaccctctctctctttaccttcaccgctatcgcaagaccgaaggcgaacccgcttccgccagacgtgcttctgcatctgcatccccatcgatgcagatgcacccacgcacacacccacactcacatccacctaattattctcatcatggcttcggaatgtttgactttgacccatcatcgcaagggttttacagggatgatgcatctagttctggctctggtggatttgttgccagttttgatccttatgctaacatcaaacgtgatcccctgtga

SEQ ID NO: 31203 - DNA, 267 bp, Glycine max
  Peptide Sequence Number=SeqID_147981
atggagaagctcatggaggagaaccatcgtgaggaggttctaccaaattcggtaagaacattcaatgcctaccatagggctcgaacccactatcacaaggttaagagccttggggaacttatgaagtacaaccatatcttcctagtaggagggacacatgaatactgtaacacttcgaacgaatcacaccaaaatgagaggaatctagaaattatacaggggaggaagtccattaaaaaggaaaacgagtttctccttgccgagtaa

SEQ ID NO: 31204 - DNA, 747 bp, Glycine max
  Peptide Sequence Number=SeqID_147982
atggatcgaagttggatgaatgcaagtcacatgagccctgcatatgagaatgtggttcaacagttcttgaaatttgcgttggaaagaagtcggtcggttgaggatgagagatatttatatccttgtattaaatgtttgagtgggagacgacaaaagtcattgaaattgttgccagcggtgttaagtctggttaatgtgaaggccaaatatgggtggagtgacaaaaactttacatcattgctgaaggtaatgcatgatatgcttccagaagaaaacacgttgtcaaagagttactatgaggcgaagaagatactgtgttcgatgggtatggagcatcagaagattcgtgcatgctctaatgattgcatattgtacaaaaatgagtttgaagaaatgcataaatgccccaggtgtggggtatcacagttcaaagtgcaggatgataacgagtgtagtagtgatgcaagcatgaagaaaggtcccccaacgaaggtgttatggtatctttctatcattccaaggtttaagtgtatatttgctaatggagatgatgcaaaagaccttacatggcatgcagatgggagaatctacgatggaatgctctgtcattcagatgattcttctcaatggaagaaaattaatcatttgtatccagatttcaagaaagaggcaagaaatcttaggcttggacttgccactaatagaatgaattcatttggcagcttaagcactaagcacagttcgtga

SEQ ID NO: 31205 - DNA, 561 bp, Glycine max
  Peptide Sequence Number=SeqID_147983
atgaagatcttaaaaggacataccaagaatctacaccatcctgaagcatccattactaaaagctacattgcagaagaaactattgacttttgttcagagtacattgaaaaggaaaaacctgttggccttcccgagtctcgacatgacgagagagtggttggcaagtgttcacgaggattggatgtttcaactctaggtctaaaggaattgaaacaagtgcatttgtatatattgaataacaataatgaagttgtgttgtacatagttcgtcacaaagccttagtcaaggaaaataacccaaaaatggtcaaaaagtgcatcgctacactaccgagctccccttcttctgagtcaacaccttcaccgtctacgtcgaagatgatgagaaaagccacacgacttagatccttgtctgccaaacctgtggaggtagagagaccaacggttcacgttgatcttaccactgggaaagatgatggttcacacaaaaagaaattaaggacctatttgggggtcatcgctcgagacaaagtggatgttagatgtgttaactgcaaatag

SEQ ID NO: 31206 - DNA, 576 bp, Glycine max
  Peptide Sequence Number=SeqID_147984
atgtatccagttgaatggaacatgaaggtcttaaagggttatagcaagaatcaatatcgaccagaagcttccattgttgaaaggtatgttgctgaagaatctattgagttttgttcccagtatattgaaacagttaaatttgtcgggattcctcaaactcgtcatggtcggacatggggagttgttgtgccaaatctcaatgtccctgcatggaagggatatgatattaacaattattccttctacaccaagtcacaggatgataaaagtaacatgcagaataatggggataaacatgtaccaaagggattgacaaagcttgttgataggccggaacatgatgacgatctcatatatcatatgacattgatgatcccacaacttttcctcaagcctatgcaggtgtcgtgggatgcaactatgtttagggtgtacaatgataatgtccccttaaagcataaagatctttgggaaatagcacacgatgtgggcattagcaactggtggttatatgtcctaaggacaatgttgtcgcctggttttgttccttgcacaataagtccgacaactacttga

SEQ ID NO: 31207 - DNA, 177 bp, Glycine max
  Peptide Sequence Number=SeqID_147985
atgtctggaaattcaccatgtcatatccattttgtattggcatcttttattcccacatttaacatagggacagaaaaatttcctgcgcaaagaagcattttgcattggtctccaagtacacgagatgaaaccggtggcatgtcatcatccacgacattcaactatgcacccggataa

SEQ ID NO: 31208 - DNA, 462 bp, Glycine max
  Peptide Sequence Number=SeqID_147986
atggaggttgcgatgaaaatgaaggaaatgaatctgagaggtggctctagagattcatcaatgataaagagcacaaagccattgcaaatttggcagacacatgaaagggaaagcatagagaagtggtttgaatccatccataacatatacatggccaaacacaagagtgactcaaagaagcctttgtattcggggtgcaagaactccttgacgctgttgttggctgtcttaagtctgtacaaagtgaatgatgatgaggactacagttcagatgaaaactcaaagaagggccctccagcgaaggtgttgtggtatcttccaatcattccaaggtttaagcgtctctttgctaatgaagacgatgctaaagaccttacctggcatgcaaatgggagaaaatctgatggaatggtccatcatccggctgactgctcgcagtggaagaagattgatggtttgtag

SEQ ID NO: 31209 - DNA, 387 bp, Glycine max
  Peptide Sequence Number=SeqID_147987
tggaataatggtggtggtggtggcaacgtcggcggcggtggtggtggtgacaatggtgacagtgacaatggtggttgtggaagtgacggtggtaatggtggtggaatggtggaggtgatagttgtggtggtggtagtggaggaatggttgtgctggtggcggtggtggaatggttgtggaggtggtggtggtgtaggtggcaacaaggtgtggtggtggtggaatggtggtggtggaatggtggtgatggttgcggtggtggaggcagcgacgatgatggaccaagtccaactcttgagatatttggagaccttgctttctttaggagatgacgaggaaaaaaggatgattactatggaactcttgatggtagactactcaatctag

SEQ ID NO: 31210 - DNA, 1292 bp, Glycine max
  Peptide Sequence Number=SeqID_147988
gtccgattccttgtggtattcgaaacctcacacttattcaaaatcttgacttgtctggaaattcattctcatcttctatacctgattgcttatacggtcttcatcgtctcaagtctttggacctaagatccagcaacttgcatgggactatttctgatgccctgggaaatttgacttctcttgttgaacttgatttatcagctaatcaacttgaaggaaccattccaacttctttgggaaatttgacttctcttgttgcactttatttgtcatataatcaacttgaaggaacaattccgacttttttgggaaatctccgcaactcaagggagatagatttaacatttctcgatctctctattaataaattcagtggaaatccatttgaaagtcttggatcactctctaaattgtcatctctttggattgatggcaataattttcaaggagttgtcaaggaagatgatcttgcaaatcttacaagcttgacggattttggtgcatcgggaaacaatttcactttaaaagtgggtcccaattggattcctaattttcaacttacctatttggaagtgacatcatggcagttaggtcccagctttccattgtggattcagtcacaaaacaaacttaaatatgttggactatctaacacggggattttcgattctattcccacttggttctgggaagcacattctcaggttttgtatttaaacctctctcataatcatatccgtggtgagcttgtgactacaataaaaaatccaatatctatccaaactgttgatctaagcacaaatcacttatgtggtaaattaccctatctttcaaatgatgtgtatgacttagacctttcaaccaattcattctctgaatccatgcaagattttttatgtaacaatcaggacaagccaatgcaattagaatttctcaatcttgcatccaataatctgtcaggagaaatacctgattgttggattaattggccatttctagtggaagtgaatttacaaagcaaccattttgttgggaacttccccccatccatgggttccttggctgagctgcagtcattagaaattcgtaacaacttgctctcgggaatatttcctaccagtttgaagaagactagccaattgatatccttggatcttggagaaaataatctttcaggatgtattccaacatgggttggagaaaagctctcaaatatgaaaatcctccgccttcgatcaaacagtttttccggtcacattccaaatgaaatatgtcagatgagtcttcttcag

SEQ ID NO: 31211 - DNA, 225 bp, Glycine max
  Peptide Sequence Number=SeqID_147989
atgtctttattttcaacaaggcgttgtgctttgctagaattgctctattcatatgaggaatgtcaccaacacattcttttcaacttaatatccttgggtgaatttggtttaatcgcggttgtcatggccgtgatcacgacagaacaatcctttagtgtgaccactagccttgttgcgaagcagtttaagggaacaattgttgtgatcgcaatcacggatgagtag

SEQ ID NO: 31212 - DNA, 588 bp, Glycine max
  Peptide Sequence Number=SeqID_147990
gctatttcgaaaccatcgacggttcgctggaagaagcagccgcgctggatggggcaaccccatggcaggcgttccgtctggtgctgctgccgctctcggtgccaatcctggcggtggtgtttatcctgtcgtttatcgccgccatcaccgaagtgcctgtcgcgtcgctgttgctgcgcgatgttaacagctacaccctggccgtagggatgcagcaatacctcaacccgcagaactacctgtggggtgactttgccgcagcggccgtactctctgccatcccgattaccgtggtgttcctgctggcgcagcgctggctggtcaacggcctgacggcgggcggtgtgaaagagggtgatcaccagcagcaggatcgccgccgagtagatcagcacatcaaggggagatttatgatcgacgatgatcagccgcactatcgcgtagagaaagtagaccaccagtccttccaccagcgcatatttgctggtttgctcgggggcgaacagcacatccgccagatgcaccgtctctttacccaaaaagacgaccagtatcaggccaaggctcagcagaccgaggttcagcacg

SEQ ID NO: 31213 - DNA, 477 bp, Glycine max
  Peptide Sequence Number=SeqID_147991
atggcttgcctctcaactatacgccacccaatgtggcatacactctcaatgagaatgtcaataaatccactcctatacccattgagagccaacaaccccaaactgatcatgcacagaaatgggaaagttggatcatctagaggaaaggctcagggcattgaagaaggtgaagattatgcctttgctaacctagaagagttgttcctagtatccaatatcatcacccctcccaagttcaaggcgctggactttgacaagaacaaggggactacttgccccaagaaccatctaaagatgtattgtcggaagatgggggcatacgcaaaagatgaggaattgctaatacattccttccaagaaagtcttactggggtagctgttacctggtacactaacttggaaccttcccgagtccattcttggaaggacctaatggttgccttcgttaggcagtgtcagtataatggcttcggatag

SEQ ID NO: 31214 - DNA, 321 bp, Glycine max
  Peptide Sequence Number=SeqID_147992
atgcagggtgggccccaatctgaaccgtttgatgtagaaatgggagatcgcttggaggacatgattcgtgaccttgggcaagagtcttttcagcaagcacatgcatttggcaggttttgctttggtggatttgttgaggaatgggacacaaacaaagggaataaacatgatgttacaactctttttaacttatctatcaaccttgcaaataaaggtagggccattagacctgccattgtgtcacctttgcttcaattgctcaaggacacaaagttgggcatgattgaagaggcactctacggtttgttactccttgtatga

SEQ ID NO: 31215 - DNA, 285 bp, Glycine max
  Peptide Sequence Number=SeqID_147993
atgcacaacctgaattctaatatcattgtgcttattccaaaggttcctaatgcggatagaattgagctcttcagacctatcgcatgtggtaggaatatattggattacattgcagtcacgtctgaggcaataaacatgttggacacaaaggcctttagtggaaacttgtccatcaaagtagacataaaaatgtgggtaaaagcaatcattttatctactaagttgtccatctcaatgaatggaaagggcaaacagttagtcatgaaaaatcagtcttctaccatg

SEQ ID NO: 31216 - DNA, 213 bp, Glycine max
  Peptide Sequence Number=SeqID_147994
atggctaagagcgtctttggctacacaaaaatagcaggggggaaaagggggtctccctggcagactcctcttgtacaattgaagaaatcaactacctttccattcattgagatggacaacttagtagataaaatgattgcttttacccactgcacgaaaacttcaaaaaaacaaagcaactattataaatgtattacattggcagttgaataa

SEQ ID NO: 31217 - DNA, 252 bp, Glycine max
  Peptide Sequence Number=SeqID_147995
atgtcggtggtcgacatcaagataggggcactactagagaagttgcattctatatcggttaattgggtcattctacatcggtttacgatcatcgtcatagacgacatcataaaaagaggtaggctattctacgatggtcgcacagaccatcttagaatgggtatatttctaagatgttgcttgatccagaggatgggaattcagagaaaaacttataacaacaacaacaacaacaacgccttatcccactag

SEQ ID NO: 31218 - DNA, 663 bp, Glycine max
  Peptide Sequence Number=SeqID_147996
atggctgaagcaattatgggtttcacccctttcaaatcacacactcttagctcatgtctacaaacaaacaagtttcaagtgaaccagtcttcaagattgccaaagcaacattcaaactctagtcttatcaacagaccgtggcaggtcttagagggcaagagcaaaaaaagaggatctttgtgtaaagtgaatggcttgccagattggccactgatggccattatagtagagcaaatggaagggcagagagatttgatcactgagaaaacagtttcccatcttagtgatcaggcaataaaaaatgtttactcttggtacataatgttcaccgtttgggggtgcttattctttggtgccatgaaggatccatattacgactcagaaacatataggggagatggaggagatggaactggcaactggatttatgaaaagatattttattccattacatcccttgaattatcatcaggcatgccctgcccggtttggattcgtggagttttgtgcttctcactggataccatcattgttaaagatataaatcaagatgctatggaagcagaagccagagaagctctgtggcgggaggagttgattgaggagatagaacaaaaggttgaagggttgagagaacttgaagaggctggcaagaagaactag

SEQ ID NO: 31219 - DNA, 330 bp, Glycine max
  Peptide Sequence Number=SeqID_147997
atgtcctatttcaaatggaaaaagataagagagattgttttttccataaaacaaaatgtccttagtataagcaaaggaagtgcccatgtaaggaaggctaaaagcaacccaagggatttagatcccatgatgagacaaaagatgccagccaccaagaagtccagaaccaagtttctaagccattaccagccaatctttggatctggtctaaaaaccaatctcttggaaaaccaagaacttattcaattttggctaagccgcgctaccacagggaggatgaagaaaggaatcattgctggtcatgaggaagttgtaggtttccatatttga

SEQ ID NO: 31220 - DNA, 213 bp, Glycine max
  Peptide Sequence Number=SeqID_147998
atggatgtgaaggcatcttcaaagatcactatgccaacattagggggtgttttgcttttggcatttcgaaatgataaattagtttcgtggcagctaaagaacgggtggtcaaatgcagtgaacttgtcaaagttgattattttcacaattggtcatatctaccctgaaggaaatacatgtgccgataggctagcctcacacggtgttaactaa

SEQ ID NO: 31221 - DNA, 615 bp, Glycine max
  Peptide Sequence Number=SeqID_147999
atgaactgcagtttggaagttgatttgagcaaagaactcgcagctcctgtgacaggaagcaatagggtaagatataaatcagcaccaacacgtcgtgagcaagaaaaatgggatagagctaccaaggccgcaactggaggcagtgatgtgatgttccgggaaataaggcagtctcgtgaagatccaaaagttttggctgctcaagctgaggagcagtataataagttaaagaggaagttgcaaatctttaccttgggtataggtggtgttggtctggtttcagcttatgtttcttattcccctgagattgcagctagctttggtgctggctttcttggttctttggcgtatattcgtatgctgggaagtagcgtggactcgctaaggactgatggtgcaaagggatttgtcaagggagcaattgggcagccaagattactggttcctgttgttttggtcatggtctataaccgctggaatgcgattctggttccagaatttggatctatgcacttagaattgataccaatgctagtaggttttttcacatacaagattgcaacttttgctcaagctatagaggaggcaattactgtagctacaagaaagacctga

SEQ ID NO: 31222 - DNA, 669 bp, Glycine max
  Peptide Sequence Number=SeqID_148000
atgtcacctcccactctcgttgctcctaaagcaataggtgcaatgacccatgtgtccagaagtgcaaaacgcttaagggaactcagtgagactaaggatgacgaagatggcttggtgtttcggaaaagaaaagttgcgccctctttggatgagaccattgcacctcaagtgaagaaggtgaaaccaacaccacaagttcctcctcgaagggttattcaccttaagaaaaagaagaaaactgagtccactactgacatggacgatgaagttcaacatcaaactcctccatctcccatccaccatcaaggactacccgccatggaacccaacctaattgtagaagacattgcaagattgatgcccaacagattgacccatcttctgatgaagcacatccaagtcttcactcccatgtcacaatttgttcctttattctatggccatcaagccattcctttgactaaggatgacatcttgaatgttgggatgataatgatgcagtgcagattgactggccaatggccaagctaccttcctggtattcacagcaaaccaaccaccaccttcaagttcatgcagaagaaaggcaaagttcctcctcacactaaacctatgcctcaccctggtcctaaggacaacattgtcctacgtccaattccttacgattga

SEQ ID NO: 31223 - DNA, 225 bp, Glycine max
  Peptide Sequence Number=SeqID_148001
atgaccaaaactcaagttgtacaacaatcagatcaaaagtgcatccgaagcaatactaggaaacccggtccagttagtgactcggttgaggtacgaattgtcaaaaccggtccaggtcgccaggttaacaccaaatcggtcgaatctgatcagattatcccggaccaaacacatgaccggtccaataaccaaatcgatccagttatgtcattggatcctgattga

SEQ ID NO: 31224 - DNA, 1071 bp, Glycine max
  Peptide Sequence Number=SeqID_148002
atgactcgtagacaccaccaatcatcatccgaatgtacctcatattcttccgccactggtccaacgcatcatcgtagaacaactccaacccaaaaacaaaaagtagtatcaaaagaagattattacaacgttgacgatgatgcagacgcttctgaatattctcaggaagacgagtacgaatctgatgaggaagaagaggaaccagaacaagacattgatgaagatgacaacaacgttaacggtatttcttccgaatccgtgtccaataatagtacaccacccaacgttcccgaaacaagcacttcaatctccgcttctgatcttcgcaacccttcatcgaattcttcttcttcctacgtgaaaatcgctccgttacccatctttcgcggcatgtcgagcgagtctccggtcacccacttgagccgtttcaacaaagtgtgcagagccaacaacgcttcttcggtggacatgcagatgaggatcttccccgtgacgctcgaagacgaggccgcgctctggtacgacctcaacgtggagccctactacggttctctctcgtgggaggagacaaagttgtcgtttttgcaagcgtattacgatgtggagcccgtcgaggagttgaggtcgaagcttgtgggaatacgtcaggatcagagggagagtgttaggtcttattttctgaggctgcagtggattttgaagcggtggccggagcacgggttgggtgaggatgtgcttaaaggagtgtttgttgatgggttgagggaggagtttcgtgaatgggttctcatgcagaagcctggttcgttgaatgatgccttgaaattggcttttgagtttgagaaggtgtggagggttaggggaaaggagggagtgggtcccacttgtgaggttagggatgtgttggggaaggatcttattgtggggtcgtgttctgtgggagagatcagcagtggccaagaaagggttgaagatgcaaaagggagtgaaggtttggtggggagtgtgaagaaaaagcagtgccacaagtgcgggaagaagaaagatttgaggaacagtagcattgaataa

SEQ ID NO: 31225 - DNA, 1074 bp, Glycine max
  Peptide Sequence Number=SeqID_148003
atggaaaacgtttcagttcttctatgtaataaggaaaaggatcagatggatttgcctcctgggtttaggtttcacccaactgatgaagagctaattagtcattacctttacagaaaggtcacccacaccaacttctcagctagggccattggagaggtggacttgaacaggtctgagccttgggatttgccatggaaagctaaaatgggagagaaagagtggtactttttctgtgtgagagacagaaaatacccaactggtttgaggactaatagagccactcaatcaggatactggaaggccacagggaaagacaaagagattttcagaggaaaatcccttgtgggtatgaagaaaactttggttttctacaaaggaagggctcccaagggagagaaaactgattgggtcatgcatgagtatagacttgatggaaaattctctgttcacaacctccccaaaactgcgaagaatgagtgggtgatttgcagggtttttcagaagagttcaggtgtgaagaggactcatatttctgggatgatgatgttggactcttatggaaacgaattgggttattcttcttctgctttgccacctctcactgattcctcaccttccattgacaacaccaaagtactgagtgttactgatacggcttacgtaccctgcttctccaatccaattgatgctccaagagggatcttcgattccttgaacaacattaacatcaccaccaccaccactaccaacaacaacaacaccctttatggagtttcttcaaaccattcattttacaatactcaacttcatattccaccaactttgccattacctagttcttcaaaccattaccttagagcctttcttgaaaaccaaggaaatggatcaaacatgaggaataatggttatgaaacagagagggaaatggtcagtgtctcacaggaaacaactatttctactgatgtgaacgctgaaatctcttcattgggtaaaaggcaatttgagaatcagcagaatccaactgcttcatcagctgttgttccaatggacgttgctaccttgtggaactactga

SEQ ID NO: 31226 - DNA, 651 bp, Glycine max
  Peptide Sequence Number=SeqID_148004
atggcggaagaattatcaacagcgattccgcaatcgcaagcaagctccacgaagaaacgcgcttcaaagaacgaaaagctgtgcctcgaggactaccttcacctcgttcactctcgccaaacgcttcagctcaccatgaatcaactcaatcaggtcatccgcattcacggcttcaagaaaatccaccacgctcctaaggttttcgtttcgagaaattgcaaaaacctaagtcgatttagtgcgcagaaagtgctggtgcaagcggtggagtcgctggatctggtggatctgccgcggtcaacggtgagcgagagcgtgtcggcgttcgcggcggtggcgctggaggacgtggttgcagatctcggcgagctcagctggcaggagtgctgcgtgacctccgtcgagaagatcagcttctccgacggccagagcgtgttccctgctgcttgctccgatcagagcctccgcgtcgtgaaccactcgctgtcacaggctcagaaagagaacaggatcgacgaaacccgtaacccaatccctgaagcttctagtaaagacctgaaaccaacgaaaatggtgctgaagcggaagaggagcaaccttcgcgactctgttgcctcgactttggattccgcttctctcgcttcgtgctga

SEQ ID NO: 31227 - DNA, 276 bp, Glycine max
  Peptide Sequence Number=SeqID_148005
atgacttcccttttggtgattttcgaacccaccatcacgccaccatcgcataagctccaccatcgtcacactgtcttcgcacgagctccaccaccatcatgccgccctcgcacgaggtttccaggccttcgttgcacattgtcgtgccgtccgctcatccacatcgtcgcacacgccgtcacgcccacgccagctgacccttattatttgattgatgtcgttgtccttaccagtgcttctttgcttggccttttgtctcgttcgttttgggtttag

SEQ ID NO: 31228 - DNA, 512 bp, Glycine max
  Peptide Sequence Number=SeqID_148006
aacaagaagtcgttgattgtgacacaaagggtgaggaccaaggttgtgcaggtggttttatggatggtgctttcaaattcatcatccaaaaccatggactcaacaatgaacccaattacccctataaggctgttgatggaaaatgcaatgctaaggctgcagctaaccacgttgctactattactggctatgaagatgttcctgttaacaatgagaaggcactgcaaaaagctgtggcgaatcaaccagtttctgtagccattgatgccagtggctctgactttcaattttaccagagcggtgtgttcactggttcgtgtggaacagagttagatcacggtgtcactgccgtgggatacggtgttagcgctgatggaactgagtattggttggttaaaaactcctggggaaccgagtggggcgaagaaggatacattagaatgcagaggggtgtaaaagctgaggaaggactctgtggcatagctatgatggcatcttaccctactgcataa

SEQ ID NO: 31229 - DNA, 540 bp, Glycine max
  Peptide Sequence Number=SeqID_148007
atgtggttcatagtactttatgatcatgtattcagtattggttttcttcttactttcaaaaacttattcagagctgtcaatctggtcggcttaaggtttactggttgctatcggtcacatgcttgcaatcatttgaagaagcatgtgagatgtcttaagcatatccaccaatggattagccataccacgatgcctgaacaaacattaggttgtcaggtgggtaatttggtggccactaactcagaaggtgagaaaataatgggttttcgcatagtaggtattgttaggcggacttcgttttctacaacccaagcagcctccaagagggttgacgtaccaaaaggctatgctgcagtctatgttggagataagatgagacggttcacaattccagtatcatacttgaacgaaccttcatttcaagaattactcagtcaagcagaagaagaattcggatatgatcatccaatgggtggtctaacaataccatacaaggaagaggagttcctaaacgttaccgctcacttgaatgagctgtaa

SEQ ID NO: 31230 - DNA, 1032 bp, Glycine max
  Peptide Sequence Number=SeqID_148008
atggccaccaaaattcagttccatcatatttcattggcattatttttctgtttgggattcttggcttttcaagtcgcatctcgcactctccaagatgcatccatgtatgagaggcacgaacaatggatggctcgttatggcaaggtgtataaggatcctgaggaaaaggaaaaacgtttcagggtatttaaggaaaatgtgaattacattgaagccttcaacaatgctgccaataaaccttacaagctaggcattaatcaatttgcagacctcaccagcgaggagttcattgtgccaagaaatagattcaatgggcacacgcgttcctcaaacacaagaacaaccacttttaagtatgaaaatgtgactgtgctaccagactcaatagattggagacagaaaggagcagttacacccatcaagaaccaaggctcatgtggatgttgttgggcgttttctgctattgcagcaactgaaggaattcacaagataagtacaggaaaattggtctctctctcagaacaggaagttgttgattgtgacacaaagggtacagaccatggttgcgagggtggttatatggatggtgctttcaaattcatcattcaaaatcatggaattaacactgaagccagttacccttataagggtgttgatggaaaatgcaatataaaggaagaagcggtccacgctgctaccatcactggctatgaagatgtccctattaacaatgagaaggcactgcaaaaagccgtagcaaatcaaccagtttctgtagccattgatgccagtggtgctgattttcaattttacaagagcggtattttcactggttcatgtggaactgagttagatcacggtgtcactgctgtgggatatggtgaaaacaatgaaggaactaagtattggttggttaagaactcatggggaaccgagtggggtgaagaaggctacattatgatgcagaggggtgtgaaagctgtggaaggaatctgtggcatagctatgatggcatcttaccctactgcataa

SEQ ID NO: 31231 - DNA, 381 bp, Glycine max
  Peptide Sequence Number=SeqID_148009
atgggttttcgtttacctggtatcagaaaggcatcattttctgcaaaccaagcatcttcgaaagcagtggatgtggaaaagggctaccttgcagtctatgtcggagagaaaatgaggcggtttgtgatccccatatcatacttgaacaaaccgtcattccaggacttgctaagtcaggctgaggaagagtttggatatcaccatcccaacggtggcctcacaattccttgcagtgaagatgacctctgcaatccaattgcacagtgggccatgatggggtctattgagggagaaaggatcacatggcatcgtggtatggctaatccattggtggatatgcttaagacatctcacatgcttcttcaaatgattgcaagctga

SEQ ID NO: 31232 - DNA, 165 bp, Glycine max
  Peptide Sequence Number=SeqID_148010
atggtgggaacaaatatttctggttgctcaatgagaggtgaagatgttgtgctgttgataggaattcgtgaagacccctgtgtttggtcaatgtactcaaaacaatttacctgtcaaggaaacctgatacaaccattgttgggtctgcacaagagtggtctatga

SEQ ID NO: 31233 - DNA, 297 bp, Glycine max
  Peptide Sequence Number=SeqID_148011
atgacgtggcatcttttaagagtggttttgggctattttttccctcttttggttgccactggtgttgttcctctcaatagggagttgtggactgacgggtacttctcaattattactgatattgttggaggagtatggttgaggtggtggcttcaagctgctgctgcaatgtcaaacatggaaatgtttgttgccgaaatgagcagtgactcattccagcttctagggatggcagagaggggcatgttacttgagttcttcggcaagaggtcatgttacgaaaccccatatacttga

SEQ ID NO: 31234 - DNA, 276 bp, Glycine max
  Peptide Sequence Number=SeqID_148012
atgaagcggtttgtcatccccgtatcatacttgaaccaaccatcctttcaggatttgctgaatcaagctgagaaagaattcgggtatgaccatccaatgggcggtctcacaataccatgcaaggaggatgagttcctaaccgtcacctctcacttgaatgacctctatggagttgttactactatggtattgccatggaattattactacataccatggtattgccccaaaattcacagcaataacagaacagatcgccaattttgctggacataa

SEQ ID NO: 31235 - DNA, 1032 bp, Glycine max
  Peptide Sequence Number=SeqID_148013
atggttgccaaaaatcaattctatcaaatttcattggcattgcttttctgttcgggattcttggcttttcaagtcacatgtcgcactcttcaagatgcatccatgtatgagaggcacgaagaatggatgggtcgttatgccaaagtgtataaggaccctcaggaaagggaaaggcgtttcaagatatttaaggaaaatgtgaattacatcgaagccttcaacaatgctgccaacaaaccttacacgctaggcatcaatcaatttgcagacctcaccaatgaggagttcattgcaccaagaaatagattcaaggggcacatgtgttcctcaatcacaagaacaaccacttttaagtatgaaaatgtgactgcaataccatccacagtggattggaggcagaagggtgcagtgacacccatcaaggaccaaggccaatgtggatgttgttgggctttttctgcagttgcagcaactgaaggaattcatgcactgagtgctggaaaattgatatctttgtcggaacaagaagttgttgattgtgacacaaagggtgaggaccaaggttgtgcaggtggttttatggatggtgctttcaaattcatcatccaaaaccatggactcaacaatgaacccaattacccctataaggctgttgatggaaaatgcaatgctaaggctgcagctaaccacgttgctactattactggctatgaagatgttcctgttaacaatgagaaggcactgcaaaaagctgtggcgaatcaacctgtttctgtagccattgatgccagtggctctgactttcaattttaccagagcggtgtgttcactggttcgtgtggaacagagttagatcacggtgtcactgccgtgggatacggtgttagcgctgatggaactgagtattggttggttaagaactcctggggaaccgagtggggcgaagaaggatacattagaatgcagaggggtgtaaaagctgaggaaggactctgtggcatagctatgatggcatcttaccctactgcataa

SEQ ID NO: 31236 - DNA, 414 bp, Glycine max
  Peptide Sequence Number=SeqID_148014
atgggcttacttggaggtggtcatgcacggttgcggatagtcacgtcggagggtcgcagagggggaaggaggaagggggaggtcggggtggatgtagtaatcccatactcgtacccgtacctgacttttgattattggggaaaactcaaacccgaacccatactcgatcaacttgggtattacccgtcaaagtcggaacgaatacccacgggtatgggttttcttgcaatgtctaagggggagagaggaaagagaaggaagaagaagaatcatgtccatgtagtgctttctttctacaactctaattttgctgttttttctttgcctgcccttccagaagattcccagaaagtgagggtgcaaaggccgattcttggtggcaccatgggatttgatgcaaatgcacgtttttga

SEQ ID NO: 31237 - DNA, 3585 bp, Glycine max
  Peptide Sequence Number=SeqID_148015
atgaagctggaggttcatgaagatgatgctgcaggatcgtgcccaacggttcccctggtcctcgaattccagggattctctagctgtgtgtatcattttggtgctctcgttgctatgcctgattcctctaatactcctgcttccttagaggatgccattctcaagcttgcagctcagcaattgtccatgggtgagaccttacaaacagtcacgttccagctgaatgaaatccttcatcgtcttccccctacgagtcccaacacaggtcctgccacaactacctctgtttcatcttcttcccctgcacaccatcaccgaattaaaattgatgttcctcgatttgatgggagtgacccctctgggtggatcttcaagatcacccagtacttcgagtaccattcaaccccagaggcagagagacttaccattactgcattctacatggatggctgtgcgttggcttggttccaatggatgaacaacaatggccaattcacgtcgtggcctgcttttcttcaagcggttcagacccggttcgctccttcccagtatgaggaccctaccagcgtcttgttcaagcttactcagaggggtacggtggcccagtacctcgccgaatttgaggaattggcgaaccgcattgtcggactccccccacccttcctgctgagctgcttcgtgtcggggttgtcgccggacattcgccgcgaggaggaaaagttcctcgatggccgcaccctctctcgtactcgtcacccccaacccatacacactcaccctcaacccacacacactcatcctcaacccaaccccacccaccttgaacctctttcccccaaccagaaccctaattcacccatgcccctgcgctcagtccctaccccacctatgctaccaccacccctgcgtcccaccccttcacctgtgaagcgcctcaccccagaggaaattgcctctcgccgggagcaagggctttgcttcacgtgtgacgagaaataccacagagggcatcgctgtgcctctagggcatttcttctggtggctcccgaaacgttgcgtttcatgggcttcatcggagaccgccaggtcgtcttgctggtggacggtgggagtacccacaacttcatccagctccagctagtttcagaattgggtctctccacacgtgacactagccccttgcgcgtcatggtaggtaacggacaacatttggaatgcacgcgcgtctgcgaggatgtcacggtggttattcagagcactcagttcaccgttgacttgcatgtgttgcccattgccggtgcgaacgttgttctggggggtgcaatggttgaagtccctcggaccgagcccccttccatccaagctaatcctattccccctccacaaattcaggccatccttgaccgatatcacactttattccaaccacccagtgctcttcccccgcaacgagagaccgaccaccatatccaccttctgccccaagccacacccgtaaatgtccggccctatcgttaccctcacttccagaaacaagagattgagcagcaagttgaacttatgctacaaaagggcatgatacaacccagcaatagccttttttcctctctggtcttgcttgccaagaagcaagatggatcatggaaattttgcgtggattatcgggcactcaatgctctcaacattaaagacaggttcccgatacctactgtagatgaattgttagatgaattaggaggtgctcattacttctccaagctcgatttacttcaggggcgcttcattagaggctatgctaccatagctgctcctttggtccacatcaccacgaaagcccattttctgtggacagaaaaagcccaggccgcatttgagcaattgaaactagcagtgtcaacggcccctgtgctatcgttgccggatttcgagcagcccttcaccgttgagacggacgcatccggtgtggggatgggagctatcttatctcaacagggacacccattggctttctttagcaagccttttcccctgaaactcttgagtgcatccacttatgtaagggaattatttgccgtcacggcgacagttaagaagtggaggcagtatttattgggccatcgcttcaccattgttacggaccatagaagcttgaaggaattattaacgcaggtcatacaaaccccagagcagcatacttatttagcaagattgatgggatatgattaccagataattcatcattctggagccttgaaccaagctgctgatgctctttcgcgtctgccagagcataattcctcattgatgatgttatcggtaccatgtcttactttcatggaggagctccgccggcagctggaagcttcctcagaatatgtgaatcagaggcaagcaattggtcaatctcctaccacattcccagagaatttcagttggcctggtcttcgcatggatgtaacaaaattcgttgcccaatgcgttgattgtcaactcactaagtacgaaaccaagaaaagtgtagggcatacacctgggtatgttaccagcttcgcacacagttcacatggtggctgtcctgttcatggagatcgtggggaaaattcatgggattccgcgaagcttagtatcagatcgagaccccctgttcctcagcaatttctggcttctgcctatcaccctcagacagatgggcagactgaggtgatgaacagaatcatcgagcaatgcttacgcgcatttgttcaccggagaccgcgggtgtgggggaagctcctcttatgggtagagtggtctcataatacctcttggaacgctgcgatgggatccacaccttacgagattacttttggacgaaaaccattcaatttcccagattatatcacaggaacttcaaaattggatgcggtagacgagatgctccaagacagggaggaaacattccaatgtctcaggaagaagcttcttaaggcccaaactcagatgaagaagcctcgcagacaatcatcagtgaaggataatcctggggtgcacgggaaattagcaaagaggttctatggtccatttaaggtgcttgagcgtgtgggaccagttgcgtatcgattagagctgccggaaaatgcgcgtgttcaccctgttttccattgttcagtattgaagctatttcaggggacaccggagtctgagattccggcccagttgccggaccaatttttgcaggatcaacccctcatctccccgctttctatcttggattacaggaggaccaccccagcagactcgtggcaggtgcttgtacaatggaaagggctgactcctgatgacacgacctgggaagattgggacaccctacagcaagaatatcaccttgaggacaaggtgattctgcaagggcccccgagtgatagcatagtaatgcctgaggtgcaaacagcagacacaagtgtagaacaaacgaaaccacatgaaggtgagagcaacagaccattgcagttcaagctcaagatgcaggaccaattgcataaccaatttcacagactcgagaacaagaagagaatgcagaagcaacagataagcaggtgcaattag

SEQ ID NO: 31238 - DNA, 796 bp, Glycine max
  Peptide Sequence Number=SeqID_148016
atgaagggaagggatgccatcaccaattatgatttgaatagctacgaggtgaatggcatcatgaagagtaagattacaacaacaatggatggatcggttactttgaagagagaaggaatcaacaacgaaactgaagcatgttcccctgaaactcaaagcatagtccaacacaatcatcaacaattgatcaaatcttcttccttttgtcgtcactatcaaaactacaatctcttttcaagcaacccttatgctcttggtggttttactggcgtgaacacaagttttgatccttacaacttccaagacaatactttgaatcaaataccacatgagaacttgaacttcagcctttctgatagttttcagaaccctagttccgaaccaaacaacagcggttcacaaggtttcattttcatggagctgaattcacagcagagaccattttcaatcaaattatggcctccaagtgaaaacactaggcaaacccttgtggagaggatgaccaacaatttgactactaaatctcttttcacacaaaagtatggaactttggacatggaagaggctgaagagaatgcaaagaggattgaggatgtggcttttgctactgcaaatctacactatgagaaagagccaaatggtgatggaggttctgcagtccagctttatgccaaggaatgtagtaagctcctcctagatgttcttaaaagaggacctagtaaaaaggataatgaagtggtgacaagcatagaggtggaaatggaacacattgatatcggtgaacctgagaatactg

SEQ ID NO: 31239 - DNA, 339 bp, Glycine max
  Peptide Sequence Number=SeqID_148017
atggggatcgcacccacaaagacacccagtggacctgaagaagtccaacagggtcctggggtttccagctctggttacgggcctctatcagtcctacagggtgcccgtaccccccctagcaaggtcatgccatcccaacatagggatcgcgcccgcaagacatccagtggacccgaagaagtccaacagggtcctagggtttccagctctaattacgggcctctgtcatttctacggagtgcccgtcgaccccagcaagttcatcaggcccctattaatcgggctttcatcaagaagtactgcgccctcaggcagacgcagggcgagacaccacagtag

SEQ ID NO: 31240 - DNA, 309 bp, Glycine max
  Peptide Sequence Number=SeqID_148018
atggataggttgacgaccatgatgagtgcactcctgtcagcccagaactctcaagctgccgccgctgctgtagagcagcctttggtgagcacaaccccgctatctacggtgacttctccacccctctttttgcctccaggttgtacatggggaatgccacctccagtctgtggaagcccccagcccgctgtatctgaagttccacctccttttgctcagcagtcagcaccggttccgcaacccagtacctctttccctcaagctgcaatgacttattcagctccactgattcacactattcaacaagag

SEQ ID NO: 31241 - DNA, 711 bp, Glycine max
  misc_feature (110)..(110): n is a, c, g, or t
  Peptide Sequence Number=SeqID_148019
atgactcgtgacccatcggacattgtttggtaccaagcagctagtgatgttggagagattattgtgaattctggtgaatatcccaacgtacctcttttgggtatgcgtgncggaattagctacaacccactcctcgctcgacgacaatttgggtacccgataaagactaaaccaaacaaccttgccttgactaatgaattctatcttaaccatggtgatcactcgaacaaaagggaaagattcgcacaagcttggagcgctatccgcagactcaacagaagtcagttgggaaagaaatcagactatgtgcacgaatcttatacccagtggattattgataggaccaagagctttggcctaccctaccgcttacctagatacctatcgtccaccatcccaccatcatccttgcctatcccctttgacactaaggaggagtttcatgaacaattaaccaaagaaaggcaagaaaaagaaacttggaagaggagatgccaggagctagagcaagagaatgagactttgaaagggaagatagcccaacagagccgtgagctttttatccagaaccagaggatgattgagaaggacgacttgcttcgtcggaaagacgttttgctccaccaagatgctagaaggaagaggaattttatggacttgttctcccgtgcacattcagattccgaggacccatctactccgggagtttga

SEQ ID NO: 31242 - DNA, 369 bp, Glycine max
  Peptide Sequence Number=SeqID_148020
atgaccctttcatcatggcaaaacaagctaaacaggccgatggctactccacccagctctcctgctcctcctcctccttctcctcctactaaagcaacatcacagtcgccatctaccttgaagcggacaggaaaagccacacggctaagatcattggcaactagaccagctggagcagatagaccagtggtccacgtcgatcctccgactgggaaggccgaaggtccccacaagaaaaaactaagagcatatttgggaattgtcgctcgtgataaggttgacgtgacatacaagaattggaagcaagtccctgctactcagaaggatttgatatgggaggatattcaggcaaaatttataatttactaa

SEQ ID NO: 31243 - DNA, 612 bp, Glycine max
  Peptide Sequence Number=SeqID_148021
atgagtattattcaaggtcttaatcaggcattagaagatgaaaggtcggcttctagaactgaaaccgagtggactaagatccaaagaaaagttgtgagcatgattcgattaggccttgctcctgagataaaacacaacgtgttgaaggagacaacatcgaaggccttgtgggagaagcttgagaatatcaatgtgtcaaaatcgttaaccaatcacttttgcttgaaaatggagttgtatcaactcaaaatagagatgggaggagatctctatgaccacatcaacaagttcaatcaacaactgtggtggagtctgagcgagggagaaatcattcaaggagacatgatgagtcaagagagatcaaaatcacaattgcatccacaactagatatgagtaacatgcaatgttactattgtagtgagagtggtcatgtgcaagcgaggtgcaaacaaatgaatgagaacttaaaaaaattaagatatatgaacaaagatggtgtcaactcccaagctaatgaagtgatgatggattctcctgttggaccttgtggcctcaataatcttaagagggataggcttagaatacagaagaagcaacaacaatcaatttaa

SEQ ID NO: 31244 - DNA, 252 bp, Glycine max
  Peptide Sequence Number=SeqID_148022
atgagaattgcgatttctggaggggtagattgctactgggctttgtttgaggggtacttctcaattattactgatattgttggaggagtgtggttgaggtggtggcttcaagctgctgctgcaatgtcaaacatgtttatgtttgttgccgaaatgagcagtgactcattccaacttctagggatggcagagaggggcatgttacttgagttcttcggcaagaggtcatgttacgaaaccccatataggtga

SEQ ID NO: 31245 - DNA, 273 bp, Glycine max
  Peptide Sequence Number=SeqID_148023
atgaaccttcttgcagtgaccacctgggtaacatgcagttacaaagaagaagaaaaggagaagaaacaaacaaataacaacaggaacaagaagaagaacaaaagcctgtaccgtgaggtcgcgaagaacaaaaccatttacaaaagcttgtaccatgaggtcgcgaagaagaagaagaagcgaagaagaagaagaaaactggagcgtgaggaagaagaagaaaattggagcgcgaggaagaagaagaaaaacagagtgcgagaaaggaactag

SEQ ID NO: 31246 - DNA, 417 bp, Glycine max
  Peptide Sequence Number=SeqID_148024
atgacattgaggacgtcgatgcccttgcaagcctggcgtagttcacaaagggagtgggtacacgtggtgccagtggaacatctggatgctatgcccgctattatagattatattatatcttgctatatttcgtggggattcacatatcttttagagcttcgctattatgaaggtgttcgtctgtactttggacttgaggaatctcctcacaacttggagttcaagttgattctggaggagtacgatgaacaggacaacattcttagctatcgcatggagccaatgagcatagctgaggttatcaaggatagaggagactattcaaatatggtgttcgaggagtacaaaaaagttttgtggcaattaaagccatcatccgaggtggagtatgacgatcctcgtgaggacatgccttag

SEQ ID NO: 31247 - DNA, 225 bp, Glycine max
  Peptide Sequence Number=SeqID_148025
atggccaaatttggaacgtcttcattagtagacatgttcgctacagctggggatgaggatggggatgctgtggatgtaggtactgagaatggtccatgtgcatcaattagagatgaggatgatgtcgatgtaggtgtcggggatggtccacccacatcaatcggagatggagatggtctaacttcaatcagaggtgaagatggtgtaggtgcaacattgaagtag

SEQ ID NO: 31248 - DNA, 195 bp, Glycine max
  Peptide Sequence Number=SeqID_148026
atggctcttaacaatcatggtttcaatggagggtcctggagttccaataaccatattcaaatcttagagagtacgatgagaataataactcaggggcatggtatgaatcacgccaaaaagagagaaatctacttttcagtagcccatcacttaagaaatccacggttaagcatgtttgacttggagtggttatga

SEQ ID NO: 31249 - DNA, 324 bp, Glycine max
  Peptide Sequence Number=SeqID_148027
atggacaaagcagtagacatttggaaggatcttaaaccgcaatatttgcaaggggacttgttaaggatctctaacgtgcaacaagagttagcttcaattaaacaaggaggtaggggaggtagaggttcatatggtagaggaaatacgggaggaaggagtaataaaatttgtacacactgtggaactaccaatcatactgtggatgaatgctacaagaagcatggttaccctctaggttacatactctataagccccaaggtgtaacaattaacaacacagtagcagaagttgaaaacaatgataatcagatgcaagaaaaataa

SEQ ID NO: 31250 - DNA, 324 bp, Glycine max
  Peptide Sequence Number=SeqID_148028
atgcagacacaacaacgccaacggtttgatgttgaagatgtttcattacacttggatgaaaggtccccacaggtctccgcggggagccggggaacggggacggggatggggagtagggaattggtattttccactcaggggttgaaggttgctaggtgcaagggcttggcgccgtgcatgagaataggaagaggtgctaggatttcgacatcgacaacaacaatggagagtagagaaggaaatagtgcggtggggaaaaaatgcatagggaagagaagaaagagagggaaagggatggggcacagtggtgttggtgttgtttga

SEQ ID NO: 31251 - DNA, 210 bp, Glycine max
  Peptide Sequence Number=SeqID_148029
atgatgaatgttactaacagattgggggcattggtaaggtcacttcgggtgaatattttgaagggagtttttggaattaacacatgtgagcagatgctggacaagagtagctacatttgtgcatttttctctcggtcaacagcaggtttaggtcttgggcagacagattctacctttctaaaatttcggaaaaatttaggaatgatttaa

SEQ ID NO: 31252 - DNA, 285 bp, Glycine max
  Peptide Sequence Number=SeqID_148030
atggagactagattagggtacaattcaactactgaacaaattgttaccatagatgatgaatggaaaaagttatgtgagaaatataaatatgcaaagcaatttaagaagaaaggttgtcttcattatgataaattatgtatcatttttagggatagaattgttgccggaattgatgttgctcattttacaaaggcagtcaaggcattgaaagatgatccttgttggagagctgtgtttttggcaatatcagatgaccagaagaaagatatagtccttaatctttga

SEQ ID NO: 31253 - DNA, 399 bp, Glycine max
  Peptide Sequence Number=SeqID_148031
atgaagtcggaatcgctagtaatcgccggtcagccatacggcggtgaattcgttcccgggccttgtacacaccgcccgtcacactatgggagctgtttgaacctgagacatcgagtgccatgggatttggctttagatgttggtttctgggccttcttcatatggaaattgttcagttgtgtacagattgagatgcttacaccaaaggactacattggttcacttatggaactggcacaagaaagaagagggcagttaaaagaaatgaaatttattgctgaaaatagggcatcaatcatgtatgaattaccattagcaaagatggttggtgatttctttgaccagttgaagtcgagaagtaagggttatgctagtatggagtatacctttgttgggtaa

SEQ ID NO: 31254 - DNA, 1272 bp, Glycine max
  Peptide Sequence Number=SeqID_148032
atggcatctgagtcaaaaggatcatttcctagtggcagagcttggagagcaagtgaaagtttgaagttgctgcatgttgatctctgtggaccaatgcaaacagtttctcttggtggaagtaagtatttcttgctcataactgatgactacaacagaatgagttgggtctactttctaaaggctaagtctgaagcctttgaaaacttcaagatttttaaggctattgttgataaacaatttggtttatgtaagaaagccttaagaacaggtcatggtggtgaatttttgtcaaatgaattcatcacattttgtgaggagcaaggaataagaagagaattgatttcaccatatactctagagcaaaacggagtaactgagagaaagaacaggactgttgtagagatggcaagaagtatgctcaaagctagaggtgtaccaaacaacttctggtgtgaagttgtagctactgtagtgtacatcctcaatgtctctcctacaaaggcagtcattaacatgacaccatttgaagcatggagagtaaaaaaaccatctcaaagagaaagttgtgacagtattcagcagaaaacagttgggattgatagttcaggggaggacttaattgtgccaacaaatgatcagcagtctctaagtcctcctacaacaccatcatcttcaaatcgcagctcatcatctttttcaagtccttcatcatcaagttcattgaatgattctgcaccaaaaagatacaagactcttgctgacttgtatgcaaactatgactttgcactgatggcagcagatccaaccagttttgatgaagctaaagatgaagttgaatggcaagatgttatgaaggaggaaatcaagtccattcaaaagaatgggacttggaaattggttgatcttcttgaagagaagattgttattggacttaagtgggtattcagaactaagttcaatacagatgagagtattcagaagcacaaagctaggttggtggcaaaagggtatgcacaacaagaaggaatcaattttgaggagacattctcaccagtggcaagatttgaaactgtgagagtggtattagctttggttgctcaatggaaattagatgtgtttcagctggatgtaaaatctgcatttctcaatagagacttacaagaaaacgtttttgttaagcaaccactcggctttgtcaaagatggtgaagaaggcaaggtttacaagctgcaaaaggcactttatggactgaaacaggctccaagagcctga

SEQ ID NO: 31255 - DNA, 774 bp, Glycine max
  Peptide Sequence Number=SeqID_148033
atggtgtgggatactctaaagcaagagtatctaggtgacaagaaggtcattgcagtgaggctgcaatcactaaggagagagtttgaaacagctctaatgacggacaaagaatctgtcgaagaatacttgtcacgtgtatccattgtggtacaaaaaatgtggtcatatggagaaacaatgaccaatgagcatgtggttggaaaagttctaagaagtctcacaagcaaatatgatcatgttgtagcggctattgaagagtcaaaggacatggcagattacacctttgatgaactcatgggatccttgcaagctcatgaggagaggctcaatagaaatggtccactcaaatgttactggaagaaggaggaggatgaacaaaagggtgatcaaaagtccaattttgtggagaatgagaaaaatttgttcttagcacaaagtgcagctggcaatgatgcaggaggtggcgtgtggtatattgacagtgggtgctccaaccatatgtcaagtgccaagtctatgttcagagaactgaatgaatctttaaagagcaaggtgaggcttggagatggaaaacaacttgaagtggaaggaagaggcacgattgcaatcaaaactgagcaaggaaacactaagcttttatatgatgtgcagtatgtgccaaatttggctcataatttgctgagtgtgggtcaattactctgtggaagcaatgtcttccaagattattttgatgatgccaaagaatcaaaagttaagcaagttccaaagaattag

SEQ ID NO: 31256 - DNA, 429 bp, Glycine max
  Peptide Sequence Number=SeqID_148034
atggattttgattcaaaagttttcttgctgctaccactaccaaacaacttgaaccctgattctgaggcatacactgggaagactgcacacccttttatcccagtaagagaagtctgccccagagaagtgcaatttgcaacactcaccttttctaaggatggtgggagcttcgacatagacactagtttcctacaatcatctaacaaaagttgtctcaaccttgaaagagggtacatctacttgggttgttatactgagaacaagagagggtacatctcttgtggattagttcaagtggagggtacatccacttggttgttcaaagagaacaagggagggtacatccctaatggatctttggcttgtaaaggattttacaaggttgaaagaaatctcaagaactgttggttgcttggggactggatgtag

SEQ ID NO: 31257 - DNA, 261 bp, Glycine max
  Peptide Sequence Number=SeqID_148035
atgataaagacagtagataaagatgccgataatgcgtttgaatgtttaaaggaaagaattacattacaagagttggcctgtcaggctcctaacaattggggtatagcctctcattgtcataagatgttttacactttaggggctgatgtggatagaagaagatggatggacaaaagaggagaaaagggtaatggatatagaaaaagggtttctcatattagagatgctcagactttggatgtattcattagagagctctga

SEQ ID NO: 31258 - DNA, 398 bp, Glycine max
  Peptide Sequence Number=SeqID_148036
atgacaagaagagcaaagttgatcctaaggacatctataattactacaaagaactaggtcattggaaggaagactatccaaagaaagcaaagaaagattttgttgttgctcttgttcaaaatgactcctcattggaaaacaatttggttatggctattgacagacattggtttgtggcatatgagaagaagtttggtggtaacgttctcataggtaacgatgttccttgtaagtctgtaggctttcttgctgggttgaacgtagagtatgtagatcagaggaaaagggaagtatgtggtaatgtagggaaccaagcaaggaaatttgtatatccttcaggggtcgactgtgacaaactctgtctttgctatttcataatctggaagtcatgcgtctaa

SEQ ID NO: 31259 - DNA, 210 bp, Glycine max
  Peptide Sequence Number=SeqID_148037
atggtggtgagcttgttcttgactcatcttctccttgaattagcgtctctaatcatctttcttttccttctccattctgctgccattgatattaaagaagctaaggattccactgatgaagaagatccaaggcctacaaactccacatggagctacgtcatgtggtatcaagagcatcttcgtctaggttctatcatttttgagtcataa

SEQ ID NO: 31260 - DNA, 231 bp, Glycine max
  Peptide Sequence Number=SeqID_148038
atggaaattctcatcctgggtcttgaggtcttgggtcaaaaggcttgcagaacggtcggacatgatgtatgtcagggtgttggtttggccagtggttcagggataaaggggatgtcccacatttatttcgatgacacacatacaacaatgatgatttggaaatttcatgcaaaactactcatgcatgcacccatgtggacactcaagcatcaagtttttatggtcacgtga

SEQ ID NO: 31261 - DNA, 228 bp, Glycine max
  Peptide Sequence Number=SeqID_148039
atgaggacgcatagccctctaaaggcgagggcgtgcagccctctgcaggcgaggatgtgcagtcctctgatggcgaggacatatagtcctctaaaagtgataggtactagtacccaaattgactgtccttttgaaaaagatgataattcatgcaaccttatcataccttttgcaaatctccccgggaactccttcagagtgtatgttctgtttgatttagtcacttga

SEQ ID NO: 31262 - DNA, 303 bp, Glycine max
  Peptide Sequence Number=SeqID_148040
atggaggtggttgtcatcatcaaaaagggggagaatgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatccttgtttcaagattcactaaagaccaagccttgccttaaaacaatgtgctttcaagacatgcaaggctctggtaatcgattaccaggaagtgtaatcgattaccagaagacagggttgagaaatagctgttga

SEQ ID NO: 31263 - DNA, 111 bp, Glycine max
  Peptide Sequence Number=SeqID_148041
atggagttatatgattctgggacaacaatcctctactgtactgtagcttttataatggaagaaaaagctcagaagcaaaaacaaaaggttattatcatgataagtcattga

SEQ ID NO: 31264 - DNA, 285 bp, Glycine max
  Peptide Sequence Number=SeqID_148042
atgaatataattgcgggagctttcaagcccccatgcaagatctcaatctgtcttgctgatggaagtactcccaagcagtctattcatgtgaaagttggacctctgtatgagtatctcaataagaagattttcataaaggaagctccttctggcccttttcatcacaaaggggtttcggagtcagagtaccgtacgtacccagttaaacattttacttatcactgtcataaatggttcgcaactgcaattgtggatgcaattgtcaagatttttgggtatctgtaa

SEQ ID NO: 31265 - DNA, 360 bp, Glycine max
  Peptide Sequence Number=SeqID_148043
atggcagtggtggatgaagacgccgcaacaaaactagccaaactagccaacacaccaattctaacagcagcagtaacctctcaaataggtatggtaggaggaggtggaggagtaggagtagcagcggcaacagtagcaggagtaggagccttgagggtcgacaaagccggaggccttcaccatggtccaacgatacgggtgaagttgggaaagggtcacgttcaagtgctcaagaatagcacactaaaaagcggtcaagggaagaatgagacccatgaccttaagcaaacatctgtacatgaagaagaaggatgtactactggatgccacccccagaaatggaaagtcatacacccataa

SEQ ID NO: 31266 - DNA, 192 bp, Glycine max
  Peptide Sequence Number=SeqID_148044
atgcatgctttgttagggtcattcaacagtggaaactggtctgattctaaagtccttgatagtacgggactaagttgttgtgctatcacgaggaatcgggtcttacaagaggaatctgcgaacgaggcttggtcaggactaggctatgctatcatgaggaatcggggtctggcagtccaagagacaacatag

SEQ ID NO: 31267 - DNA, 627 bp, Glycine max
  Peptide Sequence Number=SeqID_148045
atgaagaggcactggcgcaactggagccacgacgacgaaggcgaaggcctcccagattcggattccgacacgcgctccagccggagattctctctcacgcgcctcatggcaatctttctcttctctctcttcctcttctccctcatcttccttctcccacatcctcccatccaatcagcttcaacagcaaagactctgcaccaattcaagcaaactcaacaagttttgtttcgtcgaatgtatgcattgcataagtcaatgaatgttggagatcccacattcaccaaggatgatatgatcaaaatactgaccccttgcagaggtaacgttgctgattctgttgagttgcacaaagataaactacttggtggccttatagcagatggatttgatgaacaatcatgtctcagcaggtaccattcggtcacatacagcaaaggactatcgggaaatccttcatcatacctcatttctagattgagaaaatatgaagctctccacaaagaatgtggaccttatactgaatcctataataaaacggtgaaagatctgaggtctggtcatgatattgaccttagcttctgtgtttctatacgctctcctcacagatcgagttctattggttga

SEQ ID NO: 31268 - DNA, 1104 bp, Glycine max
  Peptide Sequence Number=SeqID_148046
atggccaagtttgatgttgttcctaatggtcatgcttataattctttgattcatgggtattgcaaggcgggggacttgctcgaagcgatgtggttgcgattggagatggaaagattggaagaagctatgggtttgatggagaaaatggatgaagttgaggtttttgccaattctgtgattcaatgtggtaatgtaagagctgcaatgggcttgtacacggaaatggtaatcaagggtattgtgcctgatgtggtaacttacacagctttgattgatgggcactgcaaggttgggaacaccaaagaggctttcaggttgcataaggagatgctggatgcaggactatctcccaatatgttcacagttagttgtgtaattgatggccttttgaaagatggaaggacaaatgatgcaatcaaaatgttcttggagaaaactggagctggttaccctggagataaaatggatagcagtgtgaacaagttggttcatggcgacatctcaacgtggcatcagaaagctgagactcccattagcctcaaaccaccaaaagccaaccaaacccttaagaagcaccttgaatgcaacatacacaccaaggatgtcacaacttggatttccatgattgtggggcatgcagtacatgggcaagcacgcgaggctcttcaacttttctcagaaatgagggacaaggatgattgtgtcttgaccccaaatgatgtaactttcatcggagttttaatggcctgcagccatgcagggatggttgaggaagggaagttgcatttcagaagtatgagtgaagtttatgaggtgggtgggcatttgagagattcctatgacttcattatggagatgccagtgccgccaaatgcagttgtctggcgaaccttgctgggggcttgtagtgtccgtggtgaattagagctagctgcggaagtgaggcaaaagctactcaagctggaccttggctatgtggttgacagtgttgctatgtctaatatttatgccaataaaggcatgtggaataagaagatagttgttaagaatcagataaaacagtcaagggctcctggctgcagctcaattgaggtgggaagtggg

SEQ ID NO: 31269 - DNA, 345 bp, Glycine max
  Peptide Sequence Number=SeqID_148047
atgcggtcatgggtgaggggtcagtggattcccttcgacgcagatgccctcagccagttcctaggtgacccactagtgttggaggaaggtcaggagtgcgagttcagtcagaggaggaatagggctaacgggttcgacgaggaggccattacccagttattgtgcacaccggggcagaatttcgcctggaccgctgccggggacgggtgcggatcatgcagggaagggtgttgcccttgctcctacgtatcctcaagtgcgatgaggaactcagatctatgtagttccttaaaatcgaaactcactttacaagatgaaaagagattactgatggtagaagaatga

SEQ ID NO: 31270 - DNA, 243 bp, Glycine max
  Peptide Sequence Number=SeqID_148048
atggtttttgaacgcccggagggcttcttcgacgagacctggttggcagaaagcgagtgtgagaacgctgaatgcttgggacgtgaggtgttggaggacatgaggatgtggatgatggcagttgtgtcagaggttgatgtggagaataataacgaggaagggtgtgtgagagcaatgttgattatggggatgccttttcgacgaacaaggttcaacattgcacgcatgaatcgctggtgctga

SEQ ID NO: 31271 - DNA, 240 bp, Glycine max
  Peptide Sequence Number=SeqID_148049
atgggacagaaagtgatgaacaaaacaagacacagcaaaaaagacaataacacagagcaactaaactctaattatgcacatgacgaatcgcgcgattcttcaccggcggctggcctcgtgattcttcaccttacgcagactcgtcggagagcggaatcgctggatcgtgaagacgagcgtgtttccgcgtcgctattttctcagccgtggcagagcggcgtcaagctagtttcagattga

SEQ ID NO: 31272 - DNA, 462 bp, Glycine max
  Peptide Sequence Number=SeqID_148050
atggttggatcgtatgttcacttctctgatatgacaactggagccaaacaggggttggaatgggtccaaaagaggccgatgaagacaatggtgatggcgcgacggcaatgcggtgatgggaaggcagcacttgagattcatgcgcctaacagaagagcgtactgtaacggcgctgtactggtcaaagaggttatagtttcattctttattctgatggaacagggcaaagctacaagacaggatcttgatcaatggtgtgaggaactaatcaaagaagagtttgatgaggaatgtaattttgatgtggatgatgctgttgagaaattagagaaattgggaattgttactcgagattctgttggtcgatatcaatgtgtcgggctaaaacgggctaacgatatcattggcaccaccactgaagagcttgtccttaaggcaaaacagggaagcatgacttcttga

SEQ ID NO: 31273 - DNA, 228 bp, Glycine max
  Peptide Sequence Number=SeqID_148051
atggctgaatcatatggcctgttatcggaggtttcggtcggcgaaggtggattgcaagtagtttcccaacagtgctatgaggttgcatcaagattgagagtaaatttccacaagagcagcttgggaggggtcatggtgcctcaagagggaatcaacctgggcttcggtgttggaaaaatttcaaaagatctcatcgtggcagcaaaggaaactttctattggtggtag

SEQ ID NO: 31274 - DNA, 244 bp, Glycine max
  Peptide Sequence Number=SeqID_148052
atggtagctcaagggatggtcgtggccacgcaagagagcaacgttggtggctcaacgggtggcagggaaggaaaaatgaagttggaacggtggaagggaaaggaagattccggagttggatggggaagtgggaaaggcaagtgtgaggaaggagaaaggttttggttggaaaagaagagaggtggggaagtgggaaaagaagagaggtggagaagtgggaaagacaacatggaaaagggggaag

SEQ ID NO: 31275 - DNA, 507 bp, Glycine max
  Peptide Sequence Number=SeqID_148053
atggttattgaaaatcgctctaaaaggacgaagatttatgcgtctggagcatattcattgtcatctaatccagaaacactagtagaagattctaaagctgacacaccgtctccaattgtccgtctaatgggaaaaaaggaaccaatgagggaaataaatattctcaacaccagactagcagtcttaagggagaaagaattggaaaaggagtactacaacattctaatgaaggacacatctacaatgttcgaaagtcaactccaagaccatcaaagactcaattccaacgtaggttccgaatgcgacgataattgttatttccaattgtcaatgcccttagtaatcacgatgaatatttccattattgttggtagaatgggtctctcgtcattgcaagagtgcattgcagctatttgtatattgcatacggatcacttattgattgtgtggatgagtacgttagaattgactaatacactggaactcaatgcttacaaaaatttgtaa

SEQ ID NO: 31276 - DNA, 336 bp, Glycine max
  Peptide Sequence Number=SeqID_148054
atgggaatggccaagcctgagcttagatttcacagttatcaaaggccaagccaaggctttataaatgaaaaagatcccctgaaagaagccaagttcacaaagttagatgtaaggagtgattgtcaagcaaagatcagatttaaagtggaaatggtcacaaaggataagggcaattgcattgatgatatggtcaactcaggcataagtgtaattgatgctttcaattacatgtcacaaggagtagaaggcactgagaatgttggatttacaaaaagagattgttacaatcatatgaacaagcaaaaaatgatgatgattgaagctggagatgcttaa

SEQ ID NO: 31277 - DNA, 240 bp, Glycine max
  Peptide Sequence Number=SeqID_148055
atggagcttccgcgagttaaaatgggtttgtgtttttctttcttcctcactccatcccggctattccgtcattctatcacgactgtgcgattgcgaaagcgaaggcaaggtgctccatgctcatgcgtggtggtcatgacgacgatgcgaagcggaagtatgagtggccgagacaccgagtgtgtatttcttgcgcaagatcgtgagcatgagagtgcgtggtggccacgacgacggtga

SEQ ID NO: 31278 - DNA, 240 bp, Glycine max
  Peptide Sequence Number=SeqID_148056
atggcggttcttgttgtgcggattaggaatggtaaccttgttgtgcttaatgttggggattgtcgtactatgattagtagatggggtgtggcagaagccttaatatctaatgacaagccttttagggaagatgaaagggacaaaattgagactcaagaatgggaatggtcttatgtaattatgccaagctcaatggaggctggtatcgttaaaccaaaagcaaatggtggaatctcatag

SEQ ID NO: 31279 - DNA, 264 bp, Glycine max
  Peptide Sequence Number=SeqID_148057
atgacattctcgacacataacattcctacaccttgttgtagacttgtagttcaaatgttgcacaaaaattgggtgcaagagaacagaggagaagatgaaggttcttgttcttgggtgcaagaaaataaaggggaagatgaaggtctagcgatcaagaagcagaaccacggcaaaacgatctttgacccattggctctcaggatgagcaaagcactggcagcttggaggctacagacagatacaagagaagttatccaggcatag

SEQ ID NO: 31280 - DNA, 213 bp, Glycine max
  Peptide Sequence Number=SeqID_148058
atggggggtgcagtgaccatgatggatatcactggtgggaaaaatatagtggttaaagagttttcaacatctctagaggaggatgacttagaatttttaattatccacggtaaatgcattgatgatgcccatgtttcatacttcatattgcatggaaatagtataaaccttgttaatcaccatgaggggagtttcatgtacacgacaaggtga

SEQ ID NO: 31281 - DNA, 456 bp, Glycine max
  Peptide Sequence Number=SeqID_148059
atgggtatggagaatggcgaagaagagatagttggccatggtgtaaatgtaggaacagagatgcatttaaattcaatagatgaaggtggagacacagatgatacaagtggtgataatagttatgacaaagaagaggatgttgccactattgagcaaaatggattttgtatgcataagagcaatctacttaaaaatttcaaaggtgaaaaggtgcaatacacatttgtttgctctagagaaggtcatagaaaagataggggcttgggtgttgaaaatcaaaagcatgacgcaaagaatgagactaagtgtgattgcaaggcattttttcgtgtacacattcagcaaagaatgagactaagtgctatatctcttgtatctaatgagataaaggaagcatatgtttggttgttggatcagtttctagaggttatgaaaggcaagacacttgtatcatag

SEQ ID NO: 31282 - DNA, 1059 bp, Glycine max
  Peptide Sequence Number=SeqID_148060
atgcctctcgctttgacactgctttcgtattcttttgacgatagctttagtttttccctctctctagaagaaaaacaacatagcgagcgaacagagaaaatcgaatattcacaaatcccttcatataaatacaacaccgccaccacaaagagtatggatttggaaacgctggtttccgcctgcgccggcggttgctccgaccagaaaatcgcctgcgagcctcacgccgacgagggagaccacggcggccgccttccggactcgccgccggagtcgttttggctctccggcgacgccgagtacgactggtgggaccgcaacgccgtttacgagcgaaacgaatcgacgaaaggaaactcaattatttcctcaacgaaccttaactcaaactccaacaacaattctcagcgattctcgaagaacttgaagtccaaagccgcgattatcggcttgccgaagccgcagaaggctaccttcgccgacgccaagagccgccgcaaccatcggccgccgggaaacgccaggctattcccgaagcggagcgcgtcggtcggcggaaaattggaaggctccgtcgtcgaaccgtcgtcgccgaaggtctcgtgcatagggagagtgagatccaagcgtgacagaaatcggagattaagaacacgccagagatcaatctcctcctccacggccactgccgccaccaccggttcaatctcctccgccgtcacgaggcaaaaatcgacgcggagccagaggaagaaaaccggtttcttcgaaagcgttcgcgcgattttccggcacggtcgcagaggcaaaccggttcagaaaccggatcttccgcaggaagattcgtcgtcgtcgaagatgaagaagaagagaagttacggtaagaaagcacggggaagcaccactagcagcacaacgaatcgaaacgacgcgtcgtttgaagaatcgttttcgagtgcagcaccacctcccggtttgggttcggtgaaccggttcgcgtctgggagaaggtctgagtcgtggggagtgggtgactcggaaatccgcgtgttgcattag

SEQ ID NO: 31283 - DNA, 851 bp, Glycine max
  Peptide Sequence Number=SeqID_148061
ggaactcggcggaggaattcgaagaagacacttctgccacaagcccaaacgtctcgggcgagttccaccgcgctttggaggcccactcctacaacgagatccggtccatggtccaggccccaccgcaggtccaccacatcgacgacgaggactcgcaccaccgccacgtcctctcccaggtcctccaacccgactctcacagcgtccacgaagccctcgcgaaagcaaaacctaagagcaacctcacgcgcctcgtctccacctacttctaccacagcgaaaccgcctccgacttctgcctccgcctcagccgcagcgtccaccgcgcccgccacctctacgcgccgctctctgacctcctcgccgtcctccccgcctccgcaccgccgctctcccaaccgcaatgcgaccgcgcctacgagctcttcctccaatttgaccgcgaagagatcctttcgcgctctcccgcctccaccgcctccgcgacgacttctccgacctcaagcgcgacatccagcgcgacctccaagaggagggagcttgcgaggctgaagcagcttgaggctgtggagaatgggactcttgtggtgaatgacattaacaccattgatagcctcgttgatcggcttcaaaccgcagtagaaggggataaggcttttgttaggtttgcattggataggggaagggagagacatcccattcaggaagtgcttaaccagcttagaaagaaccaacctgttttggagcatttgcttggggatcttgagcaacatatatacttctgcttttatagtgttaacatggccagatatgcactcctcaaagcgatatgcagtcatcaaactccctag

SEQ ID NO: 31284 - DNA, 315 bp, Glycine max
  Peptide Sequence Number=SeqID_148062
atgtctggacttagcgagtatgatgacgatcacgcgcttagcataagattcgcgctaaacgtacctttgggtttctttgtgggcattcttcgcgctaagcttgagctgatcgctaagcgaattgacgaactagctagttaccctaccttggtcatatatagtcatataagattcgattatttaatccataccaagatgcttagttgctttgacttcagagtatcagcattcagcggtatagcaggtccctcccccaaggctaaagctagttccttcctgacaacttttagaatgaagaaggcgctttggctctag

SEQ ID NO: 31285 - DNA, 144 bp, Glycine max
  Peptide Sequence Number=SeqID_148063
atgtctacgaatggagtgaattggactactttggaagttgctcagttagcttatgttgatgttgatgactatgacgtagttgtgaacgtgctaagtggagaactgtctagactaagggccaaacatggtaacgatgagccctag

SEQ ID NO: 31286 - DNA, 471 bp, Glycine max
  Peptide Sequence Number=SeqID_148064
atggtcgatattgaagtcgatcaaacactgaagaatgatactgaggtcagtgactcccaattcaaagctacaaaactagattgtatatatgatgactccaatcttgatttcgagaagccatcatctcaagtcatgaagaaattggaagtgcaagatccattagaaaaagtaaatcttggggatgaagtgaatcaaaagcaaacttattttttaggctttgtcatccataagaaagggattgaaatggataagaacaaaactaaggttgtactagaaacatcacctcctcgaaacaaaaaggaactgcaatctttgttgggtaaggatgaaagtgatttcaagtgggataacattcatcaaaaggaatttgaagagattaagcaaactttggctaattcacccatcatgactccacaatcagaggcagaatatttcagcatcaaaatctactattgcaagtgtcttgactaa

SEQ ID NO: 31287 - DNA, 1158 bp, Glycine max
  Peptide Sequence Number=SeqID_148065
ggtggagaattggttcatatgagggaaggaggagggggtttgtgggtcaatcttgatttccgtgagtggcattggaagcttcttcaaagtgtcattgcattatttggaggagctgcaggagccgtggcattggtagggattgctataatacttatatggttttgtttgtctcgccaaaggaatgtttctaggacttcagagacagggtcctctgatccttctcaagtgggaagacatggtgcaattgagttgcctatacgagatactaggcgatttgagatggaagaactatctctggccacaaaaaatttcagtgacaagaatttgattggggaagggaaatttggggaggtatacaagggtttacttcaagatgggatgcttgtagctatcaaaaaacgccgtggacttgctagtcaggaatttgttgatgaggagaacaatctgcagtttcttatatacgaatatgtgcctaatggaagcgtctccagtcacttgtatggtgccggtcaaaacccgcaagagaagctagaattcaagcatagactttcaatagctcaaggtgcagctaaaggtttggctcatcttcactctttgagtccccgtttagtgcataagaatttcaaaaccactaatgttcttgtggatgaaaacttcattgctaaggtggcggatgctggacttcgcaattttttggggagagttgacattgcaggctcctcttctcaagtggcaacagatgaaatattccttgcatcagaggtgagagagttcagacgattttctgaaaagagcgatgtatacagctttggggtatttttgctggaattgttaagtgggaaagaagcaatagaaccaccatttccggactctaatcaaaatctggttgaatgggtactaagcaatcaagaccgtggcatgatgtcttacatcattgatcggagattggagagtagttttacagctgaaggaatggaagagtacatcttgctcataattagatgcttagatccttcaagtgagaggcgacctgccatgagctatgtggaaatggaacttgatcggatcctagagaaggaaatgaacttgacaacagtcatgggagaaggaactccaactgtgactcttggaagtcaattattcaaatcaacaaaataa

SEQ ID NO: 31288 - DNA, 962 bp, Glycine max
  Peptide Sequence Number=SeqID_148066
caagtttggctatagttcttgtgcctgcaaggaatgttcccaaggacaggccaattactgtggaggaactaagccaaccaccagaagggtacccttcatccaaagtagttcttactggccttgaagcagagtcattgatgtttatttcagtaccctttggtgaagacaacataacattctatgatcgcataactagtgccttgagagaaagtgatgctatagccattagaacaagtagggaaattgagggtaacttttgtgactacattgcatcacagtttggaaaaaaagtgcttttgactgggccagtgttgccagaggaggctgaggggaagttagaagaaaattgggccaattggcttgatgcgtttgcgaatgagtctattgtgtattgtgcatttgggtctcaaatcaatttggagaaagatcaatttcaagagcttttgcttgggtttgagctttcagggttaccctttttggttgctctcaaaactcctagagggtgtgagagtgtggaagaggcactgcctgaggggtttgaagagagggtgaaggggagaggggtggtttcaagggggtgggttcagcaattgttgatcttgaagcacccttctgtggggtgctttgtgaaccattgtgggtttgggtctatgtgggagtctttgatgagtgacaagcagatagtgttggttccacagttgggggaccaagttttgaacaccaagttgcttgttgaggaacttggagtggctgttgaggtggagagagggggaaatgggtgggtctccaaagagagtttgagcaaagccattaagttagtgatggatggagacagtgaggttggtgctagagtgaagaagaatcacatggagtggaagaaaactgggggcagtcctaatttaatgaatggttacatggataggtttgtccaaaatcttcaagattttcctctccatgggtga

SEQ ID NO: 31289 - DNA, 186 bp, Glycine max
  Peptide Sequence Number=SeqID_148067
atggccttccatcttcaccttcgacgactacttgctgctctctcgttgcttcagatattagttctagtgttgaatgctatccagcttgtgagtggccacaatcgatggggtgtggcatcacatgttgatgaagaggcatgtggtaagggaggtagattgtgtttgcctggagcagatcttgcatga

SEQ ID NO: 31290 - DNA, 411 bp, Glycine max
  Peptide Sequence Number=SeqID_148068
atgatcaagtgcaaggatgaatcgaaatccttctccagagaccgtctgaatgacaatttctgtgactgccctgatggcactgatgagcctgggacttcggcttgccccaacggaaaattttattgcagaaacctaggtagcaagccgcagtttatagtttcttctcatgttaatgatcatttttgtgattgttgtgatgggagtgatgaatatgatggaaccatttgttgcccaaacacatgtgtcatgggtgggaatgctgagtccacgtttaggaattgcaagtcaaaagcaagtaaaaatggagtgaagtcagaggaatcggttcatactgttttcgttgccgcaccagatctagaaggagacgttaccggtgaattgaaagagaccttgcagtttacctggcattaa

SEQ ID NO: 31291 - DNA, 549 bp, Glycine max
  Peptide Sequence Number=SeqID_148069
atggttttgtgggagctgcaacgtgtgacttgggttgaactcccacttgggaaaagatccaagctttggtgttttgaagcaaaagggggacacgaggacctacctagagggtgtatgccgaggagagaagggtgtgaaaagcaacatgcggcggtagcgaagagaagaaaacatgcgaagtggaaaccaacttcttttcttcttcttcatcaccaacaaagtcatcaccaccaaccccaaaaccacaacaaccccactccaaacctgaatttgaagcatgaatcaccatgtccgaaaccacaacaaagtcatcatcacccccaaacatccaagctcgaaatacccatcatcaacaaccaaacaagatggggccccaagccattcttaggtcgagtcaaactgattttcaaggtgcagagtgtgcaatgcactgtgacatggttcgaaaagtttcgcaaggcaatgaaggcacgcaccaccatggtgctcgccgagggcaacgatggcgtggagaacacatggtgcatcaccgacgagaatgaggtctag

SEQ ID NO: 31292 - DNA, 345 bp, Glycine max
  Peptide Sequence Number=SeqID_148070
atggacacaacatttgcattcataaaaaagaatggtggtttaaccacttccaaagactacccttatgaaggggtagatggctcatgcaacaaggaaaaagctttacatcatgcagtcaatataagtgggtatgaaagagcaccttctaaagatgaggcaatgcttaaagttgcagctgctaatcaacctatctcagttgcaattgatgctggaggctatgcatttcagctttattcacaaggtgttttctctggtgtttgtggaaagaaactcaatcatggtgtgactattgtagggtacgacaaaggaacttttgataagtatcgaactgtcaagaactcatag

SEQ ID NO: 31293 - DNA, 201 bp, Glycine max
  Peptide Sequence Number=SeqID_148071
atggaagctaaatttggagcatgttttgaggctacaattcaggctaattggctgcggaactttatttcagagcttggaattgtcgacaatattgccaggtcgctgcaaatgtattgcgataactccacagtaggattaccgcccaagacatttatagaacatgttgaaagtatgtacattattgttattgatgatcattaa

SEQ ID NO: 31294 - DNA, 303 bp, Glycine max
  Peptide Sequence Number=SeqID_148072
atggcaagctacctgtggagaaaatatgctgattatttgtacacaaagtgggaaaaaacctttctttgggacatggtggaaccttacagaaggcccaaatcctttaccccattggtcactatttacattgctgctttctactctggagtcattggtgctgccatcactgaacaactctacaaggagaaaaatggtgaagctttgttgcgtgtgcctagtggtagttgttgtttggggactctattggacatagactccaatctctatgacttttttattagcagtgtgatgcagttgttttaa

SEQ ID NO: 31295 - DNA, 189 bp, Glycine max
  Peptide Sequence Number=SeqID_148073
atgcgggtgagtggaggacattttgggacacttgcaggagtggtattcaccccaagcttgtcttcccgcctttttgatgaagaaaagtactgggaagagcaccctggaaaagcagtgcctctcatgagaccgaagttttatgggggtccttggagggtcatgggcggtaatgaacccccatctaaatga

SEQ ID NO: 31296 - DNA, 559 bp, Glycine max
  Peptide Sequence Number=SeqID_148074
atgactgccttccccaatttagaggttctatatctatatggaatgagtcttaggggaagcatccctaaagaaataagcacacttacaaagcttaccgatctttacctatcgaataatcatcttcaaggttcaataccagtagaactagggagtttgacacaactagtgcttttgtctctttataataattcgctaacgggttcaatcccttctactttgagtcaattggtcaatttgagatatctccttctatctttcaaccaacttgaaggtgccataccagcagaactggggaatttaacacaactgattggattttatctctccaacaattcaatcaccggttcaatcccttctagtttgggtcaattacagaatttgactattctccttcttgattctaatcgtattcaaggtcccataccagaagaatttggaaatttaaaatctctacatatattatatctgtcaaacaatttgctcaccagtacaattccccctacattgggtcgattggagaatttgacacacctcttccttgattctaaccaaatagaag

SEQ ID NO: 31297 - DNA, 1041 bp, Glycine max
  Peptide Sequence Number=SeqID_148075
atgattactaccgccccatttccatacataactggcatcattgagggctggcgtaagcaaagattgtcattaaccctcgttttcttaacatatgaattatggttgtctgaggtctgcacttccgagagacatgagaagtggatggcacagtatggtaagctttacacggatgctgctgagaaggaaaaacgtttccaaatattcaaaaacaatgtgcagttcattgagtctttcaatgctgctggggacaaacctttcaacctaagcattaatcaatttgctgaccttcataatgaagaatttaaggcttcactaattaatgttcagaaaaaggaaagtggggtggagacagcaacagaaacatcttttaggtatgagagtataactaagattcctgttaccatggactggagaaaaagaggtgctgtcactccaatcaaggaccaaggcaattgcggcagttgctgggcattttcaattgtggcggcgatcgagggtatccaccaaatcacaacaggtaaattggtgtctctctcggagcaagaactggtagattgtgttaaaggtaagagcgaagggtgcaattttggttataaggaagaagcctttgaatttgtggccaagaatggaggattagcaagtgaaataagctacccctacaaagcaaataacaagacttgtatggttaagaaggaaactcaaggggtggctcagattaaagggtatgaaaatgttccttctaatagcgaaaaggcactcctaaaagctgtggcaaatcaaccagtatcagtttatattgatgctggagctttacaattttactcgagtgggatttttacaggaaagtgcggaactgctccaaaccatgctgctactgtgattggttatggaaaagctcgtggtggtgccaagtattggctggtgaaaaattcatggggcactaaatggggtgagaaagggtatataagaatgaagagagatatacgtgccaaggaaggtttatgtggaattgctaccaatgcttcttatccaactgtttga

SEQ ID NO: 31298 - DNA, 1122 bp, Glycine max
  Peptide Sequence Number=SeqID_148076
atggctttcactggccaaaagcaacacatgttagccctattccttttccttgcagtagggatttcccaagtgatgccccgcaagctgcatcaaacagccttgcgagaaagacatgaaaattggatggcagaatatggaaaaatgtataaggatgctgcagagaaggaaaaacgtttccagatattcaaggacaatgtggagttcattgaatcattcaatgctgctggcaacaaaccttacaagcttggtgttaatcaccttgctgatctcacacttgaggaattcaaggattcacgtaatggattgaagaggacctacgagtttagcacaacaacatttaagttaaatggatttaagtatgaaaacgtgaccgatattcctgaagctatagactggagggtaaaaggagctgttactccaatcaaagaccaaggtgatcaatgtgggagttgctgggcattttcaactatagctgcaactgagggtatccaccaaataagtacaggaaacctagtgtccctttcagagcaagagttagtggattgtgatagtgtggatgatggatgtgaaggaggtttcatggaagatgggtttgaattcattattaaaaacggtggaatcactagtgagactaactacccgtacaagggagttgatggaacttgtaacacaaccatagcagcctccccagtggctcagattaaggggtatgagatagttccttcctatagtgaggaagcactccagaaagctgtggccaaccaacctgtgtcagtttccattcatgcaactaatgcgacattcatgttttactccagtggaatttacaatggagaatgtggaactgatctagaccatggtgttactgcagtgggttatggcacagaaaatggaactgactattggatagtgaagaattcatggggcacacaatggggtgagaaaggatacataaggatgcatcgaggtatagctgctaagcacgatacgaaaaatgaggttacattaagcaaaaatggcaacagaaatgaagagaaagaagaaattttgaagcaggcccagcccaacagtggtgctaagcgcgcatcaggcgctaagcgagcaaccaaatgcaggcgctaa

SEQ ID NO: 31299 - DNA, 210 bp, Glycine max
  Peptide Sequence Number=SeqID_148077
atggctccagcttctggttggatcaaggtcaatacggatggagctgcgcagggctctccgggtgttgcagcaagtgcaggcttgttcaaagatgatcaagggagcttccttggaggatatgtctacaaaggcagtaagtactgcttgtacaagcataaagataaaattgaaggaaaagagacaccaaggcaaagctcagatcatgcgtag

SEQ ID NO: 31300 - DNA, 468 bp, Glycine max
  Peptide Sequence Number=SeqID_148078
atgaatcagtctaagaagcaaaagtattatgttgtctttattggaaagaagctcgacatatattattcgtgggacgagtgcaaggcacaaactgatgagtatccaaacaattgccaccactcctttaagttgtatgacaaagctcaatttcactggctagaccattgcaggaaatatggaattgaggctagtcaagcgaatgtaaaaccacaaaaatatgcaagagtgcctcctttgaactctttttctccaactgaagggcaattgtgcttaaatatatctctccctcccctatctacacggtacaagagtttaggttctttggtggcaaggaatttcaaagaagatgttgacaatgacataggaatgcaaaccatgaagaatgacaagttgtggttgcaaatgcaactgagcatagtgtcagaccaagcgcaagcgctgaatgcacaacttcgaggggggcagtga

SEQ ID NO: 31301 - DNA, 372 bp, Glycine max
  Peptide Sequence Number=SeqID_148079
atggagttatatgtgataagggtgggtaagcagaggaccaactatatttatatcaagagaacaatacaagatgatgataaatacaattggtggtctaagccagctcataatcaccatattgggttcaaaatagagggagtcgttgctattgtgcattatgatggtgatatggtatcaacttgtgatgggatattgcttgaatgtcctaatgatcctaaattcattaaaattagtgaagaaatgttgcgtgttactttgaggaaagcagttatagatgccattagagttggaagaagcttgtttgaggttttttaccataaacttgtatacgtaagtaatggctatgtagagtatgacggaatggaactatga

SEQ ID NO: 31302 - DNA, 200 bp, Glycine max
  Peptide Sequence Number=SeqID_148080
gaaagtgcggaactgctccaaaccatgctgttactgtgattggttatggaaaagctcgtggtggtgccaagtattggctggtgaaaaattcatggggcactaaatggggtgagaaagggtatataaaaatgaagagagatatacgtgccaaggaaggtttatgtggaattgctaccaatgcttcttatccaactgtttga

SEQ ID NO: 31303 - DNA, 899 bp, Glycine max
  Peptide Sequence Number=SeqID_148081
atggagtctggtgatgagattaatttgaacatagaaagtgggaataatgggaagagtggtggtgatgggttcgttgataggagtaaggtgcggattttgttgtgcgataacgattccaagagttctcaagaggttttcacgcttcttttgagatgttcttatcaggttacctcggtaaagtcggcaagacaggtaattgatgcactgaatgcggaggggcaacatatagatatcatactggctgagcttgaccttccgatgaagaagggcatgaagatgttgaagtacatagcacaggataaagagtttcgccgaatccctgttataatgatgtccgcacaagatgaggtatccgttgttgttaagtgcttgagacttggagcagcagactatctactattatgggagatgcttaagattttggaagagcctcattgcataccaattatcaggctacctcatctgtgcaacagtttaggggcaatgccgaacactcttggacttgtagagaagaacatcttgaattatgattttgatctggtagtatctgacccgagtgatgccaacacaaacagcaccaccttgttctctgatgacacagatgacaagtccaagagaagcactaatcctgaggtaggaatatcagtccaacaagagcaagaggtgggtttcttttttcaactttgggcgttctttgcaaataattctacctttcagagtgtaaacattgacatacattctactattgcaattgctgctgctgttgaggaacctccagatgctcatgcatcagaatgcgggcctgatgtggatggagttaatgatcaccaaacagcacatttttcatctggtccgaagaagagtgaactaaggataggggagtcatcagccttcttcac

SEQ ID NO: 31304 - DNA, 865 bp, Glycine max
  Peptide Sequence Number=SeqID_148082
atggataatgtgacgatcttatctgatgatgataggcactattcacccgtgaaaaaaaataaaaaggtccatcgaagacgtcttgaggcggagggagagaagttcagtgtgatgttggtcggagatgtgtcatgcgatttgtgcaagaacttcatgcgtcgaggccttacatggggtaagcattggcgaaaaggcatcggggagtctgccaagcaagggtcgaaaagtcgtgcggtactatttatcgcaaagaagggttgcgtgaaaaatgcggggagcttgtcaccgaaatcaaaggctgaaaatgtagtcggatacgccgatttgaggcaaagatcatgtgtgtgggtgtgcatgaaacactggttgaggaggctagaaatggacagatcaaccttcgatgagttgaatggtggggtcttcgttggatccccagcgacaaacgacaagggcgatcaccgaataagttttgtggattctgcatttacgtatgtgaaccagtacatgattgaaccgcttgacatcccaaccaatcctttaattcttgcttcaatgaggtcctttaatggtgattttccaccatggagatgcagcggaagacaaatgagaagaggtgagaggaggcgccacccactagggaataagccatggaagaaggagcttcaccaccaagatgagccttggataagaagcttggaaggatgcttcaatgaaggaaaagaaagagggagagaaagagagaggggggagcacgaaattgaaggaataaaagagggagagaagtggaactttgaagtatgtctcacaagactctcattcatcaaagttacaacaagtgttacacatgcttctatttatagactag

SEQ ID NO: 31305 - DNA, 111 bp, Glycine max
  Peptide Sequence Number=SeqID_148083
atgcagaatccacaaaactgcaagaacaacaaagttttttggtacaacaatattgatttcagcgtgaaagatttgcatttgctgttatttttgggaaatgatcttttatga

SEQ ID NO: 31306 - DNA, 813 bp, Glycine max
  Peptide Sequence Number=SeqID_148084
atggaagttatgcatcaaacatgtgctcaacaaggggtgaatgaccttcaaatacgggaaaatggagaggcatatgaaagtcaatcgcaagatgacttacccagcagcactagtatacctgattctttgtctattgagaggtcttgtactccacctgcatcaatggaagtttcacagcaaaagcactacagggaagaaaatttacatcagggtgtgatgcatccaagaaatgggactcattgttccgagcttgaagtatctggcatggcttcccaacaggtttatccatattatatttcaggggttgttaatcatgttatgatgccttcatcagcacaaatgtatcatcaaaagaatatccaggacctacagaatcatcctagctcagctatgatttcacagtacagccatcttccccaaggtggtcctcatggaacggggatgacatccttcccatattacccaatgagcatatgcttacaacctggtcagattcctaatcctcattcatggcaatcatttggaaactcaagttcatctgaagcaaaattaagtaaagttgataggagagaagcagcattgatgaagttcagacagaaaaggaaagagcgctgctttgataagaaaattaggtatgttaaccggaaacgacttgcggaaaggcggcctcgtgtgaggggtcagtttgtcagaaagttgaagggtgctaatgcggatcttaatgggcagcctgcatcgattgactatgacgaagatgacgaagaggatgaagatgaccagggagcaagagattcttctcccgaggatgcttga

SEQ ID NO: 31307 - DNA, 447 bp, Glycine max
  Peptide Sequence Number=SeqID_148085
atggctttcaccagcaaaatacagcaaaacttagccctattccttctcctttcaattgagatttcccaagtaatgtcccgcaaacttcatgaaacatccttgagagaagaacatgaaaattggattgcacgatatggacaagtgtataaggttgcagcagagaaggaaacgtttcagatattcaaggaaaatgtggagttcattgaatctttcaatgctgcagccaacaaaccttacaagcttggagttaatctctttgctgaccttacacttgaagaattcaaggatttccgttttggactcaagaagacccatgagtttagcataacaccatttaagtatgaaaacgtgactgatattcctgaagctctagactggagggaaaaaggagccgttactccaatcaaagaccaaggtcaatgtggtaagatcaagaagatcatataa

SEQ ID NO: 31308 - DNA, 294 bp, Glycine max
  Peptide Sequence Number=SeqID_148086
atgatgatgcagatgttagtcataagtcctacactttctttgatttcagccatgattgttccttgcatggtgctagttgttacctttcttggtcaagaacttcgcaagatatccaaagaggcacatgttagtattgctgctctctcggcctatctaaatgaggtgcttcctgcaattctctttgtgaaagcaaacaatgcacagtcatgtgagaataccaggtttaagagattggctctgatggactataatgcaaggctgaagaaaaaaaagatgaaagcattgattcctcag

SEQ ID NO: 31309 - DNA, 309 bp, Glycine max
  Peptide Sequence Number=SeqID_148087
atgtccaaccgcacgtgtcttactgttcaaccgtgtccggtgacggcggaggcaacggacaccgcgtcgcaccagagtcgtacccgtatgcgtgtttggtgcgagtccgatgcgggacacgccgatgatgagccgtgttcgtgcttcttagccctacagttccaaggagaaattgaattttgcagtcgaagcactgcaaaatcaatcattgcaaatccatcgccatggattccctcgtcatgctggcgcgaagactttctaacctccagatcctctacctcaaagattgacacgttaggaaaatcttaa

SEQ ID NO: 31310 - DNA, 1830 bp, Glycine max
  Peptide Sequence Number=SeqID_148088
atggctaagaacacgcgtttgaaggatttgcaaacagaaatttgtacacattgggatgatatttgtcgtatcagtcaaacgatggatatgcgttatcaagagcaaaatgataagatgcttcagatccagaattctatggatcaaattcagttagcaatgaatctgttattgcagaatgcttctcaacctcctggaagttcttcgaacaatggctcccctatggtgcaaccgattaatgcttctttgcttgttaaagagatctcacttggatttcctcacttcgatggaacgacgccggtgatggagtggatcttcaaggcggagaaatttttcaattatcataatactcccgatgcgtctagagtggatattgcggcaatgcattttgataaggatgtagtggcatggttccagatgtcgcagaaattatatttggtgtctacttggtctgagttgattcgtgctttagaatctcaattcgatccttcaccttttgattgtccaatggctgagctcttcaagcttcaacaaacaggttcggtatcagattattatctcaagtttatgtctctagctaatagatctttgggattgagtaatgaggctctcctcaattgtttcattagtggtttaaatcctaatattagaagagatgttgttgctatgtgccctcttaccttattgcgtgaagttgctttagctaaactttttgaagaaaaatatggtcctgttttaaagccatttcgaaactcctataatcacaaatattcccaaatttcttgtaccccagtctctattaatgctcaacaaaaaacacaaattaaatccagtttacctccgcttttacctactccaccaggccctccaattaggtcctcaaatgtaaaaagatttactcctgctgaaatgcagttgagaagggaaaaaggattgtgttatttttgtgatgagaaattaccttttaatcataaatgtcctaatagacaatttctgttgttgctaatggaagataataatgaggatcttattagtacaattgtaccccagggtactcaagaagatgaaatagtagaatctgaagatcatcatttgtctttcaatgctttgaaaggaggtcggggagttggtactataagagtaatggttggtaatggtaattatatgtcggctgaaggattagttaagcaattgaagtttttgcggaagggtaaatttactactttacaaggagattgtgaactggtacctgagcaagctcaattacattttataagaagaatggtggccactaattccattgctgaagtttatagtctgcagttgatggagccagatgttgctcctaaggcttttaatgcaattactatcaaggacagcttccttattcctactatggatgagtttattgatgagctttttggagcttccttcttttctaaattggatctaaggtctggttatcaccaaattttgttaaattcggatgacagacataagacaacatttaggactcaccatggaatagctatggagggaactaaattggaagctattcaaaagtggcttgagcctagtaatctcaaacaattgagagcatttttaggactcacagatacatttcaacaactcaaaattgtcatgacatctgctcctgtattgactattcctaatttcaaggaaatttttgtactggagactgatgcctcaagaagtggagttagtgttgtccttagccaaaataagcatccaatagcttatttctctaagaaattgtgcttaaggatgcagaagcagtctgcttatattcgagaattctatgttattacttag

SEQ ID NO: 31311 - DNA, 933 bp, Glycine max
  Peptide Sequence Number=SeqID_148089
atggaggaatttcacagttctaagattggtggacatgctggagttaatagaacaacaactagaattggtgctcaattttattggaatggtatgagaagtgatattagtaaatttgtgagggagtgtgccatatgtcaacaagctaaagttgatcatgttttgccagcgggattgtccaaatttgggtactttatccctttgaagcccgagtttaacaacaaggttgtggatgaacttttcattaccaacattgtcaaaattcatggcaccacattggccatgagttcttcatatcaccctcagtccgatggccagactgagaatcttaataagaccattgagatttatctaaggtgctttgtatttgaacatcctaagacagtttttggaagacctccaccagcggtgatgcactatgaggttgatcctaaagatcctgatccactcaaggatttattacaactccgtgatcaacttttgagcaagcttaaagtgaagctacaaccctataggcaacattcagtggctttgaggaagcatcagaagctaggcctgtgctattttggtccatttccagtgattgaaagaattggtactgttgcatacaaagtacaactactagagtctgctaaaatacatcctgtatttcatattgctcttctgaaaccatttcatggcaaaagttctccaccatatcttccttttccactcacttctagtgaactgggacctacgctttgcccatggaaggtgttggatgttcgagttgtcaaacgtttagaagctactttcaaccttaaggacaaggttgtttttgatgaggaggataatgtaacggagggacacgtggctcatgaaccgcacagtgagggaggcaggcgtagcacaaggttgaggaggaagaatataaggctggaggattacacgttgtag

SEQ ID NO: 31312 - DNA, 318 bp, Glycine max
  Peptide Sequence Number=SeqID_148090
atgacggtgacctacatgtgtgtccctacatcttgggagcaaggggggaggaagggggaagggaggcaagagaggcggtgggtgaagacggaggaggtgtcggagagaggttggtcaaacaagtctaagcaggaggggcagaaggaggaaggaggaaggatggaggtagaggacacaggaggttcacactacacaggtggcggttcttcaagccgcagctgctgcattcaccttcaggggggagctagtggtgggtggagggttcatggcaatggagagggttttagggttttggagaaagagaaaggatcaaaataa

SEQ ID NO: 31313 - DNA, 1830 bp, Glycine max
  Peptide Sequence Number=SeqID_148091
atgggaaggggtctgagtccaatgctacagagagagatccaaaatcttgacaaagatggggatagccgcaaatccgcaatgagagcattgaagtcatatgtgaaagatttggacatgaagacaatacccatctttcttgcacaagtttctgagaccaaggaaactggttctttgtctggagagttcacaatttcactgtatgaggttcttgctcgtgttcatggagtcaagattgttcccatgatagacagcattatgcaatccatagttcagaccttagcttcaagtgcagggtcttttcctcttcagcaggcttgctcaaaagtggttccagccatagcaaggtatggaattgaccccacaacccctgaagagaagaagaggcaaataattcactctctttgtaagcctctttcagactctctcttgagttctcaagagagtttgacatgtggtgcggccctttgcttgaaggcccttgtggattctgataactggcgttttgcttcagatgagatggttaatagggtgtgccggaatgttgctgtggcattagagggaaagtccgcacaaaccaattcacacatgggtctggttatgaccctggcgaagcgcaatgctttgattgttgaagcctacgctagattgttcatacaatctgcactgagaatactaaatgctggcagtgagcctttggaggggaattctcagaagcggtttgtagccattcaaatggtgaacttcttgatgaaatgtttagatccaaggagcttattttcagaagttgaacagataattgaggtgatggagctgtgtcaatcagacaaaatggcatatgtcaaaggagctgcatttgaggctttgcaaactgctaagataattgtcactgataaaaaatcaagaggtgtgaagagtcctgcttctatgacaggttcgaatttcagtagaaaagactatatggaaggtgaaagtttttctggtgatggagatcgttctctctcatctatttctccagagtcacagaccttggacttcttcaatggatatgcatcgcctattgagtctcccatttcaacaagtcggccttcgcataacttctacgagaggagtgtgaataggaagctttggagtcatgaaaatggaggggttgatgtgtctctcaaggatggtttgttctcaaaatcagggcacagaaatgcctcgttggaccacagtcactacactatggatcatgagttttctaatggagggggagatttaacaggggagtttgctggtttcatgcacaaaagtccttggcacggagcatctagaagtgccagcacaagtcccctaagatcatgcacgcagggcaacattaaaatctttatgactcctaggaaactcattcactctcttcaagaagacctaaatgatgagatttcagattgctctgagaaaccaaatagaaggatcaagagtctatcatcaggcaatattaagtggagtccggcatcttattctaaatatgatcaaaatggtattgcagatcatgtcaactatgattctaaagagagtggaagcttgtatggtaatggtgacattcagtttcaaggtgggccggagtcagtctcatccacagatgacattcctggtaatactgatctgcagaggccttctgaggttggtcctgaaagtagaaatggtaccgaaactgttctcatggaaaagccatttcaaaagaccacacataaattagtttgtggcatttcgtttgctcttttggcaatagctactcctttactctggatcaacagtcaggacgaaggccattttcttgtccctacataa

SEQ ID NO: 31314 - DNA, 257 bp, Glycine max
  Peptide Sequence Number=SeqID_148092
cttttgaagaagttacgaaaactcacggattgcgaaaaacacctcctttcgatttccgtcaccttacggaattttcatggatcgcggtcattcaacagtggaaactggggatagcgaacaatacactacaccaggaccccaacctttacccgtggcctactcctgagcagttcagagccactgtcacatggcctggggataggcctaattttcagcatatgattcatggaagtgatctgggcattccttctttctaa

SEQ ID NO: 31315 - DNA, 519 bp, Glycine max
  Peptide Sequence Number=SeqID_148093
atggggaatcagaataggggagaagatgctcagtatcagtcagggaactggataagggacattgagaaaatcttccaagcgatggcatgtctggaggggcagaaggctgaaggtcaagttgtgacctgggaaacctttaagagggcatttatggagaaatactttcctgaagatgttaggaacatgaagaagatgaagttcctagagctcaagcaggggaacataattgtggctgaatatgcagttgagtttgaggaactggtgagttactttcctcgctacaaaggaagagatggtgaaagttcaaaatgtgtgacatttctaaacggcttgcagcctgaggtgaagcaagttgtgaactatcaagggtttgctggtggtagtggtagcaaaccaactactttctcaacccaaatcatttgtttcaggtgtggtaagctaggatatatcttgatgcaatcctaccctgcaagggcattggatagaagactccaagcagattgggccagagatccttag

SEQ ID NO: 31316 - DNA, 537 bp, Glycine max
  Peptide Sequence Number=SeqID_148094
atgccttctccagatcctagaattgaacctttgttggttcaggctgggttttcagatgctgcaaagctcaaacaagttaaaatcgatgatgctttagttattgctttggttgaaggtattgttcccccagagaatgcactagtggggtcaacacttaaactaaaatggttaaaagtaaacatgtttaatctcccagcagaacacacaccacaacaactagcaacccattataaggcatacattttagggttgattggtgtggtgttgatgctagacaagtcaggggacagagttcacctgatgtatctacccttgttagcatatcttgatcgggttggtcgatacatctgggtggtagtatggtatcaaactgacaaggtcatgctccaatttgaactttttcaagacataccaaatccactgcataatcttgacaaagtccattatactgacatgagaggacatagtgacacaaattgggcaggaaacaccaacagtggattgcaatttggaaggaaatatgcaaatatgtgttaa

SEQ ID NO: 31317 - DNA, 1008 bp, Glycine max
  Peptide Sequence Number=SeqID_148095
atgactaacccaatccctgagactcaaatccccgacgaaaccctaaaccccaacgccaccaccgaacattacccacaacaagaaccaccaccaccacacaccgatccccaattccccgaaaccctaagccttcccaatcctaattcccccaaccctaaccaagatcaagattctaccatgcaagactcgatccccatcaccctcaccgtcgtcgacgacgacgacgacccggagcccggcgctgccaccggcggcggtggcggcaccaccacccgacgcacgacgaagcggaagaaaaagggccctaagagaaccgcgctggagagaaagtctcgcgagaagctccaggttatcgtcgaaaccctaaagcccattcctttcactcccgcgaaaaccctcgatttcgagaagcaccagagcctcttgcagcggctggggctctgggacttcgtccacgtcgagttcgattcggcgctccgcggcgatctcatcgcgcagctcatcgcgagctacgtccccaactatcggtgcggctacgtcaatggggttaggatcaatgtgaaccgtgccgatctcggccgcgccctgaagctgccggtgaagaagtctggtggcggtggcgccgccaccgtggattcgatagactcggcggagtctatagcgtttgttgaggaggtggtgtatagttggatgcttctgcatgatgatgaagcttacatcatgcctaatgatgttttggggtggttgagtttgatccaggatgggaatttcgagaaggttgattgggcggggatcatatggttcatggtggagaaggaattgaaggcgccgcagctggtgagttgttactacgcttcacatttgcagcatttgattaagacgcagcatgaggagttgttcaatgagggggttgaggcagtggaggaggtggtggaagaagagaatgatgtgaaggaggagggggaggaggtagaggaggaggaagaggaggaagggttgaaggaagtg

SEQ ID NO: 31318 - DNA, 259 bp, Glycine max
  Peptide Sequence Number=SeqID_148096
atgccacgtcaaatcgtctttgctattgtcgtagaagagctactattcgaacaacaaggacgggtgacaaagaacggcaaccaccaccattgggagagcgatgatcgacgtggacctagcacaggaacactatccttcaaccataggagggagaaaatagtgagagagaattcatcacgtgtcgtcgaaggccaccttgtcatcggagtggtcgagctaaggttaggcgtcatttgggggttcaattggggtgtcgaag

SEQ ID NO: 31319 - DNA, 249 bp, Glycine max
  Peptide Sequence Number=SeqID_148097
atggcagcatgtaggtcctcttcaccagtctcggctgcaccatcatctccttatccgtacttggaaaatatggctgggattttagggctgaatgcttcatattatctgaaaataggagtaaacatggcttccaatgattctaatgttggtagtagaagtgataattttggtagtgatgttgttgctagtaggagtggaagtgggtacttgtctttcttaataccaaatgaaaatgcagctcctttatga

SEQ ID NO: 31320 - DNA, 1736 bp, Glycine max
  Peptide Sequence Number=SeqID_148098
atgacccataagctcgacaccctcatttccaccctcaccaccaaatctcccgcaccctccccaagctcacccccacacgtttccccgacttcaccctcatcccctcaccctcgcgtcaagctcgatgttccccggttcgatgggtcggacccattaggctggatattcaaaatcactcagtatttcgaataccatcacaccccggaccaagaccgactcaccattgcgtccttttacatggacggcagagctttggcctggtaccagtggatggctggtaatggccaactctcctcctggcagagtttcctccatgccctgcaaattcgttttgccccctcccactacgaggatccaactggggccttattcaaattgactcagaaaaccacagtacaagcttacctttctgaatttgaggatctcgcgaaccgcgttgtcggtctccctccgcactttctcctcagctgctttgtctcaggcctcaatgccgacatccgtcgtgaggttcttcccttgcaaccattgacggtcacccaggctgccggtcttgctagattgcaagaggagaagcttatcgaagcgagaagggcttttcatccccgtgtcccaccctctccctctcaaccgctccccacgaaccctttctccccctctttaccctccttgccctcgaatcccaccaccaagcccctttccgtcattcctctgaaacggctaacccctaaggaattaactacccgcagagagagaggtttgtgcttcaattgcgatgaacgataccatcgtggtcatcgttgcaattctagggtgcacctcctagtggttgatgatgacgagcgctccgtagaagactataccctattgggcctggaacccgaaccacctgacccatcacttgtaaatgaggcccaactcaatttacactccctcactggaccgttagcacctgagactctgcgtttttccggcctcattgccgatcaacaggtgctcactctcgtggatgggggaagcacccataatttcgtgcaagattccatggttgccgaattgggccttaccccttgctcgaccacacctctaaaggttatggtgggaaatggccaattccttcaatgccaacaagtctgtcaagcagttccactaacaatccagaacattgtttttattgttgaccttcacgtgttacccctctgcggtgcacacggacgcatcattgaatttcaaggagaggacacttccaccctccagccactaacctccactcaagtccgacgtttggttcgcacggccggagccaccatttacctccacctttctgttaccccctccgacacacctgatacacctaatcccccttaccctctcgagattcagtcccttctaagcagatttgcttccctgtttcaaccacctaatgcccttcctccctctcgaccgactgaccaccatattcacttaacctcaaacgcccaacctgtcaatgtccggccctatagatacctacattatcaaaaggctgagattgaatctcaagttgcttctatgttgcagaaaggcatcattcgtccaagtacaagtccctttagttctccagttcttcttgttcgtaaacacgatggaacctggagattctgcgtggattacagagcactcaatgccctcactatcaaggattgttttccgatacccacgatagaagagttactcgatgaattaggtggtgcttcttg

SEQ ID NO: 31321 - DNA, 453 bp, Glycine max
  Peptide Sequence Number=SeqID_148099
atgcccaccccaaaaagcctcgttctttcgctcctcctccttctgggcctctgttccggcgacggcggcggtggcgctccgccgcaggagctgtggtgcgtggcgaagaacaacgcggaggacgcggcgctgcaggccgcgctggactgggcctgcggggccggcggcgccgactgccgcccaatccagcgcggtgggccctgctacgaccccaccagcgtccagaatacggcgtcgtttgccttcaacgactattttctgaaacatggcatgaccgacgatagctgcgacttcaacaacaacgctgccgtcacttccttgaaccctataagagtgggagcaatgggagtttttctggatcaacgcccacttcatctgttggattgggacccagtaaagatttcagtgggtgctcgagagtttcttggggatggtggtggttttggcctttga

SEQ ID NO: 31322 - DNA, 1847 bp, Glycine max
  Peptide Sequence Number=SeqID_148100
atgcccttcgggctatgcaatgcgccctcttcttttcaggctacaatgaattccatttttcgtccttaccttagacaattcattattgttttctttgatgatattttgatctatagcaccacgttggaggatcatgtgcttcatttggagcaagcttttcgaattttgttgcaggaacaattcgtcctgaagctctccaagtgcacctttgctcagcctcaggttgaatacctgggtcatgtggtgtcagcccaaggtgtggaaccagtcatggacaaggtccaggccatccaacaatggccagaacccaactcagggcgcacactcagaagttttttgggccttgctgggttctataaacgcttcattcgcggctatgcaactattgccgcccccttgaccaagatggtcacgatggaacctttccaatggacagaccaagctcgtgctgcttttgatcatctcaaacaagtgctcacttccacccctgtcttgcggttgccgaatttctctcttcctttcacggtggagacagatgcctctggcaccggcatgggagctgtgttgactcagcaaggacatcccattgcgtatttcagcaaagtttttcctcctaaactcatggctgcttccacctatgttcgagaattgtttgcaatcactgccgccgttaagaaatggcgccagtacctccttggccgccgtttccacattttaacagatcatcgcagcttgaaggagtttctcactcaagtgattcaaacacctgagcaacagatgtaccttgctcgattaatgggttacgattacaccattatgtatcgtccggctgctcatcctgacttttctgtcacgaacgatttgatcctccataaaggtcgtatttggcttccccaagctttgcctttcatttcaacactactctcggaataccactcaacccccactggtggtcacatgggcatcaccaagaccttagcacgattaacggagaatttttattggaaggggcttcgtcaagatgtagaacgtttcatagcttcttgtgttgattgtcaacatacgaagtatgagactcgtaagccggcgggattactttgtccattacccataccatcaaaaccatgggaggatttatcccttgattttatcacaggacttccagcattccagggacatactgttatccttgtaatagttgaccgattttctaaaggcattcatcttgggatgttacctacgcgtcacacagcttacacggttgccgttcttttcatggacctcgtcggaaaactccatggaatgcctcggagcttggttttcgatcgagaccctttatttttaagcagattttggcaagagctttttcgtctaagtggaacaaagctcaggctcagttcagcttatcatcctcagtctgatggacagaccgaggttctcaacagagtgatcgagcaatacctccgtgcttttgttcataagaagccttcgttcttgggaaagctcttaaggtgggtagaatggtcatataacacttcttggaattcaagttcaggcatatccccatacgagatcacctttgggaagaagcctgctaatttcccaaggtacctcgaaggtaactctcccattgttgcggttgaagatatgcttgttgaacgccaagctgtttttgaacaaataaagaagaagttggaaaaggcccagaaccgaatgaagcatttcgcggatgcacgaagacgcgatgttcacttcagcgttggggatatggtcttggtcaaactaagaccccatcgtcaaagaacggtgacgggtcaacccagtggtttctctaaattggacaaacg

SEQ ID NO: 31323 - DNA, 302 bp, Glycine max
  Peptide Sequence Number=SeqID_148101
aacccgatactaccccgtattgcagtacgttgcccagtctttatgagaacgaccaacttgtggttactccgttagctattcttgatacacgtcactctgccggatctgcactcgaggttcttgtacaatggcaaggtttgactcctgatgacaccacctgggagaactgggatcagttgcgtgaagaataccaccttgaggacaaggtgcttccggaagtggtgaaggatgatagcaaggaagcagaaggcagacccaaaaggaagaagaagataccaacatacctcagagacttcgtttga

SEQ ID NO: 31324 - DNA, 129 bp, Glycine max
  Peptide Sequence Number=SeqID_148102
atgccccctggtatggttaaatgtaatatggatgcagccatttttgttgagcaagagtctgactatgaagcaccgacacagacacggacaccggacacgacactgacacgaacacgtggacacctgtaa

SEQ ID NO: 31325 - DNA, 732 bp, Glycine max
  Peptide Sequence Number=SeqID_148103
atgaatgtcttcgacaacgatcacgatgaagaaccatttggtcaataccatagcaacgtgaacagaacaatattgtacgtgtccatggtttccttcgcaatggtcttgttcctcgtcttcgttctctacctctacgcccggtgcgtcctaaggggcaggtcccgccaccgcgccgccatccgccgcctcaccatcgccgcgcttcacgtctctgacctcgacgccgtcgccgccacacaccgccacgccgaaccaccaaactcggggctcgaccctgccatcatagcgtcactgccaaccttcgccgtcaaggcaaaggttttagaaggtggttgcagtggcgctacggtggtggagtgtgccgtgtgcttgagtgctctagaaggcgaagaaaaagccaagttgcttccgaattgtaaccacttttttcacgtggattgcattgacacgtggctggattcccactccacgtgtcctctttgtcgagccgaggtcaaacctcggctcgaaccacaggaccgcgagggtcctgttggtcttgctatcgatggtgcacctccacttggtgtaggtgttgatggtggtggtgaatcatccaaaattaatggttctaattcgcggataagctcgtttagaaggattctcagtagggaaagatcttcaagaagaatccaaccctctggctatgatgatgaggatggtggtgttgatcaagatttggaaagacagtga

SEQ ID NO: 31326 - DNA, 658 bp, Glycine max
  Peptide Sequence Number=SeqID_148104
atggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttctgatacaggtgtgggaaatgaaaaatctcaggagggctgtagctgctattggggatgtgatcgagtcagacgatgacacagaggaccgccgacgattggaccgggctcgagtattggtgcggacaccgcttctgccgttgataaggtcggaggtcatcgtccgtgtgggggagcttgagtatcgggtatggattgtggaagagacagggttcgaaggtgggtcgaaccggaaaggaagctcgccgtccgatgggtggtcggagatgataacatcggacgacgaaggggaggttggcgatgttcttgacgacactaataccaatttctccttctcgccggagctgcccaaccagaaattgtctccgtctcgtacccaacgggcagaaggagggaccgatgtgcgctgttgtgatcttagacccctgg

SEQ ID NO: 31327 - DNA, 809 bp, Glycine max
  Peptide Sequence Number=SeqID_148105
gatgtgcggaaaaaggcacaggccatccagaagcaaaacactacccccacgtgttgtctcgtgggggttatgaatatttagaaaagaagcttatggatgagaagaaaaagaaaaaattggaggaaactgctcaatccgaaagcaatgacaccatgattgatccttcttctcccatcaaacgacacgtcaaatggaagatggcccgcacaaagaaaactggccagatgatgtctaaggcagcaaagcaaattgctgagaagattgactcattggaggagcaagcgtcacatggttcatttgtcgcccatggacgtcaggatgtactaactgctgccatggggcaaccagaacaccccggtcgtgtgtgtgctactggagccaatgtgacgatcaaacaatactttggaacggctccaaggacctctcgcacgtcttcctccatggctcccgaagacctggagcagctgactcaacaaatcagggaccagctagaggagtcgatcacagaaaaatcacagatgcaatcacagggacttgcactacttcctgagcctgaggttggtccttcagctgctcgtgtcagcacaaaagagagttgtgttgatcccttagggaacgatctatacacgggtgacttagacaaatgtgggttgtacatcgaagaaaattctccccgcctggttgccctaggaagagtttatgagggatccacaaccgttcacaacatccctttgttgcatgatcaagtgaaggtcggtgttgaggaggttaaagatgcagatgctctcattcctgtacccactgaagag

SEQ ID NO: 31328 - DNA, 234 bp, Glycine max
  Peptide Sequence Number=SeqID_148106
atgctccacagcctaaatcaaaggctcctgctaggtggattgtcgtcaagacaaaaaggaagtactaagtgcggctactatgtcatgcactggatgtctaccatcattttaggaacttttaggaataactgggaagcgtattttaacgatcctagaccattggagccagagagattaaaggcgttgcggattcagtggacacaatattatctccgagttagagatcagacctag

SEQ ID NO: 31329 - DNA, 279 bp, Glycine max
  Peptide Sequence Number=SeqID_148107
atgagaaggttagggttcagtgaagagggtaggggctcaaatgcgaaagctgcagcgagaagaaaccggggtaaattttattacacaaaacattctaaggcggttttcaataaccgccttagaatgttgaagtgcgcaaggtgcatgggcatcgatatagggtcagaaggttctcgaccacttggagtgtatggtgtcaaggccatgtattggatttttggagtcttaggcaaattttctaaaaagacttacgacactaatgtcttttataaatggtaa

SEQ ID NO: 31330 - DNA, 351 bp, Glycine max
  Peptide Sequence Number=SeqID_148108
atgactggccccctcaatgagtcaatctcatgctttctcataagggtggacccttggatactagaacctattgcctttataggactacacgtcctcgccttcagagggctacatgccctcaccttcagaggactacacgtcctcaccaacagagggttgcacgcccttaccttcagaggactacacgtcctcgccttcagagggctacatgccctcaccttcagaggactacacgtcctcacctttagagggttgcacgtcctcgccttcagagggctgcacaccctctcctttagtgggctgtatgccctcgcttttagagggctggacaccctcgccttcaaagggtga

SEQ ID NO: 31331 - DNA, 315 bp, Glycine max
  Peptide Sequence Number=SeqID_148109
atgaagattgttactcatcaaaacatacgtcagcatgaggttcttcatagtcatccacctattcatctgctcccccgaacacaagttcaagatcatcacaggatccaaacacaacaacacacagggactcacgtaacttcaccacttcgtcattcaaaattcacttttcaatcatcaatcacattacacaagaatctcacacttcaatcacgttactatggaaatgtcttcagaattacacctcccttgtgtttcaccaaagaagatgcagactttgtagcagacgcaatggacttgaccttgtctagaatgtga

SEQ ID NO: 31332 - DNA, 503 bp, Glycine max
  Peptide Sequence Number=SeqID_148110
ttattaaaaatggtggaatcaccactaaggctaactacccctacaagggagttaatgggacttgtaacacaaccatagcagcttccacagtggctcaaattaaggggtatgagacagttccttcctatagtgaggaggcactccagaaagctgtggctaaccaacctgtgtcagtttccattgatgcaaataatggtcatttcatgttttatgctggtgggatttacacgggagaatgtggaactgacctagaccatggcgttactgcagttggttatggcacaactaatgaaactgactattggatagtgaagaattcatggggcacaggttgggatgagaaaggattcataaggatgcagcgaggtataactgtcaagcatgatacgaaaaatgaggatacattaagcaacaatggcaacaggaaggaagagaaagaggaaattctgaagcaggcccagcccaacagtggcgctaagcgagcaactaactgcaggcgctaa

SEQ ID NO: 31333 - DNA, 177 bp, Glycine max
  Peptide Sequence Number=SeqID_148111
atgaaaggatttaggaatcaaatgctgaatgctattaaaggcttttcaagatcacctcaaaatggattgttcataaattcatgttttgctcactaccaatctgagaggcaggatacatggtttgctgacaattctcctgtcattgggaacaaggtgggtgccttatcatgtctctga

SEQ ID NO: 31334 - DNA, 158 bp, Glycine max
  Peptide Sequence Number=SeqID_148112
atgtcagtgaaaaacctcattggacgcctaagagtacatgacaagacaaaccacacactagtaagtcaggtcactctcactaggcttaaaggagcattcaaaccaggtgtatttaccctcaaggcctatacttcgaagagtccgtcagggcctctcct

SEQ ID NO: 31335 - DNA, 1815 bp, Glycine max
  Peptide Sequence Number=SeqID_148113
atgaggggtgggaggaggggtaagataaagcttcagtttagcaagatctactcatttgcttgtggtaaaacaatcttcaagagggaacattcaaagattgggggacatggtcattccagggtggttttctgcaatgaaccagatagatttgagggagggattttcaattatgctgataattctgttaggtccacaaagtatactgttgccactttcttgcccaagtcactgtttgagcagtttaggagggtggctaatttctacttcttggtggctggcatcttggccttcacaaagcttactccttatactgccgtcagtgctatcctacctctgtctatcatcatcggggcaactatggtgaaagagggtattgaagattggcgcaggaaaaagcaggacatcgaggtgaacaatagaagagttaaattgcatgaaggtgatggcattttcaaatatactgaatggaagaatctgagagtagggaatatagtaaagataatgaaggatgaattcttccctgctgacctcctactgatttcctccagttatgaggatgcagtttgctatgttgagaccatgaacttggatggtgagacaaacttgaagataaaacaagggctggatgtaacttcttccttacaggaggacttcaaattccatgattatagagccgtcatcaaatgtgaagacccaaatgcaaatttgtattcatttgttgggagcatggagtttggagagcaaaaatatcctctttctgcccaacaacttcttctgagagactctaagcttcgtaatacagactatgtgtttggagcagtcatctttactggtcatgacacaaaggttatccaaaactccactgatcccccttcaaaaagaagcaaaattgagaagaagatggataagattatatacttcttgttttgtgttttatttctaattgcatttgttggatctattctctttggcattgcaaccaaaggtgaccttgacaatgggttaatgaaaagatggtatctaagaccagatagttccacaattttttttgatccaaaaagagcagctgcagctgctatatttcattttttaacagccttgatgttgtacaacttcttcattcctatctccttgtatttctcaatagagatggtcaaagtccttcagagcatcttcatcaatcaagatatccacatgtactatgaagaagctgacaaaccagcccttgcccgtacttcaaacttgaatgaggaacttggccaagttgatacaatactttccgataaaactggaactctgacctgcaactcaatggagttcatcaaatgttctgttgctggggtagcttatggccgtggtgtgacagaggtcgagcaagccatgggtagaagtaatggttcacctatttttcatgagcatattaatggattagaatcaaaatcaaatgaaatcagggactctcttgatagaaaagaacctagcaaaggttttaactttacagatgaaaggataatgaatggaaactgggttaatgagccttatgcagatgttatacagaaatttttccgcttattggcaatttgtcatactgccataccagaagtggatgaagaaacaggaaatgtctcatatgaggctgaatctccagatgaagcagcatttgtaattgctgcaagagaagttggttttaaattctacaaaaggactcagacttgtttgtcaatatatgagttggatccagtttctggcaatgaagttgaaagaactaagcatgtggatcctgaagtccttcctcatatgggacctagagtctaa

SEQ ID NO: 31336 - DNA, 348 bp, Glycine max
  Peptide Sequence Number=SeqID_148114
atggatgcaggacctttgagtttttccccaatcatcgagacacgatcacgttacccttttcagcaacaatttcaaaaaaagagttccaaaggaaattgtgaacaccatcagttggataggttcataccaccaaatcggtcagcaatggattttgattatgctcactacttatgtttactgagaggaacaaagcttgcagaattatttaacatgaaccggctccgaattcttgctttcaagaacaaaccatctaagccagttgacttattgcatcctcagatctccactcttatccgccaaaataaaccagccaagccacgaagagttattcctcaggtgcactactaa

SEQ ID NO: 31337 - DNA, 1101 bp, Glycine max
  Peptide Sequence Number=SeqID_148115
atgtcagtgatagtgaaagatgaagaagggaaaatttttctactctgtaaaggtgctgacagtgtcatgtttgaaaggcttgcaaacaatgggaggaagtttgaagggaaaactgtggaacatgtgcgtgaatatgctgacacaggtctaaggaccctagtacttgcctattgcgaacttgatgaacaagaatacaaggagttcgatgataaattttctgaagtaaaaaattctgtcgtcgcagatcaggaaactctgattgaagaagtatcggataagattgagaggaatctaatccttctgggtgccactgctgtagaggacaagctccaaaatggggttcctgattgtatcgacaagcttgcccaagctaagattaagatttgggttttgactggggataaaatggagactgccatcaatattggtttctcttgtcgcttgcttagacaaggaatgaaacagattataattcatttggagattccagatattcaagcattagaaaaggttggagacaagatggctattgccaaggcacatccttccagtgcttccatagacagttgccacctgccctttgtcacttgctttgtgttaagtgctgctcatggtgaatcagccacccatgcatcaagggaaagtgtgcatcatcagatatctgaagctgctcaactgctttcagcatccagagggacctgccagacatctgctctgataattgatggaaaatcacttacttatgctctagaggataatatgaagaacatgtttctagagcttgcaagtcattgtgcgtctgttatctgctgtcgctcatcgccaaagcagaaggctctggttactagactggtcaaatatggaactggtaaaacaacattagctattggtgatggagctaatgatgttggaatgcttcaagaagcagatgtagggattggaatcagtggtgtcgaaggaatgcaggccgttatgtctagtgatattgcaattgcacagttccggtatttggaaagattacttcttgtacatggacattggtgttaccggaggatgtcatcaatggtattgccactcaaactagaacccaacattctataa

SEQ ID NO: 31338 - DNA, 336 bp, Glycine max
  Peptide Sequence Number=SeqID_148116
atgggattcaaacacttacatgcctttaatcttgtcatgctaaggaatatccacgcttcacatgtagtgataaagcaaggtgttcttcggagaattggcaatggtgaatctattcatgtttggactctaccttggctcaacaatgatctcaatccatttgtctcaaccaactcaaacaatgataattttgattttacagtttctgacttaatcgaacatgacaattttgcttggaggaatgatatcttggcaatttgtgaaattctaggaacgacaagtcatggtcacccgcgactctcgtcaaccgagaggagcgaaattagtgtcatacactga

SEQ ID NO: 31339 - DNA, 291 bp, Glycine max
  Peptide Sequence Number=SeqID_148117
atgactaggtgtatgactttaaagaatctcgtgctagagaacattttagtttgtacggacttggttcgcggtgcaaaggacaagcggctcaaggttaagagacctgtcaggatgcccactaaggtttttcacatcactactaggaagtccctttgtggtgaagttttgaacatgcatgccctttgtataaggagtagttttgcaatatatctcttagtttgcaaggtctggaatgcactaagtggaaaatttggaaggagacttttgaaggaaaaaggaagattaagttag

SEQ ID NO: 31340 - DNA, 108 bp, Glycine max
  Peptide Sequence Number=SeqID_148118
atgacattgggaatcggtgaagtggatcttgaggaacttggcattgagcaaggtgaagttcagttgcataataatagtcagagtattatcgatttggcaaagaatcag

SEQ ID NO: 31341 - DNA, 1230 bp, Glycine max
  Peptide Sequence Number=SeqID_148119
atgaagagaagaagtgatgacgatgagagattgatgctagcaaggatggtgagcaactccttcttccttcttccagaatatgcacaacaagggtttagtgtagtggaagaaggagctatggaaatagctaaacccgaggctgtgctagaggatgaagtgctcatgagaagtcaatttccagaattaaagcttaagggcaagcattttcttttaggaggaggtattgataaggatcagggggagtatgaagctttaatgagaaatcatacttcaaacctagttcctctacctccagacagaaaaccaattggttgtaaatgggtatttcaagaaaaggaaagtgcagatggctccattaacgattacaaagctaggcttgtggcaaagggtttcaatcaagtggctagttttgacttttctgagactttctcccctgtgtggccacttgctcaatttgatgtcaacaatgcttttctgaatggtttcctcaatgaaactgtgtatatgtctcaaccaccaggttttcagaaatctaattctaccttgcaccttacatttcagcttaattctaagttttccctcaaacagcttggttcactggaatattttcttggaatagaggtgaaaactttatttgacaaatctcttactcagagcaaatatatcaaagatctgttgaagaaaactaatatggctgaggctcaatccatatcatttcctatggcttccagttgtaaattcacgaaaattgactcagatatattttctgaccctactctgtacatgtcagtggttggtgctcttcaatgtctaaccatcaccagacctgaaatcagctattatgttaacaaggtttgtcaatttatggccactcccttagaatctcattgggttgcagtcatgagaatcttaaggtatttgaaagggactattttacatggtcttcatctcaggcctgctaccttgggacagtcctatcctattagagctatatgtgatacagattgggcatctgatgttgatgatagaagcctagctcaaattactgcagaaatctcttggattcagacattgttgactgaactacaagtccccttcgacactcctgttgtcttctgcgataaacaaaatggtgttgctattgcctacaacgaagcctttctcttcaaacatgttcctactcttgatcaaaagggcagatgctcttaccaagcccttttctccaactag

SEQ ID NO: 31342 - DNA, 930 bp, Glycine max
  Peptide Sequence Number=SeqID_148120
atgctagagcttttgattggaaacaattttgaacgtttaaatttaaacttgattaggcaatggttttactttttacctgacgctgtactgctagaaaattattcaaaaaccgaagaggctaaagtagaggagctcatcaaggcagtagcagattctggtgccaaagtgattgtcagtggaggagcagtaggagagatggcgttgcatttctgtgagcgttacaagcttatggttctgaaaatcagctcaaagtttgaactacgtcgattttgccggacaactggttctgttgccatgctaaaacttggccaaccaaacccagatgatcttggatatgtagattctgtttcagttcaggaaattggtggtgtcagggtgaccattgtgaaaaatgaagagggtggaaattctgtggctactgttgttttacgaggaagtactgatagtatactagatgatcttgaaagagcagtggatgatggagtgaacacttacaaggccatgtgcagggatagccgctttgtacctggagctgcagcaactgaaattgagttagctaaaagggtgaaagacttctccttcaaggagacagggttggatcagtatgctatagcaaaatttgctgaaagttttgaaatgattcctagaactttggctgagaatgctgggttgaatgcaatggagatcatatcttctctgtatgcagaacatgcatctggaaatgccaaagttggcattgatttggaagaaggcgtatgtaaggatgtctcaaccttgagcatttgggatctccatgtgactaagttatttgctcttaaatatgctgcagatgctgcatgcactgtactacgtgtggaccagattattatggcaaaaccagctggtggtccaaggagagagcaacctgctggtggcatggatgaagactaa

SEQ ID NO: 31343 - DNA, 165 bp, Glycine max
  misc_feature (47)..(47): n is a, c, g, or t
  Peptide Sequence Number=SeqID_148121
atggtggcaacaacaacaatagtggtgaccgtcatcaaaattgtggncaccgaccactacatcaccccattatcgttgttggcacacaagagcaatggtggttgcaccaacaacgacagcggtagtgacatggtggtggtgacaatgtcgatcataatgatgttg

SEQ ID NO: 31344 - DNA, 204 bp, Glycine max
  Peptide Sequence Number=SeqID_148122
gtgtactcccaacaatcatccataaataaaaatgttgaagaaggtgggtggttggtcaagaagtgtagtgaagaggattctaaggaggaccttgaggaagatatgcatggcatatcttcacaggaatctgattgcttggatccttttgactgctggcttctaacattacctttatgcaacttccttcctaggattgggttttag

SEQ ID NO: 31345 - DNA, 159 bp, Glycine max
  Peptide Sequence Number=SeqID_148123
atggatcttgcactcaagattgattcttgccaagatccaacactagagatgggcagtagaggaccagatggtgtgggcggtcgtgtgggaggaagaggcaggggaaggtttgtatgggaggaagataaaggcaagaaagggtttgagtgggagatttag

SEQ ID NO: 31346 - DNA, 189 bp, Glycine max
  Peptide Sequence Number=SeqID_148124
atggcaaagattccccgactaaaagatgaaatgctaaggccagagtacaaatatgttggtcaaggtcaagttaaagataccctagccaaggctaagttgaagatgctttggctaaggcataggcaaatttactctagtcgaggccaagttaaagttattctagacaaggccatggccccgactaagtga

SEQ ID NO: 31347 - DNA, 99 bp, Glycine max
  Peptide Sequence Number=SeqID_148125
atggtggctggaggtgacatggcttatattggagagaaaggagttaacttatcaagtggacagagagctcatcttgctttggcaagccaatcccattga

SEQ ID NO: 31348 - DNA, 318 bp, Glycine max
  Peptide Sequence Number=SeqID_148126
atggttttttccctccctccccctcctatacagcctagtatccaacgatcatggcgtgttgctgaggctcttgaatatggactagtgggtgttaatgaaggagtaatttcaactgaggtggctccatttggtggttttaaacagtctggccttggaagagaaggctccaaatatgggatggatgaatatttagagcatgctatacttacaatctatacaacatgcaggggtcctaggagaatgcattgtgtcatggattccattcctgccactgcaattgaaattggaggtgtagcacctatacagactgttggttag

SEQ ID NO: 31349 - DNA, 246 bp, Glycine max
  Peptide Sequence Number=SeqID_148127
aatgaccaaactttggtctctgcgtgccaacggacacgactgtgtctgaatggcaaaggggtgcggataaccaatgaccaaacttggtctctgcttgtcaacggacacgactgctctgaatggcaaaggggtgcggataaccgtaagggtcagtatgacaaagattatggggcggccgacaaaagcaaagctcttgctcctacgtatcctccaatgaggaactcagacctacgtagttctggataa

SEQ ID NO: 31350 - DNA, 735 bp, Glycine max
  Peptide Sequence Number=SeqID_148128
atggcagagtttggtattcgaatcatgttattgctggcagcttgcttgcttccactatctggggaagctatggttcgctactacaagttcaatgtaggccaaagaggcacactttggtggcatgcacatatcctctggcttagggccactgtccatggtgccttggtcatcttgcccaagcttggagttccgtacccttttcccaaaccaaatagggaacaagttatcatattgagtgaatggtggaaatcagatactgaggctgtaataaatgaagctttgaaatccggtttggctccaaatgtctctgatgctcacacaatcaatggccatccaggacctatccaaggctgtgtgcttcacaaggcaaagtccaagaaccaaaatctaacttttgacgtaattagaccaagccaatgtgactcaaattctaacaagttctccacagtagctaaagccaaagaaaaaatggaaaaaaaaaaatcaggagggtttaagttggatgttcaaccaggaaacacctacttgctaagaatcatcaatgctgcactcaatgaagagctcttttttaaaattgctggccatgaactcacagttgttgaggttgatgcagtctacaccaagcctttcaaaactgataccattctcatagcacctggccaaaccacaaatgtgcttctaacaaccaaacatgaaactggcaaatacttggttgcagcctctcctttcatgtaa

SEQ ID NO: 31351 - DNA, 606 bp, Glycine max
  Peptide Sequence Number=SeqID_148129
atggagaatatgttgatgcaattcatggaaacatcccaagctagcttcaaagccaatcaaaactcaattcaaaatctagagattcaggttggcgagagttactccatggaaaattgttgttgggagcaagagttacaaccttacaatcaatatgaagaagaaagaatttctaatcttgagaacgtgttgatgcaattcatggaaacatctgaagctaatcaacatgcatttcaaaatctggaaattcaagttggtaagctagcaaaagaagtggctgaattaccttttttggtcacaaaggaagaaaactttgtagaggttgaagttcatgaggaaagtcttgtagaagagcatgattcaagagaaaaatatgatgaaaaaaaaagtattctcgaagtcaatactcttcctcatcaactgattggcaaggaagaaagacatggagaacgtgataaatctttaagtgtcattctctccttgatcaccaacacttctcttgcaatgatgtggaaggcgtttctaggatacatgagtttcatggagtctctagctaagaggcgaaaatgcaaggaagatgtgttctatgtgatcttcatgccaccttga

SEQ ID NO: 31352 - DNA, 2199 bp, Glycine max
  Peptide Sequence Number=SeqID_148130
atgagttgccatggacacggtttccgacatggccaactcctcctcaatttactcgaagcgtgttgcacccttcggtccctcgatgctacgaaatgtctccatgcactctccatcacaatgggtcacattccaaagcaatctattttcatccacaacaacatcatatcctcttacattgcccttggcgaagtgcttaatgcacgcaagttgttcgacgctttgccccacagaacagttgtctcttacaacactcttatcaccgcttattgtcgacgcgggaatgtagatgatgcttggaacttgctctgccacatgagggggagtggttttgctcctacccagtataccctcactgggttgttgtcgtgtgagttgttgaatcattctcggggtgttcagttgcaggcattgagcattagaaatggactcctcgatgccgatgctttcgtgggtactgctttgttgggcttgtttgggaggcttggatgttgggatgaactgtttttggcgtttgaagatatgccccagaagagcttggtgacatggaactccatggtgtccttgctggcacgtaatgggtttgttgaagagtgtaagattttgtttcgtgatcttgtggggacagggatttctttgtccgaaggttctgttgttgctgttttgtctggacttgttgattctgaggaggatttggaatatggtgaacagatccatggcttaatggttaaatgtggatttggttgtgaaatcactgcagctaattctctcatcagtgtgtatgtcaggtgcaaagccatgtttgcggtggaaagattgtttgaacaggttcctgttgagaatgttgtgtcctggaatacagtcattgatgctttggtaaaaagtgagagacctatgatggcactggatctgtttctgaatatggcaaggagaggattgatgccaagtcaggccacgtttgttgctgttattcactcgtgtactagtttgagaaactcagtatgtggagaatctgtccatgctaagataatcaggagtggttttgaatctgatgttattgtgggtactgcattggtagacttctactccaaatgtgataaatttatttcagctcataaatgttttgatcagatagaagagaagaatgtggtttcttggaatgctttgataacgggttactcaaacatttgttcttccacatcaattctgttgttacaaaaaatgcttcaattgggttattcccctaatgagttttccttttctgctgttctcaagtcatcttcaatgtcaaaccttcatcagctccatggtttgattattagatcaggttatgagagtaatgaatacgtattaagctctcttgttatggcttacaccagaaatggtctcataaatgaagcactttcatttgtcgaagaattcaataacccacttcctgtagtcccatctaacatcattgctggaatctataacagaactagcctgtaccatgaaacaataaagctgctttctttgctagaaaaaccagatgctgtatcctggaacattgtcatttcagcttgcgctcggagcaatagttatgacgaggtttttgcgcttttcaagcacatgcattctgcatgcatccatccagatagttacacatttatgagtataatatctgtgtgcaccaaactttgccttctcaatttgggcagttctcttcatgggctgattataaagactaatcttagtaactatgacacatttttgggcaatgtactaattgacatgtatgggaagtgtggaagcattgatagttcagtgaaggtttttgaagaaattatgtacaaaaatattattacatggacagctttaattactgcccttgggctgaatggttttgctcatgaggcggtgatgagattccaaaacctggaattgatggggttgaaacctgatgcattagcactcagagcagtgctttcttcttgcagatacggtggattagtaaacgaaggcatggaaattttcaggcagatgggaaccaggtatggggttccaccagaacatgatcattaccattgcgtagtagacctcctggctaaaaatggacaaatcaaggaagctgagaaaatcattgcatgcatgccattcccaccaaatgccaacatatggcgtagcttccttgaaggttacagtaggcaagaaattgcaaattga

SEQ ID NO: 31353 - DNA, 375 bp, Glycine max
  Peptide Sequence Number=SeqID_148131
atggctaagcgtaagaatcctatcaagctgacgatggtgggaaggattgaatgggacattcacttgccacctacaacttccatatctgcctttgcattcagtggtattgggagtggttcttcaaaatgcaaggtgaatggtgctcctaccaaggaggatggtgtttccagcatcatatgtttgttatgccggcttgtgattgtcaccttcggccttggtttgtccgagccagaaggtgaaccaatctggattggtcaatccggaagtcaaaaaaggatgcaggaagcaatttttgggtgcagaaagcaacagccagaggtgcatggtgtagcaagcttcaattgggcaagagcgtgtcatcttattgggccttaa

SEQ ID NO: 31354 - DNA, 219 bp, Glycine max
  Peptide Sequence Number=SeqID_148132
atggcttgcgtggtggagctctcacattatgctgaggatctggtcctcctggtgcaagtctatctgcaggtgctagtgggagatcatcaccaaatggaatacgcacacgctttgataggtgaatacccgatttgtggagaaagttttggatgtcaacaacttttttgtgagcgaataatggattgtggccatggagactacgagcttgcaaagtcatga

SEQ ID NO: 31355 - DNA, 198 bp, Glycine max
  Peptide Sequence Number=SeqID_148133
atggagcatccgataaaccttgatctagatgttgttgttttatctagaatgaaacaatttagggcaatgaacaagctaaaaaaagttgctttgaaggttattgctgaaaacctttctgaagaagaaatcattggtttgaaggaaatgtttaaatccatggacacagataacagtggaacaatcactttgaagagttga

SEQ ID NO: 31356 - DNA, 270 bp, Glycine max
  Peptide Sequence Number=SeqID_148134
atggggcaaaatgagtggtgctggcgtaaagcaacccaaagggttccgccaattgcactggcgagatacccccatgccatccatccatcatcgctagcccattcatgcatgcttggttctgccagtcaaattggcgagatcactttaagttggtttcgccagtcgaggttgcaggatacacttggtccattggttccgccaatcgaggttgcgggatggccttggtccattggttctgccagtgatactggcgagatacaacccgtgtag

SEQ ID NO: 31357 - DNA, 435 bp, Glycine max
  Peptide Sequence Number=SeqID_148135
atggtggttcctagggtatctcatgtcaatatcataagtgcatttgccatgcataacataaatatgcctgagtctttcatttttatgagatgtggtcgaagtattggcgatcaaaattgctattccttggattatggggttgaaccaagcacatgttttttaaggaaaggttcatcaagtcaaggtcaagtgtggaagaaagaatgcgttttacagcacccttaccgaacgcgtgctagagctagagtaatgggtgaaatagatgaggtgcaagaacagatgaagactgacatggaggccctgaaagagcaaatagccacaatgatggaggtcatgatgagcatgaagaagatgatggaggtcaatgtggctgcagttgccgctcccagtgccgttgctgaaatggacccgattgccccatctggccttaactaa

SEQ ID NO: 31358 - DNA, 204 bp, Glycine max
  Peptide Sequence Number=SeqID_148136
atgaggcttcactgtcatcaagcgagtcagagacccagcatgaacacagatcgacctccactccttatggctcatatagacccaggtgtagggcctaacatctcaatgtgtgtgagaggtgctgaaggtagctcacccaagcgagctgataacttcattttgaagcaacttgctcgcccaggcgagatggttacttcatcatga

SEQ ID NO: 31359 - DNA, 204 bp, Glycine max
  Peptide Sequence Number=SeqID_148137
atgtctgccctccgaatggttcctctaagcaagcttcttttccaaaggctaagacatgaagagaggtgggatgatgaaaggaaaaggatgcaaaggaactggtttcaggggaaggccctgcttacccctggatccgtcactgatcaaaattctaagcttgagaagaacgtggacaaaaagagcccggaatggtttcttccgtga

SEQ ID NO: 31360 - DNA, 497 bp, Glycine max
  Peptide Sequence Number=SeqID_148138
atggagtggcacgtactgaagacgtggtgtcatgctcttgcatacgtgtccctcatggaatggcactactggagacgtaatatcatgctcttacatacgtgtcactctggagtgacacatactggagacgtggtgttctgctcttgcattggcgtcacttgtggagtgacacgtactagagatgtggagtggcgtgtgcatgagacatggagttgtactcgacttgccacaagaagttcctctttccatagtcctttaggcttgttgagtctagttcaaattgaggatgactctgttggctgcctttgtctgtccattggtctggggatattcgatagaggtgacaaggagtggtccctatatgtccattccccacatggcaaatggccaaagggaccacagactatggagattgttaggaggggtgtgttgatgcaatcctatcccgcaagggcattggatagaagactcaaagtagattggtccaaagatccaag

SEQ ID NO: 31361 - DNA, 1002 bp, Glycine max
  Peptide Sequence Number=SeqID_148139
atgtcttcatttatgtctaatttcgccatcgacatgggtggcaatgattctgagggttcgattcagcaacccccagggaccatgaggtcattcccattgggggttcctcctcaaatgatactccccatggggagggcgcgaccttccatggcttccctgaccaaggagcttgtcccggtcatgatgattctccccccttttgcttctggggaggaaggagaagtgatagggatgttagggcatctccttgcgtgcatagtagccataacgttgggtcatcatcgtccctacctaccattactagctatgaagctggcaaatcttgaggactcatacaaggtagtcgtctacgcttacaggagtgatgctccctttcttaagggcagccacttgaacgtgacccctacccaaatccacccgaacagtagggccatgatgaagctgattagcaagattggttgggtctccttaaacagcatgtccaagaagttgtttgagtttgactcaaacgtctttcgttgcttcaaggattatttcttcaaggtcttagctactaatgtcgcggctgatggatctgttgacccttgtggaactgcgccacagtccattgtgtcctctgttgctggagaagggggtcaacctactattgaggttggccctgttgttagtgctgctgagattgcttgcagtgtccattcctctattttgactgagaggaagcaagctgcaaggttgacccccgatgcgggtcgcccttcaagtttgcaagacctgcctccagctccgtcagtcgttgaggctcctgcttcttctattgttgttgctgctactcctgcttctctacctcctcttgccactcctgctgctgaagttgatgcaccagccacttcaactgatcttgttgtgattccatcgcccaccatcactgcacccttattaagtgcgggtgtgacaactataagtgctcccgagatgccgcctcctccttcttcagttccctag

SEQ ID NO: 31362 - DNA, 873 bp, Glycine max
  Peptide Sequence Number=SeqID_148140
atgtctctttggatcatccatacacctccggtgatgctgattcattgtgggaatgctacggattctgccaaggtcttccttcaaaggagtttggcgattctagggagaatggacaatgacaccaagaggttctgcacaaggaggcgtccttggaggcagagtcaaaccgctagctgccttcgaaggttggtggtgctcttgccaagttgctacgcaccagaatggatgatgatgagctatttgagcactgtaagggcttgtagcgggagaaaattgacttggttggcaaggatggaggagtctgagctacgagcagctaaggagaaagaggccaacaatgagcttgaagaagagttgataatgtacaagaaggaggctgtagagcagcatgagaaaggctttaacaaggccattaggcaggtcggatgctttgccaaggaccttgacttgggtctttttgaccatttcaagaatgtgaaggacggtgttctgctagacaacgaaggtattgctactaaggaaaaggaagcaagaccttggcagtgtatgaagcaaggccttggtaatgtaggaatcaatgcctcaatagtcttgtgtggagtagagaagtatgaaataatctcaggtcttgttaatcattttggtggtaggtcatttagccttatggaacccaaacctttggcaatggtcgttgtggttcttaaggagtgggctgaccaagggggcttaccaaggatagaccttgggttttgcatacctgtgagactcaccaaggactcaccaaaggtggaccttgggtttgacgagcctggtgtgtgcagcgcacgcgtcgtgctcttgcatacatgtcacttatggagtggcacgtactag

SEQ ID NO: 31363 - DNA, 993 bp, Glycine max
  Peptide Sequence Number=SeqID_148141
atgaatgatcttcaatcatcatggagtagtggaacttctaatgcagacttcacagtggcacaagatggttcaggcacccacaaaacaatcattgaagcaatagatgcactagctgcaatggatagtagtcgtccttcaagaccagttatatacgtaaaatcaggggtctacaatgagaaagtggatattggaatcaatttgaagaatgtgatgtctgtaggagatggcatagatcaaactattgtcactggcaacaaaaatgtcattcagggttattcaactattagctcagccacatttgatgtatcaggggatgggttttgggcgagagatatgacatttgagaacacagcagggccaagtgggcaccaagcagtggcattaagagtcagttcagatctatcagtcttctataaatgtagcttcaaaggttaccaagacactcttcttgtgcattcaaatagacaattttatcgtgattgccacatatatggcaccattgattttatatttggtgatgcttcagtggtgttccaaaattgtgacatctttttaagaagaccaatggaccaccaaaccaacttcatcacagcacaaggaagagatgatcctaacaaacccactgggatttcaatccaaagttgtcaggttaagcctgcttatgattttgactcttataaggactcaatcaggagctacttaggcaggccttggaaacaatactcaaggactctatttctaaagacagatttagatggattgattgacccaaaaggatggggtgaatggaatggagactttgcactttcaactttgtactatggagagtacatgaacaccgggagtggtgcctctacccaaaacagggtgacatggcctggtttccgtgtgctgaataatgatgatgaggccacacccttcagtgtgagtcaattcttgcaaggagaacaatggattccagctacaggtgtgccattctggtctggaatttaa

SEQ ID NO: 31364 - DNA, 207 bp, Glycine max
  Peptide Sequence Number=SeqID_148142
cccacttataaacacccagcagagatgcaaaaatgcgtacctcgtacctcgtttgccattgacgtcgaacaaaccaccgcaacaatgaacaccgacaccttcaccttcaccgaaagctcacctagcgcaagaaaatatctcacggaagagagaaatgcaagaaaaaaaagctctgcagcgaaaatcactgtgcacccaactttttaa

SEQ ID NO: 31365 - DNA, 231 bp, Glycine max
  Peptide Sequence Number=SeqID_148143
atgaagaggtactatagactcaaagctcattgctcagactccatatttgcttttgctcaccacatgcagcctatcattgagaaaatggattatgctgatgaagttgcagctaatcctaatgcaatggttgtttccatctatgattcttcaccttcaagggcatatgtcaagttgatcaaggctgagcttccaaggacacaggaagcccttacaaaagctcttgaagattga

SEQ ID NO: 31366 - DNA, 345 bp, Glycine max
  Peptide Sequence Number=SeqID_148144
atggacccaaaatctaccctaaggctcatgagaatcaacgtgaaggggagcagggaaagaatcatccctagcccaatcttcttggagtctcttagtcatggctctggtgatgggtcccctccttgggaggattgcatcagaatgattggtggagcctctacattgatggcacatagaaccaatgtgaaggggagcagggaaagaatcatcctcgaaggccttaacaatgtcaccctagagcaagccctcaagctcaactttgaaacctcaaacaatcaagttgagtacgaggcactcattgcaagtcttatactagcaagagaagtctgggccaggaagttatga

SEQ ID NO: 31367 - DNA, 363 bp, Glycine max
  Peptide Sequence Number=SeqID_148145
atggaggagacacatgaagcacctcgagaccacaatctagtcgacttcaagcctcacctcggatgtgccattgacgggcaagcatttggtggaatacccctaccaaacactttggggggacctcaactgcctcctaccgtagtggaaaaggagaaatttgatcacatagaggaaaggctaagggctattgaaggaggcagagattatgcctttactgacatggaagaactatgcctagtgcccgacgtcgttatccctctgaagttcaaggtgccagatttcgataaatacaaggggactgcttgctccaagaatcatctgaaaaatgtacagcaggaaaatgggggcatacttaaaaaatga

SEQ ID NO: 31368 - DNA, 339 bp, Glycine max
  Peptide Sequence Number=SeqID_148146
atggcggcatgcccagatgaagtatggggcagaattatagattcgtggaaagcctccaaacttgagaaaggaggaagtgacggttgtgcacttcaagttagtatgtctaaccaagagaaacaatctccctcaagtccacttcctttcactaaggaacaattagaccaactatataaacttcttaagtctcaaacctgtcgcaacctacccttcggcgggagggcgacgcgagggctcatgggtgcgtcttgcaagaaaggaaaatgcgtggagtcgccaccgatgtttattcgaggaaaatgtcggaaaaaccagaaaggtgtggtctacgaactttaa

SEQ ID NO: 31369 - DNA, 390 bp, Glycine max
  Peptide Sequence Number=SeqID_148147
atgatgattagaaacaagaggattctagaggacctcgaggagagggaagactttttcccaaaagctgcagatgacatccttactaaaaaggaccaagcacctaagcacattgaggtttctaccgatgggaatccagtgctaaataaggagggtgagaaaaaggtattgacacctcctcagatgttggggttggctgatgaggaggaagtgtttagagtgtttgatctggtaattaatgtctcctcctcccttacatgtaattttgtgcaagccaccaacaagatgaagactgttgtggctaaacctcacccaagtgtggggaaggaagacctttcaaggaagaaagtcattccaaaagaccctgtatggagtaagaaaagagggagataa

SEQ ID NO: 31370 - DNA, 555 bp, Glycine max
  Peptide Sequence Number=SeqID_148148
atgaagaattgtcgatgcaatctatgtgaaacactgtgcgctttaagaatcttgccgagacactattcaaacactatgcccattaggaatcctgtcggatcacagtgcaaacactgtgcgtgtcagaaatcttgtagaatcactatacaatcattatgcacgccaggaatcctgtcagatcactgcacaaacactgtgcatcaggaattttgtcggatcactgtgcaaacattgtgcacattaggaatcctatcggatcactatgcaaatactgtgcgcgtcaggaattctgccagatcattgtgcaaacattgtgcgcataaggaatcttgccagatcactgtgcatgtcaagaatcctgccggatcattgtgtaagcactatgcaaaatattgtgcaaatactgtgcgcgttaggaatcatgtcgagacactaagcaaacattgttcatggtactgtgcattaaagattcctgtgcaaacatggttgttaccatcattgacgatgaggatattgacaacaagttcaatgtctataaccaaaatcaatgcataa

SEQ ID NO: 31371 - DNA, 222 bp, Glycine max
  Peptide Sequence Number=SeqID_148149
atgcaactgccaagtgaagcgtcaatgaatgtagaaactggtcaatgctcaaggccaacaaacatagtgcaaacagaatctaatcctgtatatggaccaattctctcgaacatggattacattccacctagtcctctgaacatggactatgctccaccaattgtccaagttgatgaattcatgagcaatgaaacattatggcacgctagcatcagctcgtga

SEQ ID NO: 31372 - DNA, 351 bp, Glycine max
  Peptide Sequence Number=SeqID_148150
atgggaaatgaagccaacaacattaatatggaaacaagattgtcatcgatcttcaaagatacaaaacatgtcactgcacttgttgagcgatggagaccagaaagccacattttccattttcttgttggtgaatgcacaattacactcgaggatgtaacattacaacatggaataagggttggtgggagatgtttagggccactgaccatgaggcaaaaaccatgggcggcaagagttaatcgcaacccaatgtattcattggttacgagtggtggattaagctttctcgggacaccaaatggagatgttgtcgcttatagaataagattagacaacatgacacctgaatag

SEQ ID NO: 31373 - DNA, 741 bp, Glycine max
  Peptide Sequence Number=SeqID_148151
atggagtggaatgaaatgttgtccaatggggcatcagggacatttccaggcacctttttccctgatttcttggctctcttgatgtcgggaacatctagttcgacatcattatcagaatcagatgaggaaatttctttcctcttcttggaagggattgcaactttgctccatctggatgtggtaggagtgattggtgtgctcttcttctgtgcagtagttttgattcgtccagacctagtaatgggggtttttccctttctgctttgtaatctttctgcaatgccaggtgccaactttttggcaatgggttcctcatcagattctacttcttctaggtcaatgaagtcacctggagcagataggacttcagcatttggggtggaagatgttgggacatctttatcagcatcagggacagaagcatttttcaaaatgctattcacaaaactgcggatcttcttatccatctcagtgtcttcttccctagggcttgttgcaaagctagggttttcagaaatcttcactccctgttgtcttttagggaccagtttctcaggaacagggcctggaccaggaatcatttgtatggattggatattgagtgcaggttgttcctggtttgatggagttttggaggatgatggagatgatggtacagagggtgaaacaggggatgaggtttcttttggtgaggtagccatggagaagcagagctttgggagtggtttcgtgaatatctga

SEQ ID NO: 31374 - DNA, 762 bp, Glycine max
  Peptide Sequence Number=SeqID_148152
atggatgtcgataaacctggcaaggatagttatgagttgcgcaaagctggcgcttcacaaactattgtcgccagtaagcagcgttgggcgctgatgacagaaaccccagatgaacccgaattagatcttcaatggctggtaagcagaatggatccggacaaattggatttcgttttggtggagggttttaagcatgaacctgtgccgaagatcctgcttttccggcaaaatagcgggcatcttgtagaagagctagtgattgatgaacatacgatcgccgtagccagcgatgtgcccatcgtgacgtcacttccgctgttggatttaaataatattccacagatcgcgacgtgggatttccccggaggcggtgctgcgcaccttttccgggctacggggtctgtagccccggtaagcgcagcgccaccggggaagatggcggtgcgtctgaccgcaaaacacaaaaacaaaaggcccggtcttccggctgagccttttgtttacgttgctatgacagcggctttccccggaggcggtgctgcgcaccttttccgggctacggggtctgtagccccggtaagcgcagcgccaccggggagccggcggagcgcctggccgcaaaacacaaaaacaaaaggcccagtcttccgactgagcctttcgttttatttgatgcctggcagttccctactctcacatggggagaccccacactaccatcggcgctacggcgtttcacttctgagttcggcatggggtcag

SEQ ID NO: 31375 - DNA, 993 bp, Glycine max
  Peptide Sequence Number=SeqID_148153
atggctgaaggatttggaaggattggccgtttggtggccagggtggcaatgcagaacgatgacgtggagcttgttgctgttaatgatcctttcatcacaactgattacatgacttacatgttcaagtatgatactgttcatgggcaattcaaaaactgtgagattaaggttaaggacagtaaaacccttctctttggtagtagctcagttactgtttttggaatcaggaatccagaggaaattccatggggtgaggctggagctgattacgttgttgaatccactggagttttcactgatcaagacaaggcagctgcccacttgaagggtggtgcaaagaaggttattatttctgccccaagcaaggatgccccaatgtttgttgttggtgtcaatgagaaggaatataagtctgatatcactgtcgtttctaatgctagctgcacaactaactgtcttgctccacttgcaaaggttatacatgacaaatttggtattcttgaaggcctcatgagcactgttcactctatgactgccactcaaaagactgttgatggaccatcaatgaaagactggagaggtggaagagctgcttcttgtaacatcattcctagtagcactggagctgctaaggctgttggtaaggtgctgccatcccttaataataagttgacaggaatgtctttcagagttccaactgtagatgtttcagtggttgatctcactgtcagacttgagaagggagccagttatgatgagattaaagctgctatcaaggaggcatcggagggaagtatgaaaggaatccttggttacacagaggatgatgttgtgtctactgattttgtgggtgacaacaggtcaagcatttttgatgcaaaggctggaatttcattgaacaacaactttgtgaaacttgtctcttggtatgacaatgagtggggctacagcacacgtgtggttgacttgattcgacacatggcctcagtctaa

SEQ ID NO: 31376 - DNA, 924 bp, Glycine max
  Peptide Sequence Number=SeqID_148154
atggattctaaccaaagatatcctcagggacgaaatcttacttatgcccaatatttgaccaaattcgtgtatgtttcacgtcgaagatgctggcaaccaagaaaacaaggatatacaattggcaggctcatatgggtacccccttcaacgggagatttgttctacctgagaatgatgttatcttctactaaagggccccaatcttacaaagacattagaatagtagaaaatgtggtttatggtacattcagagaagcatgcttagcaaaagatgagcaatgtgttatttttgataacattatgcgtgttgttacaactcaatcaggtggagtttattttctgtatggatatggtggcactgggaagacatttatctggaaaactttatcatctgctatacggtctaatggaggaattgttttaacagtagcttcaagtgggattgcattattactgctacccggaggaagaacaacacattttaagtttgtcataccagtgtctgcaacacagaattcaacatgcaatattcatcaagggggtgacctgactgaattgctaaaaattaccaaactaataatttgggatgaagcttcaatgtgtcacaagtttagttttgaagcacttgataaaagcttaaaagacatcatgcacaacgataaaccttttggaggaaaggtcattgtttttggtggtgatttccgtcaaatactaccagttgtgccaagaggtagtcactctgatatcgtgcatacaagtctaaatgcatcatacatatgggatcattgtcaaattttgaaattgacaaagaacatgcgtttgcaaaccaatgctgccgaaaccaatagtcatgacctcaaacaattttctgattggctactagacataggtgatggcaaacttggagaacctaacgatgtctag

SEQ ID NO: 31377 - DNA, 764 bp, Glycine max
  Peptide Sequence Number=SeqID_148155
atggaggacgcaggaggggggaggaagaaggaggagtgggagggaggaaggagggggagagggagggaggaagaaagggaagggggaaggggagtggcagaaggaagaagaaagggggggaggctgagtgagggagtgaaagtggtcactgtgtacacaatgaccattattgtgtacacagtaatcttcgaaaaattggacaaaggaagtgcgaacgaagatacacaccttattagttcatggctcaatatctcaactgatccaattgttggtgtaggtcaaggaaaagaagcattttggttgagagtcatggaaagttacaacaaatttcaagcggtatcattgaagaaaactagttgcacagataatgatgtcatgcttaatgcatatgtcatttggaaggaagacaaaggaaccgattttggtttggaacatgcttggcaacttttgaaagatcaatcgaaatggttagagcagtttattgaaaattgctctaaaagaacaaagatttcaacatctagggcatattcttcatcatctaatccaaaaacaccgtctccaattgttcgtccaatggggcaaaaggcaatcgaaaggaagagcaaggggaaaagagtaggaatatctaccaatcctatggatcttattagtttggaggaagcaatgagagaaagaaatgttgtcgacaccaaactagtagccttaagggagaaagaattggaaaaatattattacgacattctaatgaaggacacttctacaat

SEQ ID NO: 31378 - DNA, 261 bp, Glycine max
  Peptide Sequence Number=SeqID_148156
atgaaagagaaaaaggaattggtgttgtgggtgctccagaaggttcgtggcagaggtggccagcagcagcggtggtggaggaagatcctttgcgcttcttcgatgattctgtcatttgatgaagttttaatgaatttcaattggtgggtgaactttggaggtggtggcggtgcgtctgttgcccactactgtgatgcctcgccctgtgcctgcctgggggtgcagtacttctcgatgaaagccctgttaataggggcctaa

SEQ ID NO: 31379 - DNA, 405 bp, Glycine max
  Peptide Sequence Number=SeqID_148157
atgcataccggggcaagatttcacccagacgctgcaaggagacgagtgtggatcgtgtgcatcaacatatggatgatgttgctacttagcaaccttcttaccagcgaccaccactccgatctccccctgccgagggatcacgcccgcaagacacccagtggacccgaagaagtccaacagggccctagggttctagctctgattagaggcctttgtcggttctacgatgtgaccaccactctgatctccccctgccgaaatgtcagttggtttatgccatcaagacatagggatcacgcctacaagacactcagtgtgcccagagaagtccaacagggtcctaaggtttccaggtttgattacgagcctccgtcaattctacggagtgcccgtcgcccccaatag

SEQ ID NO: 31380 - DNA, 243 bp, Glycine max
  Peptide Sequence Number=SeqID_148158
atggagtgttatctacaacacttggttcgccagcaggcggccaaccactgggggcagggtttcgcttcttttgcatgccctactctagaaaagtttggggctgaggtcgcatggcccagagattggaccgaggcccaggcaagggaggagcccgcaggatcccccggtgcggcagaggaggcccgtatggatgaagaaatgacggacttgcttggtttcttgggaggaagcggagccacgtga

SEQ ID NO: 31381 - DNA, 534 bp, Glycine max
  Peptide Sequence Number=SeqID_148159
atggcggatgataatatgttgtctctgcgtgtcatcggatttgccggtgcagacaaccacgttggtcgctggatgtcattggacctgccgtctctggatgacaaaggagagactaaagtagtctcagtcgatagatgtcgcgtcttagacaaagggtgcagacaaccacacgaccacgttggtcgccgcatgtcatcggacttgccgtctttggatgacaaaggagatactaaagtagtctcggtcgatagacgtcacgtcttcgacaaagggtgcagacgaccatacgaccatgttggtcgctgcatgtcatcgaacttgccgtctctggatgacaaaggagagactaaagtagtctcggtcaatagacgtcgcgtcttcgaaaaaggcttaacagcaaatggatcttctttcttgggagatccttccattccttcttccaagggtaagggtggcaattcctatcctaggtcaaggtttatggacggcgagctaaggttttggctcaacaggcttgtagagggtcgggcatga

SEQ ID NO: 31382 - DNA, 135 bp, Glycine max
  Peptide Sequence Number=SeqID_148160
atgatatcaccgaaaattcgcgacgtggactcactggcttctgtggagcgtgcttataacgcaccaatggggagtgacgtggcatgctgcgtgtgtttcacgcgatggtgggaggggcttatgtgggctttgtga

SEQ ID NO: 31383 - DNA, 905 bp, Glycine max
  Peptide Sequence Number=SeqID_148161
atgtgaaaggagcggcgcaagcattgtttgttgcacactggccctctatgtgtggttggtctcacaccttttgtgccaagaggggaggcacgtttgtccactacaaggtcaccactcgtgtgccaaaaaggggaaggatttccaaatgttcccttgatgggaataaggtttgtattaactataatcccgtcctcgccataagacagcttggctaccccatgagaggagcaccgtcagaggaaaacctcacgccttttatcacacggggtttcaatgatcccagcgtgaggctaagggctgtgagagaggaagaggccaaagctccggaagagagtaaggaggtacaagccataaaggtggagcttgagaaaacccaagcagtcaaggagaagttcaaggcctggaaggaagaacacgaccgaaacaagttccgaggagctttatggggcagcaatagcgagcttaaactccgaagagacgaaagggatcagtcgcgagtcgaaggcctgattttgaaggacgagttaaaggcttgtattaggtccaaaagaagtttgtcccagcagttaagcgagacagaagggaacatgttggccatcattgataaatacagagaagaattgaacctagcgacagctcatgagcataggctagtggatgagtacgccaaggtatcagtggaaaaggaagcaagggggagggtaattgattcattgcacagagaggcaatcatgtggatggatagattcacctccaccttgaatggaagtcaagagcttcctcgactgctagctagggccaaagcaatgacaaacgtatactcgacccccgaagaaattcacggactcctcaactattgccagcacatgattgatctgatggcccacataattaggagtcgttaa

SEQ ID NO: 31384 - DNA, 2954 bp, Glycine max
  Peptide Sequence Number=SeqID_148162
gagagaaacagagattcggggagagaaaggtttacacgaggaggaaagtaaagaaagaccctaaagccgttgcttccgccattgaaaataacggcaccgccacttccaccgttaccaatgacaatagtgtcagtaacagcaccgttcagaagagcaacactggtgaggccaagagcaaaagtgataatgtttcggttcagcctccggcacggcaacaagctgtgctggaggatggggattcggctcagccaaaagtgggttcgggattagaggatgggaattcggggcagccacaactggaggatcaaaatatggttcaaactgaagtgggttcaggattggaggatgggaataaggctcagccgcgaggggaggatcagaatatggcacagacgcaagagggatcgagattggaggatgagaatacagctcagccgccaggggaggatcataatttggcacagacgcaagtgaattcaagattggaggatggggatatggctcaaccgcaattggatgatcagaatatggttcaacctcaatcagaggatcagaatatggctcaatctcaatcagaagatcatattatggctcaacctcaatcagaagatcagaatatggctcaacctcaatcagaggatccaaatatggttcatcctcaatcggaggatcagaatatggctcaacctctaatggaggatgagaatacagctctgccacaattggaagatgagaatacagctcagccacaattggaagatgagaatacggctcagctgcaaggaagttcaaaattggaagatgagaatacagctcagccgcaagtgacttccagatcagaggaagggaatacggcacagcctcaaatgagttcaagatcagaggaagggaatacggcacaacctcaaatgagttcaagatcagaggaagggaatacggcacagccgcaagtgagttcaagatcagaggatgggaatacggctcagcggcaagtgagttcaagatcagatgatgggaatacggttcagctgcaagtgagttcaagaacagaggatgggaatacagctcagccacaagtgagttcaaaattggagggtagaaagtcccctcagccggaagtgaattcgagattggaggatgggaattctcctcggccacaagtgaattcaagtttggatgggaatacagttcagccatcggcagtgctggtttctgatgactcgcgcagccggcagcctgatgaaccttctagcctcaatgttcagcagcaggatgatggaccttcaagccccaaccgtcagcaggaggcagttcctagctcccgagaccttattttgggaaatggggttgcggaaccatggcggagggaccgaatcaagataaacctggcatcaaaatcaaagcagcagatgcgggagcttcggtggaagcttgaaagtgagcttggtgttgtgagaagtttggttaataggattgaagtgaagcagaggcaagttggtggctttggcaactcagatgtgcttattgacagtgggattaataatgttggtggagccaagcgtgctcattcagaagtggcatctgcttgtgttccacgggaacctgccagtaccaggcctttgcaccagttaagtttgtcaatgttggagaatggtcaagggatctgtgaaactgttgagaaggagaagagaacacctaaagcaaaccaattttatcgtaactcagagttcttgcttgcgaaggacaaatttccgtcagcagagagtaacaagaagtcgaaattaaattggaagaagcaaggtgggggagaaatgggacatggttttgggatgggatctaaatttttcaaaagctgtagttcactgcttgaaaaattgatgagacacaagcatggttgggtgtttaattctcctgttgatgttgagactcttggtttgcatgattattttactatcatcactcatccaatggacttgggaactgtgaagacaaggctgaacaagaattggtacaaatcaccaaaggagtttgcggaggatgtgagactcacttttcgtaatgccatgacatataatccacagggacaagatgttcatattatggcagagcttttatcaaagatattcgaggacagatgggctataatcgagtcagattacaatcgggagatgagatatggctttgattatagggcagctccccctgcaccctcacctttgtctagaagggtttctgcatttacaccaccacctcttgatatgagaaggattttggatagatcagattcaatgacacagactccaagactcatgagcatcactccatccagtagaactccagctccaaaaaagccaaaggcaaaagatcctcataaaagagacatgacatttgaggaaaaacaaaaactaagcactaaccttcaaagtttgccttcagagaagcttgatgctattgtacaaatcattaagaagagaaattcagcacttaatcaacatgacgatgaaattgaagtggacattgatagtgtggatgctgagactctctgggagcttgatagatttgttaccaactataagaaaagtttgagcaaaaacaaaaggaaggctgaacttgctcgagctagagcagaagctttgcagcagaatgccatccagaagagtcaggcaccagctatggcagagattccaaaagaaacacaaacaggtgaacttctaagaatcagtattggtatgaaaggagtcttccccaacccttgcctgtgcaagggagaaatcaagcggataatgggagtaggtcaagcagttccagtagctccagcagtgattctggttcttcttcaagtgattctgatagtgacagttcctcagcatctggatctgatgcagggtcgcaagggacctgactatgctctgtcagcacttctccctttccattctgaagatggatgtgtgtag

SEQ ID NO: 31385 - DNA, 471 bp, Glycine max
  Peptide Sequence Number=SeqID_148163
atgtgtaagggttgggatcctggccctactggcgtagagtgtattgatagaaactctcattcagccgcacctgaccccagtggttggctgcctactggtcaaccacatgtcgtatgcagcactcaaacctccgtaggtgagctgaggtggactccagggttgacggtggtgcatcagctgcctgtggctggtcgtctccgggctgctgtggtgcctcgccctacgcctgcctgggggtgcagtacttcttgcctgcctgtagaactggtagaggcccgtgatcagagcaggaaaccccagggcccagttggacttcttcgggtccatagggtgtctcgcgggtgcaacacttgcaaactgataaatggcgtcagaaatcagctaagccacatgcacactcacctgtgtaagaatggcataaaccaactgacacttcggcaagggaaggtcaaagttgtggtcgctgggtag

SEQ ID NO: 31386 - DNA, 291 bp, Glycine max
  Peptide Sequence Number=SeqID_148164
atggctaaattcgatccaaagatagtcatggagttctacgctaatgcctggcctaccgaggagggggtccatgatatgcgctcctgggtgaggggccagtggattccattcgacgcagatgcccttagtcaattcctggggcacccactgatcttggcagagggccagcagtgtaagtacggccaaaggaggagacaggtctctggctttgatgaggaggctattgcccagctgttatgcatactgggacaagatttcacccggtccgccgaagtgtcagttgctacttag

SEQ ID NO: 31387 - DNA, 263 bp, Glycine max
  Peptide Sequence Number=SeqID_148165
atgctgcattaagggagaagttgaacaagattatgtcttcggagtactttactacgacacctgagatgaaggctccggttgaagttgctgcggcagctgctgggggaaattacgtttccttccatgtgccggtgcatgggtctgtggttccggttgaagtggagcagcctgtttttcagtctcaggagaagggacatggttatgtgacctttagcgttgctggttatggcgttgcaacctttgttgtgggtaaggcactgtga

SEQ ID NO: 31388 - DNA, 171 bp, Glycine max
  Peptide Sequence Number=SeqID_148166
atggtgcttcacttgttctgtgatatgaattctacagatacacttcaattctcactgcttgtcgcttttggaactgcaattcaaggacatggatctgaagaagatccctctgatcctgagggagagcttctgaaggatgaagtagaagcagaagcaggaaaatgcaggtga

SEQ ID NO: 31389 - DNA, 264 bp, Glycine max
  Peptide Sequence Number=SeqID_148167
atggagattccttctgccaccgaaacccagatgccaaagggatgtatcctatcctctattctaagtgcgatagacgagtacccggaaactctcatcagagaactagttcccccgcctttcataaatcgatcgctaatagtgaatttgatgtcagagaaaggggtgcgtcctcagccggtgaggaagactaactatctgatctttatttacatgattgagtccatagcacatcagccagcctttcaagcatcctactccttgtaa

SEQ ID NO: 31390 - DNA, 687 bp, Glycine max
  Peptide Sequence Number=SeqID_148168
atggcggccaccgcaagcaacaatgacgtcgccgccgccaacgacggtcccgtgatgagccttatcaacaagcgcctccgcgctctccgcaagaagctgaaccgcatcctcgccatggaagaggccgtcaccttgggcaagcccttgaacaaggagcaggaagaggttctacgctccaaaccctccgtcctcgccctcatcgatgagctcgataagctccggcaacctctcgccaccgctctctccgaagagctccaaatcaacggcacgtcttctcaaaaccctcgccacgagaccgagaccgaaaacgaaaccctagctgagagctccggctcgactgagccgaactcgaactcgaggaacgacgtcgttgtggaggacctgcttaatttgctctattttggttcacttttcgatgtgaagagtgactttgcgtccacgatgcttaccaggacgcacgagcgtggctgctgcttgacctacgactacgtcaccgacgatgccaccgatctgcttggcgagaaggacttggattcgatctccgcactgagagggttgctcgtttcgcggcccgcggattcaagcttttcgcacaagaacgcgctgcaccgctgcgtggaacacgccaagctgtggcttgctaagtcggagcagcccattgggcctgatgctgatgttacttgtatg

SEQ ID NO: 31391 - DNA, 228 bp, Glycine max
  Peptide Sequence Number=SeqID_148169
atgtgggggtaccgcatggttatccgcacctttcgtcaaccaggggaaaacgagcccgttgacgcgcagagactaacatcgtcttctacaccttttatcatcctcacccatgaagtcagctttcgtcaaccaggggcaaacaagctcgttgacgcgcaaggactaacgtcgtcctctgcacctttcgtcaaccaggggcaaacgagcccgttgacgcgcagagactaa

SEQ ID NO: 31392 - DNA, 183 bp, Glycine max
  Peptide Sequence Number=SeqID_148170
atgaagttcttggaactcaagcaaggtaacatggttgtggctgattacacacttaagtttgaagagttgtcaaggatttatgatgaggatagtagggaaagaactgcacattataagaatgtggacccaatgaaggatgatgtggggctcaaaaccttattccgctctaatcaatcaacctaa

SEQ ID NO: 31393 - DNA, 5646 bp, Glycine max
  Peptide Sequence Number=SeqID_148171
gtttctttcgcggcaaaggagcttgacgtggcggaatggaaaggggaccttctcgccgttggcgtaacggagaaggacgtcgcgagaaacgtggaatcgagattcgagaacgcgattctgagcgcgttggactccaagctgggcgggttgttgggccaggtctcgtccgaagaggacttcagcggcaaacttgggcagtccacggttctaagaatcgcttccggactcggattcaagcgcgtcgccttgcttggcctcggcgcctccgcgtccaccacctccgcgttcaagtccctcggcgaggccgttgccgctgccgccaagtccgcccaggccggccacgtcgccgtcgcgcttgcctctcccgacgcactctccaccgagtctaagcctaaaacagcgtccgcaatcgcatctgggactttgctgggaacttttgaggataacaggtacaagtcagagtcgaagaaatcagtgcttagttcggtggatattattgggcttggaactggacctgaattggagaagaaacttaagtatgcagctgacatttcttctggaatcattctcggaagggagcttgtgaattctccggctaatgtgctcacgccaggggtattggctgaagaggcatcaaagattgcttcaacatataatgatgtttttactgccaaaatattagatgctgagcagtgtaaagaattgaaaatggggtcctatcttggtgttgctgcagcctcagcaaatcctcctcattttatccatctgtgttataaaccaccaactggacctgtcaatgtcaagttagcattagtcggaaaagtaattgatacgaatgctcaaacagaggcacaagcaggaggtacaagagaagaaagggaggtgcaggtgctggttcctcgacaaccagagggtgtgaacctaacaattggtgctctcgttgcctccatggctgattcttcaccacagctcacagaggtacttgctcgcctcggtgacatgatgcattccatgtccctgaaactagacgaaatcctccaccgcttctcaccttcatccccttcctctgcctcaccaaacccaactccccatcatcagccccctgccttacagacacggtttgtgccgtcgcagtacgacgaccttaccagcatgctcttcaaactcacacagacgagtacggtagcggattacctgtttgaattcgagaatctggcgaatcgaatcattggcttgccaccaccatttctcctggcgtgtttcatctctggtctcgcgcccgacattaggagggaggtgcaagctcatcagcccctcacgttggtccaggccgccggcctcgcatgcctccaggaggagaagatttcctcatgccgttcgaccccacgtgcacccccacaacatttgcttccggccccttcgcgcaccactcccttgcctccacttttgtcgtcacctcctcgatcgcctccacctccgaagtaccacagagggcatagatgcgcctctagggttctcctcatgatagcaaaagaggatgatccttcgtggtctaatatagacttgggcgacccaaacccaaatccagacccacccgacagcccaaacccgctccaggcccaaatcagtttgaattcactttcgggccacttagcacccaaggcactccatttagtgggctttatctccgaccatcgtgttaccgtcctcattgacggcggtagcactcataatttcgtccaacctcaggtggtcacctccctgagcttaccgtgccagacgatctcaacgcctcttcgtgttatggtaggaaatggtcaatacttggagtgtgctagtgtttgcgaagacgtgttagtgtgcattcagaataacaccttcacccttgatctctacattctcccaatttcaggggccaatgtcatactgggggggaacatgcgaccagcacgggttctcacacaacaccagtttcaccgcctttatcgccatcaacccattgcttcatactttcacatcaccttggttcccgagacaccaacagcggccaccacacataagctaccacctgaaattcagcatttacttgcctcctacgagtttctctttcaacacccacagtctctacctctgccgcgaaccaccgatcaccatattcatctgctccctcactccctgcctgtcaatgtgctcccgtatcgctaccctcactaccagaagcacgaaattgagcttcaagttgactccatgctgcaacaagggctcattcaacctagcacgagccttttctcatcgccggtcttactggtgcagaaacctgacggcacgtgtcggttttgtgtcgactatcgtgccttgaacgtcgtcacagtgaaggataggttccccatcccaataattgacgagctgctagatgaattggggggtgccacatgcttttcgaagctggacttactccaggggtaccatcagattcgtatgaatgaggctgacgttcccaagactgccttccgaactcaccatggtcattacgagttccgcgtaatgccgttcgggttgtgcaatgcaccctcctcgtttcagaccaccatgaatatgattttccggccataccttcgccatttcattatcgtcttcttcgacgatatcctgatatatagtacctcattggaggatcatttgctgcatttgcaaaccgcctttcaaattctgcttgataatcaatttgctttgaaattgtctaagtgtttctttgcgcaacctcaggtggaatatttggggcaccttgtcttaggccggggtgttgaaccagttgcttcgaaggtcaccgccattcaccagtggccgacaccacgctccaccagggcagtaagaagcttcctaggcttggctgggttttatcgcagatttattcgtgggtatgcaacgattgcggctccgttggtcgcggtaacgaccgtcgaacctttcaagtggaccacccaagctcaaatggctatcgagcagctcaagcaggcactagcttcagcaccagtcctcgccctacctaaattcgagttgccctttacggtggagaccgatgcctctagggtgggcatgggggcaattctctcacaacagggacaccccattgctttctttagtaaaccgttcagtcagaaacttctctggtcttcaacctatgttagggaattatgcgcaataaccacggcggtgaagaaatggaggcaatacctcctgggccatcacttcattatcctcactgatcatcgtagcctcaaggagctactaactcaaacaattcaaacgccgaagcagcatatgtatttggcaagattgatgggctacgattatgagattcattatcgttcaggcagccataatcaggccgcagatgccttatcgcggctaccggagatagcttcctccctgtctttgatcttgtcagttccaacgttgactttcctagaggagcttcggaaaccgttggaagcaaactccgagtacacagcactccggcaatctattcgtgataaaccccaggatcatcctcagttttctctctcgcagaatctggtgttgcattcaggccgcatttggttacctaggggaattccactcattaatactctgctcactgagtaccacgcaacgcccacaggtggtcacgcaggggtgactaaaacgttagctagtatcttagaaaactttcagtggccgggacttagggatgacgtcaagcaatttgtggccaaatgtgttgattgccaagtgactaagtatgaagcacgaaagatagctggtcttctatgccccttgccggtaccaaatcgaccctgggaggatctctccctggactttattgttggattacctccgtatcagggtaacaccacaattttggtggttgttgatcggttttccaagggaatacaccttggtatgcttcctgctacccacacagctcacatgactgcctcattgttcatcaacattgtagttaaaatccatggcatccctcggagcttagtctccgatcgagatcccctgtttatcagcaggttctggcaagacctattccatgcaagtggtacccttcttcggatgagctcgccataccatcccaaaacggatggccagatagaagttttgaatcgcgtaattgagcagtacttgagagcttttgttcatcggccgagcttttggggaaacctcctgccttgggtggagtggtcccacaacacttcttggaacgtagggactggggctaccccttatgaagtcacctttggccgaaaaccttttaattttgcagaatacatctcggggtcctccaaggtcgacgctgtggaagagatgatgattgacagagacaccactttccaggccattcggagtaagctcttcaaggctcaggcagcaatgaaatctcaagctgataataaaaggcgtgcagttaattaccagatgggagattgggtcctcctcaagttgcgccctcgctggcaggtaactgcaaggggagctcaggctttaaccggtaaactggccaagcgtttctatggaccctttcaggttgtagaacgcattggacccgtggcttacaagttacagctaccagagggagtgcaaatccacccaatatttcactgttctaagctgaaaccttttcgtggttcatcggaaaatatggtaggaattcctctgcctattgaattactccatgatcagccccttgtttttccgctagccattctggatactcgtcgcgcttctaatggagatacgtgggaagtcctcgttcaatggaatggcctttccccagacgacactacatgggaggattgggaacagctctgtcacaactaccaccttgaggacaaggtggtcttccaagggccgagggattatacgaatgctcaaacagaggcacaagcaggaggtgctggttcctcgaaaaccagaggtggtggctacaacatcaagacaggacctggctgtttgattgaacttatgaaatttgatatgggcggttctgctgcagtttttggagcagcaaaagctctaggtcagatcaaacctcttggagtggaggttcattttatagttgcagcttgtgagaatatgataagtggaacaggtatgaggcctggagatattgtcacagcttcaaatggaaagactatagaggttaataacacagatgcagagggtaggcttaccctggcagatgctctggtgtatgcttgtaaccagggtgctgaaaagatagttgacctggcaacattaactggggcctgcataattggtcttggatcctcaattgcaggtgtgtttacaccaagtgatgacctggcaaaagaagtttttgatgcttctgaagcgagtggggagaaactatggaggttgccgttagaagaaagttactgggagtcaatgaaatcaggagtagctgatatggtgaacactggtggtcgaccaggtagtgctattactgcggctcttttcttaaagcagtttgttgacgagaaggttcaatggatgcatattgacatggctggtccggtgtggaatgaaaagcagcgctgtgcaacaggatttggtgttgctactttggtggaatgggttttgaggaacgcatcttaa

SEQ ID NO: 31394 - DNA, 572 bp, Glycine max
  Peptide Sequence Number=SeqID_148172
atggtgatggtgactttaacagcatggttaccagagttgcatcctccaccatgcactcctcagcaacaagcattgaaccaatgtgttaaagctagcacacctcaccaaggtgctctacttacgggactttgccttttaagcataggctctgctggcataaggccatgtagcatcccatttggtgtggaccaatttgaccccaccacagatgaaggaaaaaaaggtatcaatagcttctttaattggtactacaccactttcacggtggtgttgttgatcactcaaacagtggttgtgtatatccaagactccgttagctggaagataggttttgccataccaacagtgtgtatgttctgctctatcatcatgttctttgtgggtacaaggatctacgtgcatgtgaagccagaaggaagcattttcacgagtattgcacaagttctagtggctgcttatagaaaacggaaagttgagctaccaagtgagaagcatgttgatggggttttctatgatcctccacttactgggacacaagttttttcaaagctaccactgaccaaccaatttag

SEQ ID NO: 31395 - DNA, 549 bp, Glycine max
  Peptide Sequence Number=SeqID_148173
atggttgggagaggaaagcgatccttaatggttattatattcagagcacggagaagaatagggactgcgactcgggcggatgagctgacgctggagcataacgtccacttgccgttcgatttcttgcttctagtagtaagggtactggtaggagcagacattgacgagtttcgaatttggttcaaggtgaatggtatgggtcacaactcgttgtgtggacatcatacgcttaacctggccatgagtgatcccgaatgggcctggtgtgatgctgccttggataatgatgggttgtccgtggagaagcaggagggtcggagttcaagagctcatcatcctcggaagcaacgaaaaggaagaatttgtcacgacaacgatggttcgggccataacgctcatcgcaattgtagcataggccgcgctcgcgggggaggaaggggtggtgaaggaagaagggtaacggcggaaattggtggtggtagtggaggtgggcgaggacgagaagagcggcgagcatcgttaatttttatcctcctgaagtcgggctag

SEQ ID NO: 31396 - DNA, 2340 bp, Glycine max
  Peptide Sequence Number=SeqID_148174
atgacgatggacagagagaaggagagagagatagagctggagagtgcaatgtacacgaattgcttgttgttgggtctggatccggcgattatcggagtcggagcctccaacgcgactcctcgggtcgggcatttccgtcactcgaaccctaaattgggggaacagcttctctacttcatcctttcctctctcagaggtccaattcaatccgcgaaagatttcgataaggtctggccgattttcgattccgcgcagtcgcgtgattttcgtaaggttgtgcaagggattattagcgagcttgagtcgcagggcgcgcttccgaggagcaattcgagggtttcttcacttgctacatgctgtggacctaggttggtgttgactgtgttgatccctgggagtaaggggatactgagggggaaaagtgaatgtagtttaagggtttgcctttttgggaaattgacaagattgagagttaattcatttgggagaaggtttgttgagcttctatggcaactttctttgcatgctttacgagaggttcatcgacggacatttactgctgacatatcttctaacccattgcctgcgccattgactgatgtagccttttcacatgcggctactctacttccagttacaaaggcaagaatagcccttgaaagaagaaagtttcttaaaaatgcagagatggctgtacagcggcaggctatgtggtcgaatttggctcatgaaatgactgctgaatttcgtggtttatgtgctgaagaggcttatttgcaacaagaattggaaaaactgcatgacttgaggaataaagtgaagttggaaggagaactctgggacgatcttgtctctagttcaagtcaaaattcccatttagtttcaaaggctactcgactatgggaatctttattagctcgtaaaagtcaacatgaagttcttgcgtctggtcctattgaggacttgatagctcatcgagaacataggccaaatttaccagctaacttattgatacaaaatttcagatatcgaatctctggatcatctttgcttgcagcaatggaccagagttctcaagctccttattcagatgtattatctgctcagtctggggatttgtctgcgatggataacaaagaagagaatgatggatcacattttagcaatgagacattgacaagagtggatgacagaactggaagagcccaccaaactgttgatgtagcagaggttatacggcgatggacccatgccttgcagcgtatccacaaacaatcacttcatttggcaaaagcgaatgatggagagggtcctgatatattgcgcagtgcacaggaaggtgattcaagtggccatgctgagtctttagcagcaacccttgcagagcatcagcagcatttggctagcttccaggtgcttattaaccaactcaaggacgttgctccaaccatacagaagtccatatctgagtgtacagaaaaggttaactgtatagcctccaatctacctccaatgaacagacctaatggtcgatcaacgtcacctatccagacacagagtagtgggaggatggacaatagcactgatgatgttagtgaggtgacttctagaatatctaatattcagcttgacaaggtttctgttagtcctcccactttaaagcttcctcaattgtttagcttgactccatcttctggaaaagctggaaatgtccaaaggcggcacaataattctcctcaaaccagccaaacagagaacctctctgataggaaatcactggatcctccttcaaataacgaagtagcaagttcagcagaagatagtgacagttcctatgtccacaatttgaagaggtctgtaagagaagcggctctgtcattgcggtcatgtaattcagagtcatcacgggatagtcaatctgatgaaagttctgagcatttctttgtccctctttcagaaactagcttttctaatttagatgcagacaaaaggggagcttcattaaggagcaaaagattatttgtatctcaaatggatgattccttgcttgagagtcatgcatccggtgggcatggggagagaaagtttgatgaatttccagatatgttgaatgatttggaaaggctttctgtctctgattatgacaatgttaatggttttctctcatatcctggttcaaattcaacatctgatgctcggcggtcaatttttgattttgaggatgcccaggatcaagtcttctcaccacctttgctaatggactcatcacttttgacagatccatttgaagacttgctggcccctctgtcggagactgaaacggccttgatagaccattga

SEQ ID NO: 31397 - DNA, 390 bp, Glycine max
  Peptide Sequence Number=SeqID_148175
atgaagcttgatgactctctgtctgaagtggttttggaaaataacactacaagagccaacttatggtgggtccttcctcctatgggaactgtacagactaagatactacttaggaacctggaaattcattcacatgcaaatgatgctatccaaatggttaaaggattagccaacccaaatcagcatgaaaagctgatattggatgcgattcaggcctctatcatgcctgctatgacagttcaattttcacatgtttatagagagtgcaacaaggttgcagacctgttagctaagaaaggtctctccctagatgagggaatagtttattttttagatatacttggctttgtggtatctgcctttcatgctgatattgttagccttgggtaa

SEQ ID NO: 31398 - DNA, 819 bp, Glycine max
  Peptide Sequence Number=SeqID_148176
atggttggcaatggcaccgagatagcttgcgacaaggtgtgccgcgatgttgccgttttgattcaaggccacgaatttaacctagacttatacgtcatggcattaggtggcacagatttagttctgggtgtggcttggctcaaactcttaggcccaatcaccacagactattcacacctaacaatgagttttatgtaccacggacaacccatcattatccaaggcagcatcacaccaggcccattcgggatcactcatggccagcgtcagctcatccgcccgagtcgcagtccctattcttctcctgtattgttagtaaagaagaaggatggcacatggaggttctgcgtgaattaccgtgctctgaatataataaccattaaggatcgctttcctctcccaaccattgatgaacttctcgacgatctgggccactcctcctggttttcgaagatggacttagcccaaggtttccaccaaattcgcatggtagagcatgatgtccctaaaacagcctttcatactcatcagggtcactacgagtacttcgttatgcccttcgacctctgtaatgcaccttccacatttcaagctacaatgaatgccctgttccgccaatacattcgtaaatttgtattggttttcttcaatgatatcttggtctacagtcacgatctccagtcccacctcgacaatctcgattgtgtcttacgaactctacaacagggagattttcacctaaaacaattcaaggccaagaagaattacaaaaaggccctcaggatgggaggagttcattcactaagcagttatcagtag

SEQ ID NO: 31399 - DNA, 429 bp, Glycine max
  Peptide Sequence Number=SeqID_148177
atgatcttgaaaaacaaacaagcccttggttgcttgattagtagtttgttcttcgaaaaaagaaagggtttaagcctttttaatctcaaggactggaaccttgcgcttctttcccgtatcctgtgggactttcattgtaagaaagattctctatgggttcggtgggttcaccattactatttcaaaggttacaatacttcttcatcagattcagttttgataaagaaaatcattcaaataagggactttattatctctaaagagctaagtacggaagaggccaaaaagaggattcaatcttggagcaccaataaacaattgcttgttggcaaagtttatgaatacattagaggtgtcaagcctactgttagttggtgttctattatatggaacccagcaatcccccctaagatgtctttcattttgtga

SEQ ID NO: 31400 - DNA, 336 bp, Glycine max
  Peptide Sequence Number=SeqID_148178
atgttgcgaaactttatggattacgcaacaatgctctttttggcttccggaatgttgaggaactttacggattgtgcaacaatgtttcttttttacttccagaatgttgccgaactttatggattacctaactgtcgcaacatgcccttttgcaggcgggcgaggcgaggctcacggagcggggctcttgctcctacgtaccctccatcgaagaggaaatcagacctacgtagttcttttttaagggtgaatcaagcgattatttttacttggaaggtgatcattttaaggcgttggaccttaaaaatgatccatttacttggtaaggaaaactga

SEQ ID NO: 31401 - DNA, 475 bp, Glycine max
  Peptide Sequence Number=SeqID_148179
atggcagggcggtcggtgttgaacgccggtgttcgcgtagaagatagtggcagcattgttggatgctcaaacgacggttctcagcgccgtttcgaggagttggtttctgagttcacgagcgagatctgtgggagtgattattttttgccttttccgccaatgttgggtgatgggaaacctgtggatttgtataagctgtttttggtggtgagagggaagggtggatacgacgccgtttgcaattgtaagttgtgggatatcgttggggaggagtctgggttgggtgtgagtgttggttcttctgtgaagttggtgtatagtaagtatttgagtgctttggatgcgtggttgaagaaggttgcggagagtaaggtgtcccctgagtgtggtgtggtggatgatagggacaagttcgggaggcggttgatggagttgcaggcagaggtggaagggttgttatctggttgtggggagg

SEQ ID NO: 31402 - DNA, 273 bp, Glycine max
  Peptide Sequence Number=SeqID_148180
atgaagaacaccgaagaacggtcgaaaacctttgctaaatcactcacggaaacgttacggaagcgttacgaaagcgcctcggcttggattttcttcacggaactaattttcctcagcaaattcgaaagagagagaaaaaattgggggagaagcttgccacccagctcgcccaggcgagcaaggttgcttcctccagaagcaacagccttctggaggaatcttctggagggcccaagtgggcctggttgctatttgcacccctatttttactaa

SEQ ID NO: 31403 - DNA, 243 bp, Glycine max
  Peptide Sequence Number=SeqID_148181
atggattcttctactcatctcgagacaagtgtccatagggaggaggccccacagtcaaaatacgtaggaaggaggaaacgtagcgatggtgctataaaggacgtggccaatggaggtgttgttagagagggaatgagaataaggagtagaaaaggagaggggtgtgagaagaagcaagaaaaagaaaaagtggggcactgctgtcgaaaatcgcatctgcgggtgatgcaccatggagaataa

SEQ ID NO: 31404 - DNA, 261 bp, Glycine max
  Peptide Sequence Number=SeqID_148182
atggataatgcatcttcatgctctgatatccatgaagtcttaaaaggcataggaccacctcttatccatttgctccccacatatgtcaaatacagaatcatcataggcacgaacaacacatgcaataaggcaaggattcaatcatcatacaccatcgtcatcattaccatgattcatctatcaaacatcatcatcatcagtccatcaatcattgacactaaagatagactcgactccatggagatttcaccttttgagtga

SEQ ID NO: 31405 - DNA, 228 bp, Glycine max
  Peptide Sequence Number=SeqID_148183
atggcggaaaatcttcacggaattacccacagaaatgtttcggacacgttacggaagcgcctcggcgtggattttcttcacggaaatgattttttttcactaatttcaagtgatcccaagataccaggagggctgaacgaaaatgagggaggagcttgccacccaactcgcccaggtgagctaggttgcttcctccagaagcaaccgccttctggaggaacatcctag

SEQ ID NO: 31406 - DNA, 1026 bp, Glycine max
  Peptide Sequence Number=SeqID_148184
atgaacaggtcagatccttgtctgcaagatttgagggataaaattttcccatttgaagaacaaaatgcttcagtcaaattgaacatctacagaaagaagaattctctatcttcgttaaaaaagaatgcaaaaatagacaaagcagcttcaaaacctgataaagcggaagatgaaaaccgtggtgaagtagaagttctggaagaagcttctagttctacaataggatccgcgagaagagccaaagctgcagctagattaaaatttacttgctctgcaccacctgctgcttgtcaacttgacaaagtagcaggagaagataagaaagatggtggtcatccccggggtggtgaaacttccaacggaagtctcaaaatcaaaattccgaattcttccaaagcaaattcaagtcaacaatcagataccaacaagagggacaattctgagtttaggaatgaaacggctgatatgttagagccattaaattccctggtggaacctggaagcaaaaagtctcgtaaaaagtccaccatgcgctccaatgacaatgccgctgatcaaaatgaatcaactccttcaaactcagattcagtccaacaccaaaggcctctgagcaatcaagagaaaacactcagaatctctgaggacttaaattttcctgcacaacctgagattggttccaacattgaaggcaacaaagaatttggtccaatctggttctgcttggttgctgcagaagagaagaaagcaagtgcacgactgccacagctatattccagctacctaagggtcaaggatggtagtgtaactgtttcctatattaaaaagtatctggtgaagaagcttggtcttgctagtgaagatgaggtggagatcacattacaaggtcgagcacttttgtcttcattgcaactgagaaacctagtagacatgtggttgcacacagtgccaaagaataagattcagacatttgttggaagctcagccaaggattttattatggcactttcatatggtcgaaagacttga

SEQ ID NO: 31407 - DNA, 426 bp, Glycine max
  Peptide Sequence Number=SeqID_148185
atgactctagaagagctcattgtgattctcaaagtccaagaatctaatgatgatgactttaatgaagaagatgacgagctaagtttgatcaccagaaagatgtggaaaaacaagaactcctccaggtttaacagttcgtctaaaagatcctttcacgaaaaggagaaaagtcgagtcatctgctatgagtgcaagatgccaagacatttcaagttagaatgtcctgaccttgaaaagtcaaaggataagaagaagaaattcttcaagtccaaaaagaaaagcctcataaccacttgggaggacttggatgattcatcgtttgacacggacagcgaggaagaagccaacctatgtctgatggttgatgcgtccaccagtaaagctgaaccagcattggatgcatgcttagaggatgaagatccttaa

SEQ ID NO: 31408 - DNA, 468 bp, Glycine max
  Peptide Sequence Number=SeqID_148186
atgcaagaaagggtgaaatccttaaccatagctcttaaagattcaaaagaaaagcccaaggaaatgcttaaacaaaagctcttactgcaaaaagaatgcacttttgctaataatgagctttataagttgaaaaagaagaactcagatctctggacgaaatgtcaacactataaaaaaatttcttatgatttaaactataagcttaaaggacatgagatctggaaggaactacctcttgagattgaaaaactctataaggagatagaagccttgagaaataacataagcaagtttgttggtggtcatgaaacccttaccaaaaagattaaggtgcaaagaatccccaaagacaaatctgctcatggtttcaaaggcaaaaaagtgggtcatgagacttataagttcaaggacctccctgaaaagggcaacccatcgaagggtccgtccagtgcttatcagcacctataa

SEQ ID NO: 31409 - DNA, 171 bp, Glycine max
  Peptide Sequence Number=SeqID_148187
atggcggtggtgggaacaacaggtagctacggtgggcacgacggaggtcagggaacggcgattgatattacttgtcatgtgagttatgagttatacaataacccgaccagtgtttaccttaagagaacttttatgcgcagtgttaaaggaaattgtaggattcctagttag

SEQ ID NO: 31410 - DNA, 222 bp, Glycine max
  Peptide Sequence Number=SeqID_148188
atggaattgtttagatattttcaagcaaaattgaacttcaattactctaataccttgttgaactggggaccgtctccttcagtggcccgcattcgcccgaagatgctatatgcaacatccaaggacaggttcagaagggagctgcagggcatccattatgagattcaggcaacagacccaacagagatggatcttgaagtcctcagagaacgtgcaaactga

SEQ ID NO: 31411 - DNA, 636 bp, Glycine max
  Peptide Sequence Number=SeqID_148189
atggctacctcattcagactcttatttttgtccattttctccttgttcatagcctgttccatagttcaaacctctttcaaaccaaaggcacttgttcttcttgtcaccaaagatgtttctgcctcagaaggctatgtctctcattcacctctaaaccagtccgttgtggctctgctgattgcttacttttcgggaaacacggttgcagtgaagacaaaatttggtgtcactttccagagaatagtttggagcccctacagttgcacctgtggctccatttgggacttgctttgcaaccaagacattgggttttcaagaatgggcccgggtgtgccaacgataaatctggtattgcagaatgaggaagtggtgtggagcatcattggtgcgaattcaatggtgcagtttaatgacgtaatttgcttgggttttggggatgctggatcagacccaagtgcagaccaagttggagctgtggtgggtggttttcacctaatgacttcaatcacaattggagcaaatcagttggagaacaacatgctacaatttgatttagcaacctcaaggcttggcttctgctcgctcttcttggagcacactgactgtgctaactttaactttacctcttctgcttag

SEQ ID NO: 31412 - DNA, 183 bp, Glycine max
  Peptide Sequence Number=SeqID_148190
atgaccaaaccatatatgcatccagagaggaatgcagacctagttggtccaaacagagtaatgatgcaatcctatcctgcaaggacattgggtagaagactccaagtagattgggctagagatccaagggaaggccctagggttctcacgagccttagggtagatttcgagcccatcggctaa

SEQ ID NO: 31413 - DNA, 234 bp, Glycine max
  Peptide Sequence Number=SeqID_148191
atgacatcgtcaacatccctcgcgagcttctttctccgcgctatgcttctctctcctcaagcttctgaaaagcgaattctagggcgaagattcaaacccaacaccagatctgggaaaggcaacaccagatttgattcaaaaccaacacttgatctggaaaacgctcctttgactgtgcatcgtagatctcttctccaacgtccaacgttgtgggcttccccagtagcgacgtga

SEQ ID NO: 31414 - DNA, 213 bp, Glycine max
  Peptide Sequence Number=SeqID_148192
atgattgccgccaccaagactgatttccctgtcattgttgtcaccaccgccaccaacaaccgtcttagtggtggaggtggtggtggtggcggtagcggtagtggtgttgatgacagtgttgatggcaacgacgattatggtagtggttgtagtggagatcatggtggtggcagtgattgtcatgatggtgatgggttaaatgaaatattttag

SEQ ID NO: 31415 - DNA, 306 bp, Glycine max
  Peptide Sequence Number=SeqID_148193
atggacgatatcatattcgatgctactaaggactccttatgcaaagatttttccaagcttattcaggcagagtttgaaatgagtatgatgggagaattgaagttcttccttggacttcaagtaaagcaaatagatgaaggcatatacatacaccaaacaaagtatgtgaaggaacttctgaagaagttcaagatggacaatgcaaagtgtgaagtgttatggatggaaagaaagagcactagtggaggttgttacttcattagtggatgcttagtttcttggacaagaaaaaaaaaggaacaatag

SEQ ID NO: 31416 - DNA, 564 bp, Glycine max
  Peptide Sequence Number=SeqID_148194
atggtgaaaaagtctaatgggaagtggaaaatgtgtattgactacatagacttaaacaaagcttgctccaaagactcatatccactctcgagtatagatcgactaatcaatggggcatccgtgttccccgtcctcagttttctagatgcatactcgggtcacaaccagattcccatgctcaaccaagacgaggagaaaatgactttcatgacagacacaacatattattactactctatcaggtcatttggcctcaagaatgcaagagccacttaccagaggctgatggataaaatattcaaggatcagctcgggaggaacctagaagtatacatggacgatatagtggtcaagagtgcaagcaccataacacacgcgaaagacctagaggagattttcgcaaaaatccaaaagcacaacatgaggctcaacctagaaaaatgtgtgtttggagtgcaaggagggaaattacttggcttcatgataactagcagagggatacaacccaatctggagaagttcatgaccatcatcgaaatgaggagtccaaacaacttgaaggag

SEQ ID NO: 31417 - DNA, 234 bp, Glycine max
  Peptide Sequence Number=SeqID_148195
atgatagctagagggttttccaggggaggaagctcaaacttggcacgtgaacactatgtccacagtctcaaatcagtcacggcggtagaagcagaaatgaaaccaactagaaacatgcctcttatcaatggaactggaatggagaggaggaaaggtgattggagatgccacttcaaggagaagatgagtcaagaacaagcttaccaccataggaagccatggataagagcttga

SEQ ID NO: 31418 - DNA, 252 bp, Glycine max
  Peptide Sequence Number=SeqID_148196
atgacgacaacgaccaagcatgctcaacctcaaattttttacatgtatcctagttcgatgaggttaaggagagaagcgggaatgtcaaggacatggacaaagaaggtgttgttctctaacattagcatgagaggatgggttaatttcacgagttgggtgaggattgggccgcaaatgtcgtcagagatgacaaggtggaggtgggatatctttggcagaatctcaccgaataagtcgttgagtgagaagtag

SEQ ID NO: 31419 - DNA, 141 bp, Glycine max
  Peptide Sequence Number=SeqID_148197
atgtctcaatcaaaagccgcatcttcttcaagtactagtaacaatgaattacatgacactgtgatgcaatcctcccaaggaggggacccatcaacagggtcatggctaggagactccaagaagactgggctagagatgtag

SEQ ID NO: 31420 - DNA, 381 bp, Glycine max
  Peptide Sequence Number=SeqID_148198
atgttatgcactgctgccccagtcggggttgaggatgtcagcaccctgatgaagtgccttaaaccggggtttccctcgagggtgggagaaagaatcctgtgccgtcatcccttccaagaatccaagagagcatatgtggtgccacagcgtgttgaggagcttctgaggtgttactggtctgggagtacagatattaagaaagatactttaccagctctaagagatattagagagcgatgcatcaatcaacttgagcaaatgcgacctgaccacatgaggagacttaacccaactccatataaggttagtgttagtgcaaaattatacgacttcattcatttcctgtggctcaatgaggcaccagttggggagctacagtaa

SEQ ID NO: 31421 - DNA, 243 bp, Glycine max
  Peptide Sequence Number=SeqID_148199
atggatcccaacatcgatttagatgaggttttggatcaaatgatagatgaggaattggaaggcaacactgaagaaatcattaggttgatacttgagagggtcgatgcactgcatcgaaaaggtctatctctattgcacaagtgcacaactgctcttcgtatattggcttatggctcacatgctgataatgtggatgaatatgttcgaattggtgaaacaaatgcagtggaatgcttaaagtga

SEQ ID NO: 31422 - DNA, 1080 bp, Glycine max
  Peptide Sequence Number=SeqID_148200
atggatttgccagtgaatatactatgtgtttcctttctgcagttatcaaatggtgtttttggtgagaccaatcaaagtgagttggctgcattcacatcatatgctttggcatttcctgatggttttcttgccctcgtagatacatatgatggtatttacataactgggaagatgagtgaaccattgtgtgcttataaatctgtgtctaggtattgggaggttatgagaagtggaatccctaatttctgtgcagttgcattagctctcagtgatttaggatacaaagcagttggcattagattggactctggtgaccttgcatacttgtcttgtgaggtcaggaagttcttttactctattgagaatgaatttggagtgcctggatttgggaagttgcaaatcactgctagtaatgatcttaatgaggaaacattagatgctttaaacaaacagaaattggtaattgaaggggatgtgaatcatcgcattcaagcaggatggatgaaatggagaaaagcatcgggggtgttatgtgatgcaaaggtaccaatcaagctaaagggaaagttttatcggactgcggtaagaccggcgattttgtacggaacagaatgttgggcggtcaagagccaacatgagaataaagtaggtgtagcggagatgaggatgttgcggtggatgtgtgataagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtatgggacatgaggttgatgcctttggaattggtacatatctagttacatgttatgctcaagctgctttaggtgttgtcttcaagctggttgaaataaataatcagcctcgtatcaaactttctgaagatgtatcaaaggtttga

SEQ ID NO: 31423 - DNA, 168 bp, Glycine max
  Peptide Sequence Number=SeqID_148201
aatccgtttggtggggaatatactgtcttcgctggcttggaagagtgcataaggttcatagctaatttcaagctcactgaggaggagatcgattttgttaggcaatgtttatcttcctcttgtgagacaaaaggaatgaaagatgatgacgtggctgtgaacccatga

SEQ ID NO: 31424 - DNA, 309 bp, Glycine max
  Peptide Sequence Number=SeqID_148202
atgtccatgtttgttgtgttcggggcactgcatgtgaagtccattcttttcatcaacagatatcgaattcagcagctcatacgtggccggggaaaacctcctatgggtttcactaagtacaatattgacgttgcactgttttcaaaatctggtttaatgggtatggcagcatgtttaagagatcaccatggccactttatatcagtattaatgactggcacggttaaaagaatttgcactcctcaagaagctgaagcaaaggctatgcagatggcaattgcttggacaaagaatctaggtctaaaataa

SEQ ID NO: 31425 - DNA, 683 bp, Glycine max
  Peptide Sequence Number=SeqID_148203
caccaggcacaacagccccaggtgcaacgacaagtaccagtttgacttgggggggtgataatttagtagcagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaattttgcgcagagttccattaccattaatgggtggctccgtgatttcttatgggcacaggcatcccaggtaattcagtcttatggttcttcattatctgcatatggtctttttttcttgggtgcacattttgtatgggcttttagtttaatgtttctattcagcgggcgtggttattggcaagaacttattgaatccattgtttgggctcataataaattaaaagttgctcctgctactcagcctagagccttgagcattgtacaaggacgtgctgtaggagtaacacattaccttctaggtggaattgccacaacatgggcattcttcttagcaagaattattgca

SEQ ID NO: 31426 - DNA, 531 bp, Glycine max
  Peptide Sequence Number=SeqID_148204
atgtatcggttggaatcgcgcccacaagatgcccagtggacccgaagaagtccaacagggccttggggtttccagctctggttacgggcctctgtagtcctacagggtgcccgttcccccccgacaaggtcacgtcatcaggacataggaatcgtgcccacaagacgcccagtggacccgaagaagtccaaaagggccctggggtttccagctctggttacgggcctttgtagtcctatagggtgctcgttccccccggcaaggtcacatcatcatgacatggggatcgcgcctgcaagacacccagtggacccaaagaagtccaacagggtcttagagttgtcaagctctaattacgggtctctcaaggtcatcaggcccccaactaatcgagctttcatcaagaagtactgcgtccccaggcaggcgcagggcgaaacaccacagcagcatgaggatggccggcagcgggcaacaaacgcactgccatcacctctagagttcacctcagctcatccacaaaaaggttag

SEQ ID NO: 31427 - DNA, 252 bp, Glycine max
  Peptide Sequence Number=SeqID_148205
atgttgctaaatagcaacatcatccatatccacgtaagattggtcatgttggtgcgcatgatccgcactcgtctttttgcagcggcacgggtgaaatcttgccccggtatgcatagtagatgcgtgatagtctccctctctggatgtgctcgcacagttggttgccctccaatatcaaggggtgccccaggaactgataaaggaaactactggccccttaaccgggagcgcaagtctcggttaagcatctaa

SEQ ID NO: 31428 - DNA, 639 bp, Glycine max
  Peptide Sequence Number=SeqID_148206
atggactttagaatgtaccaaacgggtgtgaaaagtgtttttctaaatgaatacattgaagaggaagtatatgtttctcaacctcctagttttgagaatcataaaaatcctactcatgtgtataagcttaagaaagctctctatggacttaaacaagcaccaagacaatgctatgtgatacttaccaattttctccttgataaaaaatttgaaagagaacaagtttatgcagatgacatcatatttggctctactaataaatctctctgtaaagattttgtgcataagatgcagggggagtttcaaatgtcaatgatgggagtgttgaattatttcctcaatctacaagtgaagcaaatgaaccatggaacttttctccatcaaaccaagtattgcaaggaaattctcaagaagtttgatatggataagagcaaggaagttgcaactcctatagctacaaattgctaccttagtgttgagatctctctagtgggatactcagattcagactttgcaggatgcaaactagataggaagagtacaagtggaacttgtcacttattaggaaatagcctaatatcttggaatagcaagaagcaagcatgtgttgccttatctacgactgaggctgaatgttga

SEQ ID NO: 31429 - DNA, 522 bp, Glycine max
  Peptide Sequence Number=SeqID_148207
atgaagggcacctactacactaacctcgtaaattttttttacaccatagctcatattgatggtgatactaagtttctatgtgctgaggtgaaagggaaacaaattgtgatgacaccaaaagtttggttagacattgttgggatatctttaaagcgagttatggcgaaccaggtttccaagttggtgattcaattggaagcaacaaaccctaccacgagtttagatgattcagtgctcaatgttgtgctcactgctaaggttgggtttttatgtggtgattattgttgtgtatggttttggttttgtcataccctaatttcgtccggggaccttggcttggtggcatgcaacttgtatttggtcattttgaggtgcttggcacccatcattaggcccacttgggccctccagaagattcctccagaaggctgttgcttctggaggaagcaaccttgctcgcctgggcaagctgagctcgcttgggcgagctgggtggcaggcttctcccccaattttctataa

SEQ ID NO: 31430 - DNA, 345 bp, Glycine max
  Peptide Sequence Number=SeqID_148208
atggataagaggctcgtgggattacacgaggggtgggggggctatattttctgggagcgaactccagtcgaatatgaagcgcccggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctaataccccgtaggctgaggagcaaaaggaggaatccgcccgaggaggggctcgcgtctgattag

SEQ ID NO: 31431 - DNA, 348 bp, Glycine max
  Peptide Sequence Number=SeqID_148209
atgttttcctcgaataaacattggtcacgactccacgcaccttcctcacttggaagacgcacccgtgagccccgcgtcgccctcccgccgaaggccctgggcccatcttggcccatcaggaagcttctacatgaagcaaccatctcgcttgggcgagcatgttacttcaggcttaagccaccagctcgcttgggcgagctgggcggcaggctcctcccctattttggctataaaagggcatgggaggatgaaggaaagggttcaacaccctgggaaagcatatttcacttaaaattagtgaaaagaaggagaaagaagaagaaaatcaaggttgaggcacttccgtaa

SEQ ID NO: 31432 - DNA, 273 bp, Glycine max
  Peptide Sequence Number=SeqID_148210
atggcacgcagagacaaatatggtcatttgttctctttgacgaaaactcaatgtctttcaaccgtgactattgaagtctcccctgtcaaccggaggctcaatgtatttcgattgagactattgaagtctcaccttcgctatccaaagacgagcgagtctgatagcacgcagagacaaattatggtcattcgcacctttgccatccagagacaatcgagtccgatgacacacagagacaaattatggtcatcttctccttttcaaagaccttag

SEQ ID NO: 31433 - DNA, 345 bp, Glycine max
  Peptide Sequence Number=SeqID_148211
atgatagaggactttgagtcctatgaaggcgaggactttgagtcctctgaaggcgaggaacttgagccctctgaaggtgaggactttgagccttccgaaggagaggactttgagtcctctgaaggcgaggactttaagcccaacaaaggcgaggactttgagtcctctgaatgtgaggactttgagccttccgaaggagcggactttgagtcctctgaaggcgaggactttgagccctccgaaggcaaggactttgagtcctctgaaggcaaggactttgagccctctaaaggcgaggactttgagtccaacaaaggcgaggactttgagtcctctgaaggctag

SEQ ID NO: 31434 - DNA, 402 bp, Glycine max
  Peptide Sequence Number=SeqID_148212
atgaccggccctctcaatgagtcaatctcttgggtggacccttgggtactagtaccctcactttcaaaggactacacgtcctcaccttcagaggactacacgtcctcaccttcagagggctacacgccctcacatttagaggactacacgtcctcacctttagaggactacacgccctcgccatcagaggactacactccctcgccttcagaggactacacgccctcaccttcagagggctacacatcctcacctttagaggactacacgtcctcgccttcagagggctgcacaccctctcctttagtgggctggacgccctcaccttcaaagggtgacacgccactgactttagaaggctacgcgtcctcattttcagtgtgctccatatccacaccttaa

SEQ ID NO: 31435 - DNA, 210 bp, Glycine max
  Peptide Sequence Number=SeqID_148213
atgtgggttttttctggtcatgttatggtgcttagagccaattgttgcgcgatccccttgggcccatttaggcccatcagaaagcttctacatgaagcaactagctcgcctgggcgagcatgttacttcaggcttaagccaccagctcgcccagggcatgagaggttgaaggaaagagttcagcaccctgggaaagcacatttcacttaa

SEQ ID NO: 31436 - DNA, 324 bp, Glycine max
  Peptide Sequence Number=SeqID_148214
atggggggaggaggttgcaacacagctcccctagtcgagctggttgcttctcctctaagttatttaatgggcccagtggctcttgaaaagctttttggaattcttaaagtcgatgagcaagaacttgctcaagaagaagaaacaaagaaatggaagtcattagcccttacggttcaaagaccaaaatgcaactctgcctccaaagagtcatcgcccaaggcccttgctattaatgatgcttcagaagaagaatttgatgataatgactctgatgaagaagatgacgagctgattctaatcaccaggaagattagaaagatgtga

SEQ ID NO: 31437 - DNA, 418 bp, Glycine max
  Peptide Sequence Number=SeqID_148215
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggattggctctgagggctgggcacgggggtcccagtcccgaacccgtcggctgtccggtggactgctcgagctgctttccgcgggcgagagcgggtcgtcgcgtgccggtctgggggacggcatcccccaacggggccccttcgggggcttcttcccccgggcggcggaacagtcaactcagaaactgggtacgggacaagggggaaatccgaactg

SEQ ID NO: 31438 - DNA, 573 bp, Glycine max
  Peptide Sequence Number=SeqID_148216
atggcggaaaagggaaagttggatcagatagaggaaaggctaaaggtcattgaagaaggcagagattatgcctttgctgacatggaagatttgtgcctagtacccgacatggtcattcctcagaagttcaaggtatcggacttcgataaatacaaggggacaacttgccccaagaatcacctaaaggggcacaaatctttcaaagaatacgcccaaaggtggatggatttggcaactcaagtggcgcccccaatgacagagaaggagatgataacaatgatagtagacacattaccaatgttctactatgaaaaaatggtgggctacacgccttcaagctttgcaaatttagttttcgtcggcgaaaggatcgaagtgggtctgaaaagaggcaaatttgatcatcctgctttgatgaatgggaagcgtggggcaaatagagaggatgagaataaggaaggaacccatgctgtggctgccatttctacatggccaaatttcccaccagctcaacaatgtcattactcagccaatatcagctcttttcattacccatcacccaatcaaccatga

SEQ ID NO: 31439 - DNA, 360 bp, Glycine max
  Peptide Sequence Number=SeqID_148217
atgtgtgatagtgtcatcgacatgcttcttaacattcaaggcaagacaaaggatggtttgaatactcatcaagatctagctaagacaggggagcaacatgaacaacatgaagactacaacttgaagcttgaagaaaagcttgaagatgacaggttgcgacagttggtgactccaccgggaactgttagagagttaggtcattcagtctatgtgagccataaggagtggaggtcaatatgtggtcttgctgggtctccgactcacttgatgacagtgaagcctcatctagagttttcctcttttattgatgcattgtcgctgatagtgcctatcgccacaatgtgttacctaagaggatga

SEQ ID NO: 31440 - DNA, 171 bp, Glycine max
  Peptide Sequence Number=SeqID_148218
atgaccaacaaagttaggagatgcgacaatagatgcaagagaaaaatgagcaaattcatcaacaaactgagcaaagctcctagtccattgactaccgcagtggatgaaactgaccaccatgttgacgatgctcaggttgatcgttctcattacatgtcaaaggatcattga

SEQ ID NO: 31441 - DNA, 912 bp, Glycine max
  Peptide Sequence Number=SeqID_148219
atggctccgaggaagctccctgcaaagaggtccaggaaagacaccgttggagagggttccagtgcggccccacaggccaatatggatttcgatagacactggttctggagtgcggaacaccagcaacggtttgagaccatcaaaggctggtcgttcctcagagagagacgagtccaactgagggatgaagagttcgttgagttccgagaggagatagcccggaggcattgggctccactcgtttcacccatggctaagttcgatcctgaaatagtcattgagttttatgctaatgcctggcctacggaagagggagtccgagacatgccctcttggtgcgagtatagccagaggaggggtcaggcctcaggctttgatgaggaggctattagccagttgttgtgcgtgtcggggcaggacttttcctggaacgcagcggggagatgggtgcggatcattcgcaccagcatgaccactctcacgcagatctggatgatgttgctgcttagcaacattctccctagtgaccataactcggacctccccctgccaaagtggattatgcctacgagacacccgatggacccagtgaagtccaacagggccttaggatttcttgctctgattacaggcctctgtcagttctatggagtgtcgccagaggatggccagcagcaggcagctgcaaacgcaccaccatcatctctagagtccacctctactcacctacagaggttagaacgttgtatacgacatgtggctgaccagaaggcggccaaccataggggagcaaggcccacagggacctctggagatggagacgaagctcaggaagacaaagacatggccgatgtgatggactttttccttggaggaggcggagtcacacgaccagggtcgccaaacttgtga

SEQ ID NO: 31442 - DNA, 240 bp, Glycine max
  Peptide Sequence Number=SeqID_148220
atgatatccccagggacaaatggattgaatgaacataagtccagatttcttctcaactcgtgtgcaagaaatgctctattgtgggctttatcacaagaagaatactctaaggtttacaactttagaagcattgaacaaatgtgggacaccttagccattacctacgaggggtcctctgagggcgacgcgaggctcacaggtgcatcttccaaggaaggaaaacgcgcagagtcaccacca

SEQ ID NO: 31443 - DNA, 564 bp, Glycine max
  Peptide Sequence Number=SeqID_148221
atggcacgcagagacaattatggtcatcttctccctttgttgaagactcaatgtctttcgaccgagactattatagtctctctttgctatccagagacaatcaagtctgatggcacgcagagacacatatggtcatctgctccctttgtcaaagactcaatgtctttcgaccgagactattgcagtctccctttgctatccagagaaaatcaagtccgatggcatgcagagacaaatatggtcatctactccctttgtcgaagactcaatgtctttcggccaaaattgttaaagtctccccttcgtcatccagagacaataaaatccgatggcatgtggagaccaacatgttcacccgctttcgttattttgagactattttttagtctcctttaccatccagagacaagcaagtccgatgacaagcgagtccgctggcacaaggagaccctcatggtcatccatttttcatttgatttcaagactattgtagtctctgttgctatccagagacaatcgaatccgatagcatgcagagaccgtcatgatcgtccactttcataa

SEQ ID NO: 31444 - DNA, 987 bp, Glycine max
  Peptide Sequence Number=SeqID_148222
atgccaacgtgccaggtggttatagaagggagtgacgattctgttatgcaattgaggaatataaggaaacagctgatcttggtgggtggacacgtattgttgttgagaagccttttgttagtacttcgttttgcaaaccgattattcatgcctctatggaaccgtgacaacattgctaatgtgcagatcgttttcagagaaaattttggaactgaaggtcgaggtggatattttgaccagtatggaattattcgagatataattcaaaatcatctgctacaggttttttgcttggttgctatggaaaaaccagtttctctcaagcctgagcacattcgggatgagaaactgaaggttcttgaatcagtacttcctattaaagatgatgaggttgttctaggacaatatgaaggctataaagatgatccaactgtgcctgacaattcaaacactcctacttttgcaactgttattctgcgagtacacaatgaaagatgggagggtgttcctttcatactaaaggctgggaaggccttaaattcgagaaaggcagacatacgggttcaattcaaggatgttcctggtcaaaagcaggggagaaatgagtttgttatacgcctgcaaccttcagaagctatgtacatgaagcttacagtcaagaaacctggactggagatggaaacagttcaaagtgaactagatttgtcttataggcaacgctatcaagcagtaaccattccagaggcttatgagcgtctgattcttgactcaattagaggtgatcaacaacattttgttcgcagagatgagttgaaggcatcatgggagatcttcaccccacttttgcaccgcattgataagggggagttcaagtcaaccccttaccaacctggaacaagaggtcctgtagaagcagataaattactgctggaaaaagctggttatgttcaaacacatggttatagatggatccctccaacattgtag

SEQ ID NO: 31445 - DNA, 228 bp, Glycine max
  Peptide Sequence Number=SeqID_148223
atgcccttcagagaaatccatttccagaagaagctttttccggaaacattccggaagactatttttcttgaaactttccggaagaaccttcttccggaagaagaatcagtgattccggaagtactcagaaaccctttccgaaagaacgtcatccggaatttttctggaagaagcttcttctggaagatatccttttacttccagaagaaggatcttccgaaaagttag

SEQ ID NO: 31446 - DNA, 504 bp, Glycine max
  Peptide Sequence Number=SeqID_148224
atgtatgaccagttagatgaaacttctaggaccacgacacgacagattgggaggtaccttactttattacagtgctggatctatgagtacttttcgagtgtgcatcagtgcgtcaccgatgatgcgtatgaggagacgtccccacgtgcctcccggtggctgacgacgaaggcacatatgaagggaattataggagcgtcataccgggcacgttgtgatgctttgacggtcatagacgtgtgctggttgccttatactgagatgggtcctatggtggtcacagttcaaccggagagggtgctatgccagtttcggtacattcagagcatccctccgccgcctgttagcgcttcgttgtcatatgatgatatggatgacaggtggatgcatttctcagaccacgtagcagctgtgggtgacatttgtgtaatgcctaggcaggtatctgcggattacatggagtggtttttccagatatctcacccattcatcataccgacctag

SEQ ID NO: 31447 - DNA, 936 bp, Glycine max
  Peptide Sequence Number=SeqID_148225
atggattctgttggggaatcgagctttttggttcctcaggagaagggttcgtgcccctctattgggtcagtgttggatggctatttgatcaattgttgcagcctgtgtggtttcaatgagaaattggaaggagagacatgttttgagatgatcaatgctttgttgggtgatttggatgatacagaagaagtcgtaattgaagatgatgttcttgatcggttgccaatggatccctttggaatgaacataacggcattctcagattggattgaggattttgaatggggtttccgacccctggatgttgagtttgaggtggatgaaacgcatgaaaagattggtgatcatgatcatctccactttttgggtcttagttgggattttaatggccctgagaatttgcagcctcagacggttgatgctaaggggaacgatatgttggtttctggtgatgttttcaatggatatcaaaattttgatgtggtgtttgatgagggcattgtggccgatggaagcacaagggggtttctgagtgttagccaacgtcatggggactatagggttcaaagcaaggaagccgaggaatcgcgaaactacaccaaaattgaatgtgatgctgaaggaggttttccacatgatgctttgttttttgtgttgggttatctaggtgtgagggaccttctctctgttgaaggggtttgcaaatctttgtgtgatgctgttagaggtgatcctttgttatggagaaccatgcacattgatcagccattaaatgagaggattacggatgattcactagtaaagttaaccaacagggctcaaggtactcttcagcatctggccctagtgaactgcttatggatcactgacagtggtcttggacgagttttacaaagtaacccgagattgatgaaggtttgtatttatatgttgtaa

SEQ ID NO: 31448 - DNA, 745 bp, Glycine max
  Peptide Sequence Number=SeqID_148226
atgacgtgtagccctctgaaggcttggatgtgtagtcctctaaaggcaaggacgtgtagcccactgaaggcaaggacgtgcagccccctgaaagggcgtgtagccctacgaaggtatcctttgaatgtatgggcatgtagtcctctgaagtggaggacgtgtaaccctctgaaggcgaggacgtgtagccctctgatggcgacgatttatagtcctctgatgttgagtacgtgtactcctttgaaggtaagggtgtgtaaccctacgaaggcgagggcgtgtagccctctcaaggggaggatgtgtactcctctgaaggcgagggcgtctagccctcggaaggcgaggttgtgtagtcctctgaaggtgagaacatgcagtcctgttaaggcgagggcgtgcagtcctctaaacgggaggtcatgtagtcctctgaagtggaggacgtgtaaccctctgaaggcgaggacgtgtagccctctgatggcgacgatgtatagtcctctgatgttgagtacgtgtactcctttgaaggtaagggtgtgtaaccctacgaaggcgagggcgtgtagccctctcaaggggaggatgtgtactcctttgaaggcgagggcgtctagccctcggaaggcgaggttgtgtcatcctctgaaggtgaggacgtgtagtcctctaaaggtgaggacattgaatcctctgaaggtgagggcgtgtagtcctcaaaaggtgaagccgtgtagccctc

SEQ ID NO: 31449 - DNA, 792 bp, Glycine max
  Peptide Sequence Number=SeqID_148227
atggctgaattgatgaaaaggcgaaagggatcttccatcaccaccgctgttgctggccatcgacgccacagaccatctgaagcacccataacaccagttcctccttccttaatcatattagaccctaagtacctagacatagctttctttgatgatgagacatttgattactatcaagctgatatgactggcagattgcttgtcgggtcattaacctttgattgccgcatcatgcactatatcattgttagaattttgttaccccgttcgtctaatcttgctcaagcctttgaggaggacttgattttgatgtgggcttttcttaccgatcgtcagatcgactgggcccacttggttaagtaccgtatgcataaggcattacggaccaatgcacctcttccgtatcctcagttagtcactctatttcttcgtcactttcaaattcctctcgatgatgaaccttttgttcaagtcaagacatcttttgccattggtgttggagtggtaacttcttttgggtaccgtaaggatattgatggacaatggattaggaaacaagatttaccaccactaattcctgatgagcgtacttcgtctcctctgccacagagagatgcttcatctactcttatgcatgaagtcctttctgaactatgtggtcttcgagcgttcgtaggtgaccgtttggatgccatggatgctcattttgaaggcatggatacatggattactcatcttgaagacgacatgggtttcattcgccgttgcttcgatccaccggctgccccatag

SEQ ID NO: 31450 - DNA, 417 bp, Glycine max
  Peptide Sequence Number=SeqID_148228
cacttgcgaaatggtgggcttgctggtgtgtgtcatgtgaccgatcagcagtttgaagagttgaaggaattactggatgcaagcaagtatttgcaacagcaagaccagaagccacaattctacggagagtattcacatatcacatgtgaggatgaccgtgcaattgacatagaggtgtgtccaagatgcgagaaactgagacctgtttatgattgccccgccgagagttgtcaaccgaaacatcaggcttctcagctgagtgcccctggtctgcatggtcttttgacatacattggatcagaatctgcacatttggttgtctgtggtgatgctgaagaagggcatatggtggtgcttgcagtggatcttttatcttctgttcattgcgtcaaggaaaatgttgccattgttggttag

SEQ ID NO: 31451 - DNA, 372 bp, Glycine max
  Peptide Sequence Number=SeqID_148229
atggtgctagagacactaaatgaaggtccaatgcaactaatgataaatgatgcatttcgattgtctataatgggtgccaataaagagtcattaccatcatcacctaaacatagtggtgggggtgaaagaggtatatcagaattgcatcatggagaggctaaggaattatttgatttacttaaagatggagagcaacctctttatgatgggtcgaaaaggatgttgatgtcttcaaaggaaactaagagtatggtttggcatggtgagaagaataacaatgatgaggtgatgaggcatcctagagatccagaggcttggaaaacttttgatctaagatatctgaattttgcttcagatcctcagaatgtgtga

SEQ ID NO: 31452 - DNA, 864 bp, Glycine max
  Peptide Sequence Number=SeqID_148230
atggaggatgaggtagtgaagcctcaaccacaaccatggtgtctagctaaagacgctgaaggtgaatatgttgaattccaagtagagattgctaggaggtgttggacacagcttgcagagcccatgcctaaatatgaccctaaaattgtcatgggattttatgcaaatgcttggcctactgaggagggtgtcatggataagcactccaaagtgcggggccaatggattccttatcacacaaatgccatcaaccaatttttagggaatccattgatcttggaggaggggcaacaatggcgtaattttgtatggagcatggcagggaagcggttgcaaatcattaatatcctcccgagtgatcacaactatgatcttaccctacctaaatgccagctagtctacagcattatggggcagattagtgttcaagtggcccatctcatcttagatgttattcatcagtttgttggtattgagcctcctaggcacccagtggacccagaaaagtccaatagagcactgggatttcctacattgattacgggtacagcaaccagtgcaagatcagcaacatcagccggcagcagatgcaccaccaccacctccacattagccaccatccttggagtccatctcagtcacacatacatgcatcatttggctaaccagacccatcctagcccttacccttggcctactcccaagcagtttagggccactattgcatggcctggagataggcctatttttcaagaggaggcgggacctgcaagtgctcaaggagctgcccaaggagatggaggaagagttgaggatgatgaagacatggcagatctggttgattatctcattggaggagcctga

SEQ ID NO: 31453 - DNA, 378 bp, Glycine max
  Peptide Sequence Number=SeqID_148231
atggcaccagaggacatggaaaagacgaccttcatcaccctatgggggacgttttgctacaaagtgatgtcctttgggctaaaaaatgcaggggcaacctacaaacgggctatggtagcattattccatgatatgatgcacaaagaaattgaagtctacgtggatgatatgattgccaagtctaaaaccgaggaggagcatcttgtcaacttgcggaagtttttcgaaaggctgcgtaagtaccaattaggattgaatcccgccaagtgcactttcagggtcaagtcgggaaaattgctcggttttatcgtaagcgagaaaaggatagaggtggatcccgacaaggtgaaggccatccttgaaatgcctgagccatga

SEQ ID NO: 31454 - DNA, 336 bp, Glycine max
  Peptide Sequence Number=SeqID_148232
atgggatcaaatcaagttttttcattcaccaagaggttcacacatgttaaggttccgacgctcgacttatctggtttgaaagcactaaaacaattgatgacaccacaacagcaccaagattttgtcggtacatatgggaagattcttgacttggccatgatagaagtgcctacagctgccattaccgctttggtccagtattatgatccgcggatgcgatgcttcacttttcaagatttccacctagtactcattctttgggaggaaccaagcctttcttccccttgggacactctccattcgtacctagattatccaaagtgttgggaattctag

SEQ ID NO: 31455 - DNA, 2082 bp, Glycine max
  Peptide Sequence Number=SeqID_148233
atgcctcctacatactttcctcttcgttgggagagcactggggaccagtggtggtatgcatcaccaattgattgggctgctgctaatggccactatgatttggtccgtgagctgctcagaatggacagtaatcaccttttcaagctcacttccctgcgccgaattcggcgcttggaagtggtgtgggatgatgaagaacaattcaatgatgttgcgaagtttcggagcgaggtggcacagaaactgcttcttgaatctgagtccaagagagggaagaactctctaattcgtgctggatacggtggatggctaatgtataccgctgcctcggccggggacttaggttttgttcaagttcttcttgagaggaactctttgctggtttttggtgagggggagtatggtgttactgacatactctatgctgctgcaaggagcaagaattgtgaggtttttaggctgctatttgattttgctgtttcaccaaggtttttgagtggcaaaggtgggatggtggaggagcatgttggggacattccttctgtttacaggtgggaaatgaccaatagggctgttcatgctgctgctagaggtggaaatctgaagattttggaggagcttcttgccaattgctctgatgttttggcttatagagatgctgatgggtctactgttttgcatgcagctgcaggcagagggcaagttgaggtagttaaataccttacatcatcctttgacatgatcaactccacagaccatcagggtaacactgctttgcatgtggctgcttccaggggccaattacctacagctgaagctctagtctcagcatttccctcactgatctctctgagaaacaactctggagaaatttttctccacaaggcagtgtctggttttaaatctcatgcattcagaagattggacaagcaggttgaacttttgagaaacatgctaagtggtaagaactttcatttggcagacatcatcaatgtcaagaacaatgatggaagaactgctcttcacatggccatcataggcaacattcacactgatcttgtgcagctcctgatgactgcaccatcaataaatgtgaatatatgtgatgttgatggcatgaccccactagattaccttaggcaacaccccaaatctgcatcatcagatatactaattaaaaaattaatctcagctgggggaatgtttggttgtcaaggccatagttcaagaaaagccatagcatcacacttgagaatgcaaagcattggaagcagtcctgggacatcattcagagtctcagacactgagatatttttgtacactggcattgagaatgtgtcagatgctagtgctgctgatcatggaagtgggggaatgagttcatcttcatcagaacacattccatacgatccgaatccgaccgagaatcgcgtaccaatcgcaaccaaaaggcatagtactgtcaaccatgcagcagcaaggttgaagagagttcttctgtggcctagagtgaaggacaggaaatctgaagggttcaagaagccttgtacaacagatgagggttcagtggactcatgcaggaaatggaataacagctttgatgaaactccaacaccacttagacaaagattttctaggccatcttcacttcccaacaacaaaagaactctttctgtcaggagtcaccaatcaagtccaaatgccaagaagaggtttgcttcaggactagtgcatggagtcatgcaatcattgccacatgcaaaggtttctggcagatccaggtctagttccttttcaaagtcatcaatttcttcacctagatcaatagacaagcaaaagggaattttcattgacaatgacatcgccgggccgtcttgttcaagtgaacaacaactaccaccaccaccaccaccacaacctgatgatgatgaatcaccaaagttggtaaagagaacttctgttggaaggaagttgaggggccattatttctgttttggtgcacctggccttaatgtcaaaaactcagttcacaggcagcaagaaagccagagttacaaggctcatgttgttgcagtggcttaa

SEQ ID NO: 31456 - DNA, 219 bp, Glycine max
  Peptide Sequence Number=SeqID_148234
atgttccaaggagtaaaaggggttgtttgtttgtcattgaatttttctcaatgttttgttaagatggatgaagatcagtggatgcatgacaacataatgtttgaaaaagtttatatgaatgaagaaaatgaagaggaacccagtgtgaatggagaaactggagaggaacctagtgtgcatcaaaacgttgattgttttgatgccttcaatacttcttag

SEQ ID NO: 31457 - DNA, 258 bp, Glycine max
  Peptide Sequence Number=SeqID_148235
atgtcaaaggttgaaggttccaagtacaaggagcttaggcgacatatgaaggaaagaagcttgacaaacaaagttaatcgaagcaagcaagaaataaaatcaattattggcacaaaatcaatcatgcaaaaggcatttgaaatgaaagaagattcaaaatctggtgaatggcccgatgctgtggaagtttggaaggccacacacatgagatctaatggaatttggtgcattccaaaaggagaagaaatgatggattga

SEQ ID NO: 31458 - DNA, 291 bp, Glycine max
  Peptide Sequence Number=SeqID_148236
atgacttcgtcttcttctctcgtgtgcctcttctacttcatgttggtggctgcttcctctcccgctgcagcttcttcttgttgggttcatcttcttccaagcagaccccatgacacatcaattctgagatattatgaaaatcacattactctgagaacctggaatggagaggaacgtcctgagttgaaggtatcttcccatggaaggaagatggctaagttcaggaggctggctccagagattgaaggccttgtgggtactagtagactaagtcctttgatcaaggactaa

SEQ ID NO: 31459 - DNA, 609 bp, Glycine max
  Peptide Sequence Number=SeqID_148237
atgagtgactcaaagaaatgtgggttgtacgttgaagaaaatccttcctgcctggttgccctaggaagactttatgaagggtccacaaccgttcacaacatgcctttgcgccatgatcaactcaaggttgatgttgaggaagttaaagatatttttgtacccactcaagaggttcagctagtggggcagacacttaatacctttgttacttggccgatacatcttgtaaagcgtttactggaacaagttatgtgggatgctaccatgtttgggaagtttaatgacgacttccacttgtatataaagcatgaagatctgtccgaaatagcacacggtggtcgatgtctcaacatctctgttatacaattattgatttttgcacattggcaaatggtcgtcattttgcctaaggaaaatgttgtcatctggttttgttcgtttcataataggccagacaactacctcaagggaattattaacagtgctttgaaaggacttgacgatactccacaaagtaaatccaagactgctactaagtggattgttgttaaagacaaaaaggaagcactgaatgtgggtattacgtcatgcactggatgtcaactataa

SEQ ID NO: 31460 - DNA, 2103 bp, Glycine max
  Peptide Sequence Number=SeqID_148238
atgcttaaaaaagataactttatctggtccgatgcagcaaaactggcttttcagcaattaaagaagaagcttactgagactccagttttggctttacccgactgttcaaaaacctttgtggtagaggtggatgcttcaagtttgggaattggagcagtcttaatgcaagatcaccaccctatagcttacataagtagacatttgaatcatcaacaaaagtcttactctacttatgaaaaggagttactggctgtggttatggctgtccaaaaatggagacattatttactgaatactcattttatcatcagaattgatcatcgaagcctgaaattcatttcggatcaatggactacggcatttcagcaaaggtggttgggacatgataatgtagctgttgatgccttgtcgcgagtggaaccagttgcttgtcaagctctcgcagttcatcaggtggtttcagaattggtgataaagattaaaacttcttgggattcagatcctgcagttcagaggttaatttcagaattacaagcaaactctagttctcacaaacattattcttggaagaatggggagttaatgaggaaaggaagactagttgtgggtagagatgatgctttaagacaggatattcttctgcattttcatgcttctgctgctgccggtcattcaggacgaaatgcaactttacaaaggctcaaatctgtggtctattggaaggggatgagtaaagatgttagagctttggttcagcaatacagtgtatgtcagaagtgtaaatatgagaccaagacttctcctggattgctgcaaccattgcctattccggatctaatttggcagcacattaccatggattttatagaaggcttgcctagttcctttggtaagcaggtgatttttgtagtagttgacaggttgagcaaggcagcccactttatggctctttctcatccttattctgctgctgatgttgctcaatccttccttgatcatgtattcaagttgcatggatttccagattttataaccagtgacagagattcaatatttctcagtcagttttggcaggaccttatgacttttcaaggtgttcaggtccaactctccacagcttatcaccctcagacggacggccaaacagagattgttaataggtgtttggaaacatatttgaggtgtatgtgtgcagattcaccctctcaatggtctaagtggttacccctggctgaatggtggtataacaccacctttcacagctctattcgagctgctccttatgaagtggtgtatagacagtcgcctcctgtgaatcttccttacttagcaggagcttcgaagattgagttggtggatagaagcctcttgaagagggaggagatgctgaaactcattaaatttcacatgaagagggcccaggatagaatgaaacagctggcagataaacatagatctgagaggcagttcaatattggcgatatggtctatgttaaattgcacccttaccggcaaatttccgtagctgccagaagcaatatgaagttgtcccccaagttttatggcccatttcagttgaagaagcatgtaggtgaagcagtaacttcttcgagtctcccatgtttagtagaaggagatcctttaatcaaagaacctgaagctattttggatcgcatgacagtaaagagaaggggtcgagctgttactaaggtcctagtaaagtggaagcatagcttgccagaggatgcaacttgggaatttttctttgatttgaagcaaatgattgttgtgtggcagactgataaggcttcaatgcttgatgaagcaattgaatatcttaaacagcttcagttccaagtacagatgtgcaggcaagactcatttctgcaccagcatctaaatgcaaaccattcagataccaatccattaggttgttctcaaggcacattggctacagcatcactttcctttgatatgcaaccatctgcggttaaggacaacagcacttcgcaaaattttatcactggaagtgatcagtcaggagtgatactgagaaatagtgagcccaacattgttctgaccccgaggttaagtggaatgtaa

SEQ ID NO: 31461 - DNA, 894 bp, Glycine max
  Peptide Sequence Number=SeqID_148239
aagaagaagaagaagcaattagagggagagttagtgagcaaggtggatcgaaggcaagggaagaggtctctccctcctcatgaggagaaaaaagaagctttcaactttcctattattcatccaacaccatctcaaaatcgaaaggaacaagcttcaccatcacccttttcactcctcatgagtaacaacaaaaacaacaccttcttccccaccccacatggccaaataagcacttctgaatttgttaatagccaaaatccgccccaggctacaaatcaaggcattgatgatattaggaaaaagcactatagaggagttaggcagagaccatggggcaaatgggcagcagaaataagagaccctaagaaagcagctagagtgtggcttggcacctttgacacggcagaggctgcagctatggcttatgatgctgctgcattgaggttcaaaggaaacaaagcaaagctcaattttcctgaacgtgttgttatgccaataccatcacaaaccaataccaattacaataataacaataccacttcttcatcatcagctcctactacacaaccttcttctcttccaccaccaccatcacaatctctacaaaatagtagcaataataatagttctctttcatcagaagggtttccaaatcttgaggagtatgcaaggttgctgaattgtagcgatgatgatgactttcaacgtgttgcattggggctctaccagcatcacaataatgaggattatatttatggttcatcacaaccaccaccagtgccgttttttgtgtcttcttattcttcttcttcttctgcaatggcatcttcattttctgattttcttggtcaaggagggagtggttttgatgaagagaataagagggggtcgtag

SEQ ID NO: 31462 - DNA, 768 bp, Glycine max
  Peptide Sequence Number=SeqID_148240
atggggaataatgagggacttattcatatcaccgaggaaggaaaagggggtaaaaacaatccctcttatgcaaatgggtcagtaaaaggggattggttagaatcaagaaggtcagactggttgtttaggtcaaatgacgacgacgatgcgggcaaaggagggtcgtggaaagtgagctatgatccaatggacaaagaggttgtccttaaatcctactttgaattgggagcatgtctacctaattttcatgaacaagggtggataaaggaagttggtaagaaagaaaaagagagaaagcatgaaaagggtgaaagcacttcaacagaggctagtcaaactggaaagctaagtcctaagactgacatgatagtaaggggtaaggatatacacggtgaaggagattgggatagtctacaaaatgggccatgtaagactaatgggggcccaaaccacgtggagatgggaaagtgtggaaataacgaacaagagggaacatgtagccatacgaaggggagtgcgaatgataagtggttaccatgggtgggaaagaaatttactagggcgagagcaggaggtggtgctataagtagattggataaggctttggggatgcttacaatcatcatccatatccattcttgtgaaaggaagcccaatggtagaattcttggcaaaaaaatgcataagacaaggagagccgctaacaccattcctattcttggtggttgcaaaaggattaagtgggttggtcagagaagtggaaaataa

SEQ ID NO: 31463 - DNA, 255 bp, Glycine max
  Peptide Sequence Number=SeqID_148241
atggtggcccttcttaaggctcaaggtatcctacacgttagcctctacaatgctgacgaagccatgcttcacaactgggttgcacgcaatgtcatagctcatgtccctgttacccttgttaagttcttgcaatcaacaggcatatcattaacaatacatagtgggactcctaagcaacctggaattgcacttagcacgtatatttatgagctttatattgaaaatataagatcagatctgtcagaaaataactaa

SEQ ID NO: 31464 - DNA, 246 bp, Glycine max
  Peptide Sequence Number=SeqID_148242
atgataatattgagggtagataatggaaatgtttcaatttcaactctcgggttattgtacagatcgagagttccagatggttgtgcatatgcaccaacagcctgggatggattgttctggctattaacaaattcagaagtagttatttggccatgtgggagggggaagaaggtggtgttttggttggtactcatgaggagtgaaaagggtgatgatgatggtgaagcttgttcctttcgattttga

SEQ ID NO: 31465 - DNA, 219 bp, Glycine max
  Peptide Sequence Number=SeqID_148243
atgaagacaccctttactgcatttcgtcacagcatcacagtaaatgaaagaaaaagaaaaaccttagagaaagagctttggaaggtagaaatgcgagaaatgaatggaggagttttggaagtgagaatgagaaatggaatcaaagggaaggtgtgtgtggggcaacgatggcggcactcctctttaatttatgtcttctcactcaccccacacgcatga

SEQ ID NO: 31466 - DNA, 207 bp, Glycine max
  Peptide Sequence Number=SeqID_148244
atgtcaaaacacaccacctgccagactaccatggaccgcctcgaagaggcagtcaactgtctcactcaagaccaacacaccctcacccataatctatccaccttgatcactaagtctcaagagttggccgctaagcttgacgtcatccttgatcggttatcaactttcacaaccactccatcatcccccaaatcacctcgtctatga

SEQ ID NO: 31467 - DNA, 214 bp, Glycine max
  Peptide Sequence Number=SeqID_148245
gggatacacctactcccctcgagatgcgaacaaaaacacggaggagaataagaagtggaggagaaatgtgcgccacctagcaccactgcgagatgtgaacaaaatgcgggggatacaacaaggcacgacagcgatgagggagaggggcttacctatcaccactgtggaggagaacacaccttgcaccacaatcgcaggggagaaaaatgtctag

SEQ ID NO: 31468 - DNA, 1656 bp, Glycine max
  Peptide Sequence Number=SeqID_148246
atgactcgagatactattggaggaagcttgcaagagggtctgcaagatgcagcctcagttggaaatacaaatggtttcaagattaatgtaaatagtgttcttcaaatttcatcatctcaaaggggacttctgagcgatgaaagccatcatataaggaaacaaaaaatgttgacatctattgccaatatctttaaactacagagactcacactcacaccccatgctaattcagcttctccatctgctaaacttaggaagaagactgaggaaagatatgaattctcacattttgtgccttcatccatcagggaaaacttgagaaaaccttttaattgtttttttgccaagaagattgattggccatctctaaggagaagctgcaaacaatggattaagaatcctttgaacatggccattcttctatggataacttgtgttgctgtttcaggagcaattctctttcttgtcatgacaggaatgttaaacaaaatccttaataagcagtcacaaaggaactcatggtttgaggtcaacaatcaatttctcaatgctctatttactctcatgtgtctataccaacatccaaagcggttccaccatcttgtgcttctttgtaggtggaagccaaaagacatcataatactaagaaaattatactgtaagaatggcacttgcaagcctcatgagtggttccatatgatggtggtagttgtgttactccatgttaattgctttgctcagtatgcactttgtggccttaattggggtttcaatagatctgaaagacctgttgttggggttggtatatgcatctccattgcaattgctgctccagcacttgcaggagtttattgcattgcaagccctttaggaaaagaatatgaaactgaagaagcagcacagaatcatattcccactagtaacacatttgcttcaagaaatgatcatagtcttgttgagtacacacctcaatggagagggggactatttgatctttgggacaatctttctgtggcatgtctcactctcttttgtagtttttgtgtctttggaaggaatatggaaagacaaaattttggtaacaagtatgttcacattgcaactttcctcctcttctgtgtggctcccttttggatcttcaacatggctaccatcaatattgatgatgaaccagtgagattagttctggggttattgggtatatttctttgtgtgtttggtttactctatggtggctattggaggattcaaatgagggaaagatttaacttgccaccaaataaactttgttgtggaaagccagcagtgacagattgcatacagtggctattttgttgctggtgttcccttgcacaagaagtaagaactgcagaatcctatgacatagttgaagacaaatttttctgcaaaaaacagactcaaagttgtgttcagcttgcactgaactcattgcctcctgaagataaagctcctcaagttacatcaatgtccacttcttcattttggagcagtcatagtttcaacaagatctggtctgaagagtcaaaagatcattcaagtctctcagaaattgagttttcaagagaaagaaaacaaaatgttatggaagtgcctattcctctaacaattcaaattgatgataatgatatcaaatga

SEQ ID NO: 31469 - DNA, 822 bp, Glycine max
  Peptide Sequence Number=SeqID_148247
atggatggcctctcagacaatatgacaatgccaattaatttaaaagcaaaagctgttgttgcagctcatgataaagatataaattctgtagctgttgctccaaatgatagtttagtatgtagtggttctcaggatcgtacaacttgtgtttggagacttccagatctagtatcagtagttgtatttaaagggcataaaagaggaatttggtcagtagaattttctcctgttgatcaatgtgtagtaacagcatctggtgataagacaataaggatatgggctatatctgatggctcctgtttgaagacatttgaaggacacacttcaagtgtgttaagagcattgtttgttactcgtggaacacaaattgtttcttgtggtatgaggctatctgtagctgattttgttctttataacattttggtcgtggaaaaagcaagaattcgaagaataattgaagccgaaggaattccatacacttacctatgttgtcatgcctttactggtcataatggacaattcattcaggaatttttttataacatttacctttatcttagtgacattggagtatttcaagcaaaaagcattacctgttccatatgtgaagagggagttgtgaaaggtcaagagctagagaatgctgtctcagatgctgactatactaaagcaatccaaatcgcatttgaactgcgcaggcctcataggctttttgagctatttgcagaactttgcaggaagagagtggctgaaaatcatatggacagagcacttaagggcttgggtggtgaagagcttcgtatattatttaactatatttga

SEQ ID NO: 31470 - DNA, 507 bp, Glycine max
  Peptide Sequence Number=SeqID_148248
atgaagcacatatctagctccattgaaatttcagaaatgggagcagagaggcacgagaaagaggaaatgcataacaaggcaactgtggaagcactctacaaggcccttttagggcaaggccaaatggacacggttgcaacaaacatgctagcaagtgacctcgagtggtggttccatggcccccctcagtgccagcacatgatgagggtgctcaccggagagaccaccctcgacaacaacgggttccggttcgagccaaggagcgtcaccgccatcggcgattgcgtgatcgccgaggggtgggaaggcaaggcctactgggtgcatgtttggaccgtgaggaatggccttatcacgcagtttagagagtacttcaacacatggcttgtggtccgggacttgaggtctcaaaggtgggaaaacaagcttgacaacatgacattgtggcaaagccagccgcgtgatctatatcgtcggtccctgccaggacttgtgctagccatttag

SEQ ID NO: 31471 - DNA, 444 bp, Glycine max
  Peptide Sequence Number=SeqID_148249
atggctatgagaccatcctcatcttcatttagttacagattcacctatgacatgttccttagcttccgaggggaagatactcgttgtggtttcagtggcaatctctacaatgcccttcaggacaggggaattcacaccttcgtcgactacaaggagctccaaagagggcatgaaatcacatcagcacttgagaagggaattgaaattcttcggatgtgcgacaccacagaggtagtttttggagaggcattggctaatcatgaaaagaagttcaatgcaaataagatgggtttcaaacataacatggagaagacagaggcatggaagatggctctgcatcaagtggctaacttgtctggctaccatttcaatgggtaccattacaatcttttaacttattttttacactcattcattaattttaactcttctaatgatatttaa

SEQ ID NO: 31472 - DNA, 255 bp, Glycine max
  Peptide Sequence Number=SeqID_148250
atggatgagatcatcgtaggagaaatgttggccgttggcgacatcgatgaagacgcgaaggttgcaaaatctcccacggcaagggaatctcgtgaggatggtgtgatgagggttagggctaggctttggggtttgcggaggggctttgaaccccgcgagggatggtggcttcgaggagtggatgctgaagaggtagatgatggcgaggactaccaggtggggacgtgggggtcagaggagaagaatgtgtcatag

SEQ ID NO: 31473 - DNA, 123 bp, Glycine max
  Peptide Sequence Number=SeqID_148251
atgcaagtaggaacaactgtggatactttcctcaagcaaaatttgagagatcccaaaactggtgaacttgaagccctgtcttttgattttaatctatgtcaagctgtggctacatgggaacag

SEQ ID NO: 31474 - DNA, 279 bp, Glycine max
  Peptide Sequence Number=SeqID_148252
atgatctttgtacaagtgaaagggaaaggaaagagtagcaagcacttgcatgttgaggagaaagaagactttattaccatggatgacaacaagaagtggatgcataaggaaactgaaagatgctacccaagttcaaaggaaattgtggacttgagtcctgcctacctaggtgatgatgtctttcattatcaatccatgaaatttggtgaaggtccaacttctggaattttagtgcatgttgagttgacagatgctacagataatctccacattggctga

SEQ ID NO: 31475 - DNA, 747 bp, Glycine max
  Peptide Sequence Number=SeqID_148253
atggctcaaagagtctcaaccaatattaaaaaagttgcaaaaatgattgatgaaggtactgccatggaggattcgttaaaagatattcatggtctattttggaatattagaggtgataacagtaaaagaacttggagactcattcatgatattgtaaggtgtcacaaacgttctttattgttgctttatgaaacttatgttgcttttgttgtcactgaagctagacggaaagctattgactacaaacatattttttgcaagaggctagagggcactctgatgaatgcttcctggagatgtactgtagtgtatgcttcccttatcccttctattcgtgcttcccttttggatcacttacttcatttacatcaatccttctctattccatgggctattcagggtgatatgaatgagattttattggcttctgaggtgatgggtagctccttctcttataatagagttgttgttcttgctaacttcatgtctgattgtggcttaatagaccttgatagtgttggtggtgtttttacttggcacagacatacttctaatggtgttcatatccataaaagacttgatagatgcatgacttggaataatgttctcggtaatgccattgtgaagctaggaaagattacggaggaatcaaattatttcaataaggaaacctttggaaatatttttaggcataaatgccatctcgaagctagattgagaggtgtccatagagttcttgatacttag

SEQ ID NO: 31476 - DNA, 177 bp, Glycine max
  Peptide Sequence Number=SeqID_148254
atggagatcgatagagaccaggttgtggtccatgataaaaaccatagggtaatggacctaattgctggggtggtggtagtatgggtgtcgtgtcggtgtcggacactgacatggacgcgtgtcgaacatcaaacacgacaagaaattgaagtgtccatgcttcataggtttttatag

SEQ ID NO: 31477 - DNA, 318 bp, Glycine max
  Peptide Sequence Number=SeqID_148255
atggaggaagggagagctgggacagttcaaattttgtggaaaaaaagtatggaacaaggtggtacctttgaaaatgttgatactggtgtgagaggtgctgtatcggatgaagtaggtgtatgtgtaggctacaattggatggctgaaaatgtgaaccccttgttttatgaatttggttgggagagtggtattaaaggagaggattatgaagttatttgctttttatcagatacattgatgctagacgtgatcagttttctaattgagatcataatgctgagcagcattatcatcattatattcaggatcactgtttag

SEQ ID NO: 31478 - DNA, 1206 bp, Glycine max
  Peptide Sequence Number=SeqID_148256
atggaggaagcaatgcgacgtctaaacggggtagctccgattctcggacccgacccgaaagctgacggaggagtcgtcgctgataacccgaagcgttcctccgccgtgaacaagagggccttaagagaagacggcggcggagcgatgaggtaccgcggcgtgaggcgcaggccgtgggggcgttacgcggcggagataagggaccctcagtcgaaggagcggcggtggctgggaaccttcgacacggccgaggaagccgcctgcgcctacgactgcgccgccagagccatgcgcggcctcaaggctcgcaccaacttcgtctacccaacttctccgcaaccttcttccgccaccaccgaacacttcttacctaacttcaacaacagcaacaactttcacaaacactcagtcttcaatcaccaccacggtaaccgccacataaccggttccaccacctgctttgaccagcctcacgccgttgactttttagctccgcgaaactcttcttcttctgctctcaacatgcttctctttcgcgacctcgttcactctaacccttctttgctttcttcttccactactcataactttcacgatcagttttacagcaagggtgcttctactttttcgtctttacctggtgtttcttcttcttcttcttctcttgttccttgttattcggtgaacaattcttgtggaggctcttcatctgttaagatgaacactcactgtggaactaatttttctgaaaaaggtgatgatggtgatggttctgggtttttctctcgagagtcttcggattcggggttgttggaagagatagttaacaagttcttgcccaaaacgaagcctaataaatgcgagagtctgccaaaaatggagacttttcgcaaccctcaggaggagtcgcttcttctccctccgcttgtttctgaatcaacgcttgtttccaccgcgcaagaatgctatgatgatgtcacgaagaaggggtttctgaagaacgacagtttaggtgttttttcttccgatcatcaaggttttcccatgcagcaattcgacgcctttaatgggtttagtagtgtgcaggctatggctctggggaatgaacaaatcatgatgaatcatgcagagaactgtgttgttgaagatgtttttcagtaccatgagcttcttaatgcttttgcaatcagaatgcaaaatacttaa

SEQ ID NO: 31479 - DNA, 1053 bp, Glycine max
  Peptide Sequence Number=SeqID_148257
atggctcccgtggactctgacactttggggcgccattctctgattccgagctacctctattcctctccctcgccgcagaagaagaagatggaggcttcgagtttcgccattcattctccgagagagaatcgaaatatagagatgttttcgccgtcgttctatgctgcttgcaccgttggtggaagcctcagctgtggccccactcacaccggcatcacacctcttgacgttgtcaaatgtaacatacagattgaccctgtcaagtacaagaacaccagcactggatttggagttatgtttgaggagcagggactaaggggctttttccgcgggtggggacctacccttgttggttacagtgctcagggtgccttcaaatatggattctatgagttcttcaagaagtactattctgacatagctggtccagagtatgcaaccaagtacaagacattgatctacctagctggatccgcatctgccgagttgattgcaggtgttgctctttgcccatttgaggcagtgaaggtcagagttcaaactcagcctggtttcgctagaggcctggctgatgggctaccaaagttggtcagaactgaaggagtctcagggttgtacaagggaattgttcctctatggggaagacaagttccatatacaatgatgaaatttgcttcatatgagaacatagttgagatgatttataagcatgccatccccaaaccaaaatatgaatgcagcaattccctgcaactaggtgtgagcattgtcagtggatacatggctggtatattgtgtgccactgtctctcatcccgctgataacctcgtctctttcctgaacaattccaaaggggcaacggttggtgatgctgtaaagaagcttggattatggggtctgtttacccgtggtcttcctcttcgtattcttatggttggaactctcactggagcacaatggggaatatatgattcattcaaagtttttgtggggctgccaaccactggtggtgttgctcctgctgctgttcttgctcccgcttctgctgcttag

SEQ ID NO: 31480 - DNA, 375 bp, Glycine max
  Peptide Sequence Number=SeqID_148258
atggagagaatatatgcccagaatattacaatgcagaatttacagatagcaggaagaaaccaagcagatgatgaaaagaataatggtcaattacttgactatctgcatcctgttttcagctcctggatgcacttttgtgcagtgcgtgtatttaccgagagcattctgagatatggtcttccaccatctttcttggcatgtgttttagctccatcagtcaaagcagagaagaaagtacgttctatccttgaagggttgagcgatagctcaaacagtgcttactggaagactgaggacgaaggagttgggatggctggcctagcaggtgatgctgatgcccacccttatgtctccttcactatcaatcttgtttga

SEQ ID NO: 31481 - DNA, 372 bp, Glycine max
  Peptide Sequence Number=SeqID_148259
atgttagcttaccctggttatttgatcaaaaagttctccaccttcataggattcaagagccatgtcttcaccgatgtaaaaggaaaaagggaaaaaaataatttcaaaataaatataaaccaacttggcaaacaaggggagcaaaaggaagagttgagaaggtatcagagaggaatccactcagcgagtggcacccgcttagcgaggcatccaacttgcttagcgaatggggaaaccctagaagaggataagccagagatgtactcatccaacacgcaaccagcttgtccagcgaggatgttgtctcttcttgcacttgacgcgcccactcgcgctaagcgaaaattcactaactctcgcttaacgagctag

SEQ ID NO: 31482 - DNA, 864 bp, Glycine max
  Peptide Sequence Number=SeqID_148260
atggcgacgagatattgggtagtgtctctccccgttcaaaattccgcatccactctctggaacaaattgcaggaacaaatctccaaacactccttcgacactcctctgtacagattcaatatccccaatctccgggtcggaaccctagactccctcctctccctcagcgacgatctcgtcaagtcgaacagtttcgtggagggagtgtcgcacaagataaggcggcagattgaggagctggagagagtgtcgggcgtgatgagcagtggtttgacggtggatggagtccccgttgattcctacttgacgcggtttgtttgggatgaagcgaggtacccgactatgtcgccattgaaggagattatcgatgggattcacggtcaggtggcaaagattgaggatgatctcaagtgcttatcctacacttgcataaattcaacagagttgctaatgcccatcatgccaaatggcttttcattggagagtcatcaaccttcaggccttctcttgctagtagcattcttcatgaagttctctgttcgtgtttccgagtataacaatatccgcagtcagcttaatgccatcaaccgaaagcaaactggaagcttagctgtccgtgatctttccgacttggtaaaacctgaggatattataacttcagaaaatttaactacccttctggcaattgttcccaagtattcacagaaggattggctctctagttatgaaatcttgacaaactatgtggttcccaggtcttccaagaagttgtatgaggataacgaatatgctctttatactgtaacactcttcagtcgtgttgcagacaattttagaactagtgcacgggaagaagggttccaa

SEQ ID NO: 31483 - DNA, 1722 bp, Glycine max
  Peptide Sequence Number=SeqID_148261
atgaattgttttcctgatgaggtgattgggcacatatttggttgcgtgacttcacaaagggacaggaatgccgtgtctctggtgtgcaagaactggcacaggttagagagatgttgtaggaagagtttgttcatagggaactgctacaccataagtcctgagagagtgatagagaggttccctgagctaaggtccttaactttgaagggaaagcctcattttccatattttagtttggttcctagtggttggggtggttttgtggctccttggattgaagcattggccaggagcagggttgatttagaggagctgaggttgaagaggatggtggtctcagatgagagcctggagcttctttcccgttctttcgtgaatttcaagtctttggttcttgttcgttgtgaagggttcaccaccgaaggacttgcagctatagctgcaaattgtaggttccttaaggatctggatttgcatgaaaatgtagttaccgacctcaaaggccagtggctaagctgttttcctgattgctgtacatctcttgtctctcttaattttgcttgccttaaagggcagattaatgcgggggatctcgagagacttgtggccagatctcctaaccttaaaagcttaaggttaaaccataccgtgcccctcagtgcactccaaaggatattgatgcaagcacctcagctagtggacttgggtattgggtcatttgtctttgatccacgttctgaggtctacaataatatgaagaatgccatcttaaagtgcatgtcaataaccagtttgtcaggatttttctgggtttatcctcactgccttagtgctttatatcctgtttgcatgaacttaacaaccttgaacctgaggtttgcagcaggaattcagaacacagagctaataaaactaatatgctgctgtgggaaacttcagcgtttatcgataatggattgcattggagacaatggactaggtgttgtggctgccacatgtaaagatttgcaagaactaagggtttttccggttgttcgtgttggtggaaatggccctacaagagtcacagagaaaggacttgttgcaatctctatgggttgccctgagcttcactcattgctctacttctgccagcagatgacaaacgccgccctcataactgtggctaaaaactgcccaaatttcatccgctttaggttgtgtatccttgatccaacaaaacctgaccctgatacaatgcagccactcaacgaaggttttggcgcaattgtgcagtcttgcaagcagcttcggcggttgtcactctctggccagctgactgatcaagttttcctttacattgggatgtatgctgagcagcttgagatgctgtctgtagcatttgcaggagaaagtgacaaggctatgctctatgtgttgaatggatgcaagaaaattcacaagcttgcgataagaggtagcccttttggtgactcagcgcttctgatggatgtagggaagtatgaaacaatgcaattcctttggatgacgtcctgcaatgtcaccgttggagcctgcaaggcactagctgagaagatgccaagactaaatgtggagatatttaacgaaaacaaaaaggtagatcgtgatgtggatgatggccagaaagtagagaagatgtacttatatagaacactggctgggagaaggaaagatgcaccagaacttgtatggactctgtag

SEQ ID NO: 31484 - DNA, 441 bp, Glycine max
  Peptide Sequence Number=SeqID_148262
atgttcacaatcaaaaatataattgccactctaccaggagaattagatctaaagggaaataacaaacaaagccacgaggacagactagcacactctaaacaaaaaagccagactgcaaaaataaaaataaataaaagcctcgcaggaatgaaaagcacccgggctcatcgtggaggtgatgatgatccacgtgctggtaatggtagtgcggcggcggaggtggcggtggacgcccgttgtcgaagtagccctggtaggagtcatacggcggacgctgcggcggatgcggtggagggtacccaccatatcccggaggcggcggcggcggagggtacccttcatgaggcggcgccgatgggtaacccggttggggtggagggtaaggagatccgtgccctattcagaattcaattgaacaaattaattcggcaatctcattga

SEQ ID NO: 31485 - DNA, 255 bp, Glycine max
  Peptide Sequence Number=SeqID_148263
atgagtcaagtcatgcccaaaggaagaaacatgctgagtcatgcagatcaatcaaggttgggtggtggtagcagcgtggtggtggtggaggtgacaaacgacgtggagtgtggtggcaatagtgatgataatggtggtggcgatgatagtggtatggtgatgttgtgtagtgaggtgatgagttcttccaagattagtcacggttcaagtcgttggacgcttgcttccataatcaacaacaagtgcaacatgtag

SEQ ID NO: 31486 - DNA, 303 bp, Glycine max
  Peptide Sequence Number=SeqID_148264
atgactaattttgcacgctgttttcaaatcatcattgtcacgcgtgccttatggagtgatatgggagttcggcctgagaccgacaccttgacacctaaatttgttttgccccagatatcaagattgggttcccacgataaaagaccccattggaacacaaccttagacttttttgaaccttggcccatcaaaagaatcctcatcctttccccgaagcaaagggtagcggaatctcctcaagggagagcgaatagaatgctaaaacccgatttcccaaagaagggaatggagaaggagaagtga

SEQ ID NO: 31487 - DNA, 363 bp, Glycine max
  Peptide Sequence Number=SeqID_148265
ggccttggggtttccagcgttgatcacggatctctgccagtcgttcggggttcccgtcacacctagcaaggccgctgacgcaacaccaccacctcatcaggctgatccagctgggtcattcggcatggagcggtatttccagcacttggttcgccagcaggcggccaaccacagggggcagggtttcgctccttttgcgtgccctactctagatcagtttagggctgaggtcgcatggcccggagattggcccgaggaccagacagaggaggcacctgcaggagttccggacggtgcagaggacgcccgcatggatgaggagatgacagatttactcggtttcttgggaagaagcggagccac

SEQ ID NO: 31488 - DNA, 162 bp, Glycine max
  Peptide Sequence Number=SeqID_148266
atggacgtcagtgtcgatgtcggtgtcgtgtcagacaccgaacacggcaagggactggagtgtctgtgcttcatagcatgttctgaatctgcgagtttttcagcttcgtcgtccggtttgccgtcgagtttattatcttcgggctccaacaccgacgaatga

SEQ ID NO: 31489 - DNA, 899 bp, Glycine max
  Peptide Sequence Number=SeqID_148267
atgaggtacggtggaggaaagaggaggcgcgtggcactgaaaccattctttgttctgtgtgtgtcggtgactggttttggacttttggtgctttcgctcaggctcctggatgctcccgctagtagcacagtgcctctctcaagagcttcttcttcttcttcggagttcaacacttcatccaagaatggctcgcgcgtgaaaggcgtcgtggcggttcggcgcgtgggagagaagccatgcaagacggtggaagaaatgggggaggatttcacaagtggtgtcgggaagaaagagtccctcagagtgagaaggatgattcagaatcattttctcgccaacggtgcttcaagagtcagggatttgcccccggagcagttctgtagacatggctttgttctggggaaggcaagtgaggcaggttttgggaatgaaatgtacaaggtcttaactgctgcagcacttagtataatgctaaaccgctccttgatcatcagtcaaaccaggcatattgaaatcaagcatttgtggagacacaaaggttgtgaaagcaaatatgggaggaaactggttataaggattgatgattttatgaaaccagtagaaacaaatgttatctgtagcaattggaagaaatggaagcaacctatcatatggtttcatggaacagtagattctgtggcggcacagtttttcttaaagaatatacactctcagatgagaactgctgctctcaatttgtttagtgacccgcaagttctaggtatacggcctaatgtttttggggagctcatgagggttctcatatttccttcagaagatgttgaggcagctgtcaattgggttattggtggtggggagaatcctgacatctcattgcatatgcggatgcttatgaatag

SEQ ID NO: 31490 - DNA, 318 bp, Glycine max
  Peptide Sequence Number=SeqID_148268
atggtggcgaaggatcctaggcttagggatcccttcctaagcattgtctcaaatcgccgcaatgagaacaatgcgcatcgccctcattgcaacctgagctttgcttcaccgaatttggagttgcttcacttttcagttcaaacatctgataaatactctttacccccaattttcaccactccagtcttcacaaatcttctcaggagatatccaaaccagaggatatggaaatacaaataccaagaaaagacttgcattgttattggagctaattcaagaattggctatgcaattgttgttgagggtcttgcaaagtag

SEQ ID NO: 31491 - DNA, 591 bp, Glycine max
  Peptide Sequence Number=SeqID_148269
gctttgggcttcgatggctgcttgaaagacgcagattgggaagttggctatggtccgtcgtgcattgtgcagacgactgatggcttacgttgccaagagggcattgtgagacaaaggaaagggctgaaaaggatgaccgggctagagtgctgttaccaccggaagaaatgccatgatgctctcttgtggcaattgaagtggaacttcacttcaaggggatgtgatgtctggtgtggcgaaccgtcatcactactgcaggagagagctgcaatgagactcgctgcggaagactcaagcttcgtagttagggcaaagtactggcatgctgctattggtagactgatgaagtcacaaaggctgaattggaaaaagtcggataccttcataagggtttggcatgagttagcgggagactctgtgacggctcactgggccgttccaaggggaggcgaaccctccagtttgcttgacagggttaatctaggtgccctctggctcgcattccgtcccagttccttacctcctttggtccatccaaaagatttgccaccactacttccggagtggaccgctttcgaacaagatggaacg

SEQ ID NO: 31492 - DNA, 315 bp, Glycine max
  Peptide Sequence Number=SeqID_148270
atgactccattgatgaagacgatccaaggcctacaagctccacatggagctacatcattttgttttgaccttttctggaggagcacacatagagtttacatcagggagggcgacgcgaggctcactggtgcgtcttccaagaaaggaaaatgcgtggagtcgccaccaacgtttattcgaggaaaacgtcggaaaaaccggaaagggtgtggtctacgaactttaatcgtgaaaggttcgggagttttttttacgcacggggaaggtattagcatcccacacgtctgtcacaaaggacgacaacctttaatatga

SEQ ID NO: 31493 - DNA, 291 bp, Glycine max
  Peptide Sequence Number=SeqID_148271
gcagatatcctcacagctaggttccctgaccctaacaatggtgttaaaatgggttcctctcggtgtggggttgcaacggaaaacaacagtggtttgtggtggttaatggtggctgtgggtgatggagaaagtgcttgggacgttagaaatggctttggaagaaagaaagaagaagaaatggtgtttttcctaagctacacgaaggcaaaggctgaaaacgctcaagtgagaaatggtctcggacacgaaaacctcccgcacactccagaaatcttctcaaagatcccaaag

SEQ ID NO: 31494 - DNA, 852 bp, Glycine max
  Peptide Sequence Number=SeqID_148272
atgtcttcaaggaaaagaaagagtgtcggttcaaggcccactcctcaatatgatacacgaagattccagtcctttgaggcttggaccagatatactgacaatgtgttgggaagatacatattagttgagaggaaagtggaaatctatcacacagagctgggtgaattcaagggtgagatggagaggcgtaactttcacaagcgcctcaccaacttagctgatagtagcattgacctcgcattggtgaaggagttctatgccaacctctatagtcccgagggaccttcacctaaacaagtcagaatccagagccacttaataacgattgatgcagacaacctcaatgcctttttagaaacacctgtggtgcttgctgagggtcacccgaggaagatcctcagaaaagatctaaccacccttgctcagctggacatgaaggtcggagccctcatttctgggcagattacttctatggcccagtcgaactcctctagactcgggttccctgctcttatcatatctttatgtaggtctagaggagtcacttctgacagcttggtctttgagagtttgagcctggtcattaatttggcctacatgaggaagaattgttggaaccctgatgatccaacaattattattaggggggccagaagaccaagggcaaggccagctgagacttcttctacatcagcaactcctcatctagcttttacatcagcagctcttcctccagctcgtattcctcctcctcacagggacgacgaggatcctaccgctcaggtaccacatcagccggtggatgagtcatcaaagtcttccactcttgagcccttgatcaggaagagaagg

SEQ ID NO: 31495 - DNA, 221 bp, Glycine max
  Peptide Sequence Number=SeqID_148273
gtggccttgttggtgcttgcacgcttagcgcaactctggctcgcttagcgcgcattagtaaatttcggcttagcgctcatcttttcgctcagtggatggactcaagcggtgcgcttactgggattagccctcgcttagagaacatgcacaactcatccttcttccagattctttctcgcactcagccaaaggagtgttgcgctcaacggatggctcgctaa

SEQ ID NO: 31496 - DNA, 390 bp, Glycine max
  Peptide Sequence Number=SeqID_148274
atgcgggatgaaccggaagctgggtttacggtgcccaacttgcgcgctaacctagaccccacaaagggtgttggtcgattaagacagcaggacggtggtcatggaagtcgaaatccgctaaggagtgtcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcgtag

SEQ ID NO: 31497 - DNA, 141 bp, Glycine max
  Peptide Sequence Number=SeqID_148275
atggtaagaaccgagtatcgaactctcggggaacttgtgttatctggcaagctatttcgaaaaataggcgtctggtatttaaactatctaggcaaaaagaaagaaaatcacgcaagagaaatactatgtaaaaacaagtag

SEQ ID NO: 31498 - DNA, 258 bp, Glycine max
  Peptide Sequence Number=SeqID_148276
atggaagttctcgaactgaaaatcaagagttcgttagagacgattaagatctccaccaagacgttcattgttagagagaggatcctttgcgatcatgtcttccatgcttcccaactcaccaaacacattgccaaaatgaagaaaccattgtcggagaaaatcctccatatgattgatatacatcttaggtctgtcgtggcaccacaaagttgcataaggataagggggcgcattggaaaaaagaaagggcatttatga

SEQ ID NO: 31499 - DNA, 294 bp, Glycine max
  Peptide Sequence Number=SeqID_148277
atgaatctcatgaaggccataaaaagagcacagggtgcacagaaatcatgcggcaacacgcatttggccattgatcaattgatcctcggaatcctcgaggactcccaaatcagagagttgctgaaggaagccgaaagtacagaggatcctgctttccatgctatatcacgattaatagcagaatttgagtatcatctgtgcctcattcacactaaatttgatgcctgtctgatgctacatcctggatcaatcggagtgctcactcgtgagatggaaaacaaccctgaggtctaa

SEQ ID NO: 31500 - DNA, 255 bp, Glycine max
  Peptide Sequence Number=SeqID_148278
atgcgccgatgcaagagcctcattggtcttgtgagtaaacttctcaagattctggagggagcgcgtgacgtggatggagaagtggaaactgatgtcgttggcgacggaggggtcgaaggaccaggttttggtgaaggggtggaagatcaggggccgggggagggtcggggagaggttgtgggtggtggcggcagtgagctagtggctgagtcgaagagtcagagaggaagtgcgagagagtggatggagaaatga

SEQ ID NO: 31501 - DNA, 207 bp, Glycine max
  Peptide Sequence Number=SeqID_148279
atgatgatttggaaacaacgttcaaaattagtcatggctacagctaggtgggtactcaagcatccagtttatggcattgtgatactaaggcttgggatttatgcttcctatgaccataacatgccgaccttcgaggacgatgttcctaaaggaaaactctacaaggttccggaatttcaacaaacattatcaacaataacgaagtaa

SEQ ID NO: 31502 - DNA, 150 bp, Glycine max
  Peptide Sequence Number=SeqID_148280
atggttggatttttgtatgctcgggcttcaagggagaaaggagtacaagttaaagtgtttccaaatgatgttcatggaattgaaaggacacaatccgactttgaaagctacattaacattgtgatgtggttcaacaagtattgcaaatga

SEQ ID NO: 31503 - DNA, 441 bp, Glycine max
  Peptide Sequence Number=SeqID_148281
atgactaacaccactacaaataaatcattttacgacattggaataacgacggttgtatcaaaatcgtcattactccagtgggtgttctcgcaagagctgaaagccaaggtggttgcgaaggccaggcagttctcgcaagagctgcggcggttctcatggagccacaaccacagttcgtgcatgctttcgtcttcctctactccaaacgatggtggtgccggattcaaaatggcattggccatgctttggctcacatgcactttcgtcttcctcgaccctggcacgcacaaaacgcttcgcaatttgaaatttatcaacaatagatccagtggcattgatgcttggaacgaggcatacagtttgtctagagaccacaaacctgatcttgagattgagaaggaaagaatcttaaaatctggtggttttattcacacaggatga

SEQ ID NO: 31504 - DNA, 279 bp, Glycine max
  Peptide Sequence Number=SeqID_148282
atgcagtacgcgcagcttctttggagtagggatgatgatgatctacaacgtgttgcttcaggccttcatcatcaacaacatcatcatcatcatcatcatcccaatgaagctttctatgattcaagttcttcaactttgttctcatcatcgtccactacttcttctatggctgtgtctgatcaacagcagattggagatgacacgagtactgctcccaaaaggggagaatattatgactcttgcttttttagagggaatgattttcatgacaagaattga

SEQ ID NO: 31505 - DNA, 1035 bp, Glycine max
  Peptide Sequence Number=SeqID_148283
atggcctgttcaacgccgtccccgagtttcatcggtcttttccatgtcctgttgctgcgctatcatggacattatttatccatgattatgttttcctgtcaagcggccctgttccgcccttctttttctcaggtttttcactacgttaaaggcgtgaaacacaccgagtcccccatttccggcatagatgtcggcaccttgcccctttcattccagaaatggtttgtcgaaaaagggtggtctccgcgcgcccatcagctggagcttatggcgcgggcacggggcggcgagaacatgttgctgatcgcgcccaccggtgctggcaagacgttgggcggcttcatggcctcgctcaccgatctgacagagcggggcaagataccgcctggctccggctttgtcggcgtgcacaccctctacatctcaccgctgaaggcgcttgcagtcgatatcgagcgtaatctcaccaagcccgtttccgaaatgggtctgccgattgtcatcgaaacccgcaccggcgatacaccccaggcgaaacgccagcgccagaaggtgcgcccgccggatatcctgctgaccacaccggaacaggtctcgctgctgctcgccaacaaggaggccgagcgctttttccgcgacctgaaatatgtggtgctggatgagctgcattcgctcgtcacctccaaacgcggccatctgctgtcgctggcgctcgcccgcgtgcgccggcatgcgcccgatgtccgtttcatcggcctttcggccacggtggcggagccgatggatttgcgccgttatcttgcaccgcaggggcaggggaagccgcccgccggcttgataaccgtcgaaggcggtgcaaagccggatatttccatcttgcacacggaagaacgcatcccatggtccggccattcagcgcgttatgccgggagaggacttatacgaagcgttgaagcaacatcagacgacgctggtgtttgtcaacacacgctcgcaggcggaaagggtctttcaggatctctggacgatcaatga

SEQ ID NO: 31506 - DNA, 282 bp, Glycine max
  Peptide Sequence Number=SeqID_148284
atggaggcatacgcgaaagatgaaaaattgttgatgcatttcttccaggaaagtcttactagggcaggcgacacctggtataccaatctggaactttcccgggtccattcctggaaagaccaaatggttgccttcgttagaatacagctacagaacatgtgtaagaaggagcatgaatctttcaaagaatacgcccaaaggtggagggacctagcaacccatgtagcgcctccaatgatggagagagagatgatgatggaagcttgcttgtggggcttctaa

SEQ ID NO: 31507 - DNA, 837 bp, Glycine max
  Peptide Sequence Number=SeqID_148285
atgtacaaaaatgctcaaaaatacctgctggttttcgttctgggttgtgcctccacaacttcttttaaatctcagcttcaaagccttagtcttgaagaatgttatcagctggcaaaagacaattacccgctgatcagaaaaaaagggatgattgcaaaaacagccggttacaatactgaaaacgccaataagaaatatcttccccaggtttctttttccggccaagccacatatcagtctcaaaccatcagtttttcggatgcactgggagcactcccgatcaatgccgcacttccttcactcagtaaagaccaatacaaaattcagggagagatagaccaggtattgtacgatggaggaaccactcacaaccagaaggaactgataaaagccaatactgaattacagcaacaaaacattgaaacaagcctttatacattaaagcaaagggtcaataatctgtttttctccatcctgcttatggatgcacagctaaaacaaaacgacctcaacaaatccaaccttcatacccagatccagaagacagaagccgcattaaaatatggtgttgcgtacagaagcaatctggatgaactaaaagcagagatcatcaatatcgatatgatggcaacagagtataaagctaaccgggaagcctatcttaagatgctttccattttcattgggaaagaactttcagattctacgaaacttgaaactcccgacagtgattattttcaaacagaaattagaaggcctgagctcaaagcttttgatctccaaaactccatttatgacctccagaaaaaacagttgaaatccgattttctccccagg

SEQ ID NO: 31508 - DNA, 855 bp, Glycine max
  Peptide Sequence Number=SeqID_148286
cacttggaggagagagtgaaggctttggcggatcaaggtgaatgggttttgttcattgatgtcttggcgctattgatatttggagtcatcctttttccaaatgtggatgggttagtggatttaacagcgatcgacgccttccttgcttatcaccatagcaaagaaagcccagtcgttactgttttggccgatgcctatgacacatttgaccgaagatgcgagaagaacagtgcaaggattggacacccgttaattggttcccccgatggaaggaaggaagagccagggttttgtcctcatgataaggagcttaggggaagcaacaatgggatcatcgacgactatcacaagtggctgaaagctcagacacaagagttagtttggctcccgaagctaaaggcatcaagtgaggaagaggctgaaacccctgaggagagtgaggaggtgcaagccttgaaggcgaaacttgaaagggtgcaagcagtcaaggaaaagttcaagatgaaagctatcaagtggggccgaaacaagttccgaggggcattgtgggacagcaacagcaagctcaagcttcgaagggctgagacagaccagtcgagagtagaaggtatgatattagaggacaagttgaaggcttgtcaaaggtcaaagaggagtttgtccgaacaattaagtaggacggaagaaaacatgtgggccatcattgaccaatacaaagagaagctaagtctagctgcaacccatgaacaaaggctagaggacgagttcgctttcaccttgaatgggagtcaagagcttcccagtctgctagccaaagccaagacaatggcggacatgtacttggctcccgaggaa

SEQ ID NO: 31509 - DNA, 168 bp, Glycine max
  Peptide Sequence Number=SeqID_148287
atggcattcaaattaaaaagtatctctgtaaggttgtttccctacaaaaatcacgcgctaatgccattgaggcatttcaccgaacacttggcgggcgcgcgtttaggcatcaatagcaagagaacggggacaatgtggcatgtcccattgcttcaaaatgcattatag

SEQ ID NO: 31510 - DNA, 249 bp, Glycine max
  Peptide Sequence Number=SeqID_148288
gtatgctagaagtagtgtctaatccttggaggtttacagtagggaactggttatgtgactcagatctggttagtcctactggaattgaacgggttctaactgaaaaagaccttctggctgactcatattcagacctagaggcttctatccttgatgaaaaagagtttctcctattgaaggttatctctacctttccggagttgtcttgcttaatatgctctatggttggagcgggtcggggaatagacg

SEQ ID NO: 31511 - DNA, 597 bp, Glycine max
  Peptide Sequence Number=SeqID_148289
atgtcttgcctagtgatcataactccgatctccctctgccgaagtgtcagctggtgtatgccacccactaggcaccctctagacccggataagtctaacagggccctggggttttcggcattgatcatgggcctctaccagtcacttggggttcccgtcactcctattaaggtgatccgaccaccgatcacccgggccttcattgagaagtattgcatgcctaggcaggcggagggtgatgcacctcgagccacagacgcaccgccaccacctcatcaggccgatcccgctgggtcactaggcatggagcgttatctacagcacttggttcgccagcaggcggccaaccaccgggggcaggtacagatacatgagtgtctctaccggttcagcctcagtcagcaagggcagggtttcactccttttgcgtgccctactccagagcagtttagggttgaggtcgcaaggcccggagattggcccgaggcccaagaaggggaggcgcttgcaggatcccccggcgatgcagaggaggcccgtatggatgaggagatgatggatttgctcgatttcttgggaggaagcggagccacgtga

SEQ ID NO: 31512 - DNA, 204 bp, Glycine max
  Peptide Sequence Number=SeqID_148290
atgggtcactggggaagatggttgagtgacattatatgtagaagaagaatagtctggttggccaatcattcaaactctatgaggtatagtcattcacagatcggtgttgggaaaatttggacaatgcattgcattggtcatcatagtaggagggagcgaatttggtctcaagtgcttggaccaacccttgccatgaagaaataa

SEQ ID NO: 31513 - DNA, 291 bp, Glycine max
  Peptide Sequence Number=SeqID_148291
atgcagactatcataactagaagcaagagggagaccatggtgaaagatgaagggaggaatagtgatgaggaggagttagttgttgaagaagaaaaagaaaaagaagaagatcagatgagggagaaaaaaaatgatggtgaggaagaagaaaaaaatgaaaaaaaaagaaaaaatgaggaagagaagaagataaagagggagttggctagagaaaagaagaaggaggttgtctcatatagagggaaggaagcaccataccctttggtgccatccaagaaagacatggaatga

SEQ ID NO: 31514 - DNA, 197 bp, Glycine max
  Peptide Sequence Number=SeqID_148292
atggggtgttacaacaccaccccccttaaaagaagttttatccccgaaacttcgcccaaagaacgacaagaaaaagattacacatctggttcccaataccaggctgtgtacccacctaaagcgctctttgatcacccgactcctttgtacttagcgactaagcctgatggttctcgcttcctcaaagatagtatttc

SEQ ID NO: 31515 - DNA, 168 bp, Glycine max
  Peptide Sequence Number=SeqID_148293
atgttagaaagtataatttaccgtgacttaaagcctgaaaatatcttacttcagaaggatggtcatgttgtgttagctgattttgatctatcatttatgacatcttgtaaaccccagatgtcaaaaagtgggttttatgagcctaaccctaccctgcaaaaccagcat

SEQ ID NO: 31516 - DNA, 189 bp, Glycine max
  Peptide Sequence Number=SeqID_148294
atgggaaatcaaaagtaccttgctaattcttctttgaaaatcttcatcggttgcttgtcaagcaaggcaaacaactctcccccagggaagaagtcagcaactcagttgggagccctgatctttaaaaattgggagtcatgttcacttgggaggatcaaacctccactaggccacctttctgctacctag

SEQ ID NO: 31517 - DNA, 339 bp, Glycine max
  Peptide Sequence Number=SeqID_148295
atggtgtctaccctgacttatcttccttctttgaagtggcgtcatccaaactctatgacttgtatcaagcgatccgctcctagtaaggatcacatcaatttgcaagattatattgattctttttgtgaagaggacaaaggtctaacagtggatgtattaaaggttgaacattatgagaagaatgttaaggcaggatgttttgactgtgatggtgacttgtgcagagtgaaggagcttttcaaacatgaatgtgctaagtttaacaaaactattagtttaggcttccaagatcctaaaaagggaaaaattgttagaggggacaatgaacaagcaatttag

SEQ ID NO: 31518 - DNA, 345 bp, Glycine max
  Peptide Sequence Number=SeqID_148296
atggtgaaagccactgcagaaaatgttgatgaagctgtccgagaacttccagatgccaacttggtaagctgtcatttgaagaagagtggtaagagaccagaagatttgtgggcaattcattcccaacctgtctttccacgacctcacaaaaaggacaatccttcttggatagcaatacaaaaggaaggctcctccctttcatctgtggtccaattacccctttttagaattctaactgcattatatctcactattttggggtttgtgggggagtttctcaaaggattcagaagattgagagactttggtttggtgagagagaataaagtagtggccacaaaatag

SEQ ID NO: 31519 - DNA, 1539 bp, Glycine max
  Peptide Sequence Number=SeqID_148297
atggagaaactgaaagtgtctgctaagaatgatcctgctggcagcagtgatcaggcagattcatttccaatattcgaactgtgggagagtgaaaatgttggacagaagagcagtagaagagacgaagatgatacaaaagctgtaagattggatggagattctgtaattgctccctctaattctgcaaacaacagtaaggaacctgtcaacaagtggatggcatttgctaagaagcctggtttcacagttgatggcaactcagcaacaaaggataaaagtacaaccgaagacaattactcgaggaatcatctaaaagagaagccgtcttctggtcaaaattttttaagcgaagcaaccatagccgagagaactgctgaatggggtcttgcggtggactcagggaattttaaagcattagggggagagaatacaagtggtggctcttttgatggtgacaaaagcagaaacttgtcagatagatttgttgaatcaacacggacgtctggggagtcaaattacgggtctgagtcatcattaggggtgtttccaagggtgtcacaagagttgaaggaagcactggcaacgctgcaacagacatttgttgtctcagatgcaacaaaaccagactgccctatcatgtatgccagcagtggcttttttactatgactggctattcttcaaaagagattattggaaggaattggagtcttagaagtcgatttcttcaggggcctgagaccgacaagaatgaagtggccaaaattcgggatgcaactagaaatggaagaagttattgtggcagacttttaaactacaagaaagatggaactccattctggaatcttctcactgtcacccccatcaaagatgaccatggcaatactatcaaattcattggttattactacagaatgcaggttgaggtgagcaagtacacagaaggcatgaatgaaaaggcattacgaccaaatggattacctaaatcattaattcgttatgatgctcgtcaaaaggagaaagctttgggttccatcactgaggttgtccaaactgttaaggacccaaaatccattattaatgataggaatggtgatactgctaccatgcctgaagagcaagagaaattcaattttgattttgttttgccaaagtctgctgatattgggaatacaagcacacctggtagacaagcttctccactgaatatccaacgcatgagttctagtcaagataagagcaagacatcatcacgatcaggacggatttctttcaagggtttaaaagggagatctccgagttctgcagaggagaagccaatatttgaacctgaggttttgatgactaaggaaatagagtggtctaacaatttggagcattcactaagagagagggacataaggcagggaattgatctagcaaccacattggagaggatagaaaagaactttgtgatttctgatcccagacttccagataacccaatagtaagacaatttttttcttctttggagcaacagggtgcctttttttttccttaa

SEQ ID NO: 31520 - DNA, 180 bp, Glycine max
  Peptide Sequence Number=SeqID_148298
atgttcgacttggtgaccgactcggacgaattagccatacttttaactagggttgtcaatacaggctggcccaacccattttggcccggcctacttttggaccgccataaacaggccagctcggcccaccccgctaagcaaaacgggctacctttcctagcccgacccgtttcaagctag

SEQ ID NO: 31521 - DNA, 711 bp, Glycine max
  Peptide Sequence Number=SeqID_148299
atggaggaatgggaagaatgggaatataaaggtgtgacaggtgcttttccacgtcttcaacgtctttatatagaggattgtcccaagcttaaagggcacttgccagagcaactatgtcatttaaatgatctaaagatttctgggtgcgaacaacttgtaccttctgctctcagtgcccctgatattcataaattatacctaagagactgtggaaagctgcaaattgatcatgggtttactttgaaagagcttaccattacaggtcacaccgtggaggcagccttactggaacagattggacgcaattactcttgttcaaataacaatattcccatgcacagttgctatgatttccttctaaggttggaaatcagtagtggctgcgactctctaatgaccattcagctagatatcttcccaatgctcaggcggcttgatatcaggaagtgtcctaatctacagaggatttcacaggggcaggctcataatcatctccagtgtctgaggatcgtagagtgcccccaattagaatcattgcctgaaggaatgcatgtcctccttccatctcttaattatctgtacataggtgattgtccaaaagttcaaatgtttcccgaaggaggtgtgccatcaaatttaaaaagaatgggtctttatggtagttccaaacttatctcattgaaagtgccttgggaggcaatcactctctag

SEQ ID NO: 31522 - DNA, 258 bp, Glycine max
  Peptide Sequence Number=SeqID_148300
atgcagtggttcttcatgatttctcattcattcatgacaccaacactgcctgttgattcggccagacatccacctgtgacgcaagatgacacatatgtggagccacatatccctgaggttccagtggcaccagtagcagcaccggcacatgccccttctgatgcggagcagcctagacatgaagtggaggcttgccaagcaatcgcagaaaggttggagcatttgctcaacctaaggatagtcactgtaggcacataa

SEQ ID NO: 31523 - DNA, 357 bp, Glycine max
  Peptide Sequence Number=SeqID_148301
atggaacaacctgatattgacggcttgaacattgaagatgaagtggatatggagtttaacattccagaatctggtgaaagcgagatagacctctccctcttcctcgaacaaatggctgaagtatggagacctatagagggaatcgccattgatgaactcaatccaactctcttcattttcagcttttatcacaaagtggacgttcaacaagttctaaatggtggaccttggcattttgacaagcacatgctgattttaggaccttggcattttgaggcactggggaccagaaatacgtgtggagatgcaaagacttggtggaagtggagggtcacggtggctccaagagggagatga

SEQ ID NO: 31524 - DNA, 246 bp, Glycine max
  Peptide Sequence Number=SeqID_148302
atggaaaatgcagggttctcatgggatggtgagaacaataatactaagatcgatcctttgttacagttccaggtcaatgtgctaaaatctgaagagttcaagacaagttcgtggcaagaagagcagattctgactcagaatttgatagatttcactaactatccgttaatgtcactgtctgaggatctaaccggagcaaattttgatgtgttccagcagataagtttggatgacgattattgctga

SEQ ID NO: 31525 - DNA, 1727 bp, Glycine max
  Peptide Sequence Number=SeqID_148303
tagagtaccttggccacttcatttctaaggtatcaactgatccagctaaagtgcttgcagtagaacagtggccactacctaaaactttgaaacaacttagaggcttcctggggttagctggatattacagaaggtttgtcaagggatatgaggtgaatgctttaggtttgggaattggagcagtcttgatgcaagatcaccaccctatagcttacataagtagacatttgaatcaccaacaacaatcttactctacttatgaaaaggagttactggctgtggttatggttgtccaaaaatggagacattatttactgaatactcattttatcattagaactgatcatcgaagcttgaaattcattttgaatcaaaaatggactacggcatttcaacaaaggtggttggtgaaattaatggagtttgatttttcaattgagtataagcagggacatgataatgtagttgttgatgccttgtcgcgagtggaaccagttgcttgtaaagctctcatggatcatcaggtggtttctgaattggtgataaagattaaagcctcttgggattcagatcatgcaattcagaggaagatttcagaattacaagcaaactctagttttcacaaacattattcttggaaggatggggagttaatgaggaaaggaagactagttgtggatagagatgatgctttaagacaggacattcttctgcattttcatgtttctgccgctgttgggatgagtaaagatgttaaagcttttgttcaaaaatgcagtgtatgtcagaagtgtaaatatgagaccaaggcttctcctggattgctgcaaccattgcctattccggatctaatttggcagcacattaccatggattttatagaaggcttgcctagttcctttggtaagcaggtgatttttgtagtagttgataggttgagcaaggcagcccactttatggctctttctcatccttattctactactgatgttgctcaatccttccttgatcatgtattcaagttgcatggatttccagattctatcatccgtgacaaagattcaatatttctcagtcaattttggcaggaccttatggcttttcagggtgttcaggtccagctctccacagcttatcaccctcagacgaacgaccaaacagagattgttaacaggtgtttggaaacatatttgaggtctactccttatgaagtggtgtatggacaaccgcctcctgtgaatcttcctaacatagcaggagcttctaagattgagttggtggatagaagcctcttgaggagggaggagatgttgaaactcattaaatttcacatgaagagggcccaggatagaatgaaacagctggcagataaacatagatctgagaggcaattcagtgttggcgatatgatctatgtattggaacagattggggcagtggcctacaagatcatgcttccttcgggttcaagattacatgatgtattccatgtctctcagttgaaaaagcatgtaggtgaagcagtaacttcttcgagtcttccaagttcagtagaaggagatcctctaatcaaagaacctgaagctattttggatcgcatgacagtaaagataaggggtcgagctgttactaaggtcctagtaaagtggaagcatagcttgccagaggatgcaacttgggaatttttctttgatttgaagcaaaggtatcctcacttccagccttga

SEQ ID NO: 31526 - DNA, 1247 bp, Glycine max
  Peptide Sequence Number=SeqID_148304
atggctgaattgatgcaattgaggcagaagggatcgatagtggagtaccatgaagcttttgaggctattgtagctcgtttggatctgattgaggagcataggctgagttgctttttgggggggcttaaacaagaagtccagatgcttaataagcagtctaaacctgaggcttcttctaaaccatcgttgttacctacacctcctaaaactctttctaagacacaagatatccccaaaacaaaacaacaaacctctaaaactttaacccctgcgtatataagtgatagacgagcaaaagggttatgttatttttgtgatgaaccctttatgcctgagcatggtttgagtcataaaacactgcagttgcaagtgatggaagtggatgagttacaggagggtgcggaggaagaagtttttcttgaaaactcaatggggtccagctctatagatcctcaaatttttgtccatgccctcacgggaattgccaatttccacaccatgcgtgtgacaggctactaccaaaagaagcctctccatgtgttgattgatagtgggagtacccacaattttctggacattgaggtggccaagagattgggttgcaaaagtaatgtttttgattccgtgagtgtggtggttgttgatggcacacagttaaacgtgtctgctgtcgttagaggattccagtggataattcagcaaaccaaattcacttctgatatgttactcattccattgggatgctgtgatttggtcttgggaatggagtggctggtttccttgggtgatattgtaaggaattttaataagttgcagatggagttatatgttaggggaaggagaaatgtgttaagaggggcctctactggattaaaaacagttaagaggcaacaattggggaaggctatgtcaactggtgttcatttgtcaattttgcaagtatgtgatggacaaaagggttatttgaacttacttacaactcaagttgttgataaagaagtccctcctactcttgccaagttattggatgagttctctgatttatttcaagaacctagtgggttacctcctcgcaaacctggtcatgaccatcgaattccactagttcaaggtgttcgtcctattagtaagagaccatacagggatcttaacaagcatacagttaagaacatgtttccaattcctttagtagatgatctattggatgaattggaaggttctagcattttctccaaaatcgatttgag

SEQ ID NO: 31527 - DNA, 465 bp, Glycine max
  Peptide Sequence Number=SeqID_148305
atgaaggatcattcaatgttgatcaggaatgcgaaagataccaaaaggagggggaaaaagggtgtgagggaggctgagagatgggttccatggtccaaaagtgaaggaattgggagaaataagagagaagaagaggaaaacaaggctgaggcgctaccgaatcgcgaccgtaatcgtcttctacatcgttcttcatttggtattcttcattcgtcatccgcttcaatgaggtcctttaatggtgattttccaccatggagatgcagcggaagacaaaggaaaagaggtgagaggaggcgccatccattaaggaataagccatggaagaaggatcttcaccaccaagatgagccttggataagaagcttggagaggatgcttcaatggaggaaaagaaagagggagagaaagagaggggggagcacaaaattgaaggaagaaaaagggagagaagttgaactttga

SEQ ID NO: 31528 - DNA, 195 bp, Glycine max
  Peptide Sequence Number=SeqID_148306
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtctgcgaac

SEQ ID NO: 31529 - DNA, 264 bp, Glycine max
  Peptide Sequence Number=SeqID_148307
atgaagattcttccactatacaaaatgatagtaggattacaaggatgtgtttacaaaattgactcactctatggtggctcactcaagcttgaggatagagacttcccaagctatttatcttctctctcaaagaggctctctaactttctagctttctcactccaaggagtggattcactcttgtctcttggatcgactcactctacggtggctcactcaagcttgaggatagagacttcccaagctatttatctactctcttag

SEQ ID NO: 31530 - DNA, 501 bp, Glycine max
  Peptide Sequence Number=SeqID_148308
atgctttcacatagtctcccaattgatacacaaagtatcgcatttttaggagaaactagcagtcagacgattgtcaactcaaggttggctttcatttttccaaatggatcaattattcacaatgatgctggcgtttacttccaaacttcaactccggtgcccattcgagtaccaaacaactgtgattttgcaagcctaaaaaccagaatacacaatacccttcagctatccgacaaacaatttttggatgaaattcactaccggaagctattcaccgatacaggtaaccaaattcgttttcagtgtatgaaattgataaatgatgacgatgtcaacacaatgttaatgagtaatgatcaattttcttgtgttggtccgattgagttattatgcactgttggaagaacaccagatggaataataaacttacttcaacgcactaggccccgtactcatgacgcgatcctgtattacaacgagaaatggaacatgccaccgtag

SEQ ID NO: 31531 - DNA, 558 bp, Glycine max
  Peptide Sequence Number=SeqID_148309
atgggtttggttctgtcacactttaagccctggagatttggagcaataaatgcttgttggagttgtttaagaatgaggcgagttcaagttcataggatcagatttggatactgtggttattgggggagtttgaaggagggtgtgtttaaggaagtggaaaagaaaaggttggactgcgatgctaaggtgcacaaagccaacatcctcatcattgcacatacgtgtgtgttgtcaatgttctatgagtcgtcagatcaagggaatttgaggccaaggtccatagatccacctagtcactcacatcataaagtactgtggaaggcaagcgcatatgacatggtggctctaagccagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 31532 - DNA, 501 bp, Glycine max
  Peptide Sequence Number=SeqID_148310
atggttacctcgaagaaatcgcgaagggggatcggaggctccattctctaccaaatcctcgagttgagttttaaagatttcattccgattaaagtgttcctttccgtgcaagggtcttgctgcaagcaacaacggctcctggcagtcatcggtggtcggtggtggtggaagatgaggttgggggtgttaggtgagggtttgggggagaagatgggagcaaaatgtatgttttacgttgttggacgtatttgtatgctgcaagactcgtccaaacaaaatttttctcgcttaggagagctggcccaactcagactcgcttgggtgagttctgtgcgaattctgctccaacatattttactacttctgttaaaatgtcatatctcacactccgatgttatttggaaaatcccaatggtcaaaacgtgcaagcgtgggttgttttgggtcaatcttagaatcacacagttccaacgcagatcaatcaaactccacataacctaa

SEQ ID NO: 31533 - DNA, 495 bp, Glycine max
  Peptide Sequence Number=SeqID_148311
atgggtgccaagtacctcaaagtggttaaacgagggttgcatcccaacaacggatggtccctggacaaaattaggtggaaatctcaagtgggttgcttgaggactggacgtaggcacgagaagtttgaaacattcagtggtgtgacatcagatgctacacttctagtagagagcaaaggtaaggaaggtggagatagacaggtgacatcaaaggtagcaaatgcatgttgtgatgacagatcaacagagaagacaaacaagtatcaaaatgaggtaacaactggtgggccaggtggtgaaaaggacaaagttaatattgaacgatgcttagctctactgagttttaaaagattggctaagattttgttaaaacataagcacttagacaatgaaggaaagctggagttgctgcacatgatgtccaaccttatgtcaaggaataagatcgggctgcacaatgcacgaggcaagataaagtgtcaagtgaagaattga

SEQ ID NO: 31534 - DNA, 489 bp, Glycine max
  Peptide Sequence Number=SeqID_148312
atgtacaaccttcaaattgttgctcgttcccctctttgttttctgcaaaaaatcaaatcaaaatcaaacaggtttttccagcagagatttccaaaacctatgcagtgcaggccacagctgaatgggatatccttcagtaacattggccaacagcaaaatcagatgttggtgtctaatttttatgaggaggaaataagggctttcaacaaggaactacttggaaaatggaggtgggatatgcttcagcaaagtaacaagttatggtccaagatactgcattccaagtatggtggatggagatcattggtggaaggcagtagaaggaataatgagtcaggttggtggaaagacttaatggaggttacacatgaccaacagatgaattctatcctccaagatggcactacttggagggtgggatgcggggataaaataaaattctgggaggactcatgggctggacacggaaaggctcaaaagataaaataa

SEQ ID NO: 31535 - DNA, 1211 bp, Glycine max
  misc_feature (1085)..(1085): n is a, c, g, or t
  misc_feature (1102)..(1102): n is a, c, g, or t
  misc_feature (1206)..(1206): n is a, c, g, or t
  Peptide Sequence Number=SeqID_148313
tctatgcacgtgtggtcgctaaaatcgacccggactggatagaaccgattgccaacgaaggtggcagccgtgacctgacacagagtgattacaccgatccacgctgggacagaaaaccagcacaagtggtggcgtgggagcgtgtgagcttgtatggcctgaccatcgtgcccaagcgccgtgtgcattatggcccgatcaaccccaccgaagcacgcgagatttttatccgtgaggcgctggccaatatggaattcgatacgcgggcaccattctttgaagcgaaccgccgcttgattgccgaggtcgaggcactggagcataaggcgcgccgtcaagatgtactggttgatgagtaccagctgtttgtgttctacgacaaggtggtgccgcccattgcagggcctggtgatcaagagccttatcgcatctacaatggcgcgtcttttgaaaaatggcgccaggatgccgagaagatcaatcccaaggtgttgtacctgacacgtgagtcgctgatgcgccatggcgccagcgcgattaccgaggtgcagttccccgagcagatgaccatagctggtgaaacggtgccgctcaaataccgttttgagcctggccatgtgcttgacggtgtgacggcgacgattcctttggccttacttaatcaactggatgcgacggtcaccgagtggctggtacctggcatggtgcgcgacaaggtgaccgcgctgatcaaggccttgccgaaaaccctgcgccgggtgtgtgtgccggtgccggagtttgtgactggtttcctggaagccaaaaatccgcagcaccccttgttgccggccctggctgaatttatccagcacaaaaccgggcttaagctcaagccggaagaatttgacctcgccgggctggatgcgcaccacctgatgaattttagtgtggtcgatgaaaagggcagggagctgggcatgggccgcgactggcacttgcttaaaaagcaactgggttctgcggcacaattgaccttcaggacaggctcgcctggcatcgagaagtctggcctcaaacagtgggactttggtgatttgcctganacgctcacctttagcanagatggtcgccagctcactggctatcccggtctggaagacaacactgacagtgtcgcggtcaaattgtttgatacgccagaagccgcaacagtggcgcatcgcnagggc

SEQ ID NO: 31536 - DNA, 711 bp, Glycine max
  Peptide Sequence Number=SeqID_148314
atgaagaagagttcttcatcatcattccagaacttgggatctttcccaagtccaggggcaccctattatagggagagaaacattaggagccaaaagggttggtgctcagagagagtttcaaattcaaagctttcaactagtgctagtagcataagcagaagacacactatggcagggttaataacaacacccttttgtggtggaagaacactgccatctaaatgggatgaagctgagaggtggatttgtagcccagtttctgcgtatgctgagagcagaagttgttcacatgcacagcttcagcgaaggccaaagtcaataagtggccctattgtgcctcctggtgtggcttctttctactcaaatcagggtttggttgtgagaaacttggtggtgggttcacccttctcaactggggtgttggcacctgttgctgtttctgttcaccactttgatgcacatgatggcaatgtttttggctatgacttggacagtggaatgcagttttctaggcctgggatcaatgagaatggcgtggtgctttcttctttgtccagtgctgaacccacgtgctctgaacagccctgtgaccaatcatctcccatctctcaagatagccgtgttaaagggtttgtgttcatgttagagtctatgcttcataccttaaggctttggtactttaaatcaactatgacattaatgcccggttaa

SEQ ID NO: 31537 - DNA, 363 bp, Glycine max
  Peptide Sequence Number=SeqID_148315
atggccaccgtaggccgccgttgcttgctattggacccccacaccaagaggaacactttaatcggagcgaaatcctcaaaatcctcctcaaagattcggtggagaaaatccttcaatcctccatttcaaagtttctctgagaatacgaaacacccctcagccctttatgttttgacagagagacttgcgttggaccgacaagcgcgaacgagagagggatctctaagtgacgcaaagaggaaccgatggggagttcacgatagatctggggagtgtgaacctcaggcatggaaaacatatttatatgcggaatgcgactcattgttgatgttgctattggtgactttaattgatatgtggtga

SEQ ID NO: 31538 - DNA, 1026 bp, Glycine max
  Peptide Sequence Number=SeqID_148316
atgtcaaaactagaagaacttggaaaccacacaagtcagtggttcaggaaaaaccttgatgtggaaaacattaactttgacattaagaagtcagtgacagattgttttaacagtggtttcaagtggaataacatcattgttgttacctggagggcgttacctggagggcaaactgcacactctaaattcaagattcatgtttctacttttgatgactcaatttgcaatattcaccaaggtagtgaattagctgagctattgaaagtgacaaagttgattatatgggatgaagcacctatggcccataaattttgctttgaagcactggataaaagcctgggagacatcatgggacttggtaatgaatctctacaatatttggaggaaacgtcattgtttttggtggagattttcatcaaatcttaccagttattccaagaggaagccgatttgatattgttcattcaacgattaatgcatcatatatatgggatcattgtgagagctattttggcttctacaattgacactgttgatgagataaatgatttttttctatcattagtgccaggaggtgaaaaagaatatttaagtttagatatgatatacaaatcaaatgcagcagacaaccaagcatggaaagcacttactcctaaatttctaaactctcttgggacatcaggacttcctaatcataaaattaaacttaaagtaggaagtctgatcatgcttttaagaaatatagatcaatctgaagtcttacttcaattctcaagttctactttcaggaatgtgatggatgattttggagatgttttgtccaatttatcagtttcacactcttctaaaaataacttacccttccatgttgtgaatatcttaatgcaagctaagtctgattcagtcattcttgagttcctgggtggagttattactgaatgcaaaggcttgatccatcaacttcacaaaaacacaatgaagattgaaaaaggttggaagcgttactgcaaatataacaaactatag

SEQ ID NO: 31539 - DNA, 507 bp, Glycine max
  Peptide Sequence Number=SeqID_148317
atgctaatgatgcatgatgagagacttcttttggaaagacttgaaggggtgtacacatttggacaacctagggttggagatgaaaattttgccaattacatggaaaaaaatttgaaatattatggcattaagtatttcaggtttgtttactgcaatgatattgttccaaggttgcccttcgatgatgatatcatgaaatttgagcattttggaacctgtctttattatgacagattctatagaggcaagaaagtgaaagaagagccgaataagaactacttctcgtggccatggaaaggtatgatgatacagaagaaggtgaatgctttccgggaacttgtgaggagcttcactattgtgcataaacatggacctgagtatcaagaaggatggcttctaagattcattagggttttgggcttattatttcttgcaggattaccagctcattgcccccaggattatgttaatgttacccggttagggcttccctcacatttggattaa

SEQ ID NO: 31540 - DNA, 435 bp, Glycine max
  Peptide Sequence Number=SeqID_148318
atggggcttgggtggatgaaccttgcaaggttaaagagtgggttaaaagcttttttcggggagaggtatatggaaatggataataatctctcaaatagatttaagaaggcattgcctaatgtgattgattgtaggcaaagtgtgatcataagtggaaggtctttgcttcatagtgctttgataactaatgaggcagtggaggaagcaataagggggaagaaaaggagattggggttcaatgataagtggatttctaaggtcatatgcttggaaagctccaatgtatctattttggttcatgggagccctacaaatgagttcaagctttctaaaggattgaggcaacagaatcctttggtaccattcttgttcaatgtggtggcaaatgggctgtggactaatgagagaagcaataaaaaaggatcttttcactag

SEQ ID NO: 31541 - DNA, 363 bp, Glycine max
  Peptide Sequence Number=SeqID_148319
atgcatccttactataatgaacttgataagatgaaaaagaagaactcgaatctttggacgaaatgttatcattacaaaaagatatcttctgatttgaactataagcttaaggggcgtgagactattcatgtaagatttaaccacaataagcctgacactacaacgtcagagctagatgagtctttcgtagagatgaagatagaaaatttcgtgaaatctactgctacgtccagtcaagacaaacatgtgtccaactcaccagtggatgatcaacctaaagaagtcagagaaccaattggacgaatactgaggaaacatcatccagtgtcccagatcattagtaatcctaaggacaaagtctaa

SEQ ID NO: 31542 - DNA, 222 bp, Glycine max
  Peptide Sequence Number=SeqID_148320
atgccttaccaatgtaagcagatactggataaaaattctgaatattacaagtctatagttggtcatttggacaatcgactggaattgttagacaatagcatcaagcgtgacgacccaaccaagtacaatgctgctttgtctatgatggcttctaaagtatcgtacgagaatcaagcttacgttcatgctgttgtcgtaaatcgctggacggtatatacatag

SEQ ID NO: 31543 - DNA, 930 bp, Glycine max
  Peptide Sequence Number=SeqID_148321
atgattgccttctttgaatccactcacatcgatatgtgggatgttgtagaaaaaggcaatcatattcctttagaggctcagagaaacgagatccccagggacagatggatggatgaacttatgtctagatttcttctcaactctcgagcaagaaatgctttgtttacctatgaagggtcctctgaggtaaaacgtaacaagttgaaccttttcacacgtaagtatgaactcttcagtatggaagagggagaagatatccaaaccatgtttggaggcttccaaaccattatgaatgagcttcgctctctagcgttaagagccatcaagaatcttgactctatgactcttgaagagcttgttgggattcttaaagtccatgagcaagagcttgctcaagataaaggaacaaagaaagggaagtcattagcccttgcagctcaaagaccaaaatgtagcactacgctcaaagagtcatcatccaaggcccttgccgtaaatgaaacctcaaaagaagaatttgatgatgatgactgtgataaagaagatggtgagttgagtctgatcacaagaaagatcagaaaaatgtggaaaaataagaactcctccagatttaatggatcgtctaggagatcattccacaaggaagaaaaaatttcaatcaatttctatgagtgcaaaaagccaaggcacttcaaatcagaatgtcctgagcttgaaaagccaaaggataaaaagaagaaattctttaagtccaaaaagaggagccttatgagcacttggaagaacctagacaattcctcatctaacgaagatagtaaagaagaatccaatctatgtttgatggttgatgcttccaccaataaagcagaaccagcattggacccaagttcaaatgacgaggactctcagtctgatagaagaattaattaa

SEQ ID NO: 31544 - DNA, 489 bp, Glycine max
  Peptide Sequence Number=SeqID_148322
atgaagaacggagaaaagagggaggtggttgccgcccagcttgcccaggcgagctgggttgcttctaccagaaggcatcgccttcttttggaaccctcaggaaggcccaaaatgttgcaaaactttacgaattatgcaacgataggtgttaaacattttgaggtggtcaagcgaaggtcgcgatggtccccggacgaaattaggtttcaactgctggtaatcgattacaatacttatgtaatcgattacatgttttcaaaaacatctaaaaacattttaaaagcatttcaggaagtgttttggccactggtggtggtggaaggtcgaagcaccgacgaagataactcactgtcgcaacgtgcccttcacgggcgagcgagggcagggctcacgggtgcgcttcccaaaggaggaaagatgcacggagtcgccaccaacgtttatttgtggaaaacgtcgggaaaaccgaaggaaaccggtcaaaaataa

SEQ ID NO: 31545 - DNA, 237 bp, Glycine max
  Peptide Sequence Number=SeqID_148323
atggacacaaaattgtgtgaagggtccttgccaaagttctaccagggtcataggaacacaacagtgcttgatttgcctctaactggtcaagcacatgatgcaagtgttaagcttggtaagctgaagctcttcaaagtcaagttcagggttaggtgtaggcttgaggtggataatcttggtgctagtaatgatattagaatttctagcagtagttgtaagttgaagctcaggctgtga

SEQ ID NO: 31546 - DNA, 423 bp, Glycine max
  Peptide Sequence Number=SeqID_148324
atgtgtcattttcaagggtttttcaaaggaagtgtaaaaacatccaataatggttcccaatggtggtggagaaggagcttgggggtgttgagggagggtttaggggaagagaaggaggaagaagatggctcttttacgctactggacgtatttgtagcctgcaacactcgcccaggcgagccaaacttgcctaggcgagctgatccacagctcaaattttttgcttcgggtgttacaacttcaccttcctctagtgcaagtgaagaagaaaaagggaaagaatctagtgaagaaatctactcccaagaagaaggacaacctttaatggttaagggggagtgtaaggagacacttgttagcactgccacacctcttgggcttgaggttattcctcaagtaaagaagttgttggatgggggtttg

SEQ ID NO: 31547 - DNA, 1136 bp, Glycine max
  Peptide Sequence Number=SeqID_148325
gtaagcagatactggataaaaattctgcaaattatatctcattcattggtcatttggacaagcgagtgggcttgttagataatggcatcaaacgtgaagaccccaacaagtacaatgctgctttgtctatgatggcttctaaagtatcgtacgagaatcaagctaacgttcatgctattgtcgtagatcaatggaagatggagctgcttgaatgtggtgactactggaatggtaagaagttaaagaggcaagcaattgactatcaagaaaaagctacaactcaggctttcgttatgttagacaaaagtgaagaccaagataactatgttgtagctttcagaggaaccgaaccctttgatgctgatgcatggtccactgatatagacatttcatggtttgaaattcctggtgtaggaagaacccatgctggcttcatgaaagccctagggttactgttagacttcaataaagaagagttgagatggcctaaagaaattgaaaccgatgagaaccgtccacgtgtctattactccataagggatttgctaaagaagtgtttgaatagaaatgataaagcaaagtttattcttacgggtcatagtcttggtggagcacttgcaattctttttcccgctatgctaattttgcatgctgagacatttcttttggaaaggcttgaaggggtgtacacatttggacagcctagggttggagatgaaacatttgctaaatacatggaaaatcaattgaaacattatggcattaagtattttaggtttgtttactgcaacgatattgttcctaggttgccctttgatgaagatatcatgaaatttgagcattttgggacatgtctttattatgacaggagctatacatgcaagaaagtgcaagaggagccaaataagaactacttctcgtggaaagctttgataccgaagaaggtgaatgctttctgggagcttgtaaggagtttcactattgtgcgtaaatatggacctgagtatcaagaaggatggcttctaagatttattaggcttgtgggcatagtacttcttgctggattaccagctcattctccccaggattatgttaatgtgacccgattggggcttccctcactagatttggattaa

SEQ ID NO: 31548 - DNA, 843 bp, Glycine max
  Peptide Sequence Number=SeqID_148326
atggctacaccacccaactcccctcctcctcctcctcctcatgagtcatcaacaccttcaccgtctacatcgaaaaagacaagaaaaacaacacaactcaaatcattggctactagaccagttgggacagagagaccagtggttcatgtggatcctgccacatggaaagttgatggtccccacagaaagaaattgagaacatatttggggatcgtcgcttgcgataaggttgaatttgatattcctgaaacattcgatttatggacgaagaaaaaagtacttaagattgtaggagggcggtggagacagtttaagtcagatttgacctccaaacgagctctaacagatgataaggagggcgaggatgatcaagatgtactgactactgccattgggcgaccagagcaccctggtcatgtctgtgctgctagagtcaatggactcgcactgcctcctgagcctaaggttggtccgtttgctactcgtggcaacacaaaggaaagttgtgtcatttccttggggcaggacccagacactggtgacttagagaaatctgggttactttatgaggggttgacgaccgtctataacgtccctttgggcaatgatcaagtcaaggtcaatgttgaggaaagtcgagatgctgatgctcgtgttcctgcacccactcaagaggttcagttagtggggaatgcacttaacatcttcctcatttggccgacacatcttgataaacaaagagttgagggaccggtgaaacctatagataggttggatcctgatgtcgatctcttatacctgatgacattgaccatcccgcaaatttttctcaagcctttgtag

SEQ ID NO: 31549 - DNA, 390 bp, Glycine max
  Peptide Sequence Number=SeqID_148327
atggccactgaaacaattctgtaccaaaatgacatcgttgccaactccaacgacttcactgccacaaccaagaaaccgcaggagagtgattgtcaccgccaaaagcagaagaagaagaacaaggcatctgacgaagaaagtgacgatcttgttgaacaaattgaaattgagtacgtactagagaaggcagagttagttaaaggcatggatgaagaatttagaaaaatctttgataaatttactttcactgatgccattgctttggagtttatggcagcagctagattgtcagggcatgaattgtccgatctgtgtcttgggaaaccgccgcttaggtccctctccgtccgcgacaccatagccgacaacctttctctttctctcttctga

SEQ ID NO: 31550 - DNA, 346 bp, Glycine max
  Peptide Sequence Number=SeqID_148328
atatctaaaggcgttgggtcctcttactgagaaaattgatgcaattagggatgtttctctaattaaagatgtttttgtgttctatgctgaaggctcaaggaaagagtttacatcaattactcagcaagaatccccaactgaggatttagccttccatagtgtcgaaacctacccttcggcggcagggcgacgcggggctcacgggtgcgtcttccaagggaggaaaatgcgcggagtcgccaccaacgtttattcgaggaaaacatcggaaaaaccggaaaggtgtggtctacgaactaagtgtgaaagattcgggagttgtttttacacacggggaaggtattag

SEQ ID NO: 31551 - DNA, 204 bp, Glycine max
  Peptide Sequence Number=SeqID_148329
atgcagattgtggggcgggcattcgccgaaccgctgattctgcgcattggccatgcttatcaacagcattgcaagctggccgaggtggaaggggcattgccgtacaagatggaggagctggtcagtagcctcgattatgctcgacaaatggccgctattgcagaaaaacatgggcagcgactgagaaggtccacctggccttga

SEQ ID NO: 31552 - DNA, 513 bp, Glycine max
  Peptide Sequence Number=SeqID_148330
atgacggccaaggacagcgggatcaagagcttcgccgacctgcgcggcaagaatgtggtaaccaccgccggcaccaccaacgaacgttacctgaaaagctataacgtcgataacaagatggacatgttcgtgatcagcgccaaggaccatggcgaagccttccagatgttgcagtccggtcgggcggcggcgttctacatggacgatgcgctgctgtacggcgaacgcgccaaggcgcgcgacccgcacaactgggtggtggtcggggaagagcagtcacgggaaatctacagctgcatggtgcgcaaggatgacccgcagttcctcgccctgcttctgctccccgctcatacccatgaagattacgggccggcagggacctgcgagcgcggtactgccaaaagtcgctactgcgtgagcgttaccaccacagtagcgaccacccccccactggttagtcggaagctttatccgtcaccaaggtttgaggattgctactcccccatacggtag

SEQ ID NO: 31553 - DNA, 318 bp, Glycine max
  Peptide Sequence Number=SeqID_148331
gttagcttcttccgacgattctttggatctgtgaacaaagttgactatttaacattacgacatggattcatcacggcgcatttggcaccgggaagtgatgcaagatttgatttccagaagtacatcgaaagatcacttgaggaggattttaaagtagtagtgggaataagcccaatcatatggttctttgcggtgctattcctgctgactaatacacatgggtgtattcctattattgcttccatttatcccattatttgtaagcacagactaatactcattctgtttatgatgcttgtctatatttcccttcttcat

SEQ ID NO: 31554 - DNA, 972 bp, Glycine max
  Peptide Sequence Number=SeqID_148332
atgatgctatccactgccaaaggtgcacagtcttacagtgacattagaacagtcaacgatctggtatatcctacatttagggaagcatgttttgcaaaaggcttcctaggtagtgatcaagaatttattagtgctttacaggaagctaataattggggtactgcacactacctaagaaaattatttgtcaagtttttatttatgaacaccatggacagaccaaaatatgtttggcaacaggcatggcaatggatggcagatgatatcatattcaatcatagaaaacaaggtattcgccttactgaaaaggaaacaattcatttatgcttaactgagattgagaatatgctacaagcgaacagaagaagcttgcgagattttccatccatgccatacccaataggatatgcacgaaaccaacatcataataatctgatccataatgaaatggcatatgacaaagaaatgttagcagaacaatacaacacggcataccaattgctgacagctacagtttactttctctatggatatggtggaactggcaaaacatttgtttggatagccttatcatctggtatacgctccaatggtggaattgtttgtacagttgcttcgagtggaattacttcattactattgcctggtggtcggaccacacattccaaatttgctataccagtccctgcaacagaaaattcaacatgcaatattcatcaaggcagtgagttagctgaattattaaaggttacaaaactaatagtctgggatgaagctccaatgtgtcacaaatttgcatttgaggcactagataaaagtcttaaagacatcatgcaaaacaatctggcttttggagggaaaattatcgtttttggtggagattttcgacagatcttgccaattgttccaaaaggtaatcgctcagacatcgtccatgcaactataaatgcatcatacatttgggaccattga

SEQ ID NO: 31555 - DNA, 789 bp, Glycine max
  Peptide Sequence Number=SeqID_148333
taccctcatcttcagaggactacgccctcgccttcagaggactacacatcctcacctttaggggactgcacgtcctcgcctccagaaagctacatgccctcgcctttagaggacaacacgtcctcgcctttagagggctacatgtcctcgccttcagagggctacacgtcttcgccttcagaggactacacgtccttcccttcaaagggctacacgtcctcgccttcagaggactacatgccctctccttttgagggctgcacaggactacacgccctcgccttcagaggactaaacgtcctcctcttcagagggctacacgtcctcggctttagaggactgcacgtcgtcgcctttaaaggactgcacgccctcgccttcaaaggacggctcaccctcgccttcagagggctacaagccctcgccttcagaggactgcatgcccccgccttcaaaggactgcacgccctcgccttcagaggactacacgccctcgccttcagaggactgcacgccctcgcctttagaaagggaggctatcgtgcaactactatgcatatcgaggcaagatttcgcccagaccgccatagggagatgagtgcggatcatgcgcaccaccacaactctgatctcccctttccaaagtgccagttggatcacgcccacaagacacccagtagacccggaaaagtccaacaaggccctggggtttctagctctggttacgggcttctgtcagtcctagagggtgcccgtcccccccagcaaggtcatgtcatcgtgacataa

SEQ ID NO: 31556 - DNA, 223 bp, Glycine max
  Peptide Sequence Number=SeqID_148334
agatgatgagagtgatgagcaaaatgacggcgacagcgacgaagtctatttcattgaagcccttaggaagagacgggaccgtgaggcgccatttggcagaggagattccgattgtggtgacgcggaggtaactaaagtcgccgccagcgacgggcatgtcgactacaaacttggtgtagcagaaggcggagtggagggcgcaaaagccggcaatggcaattaa

SEQ ID NO: 31557 - DNA, 240 bp, Glycine max
  Peptide Sequence Number=SeqID_148335
atgtcgttcaccaaaggaaagatgtttgtaaatgaaatggctccaaagaaactctccacgaagaggtctagaagggacgccattggagaaggctccagtaccgccttggagtttgatagtcaccgtttccggagtgccgagcaccagcagcgcttcgaggccatcaggggatggtcattccacaaagagaggcgtgtccagctcgggaaaatgagtacacagacttccaggaggagatag

SEQ ID NO: 31558 - DNA, 600 bp, Glycine max
  Peptide Sequence Number=SeqID_148336
atggaagaaccatcaaagaagcaaaagggtacttcgagtcggagtcaacgacattctgagtcacaggaaacgccgattccttcctctattccctctgcctcattgttttcattcgaagaacagcagatacggtacacaaacctcttttcatcttgttccattattgatccaaaattcattgatatggatttcttttcaaatgagagttttgaatgcattcaagcatttgaaaactccaatcttattcctttcatgtctttaaaattgcctgtttattctgatttagtcaaagccttctattcaaacctagaaatccaagaaggcactttaatttctgaagtttatgggattaaaatggtcattgaccaatccctattctatgatctaactcaattaccaagtgaaggtgtaccatttgaaggtacactgattgatgattggaagtttgacttctctgtgcatgatgcccgccggttggtttgcaccaatcaagcggatatgaccggaaggcttcttgccggttcattggcttttgagagccgcatccttcattaccttattgttcatatcttgcttccaagatcttcaaaccttgcacag

SEQ ID NO: 31559 - DNA, 189 bp, Glycine max
  Peptide Sequence Number=SeqID_148337
atggcggacagtggcagaggaccccgccggagagaaccgcttctggtgtcgccggagaaagaggctacaaaagcttcgtggagacttaacgtgaaagagtttcgtttgccaaaccaaacaaatgatcatcaaaatcatcaatccttcactttccgtggctttcttcgtgaacccatggtgacgtgttga

SEQ ID NO: 31560 - DNA, 174 bp, Glycine max
  Peptide Sequence Number=SeqID_148338
atgcttaccaaatatgaaaacggttcttcttcgtcttctccttatcgtttcccacaagcggcctccattgttgcacgccgtcgcctctgttttcccgcacaggtatggcagattgacactgccaaatttattgaaagcaggagatatgcagtagaaataccggctgatcagtaa

SEQ ID NO: 31561 - DNA, 798 bp, Glycine max
  Peptide Sequence Number=SeqID_148339
atggatgaattcctttctagcatttggaactctgatgataacaaccaagttaacccaccactatccacccttgatgaagctggaaaggctaacaatagccttgccaggaatgagccactactcaaaaggcagcaaacacttggggaaatgactttggaggatttcctagtaaaagctggggtggtacaagaatcatcatcactattcgagtcttcattattatatcagaatcagattggtaacattgcaagtaatggaccattgagtgcaagttataggttcaggcatgatgtcactacaaatggcgctgtggagaaatgtccaagcttaggagaatcaagtgggaagggtaataggaagaggatcattgatggccctcctaaagtggtagtagagagaagggctttcaagtttcaatcttctacgatgacgaggaccagcagtccagcacaacaacacgacatcgatgacaaggaccaccacgatgcgagtagctcagcacccgaaccaaacttgaataaggcagacatgcaacaaaaactgaaaaacacgagaccaccacagtcatcactcgcgacgcgagacggcgagacctccacctcctcaccgctgccttgctgcgccgccgcgagagctcctcacccttaccctcgcgagagccccctcattcctcactcagtctcagactctcagcacctcaccggcgccgttagagatagttctcgttggacctcaccctctcttcacggacctcaggttttattttctattcaccctcctcaagctcaagcagtttga

SEQ ID NO: 31562 - DNA, 360 bp, Glycine max
  Peptide Sequence Number=SeqID_148340
atggctttgatttcttcttccatggcttatctccaccttttgtctttcattgcttcatcaaagttcaatatgccagcccaaaccatcacccctgagttgcagaaagatttgaagttattaaagttgagggctgccctcgatccaaagcggcactacaagaaagattctccgttggactttttctcaggcagattaacaaagaagaagaggaaagcaaggcttgcagatgagctgctttctgatcaaaaccttgcagcctatagaaagcggaaggttcgagaaattgaagaacaaaatcgaccagctgggaatgaaaagtggaagattaagggtagtaattcccgtaggcacaaattataa

SEQ ID NO: 31563 - DNA, 237 bp, Glycine max
  Peptide Sequence Number=SeqID_148341
atggagtcgaggattacccaatcaacatcgggcgagcaaggttcagtgcaagaacatttacatggtgaattgcccactggtcaatgcagtttccttcaaacagttttcaatgcaactaatgtgatgactggagttggcattctgtctacaccttatgcattgaaagaagctggccacccttatgagatagatactgctttgaaagcagggaaggaatcactagctacccaactatag

SEQ ID NO: 31564 - DNA, 474 bp, Glycine max
  Peptide Sequence Number=SeqID_148342
atgtatggaggtggtgcaatcatgggatttcccatgtttggtgatgggactttgtctcaaataacattaaatatgccacgaggtgcattagcttccaaggttacattgtggacaacggtcattaacccatttactaaatatgctttgttgatgaacccattggcgagaagtctcgaagagttgctaccggatagaatctcaaataattatggatgtttcattcttcttaaaacaacacttgttgtatctacattttgtgttgtttttctgatttttttttgggtttgtgatgactttaattgggtttctcttccgtgtacttttgttattgatagcagcagagaccctcgaggagaggatagcagcagcaactcacacgagcccagcccacagatgaataaggacgaacctgaaccagcaagacccgctaggatagcccataagcctacatacttgaacgattacgtaacatag

SEQ ID NO: 31565 - DNA, 267 bp, Glycine max
  Peptide Sequence Number=SeqID_148343
atgtggtattggaatgtgttttgggcagagttttctgcctctgccctgttttcttggttttggatacttggagggattgatggggacccggtgcagagaggaacgaggataagggctacgtgggagtccgtgagctcagttgaaggtgggcaactggggatggtgggttcatgtgtgatttgtggatatggagagtttatttgcaccatcgcccgatcgccgcctagtaccacatgtgacgggtaccccataatcctacaagcttga

SEQ ID NO: 31566 - DNA, 595 bp, Glycine max
  Peptide Sequence Number=SeqID_148344
atgtcctccttgactcacctagacctctcttatactggattctatgggaagattcctcctcagattgggaatctctcaaatttggtgtatcttgacctgagttcagatgttgccaacggaacagtaccctctcagatcgggaatctctctaagcttcgatatcttgacttgagcgccaattatttacttggaggaggtatgtcaattccttctttcctcgggacaatgacttccttgactcacctcaacctctctcatactggattcatggggaagattcctcctcagattgggaatctctcaaatttggtgtatcttgacctgagttctgtttctgccaacggaacagtaccctctcagatcgggaatctctctaagcttcgatatcttgacttgagctacaatgattttgaaggtatggcaattccttctttcctttgtgcaatgacctccttgactcacctcgacctctctcatactggattcatggggaagattccatctcagattgggaatctctccaatttggtctatcttgacctcggaaattatttttccgaacctctgtttgctgaaaatgtagaatgggtatcaa

SEQ ID NO: 31567 - DNA, 165 bp, Glycine max
  Peptide Sequence Number=SeqID_148345
caatctgtgtctattaccggagatcatgaccctcttctcaggatttcattaacaccaactaagcatgtatcttccgatgagttggatgatgagccaaaaaactttcagatttcacctgcccaagtttcctcaaataaattagccaagcattctcaggctgaatga

SEQ ID NO: 31568 - DNA, 189 bp, Glycine max
  Peptide Sequence Number=SeqID_148346
atgtattttcgtgaagaaaatccaagccgaggtgcttccgtaatgcttccgaggcgtttccgtaagcgattctgtggaaattcttcatcgttcttcatctttcttcaccgttcttcgtcgttcttcggtcttcaaccgtcactgttaaaacaaaatctaaccgatcgttcacgctgtaacctcgattaa

SEQ ID NO: 31569 - DNA, 684 bp, Glycine max
  Peptide Sequence Number=SeqID_148347
atgcagcaaaatgcagcgccagccgtgcagccggtctggcacgcgcccgcgcccgcgtgtcgcgcggaaatttcgctttcgccagcgagtattcgcgcactcggagagctgacggatcatctgcccgcggccggtttactccttatgctgctggtgctgtccattgtgatggttcgtgtggggcgggtgttcactgccaggcaggcggatcgggctgatgcattcagcgttcgccacggaacgtcggttcccgtgccggcgccgttcggcagtccggcgatggctgcacgtgcgcttgcgcatgaggaaaccgcgtactggcagcagctgctggccgctttcgcagccgccattgaggcggaagggtacaccttcggcaccgatgcacgggcaaaagtggcgttacctcacgccgtgcgggcccgtgcgggtggggcaattgtgaaagcgcgctcgcggcacattacgccgctgcggagtgaagcggcgctggaagatttgcagctgcaggcagcggaggacggctacgcgggcagctgggcggactggtgtcagcggggcgcagaggcggccggctggtatgtcatcaggcgtgaggtgaaccagctgtctgacggtgcggtaacggcgactgatgagcctaaacctgacaacaggatacagactgatggactcttaccctga

SEQ ID NO: 31570 - DNA, 520 bp, Glycine max
  Peptide Sequence Number=SeqID_148348
atggatgtaaagacagcttttcttaatggtgacttgagagaggaaattgatgtggaacaacctgagggctatgtgattcaaggtcaagagaacaaagtgtggagtgttatgtttctcatgaattgtactagacctgacatagcatatgctgtgagtagactaagcagatatactcacaatccaggtggaggtgccatatcatggaagtcttccaagcaaacttgtatagcacgttcaactatggaatcagaatttattgctcttgatttagcaggtcaagaagctgaatggttgagaaacttgttggcagatgtgccattgtgggggaaacggtctataccagtttctcttcattgtgactttgaagcagctattggaattgctaagaacagtgtttataatggaaaaaggagacacatacgcattagacacagttcagtcagagaattgttaaaaaatggtgtgatctcattacagtttgttagatcagagaacaacttggcagatccgttcactaaag

SEQ ID NO: 31571 - DNA, 204 bp, Glycine max
  Peptide Sequence Number=SeqID_148349
atgactctattttggacacgacttcctatcgaatcaaagatcaaacgtggggtgggatatcgccagtcgagaacgaccttgaatggcaatctgaagggaagagacaccaaaatgggttttcctttgccggcagtcccttaccttgctgaaaatttatctggtctaaagatcttccgttctctttctttcattgatcgagaatag

SEQ ID NO: 31572 - DNA, 289 bp, Glycine max
  Peptide Sequence Number=SeqID_148350
ttccagtcaggacgttgtatctccaaggacttgtgtccccgctgctgctcatctgatcactgagaagaggaggcctgtgtgggaacacacggtcattctaggggccttcccctgccctccagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcgg

SEQ ID NO: 31573 - DNA, 129 bp, Glycine max
  Peptide Sequence Number=SeqID_148351
atgggtacaacggatgacgttgtgaagactcctaagaagggaattgtttttgttgaagatcttccaaaagaagtagtagttgtagttaactttgatgagaggcctagcattggacatgaaagtctgtaa

SEQ ID NO: 31574 - DNA, 490 bp, Glycine max
  Peptide Sequence Number=SeqID_148352
atggtcgtgaagctcttgatcttgaagagatcagagctcgtgtcgcttgcggtgtcgtctttgacaatggcacgcaccttcatctggaacgggaagttgagttgcttttgtgacggatttgatgatggctcatccggtagacaaaaactcgagggattcacgtggcaaatcttcattgaggtagaggggggaagtaagaagcgaagcaacaaggtagagggggagaaggaagaactgaagagagtagtggagaatgaagaagctgatacacatggggagcctgtgcgacctttgaagaggttgcgttcaagaggccaagaggtgcccgagagtagttccaaactgcaacctcaaagcatggctgcattatctgatggaaatgtaaagatcggtgctcagccaacaattgaagcaggagttgctccgttagcaaataacaaaatgcctcatccatttattttgatcaagcctaaggatgagcttgttgatg

SEQ ID NO: 31575 - DNA, 255 bp, Glycine max
  Peptide Sequence Number=SeqID_148353
attaaggctgctgtttctgcgctttggaatactcgtggcttgaactggccttattcatttgagcaacagaggcagaaaactggagatttagacatgcttgattggcttagagccatgtttggctttcagagggacaacgtcaggaatcagagagagcatctgattttgcttcttgctaattctcatataaggctacaccctaaacccaagcctttcaacctggcacgtatctgcctctcactttttctgttttag

SEQ ID NO: 31576 - DNA, 312 bp, Glycine max
  Peptide Sequence Number=SeqID_148354
atgattcgaagcactttacactattttggaaacccaaggactcaatcgtatggatatgtaaaatacaggatttccaatcctagcaggaaaagggggggaacggatactcaatttcaagatccacacaaggaaaaagcacttgccattcgttggttattgggggcatcccgaaaacgtccgggtcgaaatatggctttcaaattaagttccgaattagtggatgctgccaaaggtagtggcgatgccatacgcaaaaaggaagagactcatagaatggcagaggcaaatagagcttttgcacattttcgttaa

SEQ ID NO: 31577 - DNA, 342 bp, Glycine max
  Peptide Sequence Number=SeqID_148355
atgtcaatccttaccctcggaagcaaaaaagaaaagaaaggaaattcccaatcaaagagtgggagaaagagaaaaaagaaaagaaaggaaattcccaatcaaagagtgggagaaagagaaaaaaaagaaaagaaaggaaattcccaatcaaagagtgggagaaagaaaaaagaaaagaaagaaaattcccaccaaagaatgggagaaagtaaaaaaagaaggaagctcctggtcaaagaaaccagaagaaatgtgcagaaaggtctttggaccggacaatatctgaacaatacagaattgtcaccaaatgaacaaaaagaaggaaagggaaccacgacctaa

SEQ ID NO: 31578 - DNA, 1251 bp, Glycine max
  Peptide Sequence Number=SeqID_148356
atgaaattaaaatcattgttaatcgctcacgcggtgctgctgggcagctgtgcggtgcaggcgcaggcagcagatgacgcatcactgattaaaaaaggcgagtatctggcgcgccttggcgactgtatggcgtgccataccgtagccggcaaagcggattacgccggcgggctggcgattgagtcgaacctcggcaccatttactccaccaacatcacgccggataaacagcacggtatcggcaactacagcgagcagcagttctcggatgcggtgcgcaaaggcgtgctgccggacggctcgcgtctttacccggcgatgccgtacccggattacgccaaaatcagcgatgaagacctacacgcgctgtacgtctacttcatgcagggcgtgaagccggacagcgcgcagccgccggaaacaaagctgagcttcccgttcagccagcgctggggcatgcgtttctggaactgggcgtttacttcggacaagccgttccagccgattggcggtgcgtcagcggaggttaatcgcggtgcttacatcgtggaaagcctcggccactgcggcagctgccacacgccgcgcggcatcggcatgaacgagaaggcgctggacagcagcgacgatcgcttcctcgccggcggcagcctgaataactgggaggtgccgtcgctgcgcggtgtgccacgctggagcgagcaggagattgtcgattatctgcaaaccggacgtaacgataaagccgcggtgggcggcgagatgacgtcagtggtggagcactccagctcgcatatgacggatgccgatctgcaggcgattgccgcttacctgaagttcctcggcggcaatccgccgctgcaggcgtatgacgtgcaggcgcagcagaagaccgaagcgaagctgacggcggcgaagaatctaagcgaaggcgagcgtctgtatctcgacaactgcggtgcctgtcactttgtcaccggcaaaggcgcaccggggatcttcccggaattggatcaggccactatcgttaatgcgcaggatcccagcgggttgattcacaccattctggccggtgcgcagcagccctcaacggagaaagcgccgtcgacgctggcgatgccgccgtttgcgtatcgtctgaccgatgatgaagtggcgcagctggccacctttattcgtcagggctggagcaaccacgcgccggcagtgacgaaagaacaggtggcggatgtgcggaaaacgctgcactaa

SEQ ID NO: 31579 - DNA, 204 bp, Glycine max
  Peptide Sequence Number=SeqID_148357
atgcaagggttatggttgtgggcaaaactgagggccctccgaagtgtttggcaggggtacaccaccaactgcttgctcttcagtggtgtattcaaggcaaggcttgaagttggctcgattgtggtggggtatttcatgtgtcccccctatgggttgagggataggtgcatgactagatcaaggttgttggctctcaatgagtat

SEQ ID NO: 31580 - DNA, 252 bp, Glycine max
  Peptide Sequence Number=SeqID_148358
atgaatagaggaagaaatggggataatggacatagaaagagggttccttttttagagatactcaggcttaggatgtattcattagagagctttgagtatctagggtggaatgctattaagtgtgttttttgtggtaaatatgttgaagctatcatagatttagtaagagatagtaatgttgcacctccttttttggcggttcaatacagcagacttagaccatgtggtgccttgactcgtggtatgaattga

SEQ ID NO: 31581 - DNA, 264 bp, Glycine max
  Peptide Sequence Number=SeqID_148359
atggaagaaggaaaggtgtatattttgcagaatgttagtgttatgaagaatggtgctgaatttcgattaggaaatcatgaatataagcttaaactaacaagattctcagtggttgaagacattgctgggtggacttcaacaatatcctcagtcgaacattttctcaaagacggcaagaacattcaaagaatttttactcaactcagtggtggacagtatgattcttttaacttgttggcaagtgcatcgttttgtcacaagtag

SEQ ID NO: 31582 - DNA, 498 bp, Glycine max
  Peptide Sequence Number=SeqID_148360
atggtttccttaagatacaaaattagttgggttgattggaacatataccaaataccagttaaggtttacatacttgattccaccgacaaagtgaggtcaaatggttccaaaatacttcatgattgtctggcagagtataccattccagctggtggtggtggtgattctcctcatgtccaaaaagcaaacatcccaatggaaaatggaggttatctaatttatggcactgctcatatgcattcaggtgttgtaaatgcaactttatatggacaggatggaaggactttatgtacatcaacaccaaaatatggaacgggaaaagaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 31583 - DNA, 555 bp, Glycine max
  Peptide Sequence Number=SeqID_148361
atgtggatggataggttcgccttgaccttaaatggaagtcaagacctcccgcgactgctagccaaagcaaaggccatcgctgaaggaagcggaaccgtgctacaacccgcaataaacttgggccgagacagaaacacgacgggtttcaatcgaaggtatagtcctcaagcctacccttatggtttgcctccagacttcattccccgtaccggtctagacgatttgagccaagtccctaccttcgaggggcagctccctcctcatgccgactatcctctgcaggaagatgatgaaggagatgcccatttaggccctctacttcccctcaaggaaccggccccccatgagttgccccaaccaaacatagtccgccacgtcccgtctccatccacacccgttaaagaactcattcccattgcaaaagacaagggaaagattgatctacttgaagagaggctgagagcggtagaaggcctcggcaactattcgttctcggatttagcggatctgtgtctggtacctgacatcatcatttctcccaactgcctttattag

SEQ ID NO: 31584 - DNA, 234 bp, Glycine max
  Peptide Sequence Number=SeqID_148362
atgaaatttgtgaagacttgcagctggtgtctcgctaagcgaggcttgtgcgcttacgcgtcatcagctaactcaacgaggcgtttgtctcttcctgcgttaagcgcgcctagctcgcttagtggatattcactaactcaagctaagcgtgaaaatggcgctaagctagccttcgaggacagaaagccctttttaaggctgaagttggaaaaatcaagaaagaggttagaatag

SEQ ID NO: 31585 - DNA, 885 bp, Glycine max
  Peptide Sequence Number=SeqID_148363
atggctatggatcccgccactaacggtgcagatgatgatatggaagcagcgatggctgccatgggagtgtctgatcccggggatgtacagaccatcgcggaggatgactggggtgcggcgctcgctgaacaaacccaggctgagtcttctgcgctgcaagagcaaaccagcaaaaccgctgtgtttaacgagtttagtgccaacaacaagctggaagggacccagaatgatattgatttcatcctggatatcccggtacagttgacggtagagctagggcgcaccaaaatctcgatcaagaatttgttgcaactggctcagggctccgtagtagagctggatggcatggctggtgagcctatggatgtacttgtgaatggctgcctgattgcccaaggtgaggtcgtggtggtcaatgacaagtttggtattcgcctgaccgatatcattacgccagccgagcgtatccgaaaattgaaccgcatgatgaccactggtgtggcttgggcagctgcgcctgctgtggccgcttcttctgtgccgactcctggggacagcctgggccgcatggtgtttggtacggtgattgtcttgctggtgattgccgcggttgcctggctgttacggcgtgtcatgccaggacaaaccatggcacaacgtggcgtgatcaaacaagtcggtggtttgcagcttagccccagggagcgcgtagttgtcctggaggtggctggccgatggctggtggttgggattaatgccgggcaaatgaccgctctcggtgaagttgaccctatggtcactgaaacaaaggccactgaaacgctagcagaagagggcgcttcgatttctgcagcgacaggggtcgatccggaggcttcttttgct

SEQ ID NO: 31586 - DNA, 225 bp, Glycine max
  Peptide Sequence Number=SeqID_148364
atgcaagccttctgcaaggcgtacggaaagattttagatttgaccatagcagagatatccacagaagctgttgtatcactcacccaatactatgaccaacctttgagatgcttcacgtttggagacttccaattagtaccgactatcgaagaattgaggagattcaaggatgttctcttgggggaaggaaaccgtatcttttctccgagtttcttccctccttga

SEQ ID NO: 31587 - DNA, 309 bp, Glycine max
  Peptide Sequence Number=SeqID_148365
atgaaagattgcagaaatacaagtagtggggatgtctcctccacctctaggacctcacaatcactcacaaactcatctcaagctctcaggacggcttcctcttccagctctgcggttagcgcaattctgaaccacttagcgcgcattagtgaattttggcttagcgtggcttttctcgctcaacgtgatgcaatcctccctaggaagggaccaatcactagaaccatgagcaagaggctccaagaagattgggctagagctgctgaagaaggccctagggttctcatgaaccttagggtagatttctga

SEQ ID NO: 31588 - DNA, 297 bp, Glycine max
  Peptide Sequence Number=SeqID_148366
atgacgaatacgagacttgggatgtacagggcaacatacaactcagacaaacgagactttgacctgatatgggaaacccatgatgcaaagctttttcaggcagcttgcaatgggaagttttttatacccttcccggttgaacacaacaataaattggttcaattcttccaaaaggagaaaaaggataaagagatttatgaggccagtggttgtcatggacaacaaactcctccatttccatccattgatctttccatggaagactcatcagacattttctactcagaaaacgtctag

SEQ ID NO: 31589 - DNA, 140 bp, Glycine max
  Peptide Sequence Number=SeqID_148367
atggcaaagagcagtatccacttgaaactcggcattacttacttatcatacaaacctagcccgttatggggcactttcagccggtggaaggcactcatctcagtctcagggacatgcccagaagaaactgctggtgtcag

SEQ ID NO: 31590 - DNA, 270 bp, Glycine max
  Peptide Sequence Number=SeqID_148368
atgcaatcaactttggtgccaaagggtgtgtatgaagaattagagaggctacaatgtcattttgtttggaatgataaccaatatgggaaaggttggcatataatctcttcagagaagttctacagggcgaaagtggatggggttaggagcttatctcaaaaccatctaagtcctgggttcatgttcttcaacataaatatcattgtggggatggcgttatcctgcgagttatttgctctaataatgattcccaaacttggaagggaataa

SEQ ID NO: 31591 - DNA, 738 bp, Glycine max
  Peptide Sequence Number=SeqID_148369
atggtaacaagaagtacctccaaattaattaatgttattaatgaagatagtgaccaaaacttagataacacaactgagataggatcagtgtcagaaaagaatataaatccattaaactccaaacactggaaaaccccctccaaattatattatcaacgtccaactgcccctgaccttctattagaagaaagaggtgaaaacaattttaaaagttttagtgcaaataacatctatgaatggaacatagatgcacaaacggagtataacatcatgaatacactccaacatatgaccatggtagccacggcttaccaaacctcccatgaatgttcggaagaaaccattatagatatcttagtggcaggattttccggacaactaaaaggatgcgcagttaagacggatctcaatggaaaagtcattactaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagagaagatagtcaacaacctttttggaaagaaaaattcctagccggtcttcccagatccttaggagacaaagtcagagataaatccgtagtcaatctgccaatggagacattccatatgaaaacttaa

SEQ ID NO: 31592 - DNA, 687 bp, Glycine max
  Peptide Sequence Number=SeqID_148370
atggggacaaatcaaaacggaaaaagattctatcaagtcaagattaagggcctagatgtcacaggccttaaggagttgggacggttgatgggacccctccaaaggcaagccttccgcaaagtgtacggaaagattttagatttgaccacagcggaggtatttacggaagctgttgtatccctcacccaatactatgaccaaccgttgagatgcttcacgtttggggacttccaaatagtaccgactgttgaagaatttgaggagatattaggatgccctcttgggggaagaaaaccgtatcttttctctgggtttcttccctccttgagcaagattgcagctgtggtcagagattcgacgagagagttggatcgtatgaagcaaattcgaaacagcgtagtgggcctaccgcgaaaatacttggaaggcaaggcaagggatatggcgagtcaagaagagtgggtcccgtttgcggatatagtagctttgctaatctttggggttgtcctctttgcgaacgtggacggtttggtggacctagccgcaattgatgcttttgaccgaaggtgcgagaagaacagcgcatggattgtctgctgtttacccgctctttgtgtgtggtttgtttcgcacctattccaacaagacaaaaggcacccgtgtccgcttcaaagttatcactcatga

SEQ ID NO: 31593 - DNA, 171 bp, Glycine max
  Peptide Sequence Number=SeqID_148371
atgggggagaagaaaaaggaacaactgcaggaagcaactaaattcgaaagcagtgacatcgtgattgatgttccatctcccatcaaacgacatgtgaagtggaagatggtctgcaccaagaaaagtgaccaaatgacgtctgaggcatcaaatgaaattgctgagaagatc

SEQ ID NO: 31594 - DNA, 357 bp, Glycine max
  Peptide Sequence Number=SeqID_148372
atggagttgccaactgtcgcaacctaccctttggcgggagggcgacgcgagggctcacgggtgtgtcttccaagggaggaaggcgcccagagtcgccaccaagtatattcgaggaaaacgttggaaaaaccggaaaggtgtggtctacgaactttaagtgtgaaaggtttgggagttgtttttatgcacggggaagtgattaaacgagattacaacgcaaatgatcggttgaaattcattttatcatttagtaggcgagataacggcttaaacgatcggttaaagctcgttaaaatggaagaaaagaaaatcgaaagtgaacgaaataaagatgaaagccaacaaaacaagaaatga

SEQ ID NO: 31595 - DNA, 636 bp, Glycine max
  Peptide Sequence Number=SeqID_148373
atgggtgatcctgaggcacagtatgcattgggttgtcatctaagagttgaggtgaggagtaattcaatttccatatcagatatgtatcgtattggattggatacacatattgtatctatgcatcatagttgtgcaattctattagattttgatgatgtacacattattgaatactttgggaagtatggcgatccagagaattctttagttttgttttaccatttgtttttacaacatttttggagacagaatgactatgtccagtctgatcaacaagctttttattatttggagaaagctgtggaccagttgcatccaggtgctctttaccttttgggtgctgtatatttgacaggcgactgtgtcaggaaagatattgcttctgcattgtggtgtttccacagagcatcagaaaaggatcatcctatgtgctatcctgcttttcgcatttttggggttggctactacgtaccactctttagaattgataacaagaaatggatcgaactaggtgatgatgatgttaatgctaggttgttgcctggaggctggaagcagtgcattgtatggctaaagtacaaatgtcaaaggagtaaaggagtgactgcatccctgcgtagatgtagtgaaaaataa

SEQ ID NO: 31596 - DNA, 291 bp, Glycine max
  Peptide Sequence Number=SeqID_148374
atgaatttggccaataaagccctcggaagcatcttatctgctaaaaaacaaagcaacaatgggtattcctttccaacgtcttctaaaaaatttggaaagaagaaaaagttagagaggagattgtgtacacaaatcgaaggcttaagtgaagatgtcgaagagaacacgttcgaagtgcgattcaggattcactctgtctcgttaggcgaacataggagaaatccggcgaagccaaacggcggcgcgactcagacgacggtggaggtcaggcgcagaagagtcgaagcatga

SEQ ID NO: 31597 - DNA, 294 bp, Glycine max
  Peptide Sequence Number=SeqID_148375
atggaaaggttcgaattcgggaacttaccggttgaagaccgaagaacgacgaagaacgaacgaagaacgatgaagaacgatgaaaaaccttcgcgaaatcgcccacggaaacgtctcggaagcgttacggaagcgcctcggcttggattttcttcacggaaacaatttttctcactaattttaagggaaaagagggaggtggttgccgcccagctcgcctgggcgagctgggttgcttccaccagaaggcatcgccttctgttggaacatcctggaaggcccaagtgggcctga

SEQ ID NO: 31598 - DNA, 216 bp, Glycine max
  Peptide Sequence Number=SeqID_148376
atgagatgtacaggttcgctaagcgcaccgcttcatctcactaagcgcaccgctttagttcatccactaagcgagaaaggcacgctaaaccaaaaatcacaaatgagacatcctgatgaggacatgaccaagagcaagggcaaggatccacttgaaggacttggaggacctatgacaagggctagagcaaggaaagccaaggaagatcttcaacaa

SEQ ID NO: 31599 - DNA, 222 bp, Glycine max
  Peptide Sequence Number=SeqID_148377
atgggtggctatgttgatgtgtgccgtggtgtttggaggatacaagggtcattggctgtttctaggggaattggagatagaaacctgaaacaatgggtcatagcagaacctgagaccaaagttatcaaaattgagcctcagcatgacttgttgatcttagcttcagatggattatgggaaaagctattaactaatgaaacttctatttcgaatcttgtttga

SEQ ID NO: 31600 - DNA, 288 bp, Glycine max
  Peptide Sequence Number=SeqID_148378
atgattggacccaaccttggcccatgggctcagaagtctaccctgaggttcatgagaaccctagggccttcttcagcagctctagccctatcctcttggagcctcttgctcatggctctagtgactagtcccttcctagggaggattacatcatatgtcctggccgagtttagtccaacaagaggaatctgcagacgatgcttgatcaggattaggctagactatcatgaggaatcggggtttagcatttcaggagacaccatagaacacataagaattgttaagtag

SEQ ID NO: 31601 - DNA, 201 bp, Glycine max
  Peptide Sequence Number=SeqID_148379
atggttactcatctggaacacctaaatcaaaggcttctgctaggtggattgtcgtcaagtgtaatagacaaaaaaggaagtactgagtgcggctactatgtcaatttaggaacttttaggaataattgggaagcgaccattggagccagagagaataaaggcattgcggatctagtgggcacagttttatctccgagttag

SEQ ID NO: 31602 - DNA, 242 bp, Glycine max
  Peptide Sequence Number=SeqID_148380
ggatttcctgtctgttgtatctctcgttacaatctttcaaagaaatgaacgtgggtttgaggcttttagtcctcacgggcaggatcaccttgggctaccttctggagtggagacaaaacacgaacggcagaaaccaatcaaggcacttaaggatgaacgcaagcggggatggggtcacgaccgaccgatcgttgctcttctctgtgcgaagcaagcagggaatgtcgctgcaaggcagcccc

SEQ ID NO: 31603 - DNA, 155 bp, Glycine max
  Peptide Sequence Number=SeqID_148381
ttatttgttccctcattgactggactatttgtaacggagaatggagaatcgtgaataaggaaaagaaggataaaagagaaagagagagagagtatccgccgttttggaaacgggcttttgagtttgttgacttggcaaaggcaaaggcagcggtt

SEQ ID NO: 31604 - DNA, 621 bp, Glycine max
  Peptide Sequence Number=SeqID_148382
atgactggtcagattagggaagaattgaggactcaaattaaggaagaattgagggctcagctagaagaggaaaataaaaggagcttggaaataatgaccatggcattgaaagaggctattaagaaagagttgtcacataaaggatccccagagtcaccccaaattcagccggacatacaacaattaggtgcgcgtgtcagcactaagggaagtaatgttgttatcaatgtccagccttcacaggaacatgatgctgatgtcataccaatgatgggactgtatgtgcaacgtaaggatggtacactcgggttggtggccatggggaaaataatggagggggattcaatcatacacatagtggcttatgcagatgatgttgtacgggtaactgtagaaacaattatcgatcctgaggctgaggtcctctatgccacctcagaaatacaatatatgaagcaggccgtcgatacatttgtagcttggcccacacaccttgtgaaagctgatgtagaaattattccgcacaacgaggatgcacatgtgccaaagccggctaatgtggacgcagatgatccgttgcgtggcctaataaagtacagttttgatatttatgagaagccg

SEQ ID NO: 31605 - DNA, 474 bp, Glycine max
  Peptide Sequence Number=SeqID_148383
atggctagtgtgggaaaggagcgtgcaggggcagagatagtgtatggttctgaagaatgttatcgccaatccatagagctcttagaagagttgggttttccaaagggtgttcttccgttgcaagacctggtggagtgtggaagggttagagaaactgggtttgtgtggatgaagcaaaaggccccttatgagcatttctttgagggaaccaacacgagggtgagttatgctgtggaggtcacaggctatgtggagaagtttaggatgaagaaaatgactggcattaagagcaaacagatgatgctgtgggtgccaatagctgagatgagcattgaagatcctaagggccagaagatacactttaagacccctatggggattggaaagtccttccctatcatggctttcatgaccccagaggaaaaggaaaagcacctgctgttgcaggataaggagattcaagaaaacaattag

SEQ ID NO: 31606 - DNA, 1515 bp, Glycine max
  Peptide Sequence Number=SeqID_148384
atggcatcggatctaaattcggggttgtccaaggaaacatctgtttttgggttgaaagcatgggaattgatggggataatagttgggttgttcattataatcattctcgtggtgatatcaatatgtcttacttcaagaaagaaatctagaagagtcaatggcatgcttccccttagccatatgttatcgatttcagatgagatcaaggaaattagagttgatcaagtttcagccaataatcatcctcagaatggagcttttgtgagtctgtatgacaggtttagtgacagagactccgaaaaggttttgatccaaacaaataataatggggaaaatagcagtcaatcaggctcttttgttcatcttaagaaagatgatggctctcaatcaggtgaagaaagtggtgctaagtctgtttctacttactggtcttcttcgcatcctataactgcaccgtcccccttgtgtggtctgcctgaattctctcaccttggctggggacactggtttacattaagggacctagaacttgcaacaaacaggttttcgaaagacaacgttattggtgaaggtggatatggtgttgtttatcagggccagttaatcaatgggagtcctgtggctgttaagaagctactcaacaatctaggacaagctgaaaaggaatttagagtggaagttgaggctattggccatgtgcggcacaagaatttggttagacttctaggctattgcattgaaggcactcacaggttgctggtttatgagtatgttaacaatggcaatttagagcaatggcttcatggagccatgcagcagtatggttttcttacttgggatgctcggattaaaattctccttggaactgcaaaagcgctagcttacttgcacgaggcaattgagccaaaagttgtacatcgagatattaaatcaagcaatattctaattgatgatgacttcaatgccaaaatatctgactttgggctggcaaagttattgggtgctggaaaaagtcatatcacaactcgagtaatgggtacttttggatatgtggctccagaatatgccaattctggattactaaacgagaagagtgatgtttatagttttggggtattgctcctcgaagcaattactggaagagacccagtggattataaccggccagcagctgaggtaaatttggttgactggctgaagatgatggttgggaataggcgtgcagaagaggtggtagaccctaacattgagaccaggccatcaacaagttcccttaaacgtgcccttttgactgctttgaggtgtgttgatccagattctgagaaaagaccaaagatgagtcaagttgtccgcatgcttgaatcagaagaatatcccataccgcgcgaggatcgaagacgccgaaagagcctggcaggaaatattgagctgggggaccagaaggagacttctgacacagaaaagactgagaatccagattctaagtctaatggcagaaggaaccaaaggaagtag

SEQ ID NO: 31607 - DNA, 318 bp, Glycine max
  Peptide Sequence Number=SeqID_148385
atgggtctgtgttgccaatctcaaaaatggaccttttcagagcagcaccattccccctcttcctcacacacacttcacaaacagaaagagaaggtaaaggcaaggctttcaccgacccttgtgtgctgtgaagttgttggagggaattggagaacacaagaggcacatgaaattgtgagaagagggaaatggtgtggttgggttaataacaaggcatggaattatcagtggtttcttcagacggtgacagataaacaaatgcttcaatggtactatttgacattaaatacacaagtgtggaaaacgaaaaacaaatag

SEQ ID NO: 31608 - DNA, 1083 bp, Glycine max
  Peptide Sequence Number=SeqID_148386
atggccaacgtgttcgcccaggccgggctgccgaagcgggcgccgccggtcaaccgctgcaaggacaacggcatcgccgtcggcggcaacgcgccgcgcatcacttcgccgctgaaaaacaccacctataccctgcgccagtcgcagcaggggcgagataaaatcgccttcaacgcggtgacggacgccgacagcaagacggtgtactggttcgttgacgatatctatctcggcagcagcgccagcaaaaagccgatcgactggcggccgattgacaacgggcgctaccgcattcgggcggtggacgatcgcggccgcgccgatatgcggctggatgaacacctggtggcggtgaacaagccgtcgggttggttggtgcaccgcagttggctggatcgtcatgagacccgctttatgatgcagacggtgcgcgatcagctcgggcagcacgtctttaccgtgcaccgtctcgatcgcccgacgtccggcgtgctgctgatggcgctctccagcgaggtggcgcgcctgctgtcgcagcagttcgagcagcatcaggtgcagaaaacctaccatgcggtggtgcgcggctacgtgcaggagggggcgaccctcgactacccgctgacggcggagctggacaaaatcgccgataaacatgccgatgccgataagggaccgcagccggcggtgacgcactaccggccgctggcgcaggtagagatgccggtggccgtcggccgctacgacagcgcgcgctacagcctggtggagctgcagccggaaaccggccgcaagcaccagctgcggcgccacatggcgcatcttcgccatccgatcatcggcgacagcaagcacggcgatctgcggcagaaccgtggcatggcgcagcatttcggctgcccgcgcctgatgctgcacgccagccatctgcagctgacgcacccggtgaccggtgaggcgctgcgggtgacggcgcgctgggacgaagactggcaaggggtgatgacgcagttcggctgggcgggagtattccctgaacttgccggggttgagtttagcgcggctaacggtcaggatagctga

SEQ ID NO: 31609 - DNA, 2442 bp, Glycine max
  Peptide Sequence Number=SeqID_148387
atgatattccattcccatgttgtcaacaaactcccctcaataacaacaccactcaccaaaaacacccacttttcttcattcttttcaacttctcttcaaacttccaatcccccgaaccttcttcaactctgcaccctatgcgacaccctttcccaaaccaagcaagttcacgcctattccctcctccatggcttcctcccccgcagtgtctccctctgcgcttctctcattctccaatatgcatcctttggacacccttcaaattcccttcttctctttcaacacagtgtggcatattcccgaagcgccttcttgtggaacacccttattcgtgccaattccattgctggtgtgtttgatggatttggcacctataacaccatggttcgtgctggtgttaagcctgatgagtgcacctacccttttgtcctgaaggtgtgttctgattttgtggaggttcgtaagggtagggaggttcatggggttgcgtttaagcttggctttgatggggatgtctttgttgggaatacccttttggccttttatgggaattgcgggctttttggcgatgcgatgaaggtgtttgatgaaatgcctgagagggataaggtgtcgtggaatactgttattgggctgtgttctcttcatgggttttacgaggaggcgcttgggtttttcagagtgatggttgcggccaaaccgggaattcaaccggatttggttacagttgttagtgtgttgccggtgtgtgcagaaactgaggacaaggtgatggcgaggatcgtgcactgttatgctttgaaggttggcttgttgggaggccatgtgaaggttggaaatgcgttggttgatgtttacgggaaatgtgggagtgagaaggcttccaagaaagtttttgatgaaattgatgagaggaatgtgatttcctggaatgctattattactagtttttcttttagagggaagtatatggatgctttggatgtatttagattgatgattgatgagggaatgagaccgaactctgtcaccatttctagtatgcttcctgtgttaggagaattaggacttttcaagttgggaatggaagtccatgggtttagtttgaaaatggctattgagtctgatgtatttatttctaactcattgatagatatgtatgcaaaatcaggatcttcaagaatagcatccactatattcaataaaatgggagtaagaaacattgtatcttggaatgctatgattgcaaattttgctcggaacaggcttgagtatgaagctgtagaattagtgaggcaaatgcaagccaagggagaaacccccaacaatgtaactttcacaaatgttcttccagcttgtgcaagattaggtttcctgaatgttggaaaagaaattcatgccaggattattcgtgttggatcctccttggatttgtttgtctctaatgctctgacagacatgtattcaaaatgtggatgtttaaaccttgctcaaaatgtctttaatatttctgtcagggatgaagtttcctacaatatactaattataggctattctcgaacaaatgacagcttggagtctctacgtttgttttcagaaatgagacttttaggcatgaggcctgatattgtttcattcatgggtgttgtatcagcttgtgcaaatctagctttcataagacaaggcaaagagatccatggtctgctggtgagaaagctatttcacactcatctttttgtggcaaactcgctcttggatttgtataccaggtgtggacgaatagatctcgctactaaggtcttttactgtattcaaaacaaggatgtggcctcttggaatactatgattttgggttatggtatgcggggtgagttggacactgcaatcaacctctttgaagcaatgaaggaagatggtgtggaatatgattcagtttcttttgttgcggttttgtctgcgtgtagccatggagggctaattgagaagggaagaaaatactttaagatgatgtgcgatctaaatattgaaccaacacatacacactatgcttgtatggttgatctccttggaagggccggtctaatggaagaagctgcagaccttattagaggcctctctattataccagatactaatatatggggtgcactgcttggagcatgccggatacatgggaacatagaattggggctctgggcagctgaacatttgtttgaattaaagcctcagcactgtggatactatatactcctttcaaatatgtatgcagaagctgaaagatgggatgaggcaaacaaggttagggaattgatgaagtcaagaggagctaagaaaaatccaggttgcagttgggttcaagttggagatctggtgcatgcatttcttgttggtgagaaaatagatagtttggatgatgacttttgggtatcagattgttgttaa

SEQ ID NO: 31610 - DNA, 447 bp, Glycine max
  Peptide Sequence Number=SeqID_148388
atggctgaagaagagaaggacgagaagatagtggatggagataaacaacaacgagaaagtgaaccagcacttgaaccagtggaccctttttgtgaacttgaggaagtggaagatgaggaggatgaccaagaggatgagacaccaataattttgagtgagaaagaaataaaggatgagaaaaagaaagaaaaagaaaaagaaagagaaagagaaaaagaaaaagaaaaaaatgaaaaaaatgaaaaagaagaaaagaaagaagagaagaaaaagagtaagagtgagcttgctggagagaaaaagaaagaggtagctctagctgaagggagagaggtgccatacccattggtaccctcaaggaaggataaagagcgtcatctagctagatttcttgatatcttcaagaagctagaaatcactatgcccttcggagaagctccacaatag

SEQ ID NO: 31611 - DNA, 727 bp, Glycine max
  Peptide Sequence Number=SeqID_148389
atggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatctgcacccctttgctaggcagacacagttgtgtccgatggcaagcaaagaccaagtttggtcattctgcacccaagatacgcggagataccttacggttatccgcacccttttgtcatccagaggcggcgggcccgatgacaagcagagaccaagtttggtcattctgctcccaagatacgcggagataccttacggttatctgcacccctttgctaggcagacacagttgtgtccgatggcaagcagagaccaaagtttggtcattctgcacccaagatacgcggagataccttacggttatctgcacccgtttgctaggcagatgcagtgtgtccgatggcaagcaaagaccaagtttg

SEQ ID NO: 31612 - DNA, 522 bp, Glycine max
  Peptide Sequence Number=SeqID_148390
atgctccctaacaacattattatacatgagtttgaagaagaaaaagaagttgttgttgattgttggacgatggacgatcaagattctatcaagaaggtggtcaacacaatcaagattgagaatttcacagggaagaatagcttcaacctttggtgcatcaagatgcaagccttgttgaaagaacaaggcatatgggctcccctctccgaacaactgtcgaagattggtaagccaatgcttgagttacaagaggaaaagacacattcactaattctcttatctttgtctgataaggatacatcctttgtggtacaagtagagggtacatctacttgggttgttgtaactgagaacaagagagggtacatctcttgtggattagttcaagtggagggtacatccacttggttgttcaaagagaacaagggagggtacatcccttgtggatctttgcttgtaaaggtttttacaaggttgaaaagaaatctcaaggaccgcaggttgcttggggactggatgtag

SEQ ID NO: 31613 - DNA, 2467 bp, Glycine max
  Peptide Sequence Number=SeqID_148391
atggacaagtgcctcaccaaggtactcgctgagcaagtaaaaaaggggaataaagtggataacattttgaagccagcagcatttgcaggtgcactgaaaacattgaatgaaaagtatggtttgtatttgacaaaagaacacataaaaaatcggctgaagacatggaggaagcagtttggggttttgaaggaactgcttgctcatagtggatttatgtggaatgagacaaaaaagatggttgttgcggataattctgtttggaatgactacatcaaggcacaccctgatgcaaggattttccgagcaaagtccatagaaaactatgatcaattatgtactatccttggaaatgatcaagcaattgcaagcctttctgacaatgttacagacatagatgtaacatttgcagttgataagggggatccagatcttgccattgtgtctgaaatacaaactgatggaaaccagactaaaaactttaggtggacagttgcaatggaccattggcttggaaagattcttgtagaccaagtgaggaaagggcttaaagtagataaagtttttctgacagaagcatataacacagctgtttcagccgaaattctgtctcatactggatttaagtgggatggaacaaagaaaatgatcattgcaaatgattctacatggaatgactacatccgggagtttgggcttgaaggtctgagtgagagacaattatgggctagggttgggcatgctggaatcaaggatggtggtggtggcttacgagatcgaggatggcggatggtgttggaggaagtaggcactgctgctgaggtcggagagggtggtagaagaggtggcgctggtggagtcaaagagggtggtggcaaggggagtgggcggtggtgtagtgcgatggaagttttacatggtggtggtgaaggttcgggagtggtggttatggagacacatctagatgcaaggactttccgtggtagagtttttgagaactatgatcagttctgcattatttttggccatttttatgagcctttgcattgggatgaatctgggacttgtgatgagacagttgaggctctaagtgtctacccagttaactatgatatcagtgtaggaaggcacataaggtggacaagtgacatggacagttgtctatctgcaatccttgtgcagcaaataaaacaaggtaacagaagcaaatttgactacacattgagacctgatgcatttgaagcatctgtgttggctattaatgagaagtttcagctttatttgacgaaagaacatgttaaaaatcgtcttagaacatggaagaaacagtatgccattctgaaggaacttatgacccagagtggctttgaatgggatgagaagcgaaaaatggtaattgcaaatgattctgtatggactgaatatattaagaaaaatcctgatgctcgaattcttaaaggacgagttatcagaaactacaatgaattgtgcataattctaggtcattgtgatccagcagatagttccattaatggtgcttgtgctaatatgggtatgactacagacgatggtgttatggaggttcaagagacaaaagaaaaagaaaaagttaagaatgttgtgacatggacagatgagatggatcattgcttgacagagttgctagtcaatcaagtaatgttgggaaacaggcttgagaaatttttcaagacctccgcatatatagctgctctaactgctctaaatgagagatttgacctgaatttaacaaaagaaaacattataaaccggttgaaaatatggaagaaacagtatgacgttttgaaggaaatgctctctcaagggagatttgagtgggatgagggatgtaagatggttgttgcaactgacttagcatgggatgaatacattaagaaacatccttatgctaggcatttgagagaccggcatatagagaattaccatgaattaggtatgattgttggtgatgagcaaggaagtggaaattggtctgaaaactttgagaggtttgatgtaaatcttacacctaactatgaagagcatgcagaagctcctgcactggtgttggctgatgtacagataagccctgatgctaatgcaagtgatgaagtgcagggttcatctgagcagacaagggcaaggccttcatcatcacaatcacattcaaagcaaccatcaaaaagaagacgcaccagtgatgttatgctagaaatgatgagtgttatggctgcagatatcagtcgaatcgccgatgcattgagtgaaaataacaagaccgtgtgcttggaggaagtggttgaaaaggtacaaaatatgccggactttgacgacgatctcatcattgaagcttgtgagtatttatgttttgacgaaaagagggcattgatgtttttgaaattagatgagagattaaggaaaaagtggttgttgaaacgattgcgtggtcaag

SEQ ID NO: 31614 - DNA, 276 bp, Glycine max
  Peptide Sequence Number=SeqID_148392
atgggtaacggaattggtggtggtagtaagtggtggtggtgcggtggtggtataaaaagtgatgttggttgcggtaacaatgttagtggtgatggtgatgttggtggtcatcatggtggtagcagtattagtggtagttgcaatgactttggtgggagtgacaatgattatatgatggtgatattggtggtggatgtggtggaaatggttgtggtagtcgcaatgataatgatggtagtagtggacaatgaaaaaagtgtcattatcaaaatatag

SEQ ID NO: 31615 - DNA, 279 bp, Glycine max
  Peptide Sequence Number=SeqID_148393
atggagaacataactgaaagatgggtggcacttccgattcatgaggttccctcttatcaagaggcaacgcctagtgaccacaatggtggtggtgacgaaggtggtattagttgtggtgttggtgcgatggtggtggcggcgatgacaggtgatgttggttgcggtaacaatgttagtggtgatggtgatgttggtagtcatcatggtgatattggtggtggaagtggtggaaatgattgtgatagtcgcaatgataatgatggtagtagtggacaatga

SEQ ID NO: 31616 - DNA, 531 bp, Glycine max
  Peptide Sequence Number=SeqID_148394
atggcagctgaagatgataggaatcttgtcgaaatcatggaaaccctgaatccaatagatgttgctaaatacatgaattttgttggtgccccccaagctggtgctatagctacattttcaggcacaactcgcgacacctttgaaggaaaaacaatcgtggagttgagatacgaagcttatgttccaatggcaatacgctgtatcaagtcaatctgttcatctgctagagcatcctggaacatacattctgttgctgttgctcatcgtctaggcacagtgcctgttggtgaaacaagtgtcttcgttgctgtctcgtctgtccaccgggctgatgcgttggaggcttgtagattattgatagatgagataaaagcacaagttcctatttggaaaaaggaggtctattcaaatggggaggcttggaaggagaacagtgagttcctagagaggaggtctgagcttgaaattaaagagtacaacaaaaagtcttgctgtaggaccaaggttcgggctgatgacgaatgtagctag

SEQ ID NO: 31617 - DNA, 492 bp, Glycine max
  Peptide Sequence Number=SeqID_148395
atggatcctgtagctgttgctgaagacaactcaaatgctgctgggcctgaatatggaaaggaggacagaataaatagcgtggaaataagtcaacccattgatgagttaggccaatttgagacttccccaattatattgaagggcagtggattgaaggaactaattgactgggaagagcagagtagtgaaaggaagatgtcaaggactgagagggagctgaacttgctggaaaaaggagacgaaagacagttgagtgctcaagaaattagactgaagaagcggctaagtcaaggaccaaatggcttaaagaaggggactgcaactcccacttcttccacctctcagttaatgggaaccgaagacataggtaaaagaagaggtccgtcagttctatatgaagagatttcaggaggtggagggggtcagaccaaggctgaatgggtgtgggaatgtgggagtgataagtgccctggaccggatggtttaacttga

SEQ ID NO: 31618 - DNA, 522 bp, Glycine max
  Peptide Sequence Number=SeqID_148396
atggcgtaccttaatcgtggcagagacgaactcgtttgcagtagttgcagctttaacggcagtggtagcttcatcagcgcagtttctagcagtcacagggtcaggaagaaggagaaaggagaaaaggggatggcatccacaaaaccatttggtactcctttgacagtttccattcgtctcattgaactcaatgccactcagtcacaatcagaaagggaatacatatctcatgttccttatgcaagtgttgtaggtagtgtcatgtatgcaatgggtataactgatattggactggtctatcaagatgacacatcttgtgcctttgttggatactcaaattctaactacattgtacatttggatttcacagttaccttgtgcactacagaagcagagtacatggctttagcaaaagcagcaaaggaaggtatttggttacaaggtcttattagcattcttgggtttccacaggataaagctatcattttctgtgacagtctgagtgcaatttgtttagcctag

SEQ ID NO: 31619 - DNA, 183 bp, Glycine max
  Peptide Sequence Number=SeqID_148397
atgtacaaaagaatgcgctaccatagcttaaaaacacaaacacaaagcaaaggcgttgctcagatagggctaacttggggaggaagtcgcgagggaacatgccacaaaaccaaatacgacttctttgtcacgaggtatcaagaaaacgaaacgacaatggcgtcgcagcagaatgtaggttaa

SEQ ID NO: 31620 - DNA, 642 bp, Glycine max
  Peptide Sequence Number=SeqID_148398
atgagtacagcatatcaccctgagtcagatgggctgacggaggtgttaaacaggaccttggaaacttatttgagttaccaaggggcagctaagtgtacaccatttgaggtggcgtacgggagagcacccccttcattggcaaggtttattcctggggaaatactggtagaagcagtggctcaggatttaatggagagggatgaggctttacaacagttaaaattccacttaagaagagctcaggaccatatgtctaagtatgcaaatgctcatagggtaccattcaagataaaaggagattgggagtacttgaagattaggccttataggcaatcttccatgcctattagattacatcctaaattggctgccaaatactatgggccttgtctagtgaataaacaggttggggcagtggcttttcagcttcagttaccagaaggagctcgcattcacccaggaaaatcagatgaagaagccacttgggaagaaaaggcaacaattcaagagcaatttcctgacttcaaccttgaggacaaggtttctttcgaaggggagaatattgttaggaaagagggtagagggcaatcaccagctgggccaaaacctttcttagtctataggaggagacaaacaatctaa

SEQ ID NO: 31621 - DNA, 279 bp, Glycine max
  Peptide Sequence Number=SeqID_148399
atggctgagaagatgccatcattcaagcatgggggagcctactggtttgttgatctcacaactccagattccttgtacattttgccagttttgactgctttgtcattcttaataacagtagagtgcaatatgcaagaaggcttggaaggaaatccagttgctggcaccatgaaaaagttctctaggggtcttgcagtccttacagttcctttcaccatgggatttccaaagtttgcttctcccttaacggagaacttcatgccaggatctttgggctaa

SEQ ID NO: 31622 - DNA, 450 bp, Glycine max
  Peptide Sequence Number=SeqID_148400
atgctgttgcagatgcaatcccaaggactcatactgcctcctaagcaaaaagttgctcctattgctacccatgtcagcacaaagggaagttgcatcgatccctcaaggaaagatccagacaagggtgaatcaaacaaatgtgggttgtatgttgatgacaatcatccctacctggttgcccttggaagtgtttatgaagagttgacaatcgtcaataaagtttctttgagcaatgatcaagtgaaggtcggtgttgaggaagttcatcacataactgattatacaaatttggattttcatatgaatgagttaattccgcgatcagggaatgactctgtgtatggattccttgagctagaatccatacagagatctgagcaatcacaatttgaatctgaggattatattaagaaatggatgcaaaattcaaagaaagatgtctacttatga

SEQ ID NO: 31623 - DNA, 225 bp, Glycine max
  Peptide Sequence Number=SeqID_148401
atgttgacatctccagaaagggtgcagatgaccacattggtctctgcttgtcaattggacttggggtctccgaatgacatggtgcggataaccgtaaagtatctctacatgccaccggattattgggtcacggtaacgaaaggtggggtggtcgacaaaagcagggatttttctcctacatatcctcaatttgtgatgagaaactcagacctacgtagttcttga

SEQ ID NO: 31624 - DNA, 237 bp, Glycine max
  Peptide Sequence Number=SeqID_148402
atggccaaggcatcgtccataattgatggaggttgtgaagtaacttcaatcaatagagctcagctgccatgccatgacttggaacccaaggatactgatcaggagagaatggatgatgcaatcctccctaggaagggaccaatcactagaaccatgagcaagaggctccaagaagattgggctagagctgctgaagaaggccctagggttctcatgaaccttagggtagatttctga

SEQ ID NO: 31625 - DNA, 525 bp, Glycine max
  Peptide Sequence Number=SeqID_148403
atggacaaggctactaaaggtaaaaaggctactagatgtggtaaaagggctgctagtaagggtaagaagcctaccgataggggtaacaaggatagtagtggaggtaagaagcctactgctaagggtaagaaggctgaacaaaactttttgaatgtaaatggcaatttttttgtggcacccagtttgcctaaaaatgatattgagatgggtatgttagtgaacagttgtgcagtgatgactcagatgaagagctgctggagttcaactggaccactcaatgtagttaagggtggcactgaaggagtagaaaaggctaacactgaaggagcatctcaaggtggaaacgagggtgcacttgctggagttcagactaagcaagtcaatgttgttaagggtggcactaaaggagcagccgatggtggaattgagggtgaaggtggtggagttcaaaggaaaaagtgtgtagcaatttacaagaaaagctcttactcctcaacaacatcaacgggcaaaacctctaaatag

SEQ ID NO: 31626 - DNA, 360 bp, Glycine max
  Peptide Sequence Number=SeqID_148404
atgtcaaaccataaaagcactaagtcagcactgaagaaccttgaggtccaggtgggacaactggccaagcagatagttgacaagtcatccaatagttttgtggctaatacaaagcagaatcccaaggaggaatgcaaagctgtgatgacaaggagtaaaaggtttgtggaggttgaggatgaggatagtgttgtgcataagaagaaaactgctgacaagaaagcacccaggcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 31627 - DNA, 303 bp, Glycine max
  Peptide Sequence Number=SeqID_148405
atgggtgttgctagctgtgttttttccactgtggtccagttgctattgttgggggttgtttttgcaagtgttgacagaggtagcggtttggtgaaggtgaaactcatagcggtggtgttttttctcggcggagctttttacggaagaacttccgtaattggaaaatgcttgttacgaaagaatgacttccgtaaaaacttacgaaagaacttcttccataagctttttacggaagaaggttcttccgtaagcttcttacagaagttcttccgtaacaagcttacggaagactttcttccgtaa

SEQ ID NO: 31628 - DNA, 233 bp, Glycine max
  Peptide Sequence Number=SeqID_148406
gcatcctccaccatcgagtctggagttccgcgaattgattacctagcgctattcacctatcctccaccctcaaatcttattcggagccccaatgaattgattgtcattcatgtgtcctccaccatcgaggctggagccccgcaaattgattgcctagcgctgcccacttgggccttccagattcttcctccagaaggcggttgcttctggaggaagcaacctggctcgcctgg

SEQ ID NO: 31629 - DNA, 366 bp, Glycine max
  Peptide Sequence Number=SeqID_148407
atggcttcccgtaagagaaaagccacaactacattgtcccaggccagttatgactcatccagatttgtttcaagggatgcttgggaccgttatgcagataacatcctcggccggaacattctttcggagaggaatgtgaagctatacattaatgagtttgatgacttcagaagagaagtcgagaggaggaattggcacagggagctcactattttttctgaaggaagcattgatgtggtaattgttaaagaattctatgcaaacctatatgtccctgaggacaaagaaccaaaccaagttagggttcgagggtacctaattaagttcaatgcgaactccctcaacaccttcttgaagactccagtg

SEQ ID NO: 31630 - DNA, 426 bp, Glycine max
  Peptide Sequence Number=SeqID_148408
atggttatgggggatcccatcagcagactctccttccctggtaggcgcattgtttttcactcaaaaagcatatgctggaatatttgtctctttgctaaagcatgtttgcattttagtggagaaaacaccgagactttttcaagtctcacaagttatccagaactacgtaggtctgaattcctcattggaggatacgtaggagcaagagcctcgcttttgtcgaccacaccgccttttgttgtcatgactcaagagctggtagcccgcggagataccttacggttatccgcacccttttgtcatccagaggcggcgggcccgatgacaagcagagaccaagtttggtcattctgcacccatgatacgcggagataccttatggttattcgcaccccttttgtcatccagaggcggcgggcccgatga

SEQ ID NO: 31631 - DNA, 363 bp, Glycine max
  Peptide Sequence Number=SeqID_148409
atggggtctgttatgacgtggatgccgccattgttgccggcgggaaagcttgtaccgccattgacaactgcaggaacaaggatcccgccattggcaactgcgggactcagcctaaaccgccagtacgaacggcgggacaggctgagtaggagagagagaggctgtaccgctgatagggctggcgggacgaggagagaagccatgccgccattcctcctggcgggacatgccaacgtggcagtcccgccactgcctcctgcggaacaccttgacgggacaagggccagcgttcacatgcatgctgaatcatttttatgcaggctaggcatgctgaatcatttttatgcagtttatgcaggctag

SEQ ID NO: 31632 - DNA, 360 bp, Glycine max
  Peptide Sequence Number=SeqID_148410
atgaattcaattattacagtgttgtatttcaacggaagagtatatgaagacaatgatggtgtaatatttgaaggcagtaaaaaggccattcagattaaacgcggaattagtttcaatgctttgaaaaaaaaattggagataagatttttagtttcaggaaaatatgttgcgttgcaaatttgtgatgacgaagatgttgaaactatgatcgaaagttttcaacaacaacaacaaatgtcagttctagaattgtacgtagaaaaggatgttgctggtggttcgatgtttcatgctgcaaattctgttacgtcatgtggacgtaatgtatctcatcatgatcggaactgccaagaaatataa

SEQ ID NO: 31633 - DNA, 105 bp, Glycine max
  Peptide Sequence Number=SeqID_148411
atgcatagtcctaatacagaaaaaggttattctattggtagactttcttatattcctaatggtgtaggcgatttatactacatgagaatacatctcacaatgtag

SEQ ID NO: 31634 - DNA, 1694 bp, Glycine max
  Peptide Sequence Number=SeqID_148412
atgtcgagtttggaggagccccttggccttgacaagttgccaagcatgtgtaccatagatagaatccagaggttctcatccgctgcttgccgccccagagtagataatttgggtatgggaaactgctggattgaaggacgaagctgcagcacatcaaatagctgcgatgaagacaatgaagagtatacagcagagacattcccgtggagaaggcaaacaagggacctgtcccgaggcgactctttcagtcaaaagacaatgaccatggggaggaactcgatgaaatttggaatgattgataattcattttatgcctcagattaccagtatagtccacagagcaataacaaaaatgtacaggatatgccatataagtttatgaaaggtataccaaaatttgtaaagatagttgaagttggtccaagggatggattacaaaatgagaaaaacattgtaccaacagatgtaaagattgaattgattcatagattggcatcttctgggttatccgtcattgaagctactagttttgtatctcctaaatgggtccctcagttggcagatgcaaaggatgtaatgcaagcagttcataacctgggaggcattagattgccagttctgactcctaatttaaagggttttgaagctgctatagcggctggtgcgagagaagtagctgtttttgcatcagcttctgaatctttctcaaaatcaaacattaattgtagtattgaagagagccttgtccgctatcgagctgttactcatgcggctaaagagctctctattcctgttcgagggtatgtatcatgcgttgttggatgcccggtggaaggaccaatccctccgtcaagagtggcatatgtagctaaagaactatatgatatgggttgctttgaaatctcactcggggacacaattggagttggtactcccggaactgtagttccaatgcttttggctgtaatggctgttgtgccagcggagaagcttgctgtccacttccatgacacttacgggcaatcccttgcaaatattcttgtgtcccttcaaatggggatcagtgcagttgattcttcagttgctggtctaggtggctgtccatatgctaagggagcttcaggaaatgtagctaccgaagatgttgtgtacatgctgaatggacttggtgtgaagaccaacgttgatctcggaaagctcatgtcagctggtgcttggcattccttttctctttcgcaaggtgcttggcattcctcttcttctgcaagcgtcactcttcttccgttcatcttcttcttccgcaacttcttccgttcatcttcttcttctacaacttcttcgcattcatcttcttccgttcggctttttgttcttcctcaaggtgcttggcattccttttctctttcgcaaggtgcttggcattcctcttcttctgcaaggtgcctcgtgtccgtcttcagcgccactgtgcctgttcgtcttctttcacgaccatttccacttgcgttcgtttgttcttctccggcgtcgagcttaggtgcttccatggaatggcgccaaggtgcttccatggaatacggaagaagtttgtcttacggaagaacttcttccgtaagtggaatacagaacaacttactcttacggaagaacttcttcgataagtgtttacagaagaacttcttcctagttcttcc

SEQ ID NO: 31635 - DNA, 216 bp, Glycine max
  Peptide Sequence Number=SeqID_148413
atgtgcgataaaggaaaatcatcctttggactagggacatctcgggtttcattctcctcagcttttgctttactagggaacactcaggattcagaggtagtttgttttgcacgatatccgagctcaaaccaggcatatcctggtagtcttggtagtctcacaacagagtcaccaattcatatcgaacgtttgcggatatgcaagtgtcgaccttga

SEQ ID NO: 31636 - DNA, 1113 bp, Glycine max
  Peptide Sequence Number=SeqID_148414
atgtctttggtgaggaagagtctgacttcaagagtggagaatgttgaggacagccatgacatgtcagtgttggacttgcctgagttggccttggattgcattcttgagaggcttcccccctctgcactgtgtcgaatggccgctgtatgccggtccttgagggagaggtgtgtgagtgatcacctttgggagaggcacatgaggcagaagtggggtagagttattggccctgctgcttatagggagtggaaatggcatgttgcttccaaaaggaatgttgggggtcttaagcatggcaggcaaaagggtttgatgagatttatgtctcttcgttggcctttgcaatggataagaccaaaggctgatgcaaataataatagccccaagcaggggagctctttgcctgttgactcagtcatgaactggtatcttgctcttgagtctggcaatttttggttccttgctcaggtctataaccgtgagaatggtcatattggattcttgttatcttgctatgatgctgaacttagctatgatccacaaactgatacctttcaagccagatatcctccacatggaagaagggcaggtgctagagagtgtggcatcccatgggaaaggctaagagcacctcctattgatacttctccgcatgatcttcatttctccgactgtttaaatgatttgtatccgggtgatcacatagagattcaatggaggagaaacaaagaatttccttatggctggtggtatggtgttgtaggccacttggagtcatgcaatgggagtgaaaattattgccgatgtcatagtagtgaccagaccagaccacaggtttggctaggtctctctctggattctaatatatctaagcatggaccacctgctatgctatttggctggtccccaagacctttcatggtcaacactgtggtgctagagttcaatcattacactcctggctcgcaatggaggcagaccactatcagtaggaaagaccatagggaggaggggaatgaggctgatggattttatggtggaataagaaagattaagagtgaggcggagattaccacttggaaacacctttggccattggaagtcttggaatag

SEQ ID NO: 31637 - DNA, 766 bp, Glycine max
  Peptide Sequence Number=SeqID_148415
atggggagtgggataaagaatgtttttggaagaaaagaactcattgggattacaaccaatgtacctgttgtaattggtgcagctagccaacttaccttgatcaacagatgcccctccactgcccttgatatgagaactcttgaagaagtttggttaggtcaccctccaaacttgatcagacttaaagtgtttgggtgtgttgaatatgctcacattaggcaccacaaattggaacctagagttgtgaagtgtatgcttataggatatccatatgaaattaagggatataggttgaggtgcttggaacttggtcataaaaagtgccttataagttgtgatgttgtctttaatgtgactcatatggattacaagacaaatactgagatggcaaagcctagcactagtcaatcgaagacaagtgagcttgagaggttaaaccttgaggtggagcctaaggacaagaatgatgaagttcagactgaagaagatggctatatgctagcaagagacaaaaccagaagggaaatcaaaccaccaaataggtatggatatgaaaacttgatagctgctagtgaggttctggaagatgaacctacaagtgtgaaaactgccttggctagtaaggaaaatgaaaaatggaaagttgatgtgcaagaaaagatgaagtctctatctgacaacaacacatgggatttgattaagaggcccattggtttcagagtggccaactgcaaatggatcttcaagaggaaagaaggaataaaag

SEQ ID NO: 31638 - DNA, 337 bp, Glycine max
  Peptide Sequence Number=SeqID_148416
atgaaaagcaggagtttagatggcacagtaacacacttcacacctctattagatgtatctcatcataaagaaaacacaagacagtaccgatggtggaacagcaaaatcctggatttggaggaggccaaacatcaattacttttttcactacctatgttccttacaaacttgttctattacttaatcgtgttggtttctgtaattttcgctggccaccttggtgatcttcagcttgctggtgctactcttgcaaactcttggttttctgtcactggtttggctgtcatgattggtgctagctactttaacaatgaagcgcaggagtttagatggcaca

SEQ ID NO: 31639 - DNA, 801 bp, Glycine max
  Peptide Sequence Number=SeqID_148417
atggctttcacactagacaggttcgaagagaacatggtgttcactttcgagtctcagaagtcagtgccagcaccctttctgacaaagacataccagcttgtggatgaccctcacactgaccacattgtgtcatggggtgaagatgaaaccacatttgttgtgtggaagccccctgagtttgccagagatcttcttcccaactatttcaaacacaacaacttctcaagctttgttaggcaactcaacacctatggtttcaagaaggtagttgctgacaggtgggagtttgcaaatgagtacttcagaaaaggagctaagcaccttttgtgtgaaatccacaggagaaaagcacctcagcagcatcaccaactcttccatgaccaactaccatcccagattcttcagaaagatgaaagtctctgctggcttgacactccactaccatcttcaaagccaaacacagacattctaacagcactttctgaagacaaccaaacactaaggagaaagaacttcatgctcttatcagaactcagtcacatgaagagtttgtacaatgacatcatatacttcatccaaaaccatgtaaaatcaccaccctttgaacaaagaagcagcagtgttattccaaagctggtagaactggactcattgcatgagtctccaaatgacatgggggttctcagaactgccaaaagttgtgttgtggataagtctttggttacttctactgaggaatcgaacagttctgtgaagctctttggggtcactctaagtggcagaaagattgcacccagataa

SEQ ID NO: 31640 - DNA, 555 bp, Glycine max
  Peptide Sequence Number=SeqID_148418
atgggtgcatttttcactcagattaaaggcactgtgttctacacagatgccaatggagcagttgttgatatcactgccaagtcttcggcatatttgccactgcaagaggcgtgcattcacagagttaagcatgtagaagaagcgggcttagtctgggttcaaagaggagtttttgatcgttgggctcttcagtttgaccttgcatgggaacgatgtagacagcttcaagcagaagatgttactgtcaagggtaagattgtgggggtgaacaaaggcggagtggtggctgagttggaagggcttagaggatttgttccattgtcacaaatatcaacgaactcaaatgtagaagagcttcttgataaggagcttcctcttaagtttgtggaggtggatgaggaacaatctagacttgtcctgagcaaccgcaaggccgtagctggcaaccaggcgcagctaggaattggatcagtggtcactggctctgttcaaagcctgaagccatatggtgccttcatcgacattggtggaattaatggcctccttcacgcctag

SEQ ID NO: 31641 - DNA, 414 bp, Glycine max
  Peptide Sequence Number=SeqID_148419
atggatttgtgggtgaatggcactctgctggaacctttgacaagggcacaaacactggtggacccttcggacattgctattaggcttttggagccactcaaggcggagttccctattttgagctacgccgatttctacctgttggctagcgttgttgccgttgaggtcacgggtggacctgaagttccattccaccctggaagagaggtattatgttccaagacattactactctattgctttctgttgttgcaggtattatgtttcaagacattactacgttctgcttcactggaaatcgtgccacttgaggaagtttttcagactctgatgtgtgattcaaatggactcacaatagcatctgcagaaagagtcagagatgtggaaccctatgtcttgatcaagtgttattga

SEQ ID NO: 31642 - DNA, 231 bp, Glycine max
  Peptide Sequence Number=SeqID_148420
atgttatattcaggatcaagggaacactcacctaatgaaaggaaaaataaaacaggaaagcaaatcataagaggcataatcggcaaaggcaatgcctctggtgagagcatatttgaggaagttctagcggctaggagaggtggcagaaggaggagggaagcagaagcagcattgatgcataggaatggaaaagaggacacacacgctcaggatttaaaagggaattggtga

SEQ ID NO: 31643 - DNA, 1302 bp, Glycine max
  Peptide Sequence Number=SeqID_148421
atgttgatgggagtgaacatcattcatgtgtcatgcaaattgttgactgattctagctacagaaatgcttcagagggagaaaagctgtcagaactgaacaatctaaggaattcttttggtccagattctaatttcctctaccagttcctctatttctttaaggcagaaaatattgatgatttcttagttcttgtgcaaatatgccggttgctttggtggtctgttcaggataatggggtggattattcatccacacgtgctttggtgaactttagagtgaagcgatttgtacaagcttgtgtttgtgctctgcatcagaatagaaatcagttaaaggatcagcttttattgactcctgaggaattgaatgtgtcagctattcctttattggaggttttagtattgttaattgatcccaaattgccatggagctgtaagatagttgaatatctcattcaaaacaatgcagttggcctactcagagagataattcttacaggaaaggataatgcagaaaattatttttccattggcaagggatcatcattggagcgtgtgcttattgctgtaatatgtcatgttggtcagaagccattaatttctgacatcttcagtcttaatgctggaggatcctttatttttgccgcagacgacctgaaccaatgctacattcatcaaatggcaatgtttgggcaaaatctgatcaatttgctacctaaggatatatcaactgaatttccgagccatgcgtgtatgcttggaaatgtattagaaactgctggaattgctttgtcccatcctaactgttcatttgacatggccatagaccttgcagctgtcactacatttttgctggaggcactcccatctgtgaaaacttccaatagtagagaaagtcctatgattgctgaggatgatatgactggagacaatgaagtcatggaaatagctttagataggaaattggagcagcaaatttataatgccataaatcctcgcttccttctgcaactgacaaatatactatttaaagagatttcatctgtcaatggttcagattatggacccaacgatagagatgttacagctgttgatggggtttgtgggtttttgaatgttaccttcaacaaactgccacttgaacggattatgacagtgctagcttacagaactgaacttgttccaacactttggaattttatgaagcggtgtcatgagaaccaaaaatggtcatcacacttctcaaatgatgcacctggttggctgttacctctggctgtattctgtcctgtctacaagtaa

SEQ ID NO: 31644 - DNA, 282 bp, Glycine max
  Peptide Sequence Number=SeqID_148422
atgttcttcagcggcgatccttcgacgcggaagcgtgtcgatttgggaggtcgcagttcaaaggaaagggaccggaagaaccttctagaacagacgcgagttgaacgcaaccggcgcttatggttgcgccagcagaactctgctgtactcaaaattcagctgcctccggcaatttacgttgtttttgtcaagtattgctccactgtttcaaattccgtcatgttggaaaatagaagtttagaaacccaaatgtgtatagatgcccatatgtgtatatattaa

SEQ ID NO: 31645 - DNA, 483 bp, Glycine max
  Peptide Sequence Number=SeqID_148423
atgattaccaaattcctcacattcagcatcctttccataattaccctcacctctgtcacagccgaagatggtgcaggtattcaaatcattccctcactcccaaaatacaacacaaccacttcgtttggtttggtgagaatcttagacaaccctttaaccttgggacccgagttgagctccaagcaagtgggtagggccgaagggctctacgcgtcggcgtcgcggacagagcttagtcttttgatggtcatgaacttcgccctaaccgcagggaagtacaatggcagcaccatcaccatcatggggaggaataggcctctcatgaccaaggttagggagatgcctgtgattggtggtagtgggattttccgggttgctaggggatatgccctggatgaggagttaggacaaggtgaaatgagtgatttgcttcactggatgaatgttgcttataaatgggataagggaaaaacatctccttag

SEQ ID NO: 31646 - DNA, 1656 bp, Glycine max
  Peptide Sequence Number=SeqID_148424
atgtcatgcccccatacccctgctcaaaatggcaaggctgaacgcaagcatcgccatattactgagacaagtcttgcaatgctttttcattcccacatgcccactatgtattggctcgatgctttctgctgtgctgtttatattataattcggttacctactcccttgttaaaagcatcatgcacaaaggttttcggtggttggacgtctcaacatcccggatctacattgctcgtcatgccaaatttgatgaattttactttcccttctccaacacaagacctatttcttcgatctcacacttgggattctctctctttgatgaaccttctaagcttgtcgctgtctctccgcctgctccttccaaatcgtcttcgcaatcgtctatgccacttttgtctcgcccttgtggcttatgtccttcagaagacacttcccctattcaggtcaccctatggtgactcgtctaaagctggtatttacaaacctcgtcactttgcagatataactacttgtcggccatcttctcttttacatgcattactcaccacttctgagcctaaaggttttggatctgctgccaagcatcttggctggcttgctaccatgaatgacgaactcacggccttacactccaacaagacttgggaacttgttcctcgaccacctaacactaacattgttggctccaaatgggtattccgcactaagtatctttctgatggttatattgatcgctttaaagcacgattggttgcacagggatttactcagactcccggtcttgattatgatcatacatttagtcctgtggtgaaggcatcaactgttcgtgttattcttactctagcagtcatgcaacattggccccttcatcaactggatgttaacaatgccttcttgaagggactcttgtcaaatccagtctacatggagcaacctcctggattcattgatcctcgcttccctcaccatgtttgttgtcttcggaaagctctttatggcttcaaacaggctcctatagcatggtttcagaggttctgctccttcttacttcatcttggttttattggcagcaaggcaaatccatctctcttcagctatcatcataacaccgcaactctataccttcttgtctatgtcaatgacattattttgaccggcaataatcaatttgccatccaaaccatcctggctaaaattcgagctgagtttgccatcaaggattcaggtcatctgagttattttcttggtcttcaggtacattatggtgctaacggtatttttctaagccaagcaaaatacgcccatgacattctagacagggcaaatttgttggatgccaagcccattgccacgcctcttgtgggagcattacagtacccaccatcactcgtccggatctctcatatgctgttaactctgtcagccaattcctgcaggctcccaccactgtcatttccaagttgtcaagcgaatattgcgctatgtcaagggcaccttgtgtcctggagtgctaaaaagcagcctattgttgctcattccggctgtgaatctgaatatcaggctatggcaaatgcagcagctgagctaatgtggttcactcatttgatgcgcaatctgcatgtttactctactccccgtactcatctttaa

SEQ ID NO: 31647 - DNA, 354 bp, Glycine max
  Peptide Sequence Number=SeqID_148425
atgtcgccacacgggggcgacatggatgggggtgaaaaaaggaaagagagggatggggtttctcttgcttttggcatagcgggccccggcgggaggcccgcacgacgggctattagctcagtggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 31648 - DNA, 183 bp, Glycine max
  Peptide Sequence Number=SeqID_148426
atgacaaaccaaatgttcataatatacttgcgcagtaacagtaacgattggggggggaaaactgccaggaaaccacattacaagcgaaacctcaaagagagttgggcttcgtcctcaaaaggaaacaacaccagaaaatctagccttccatggattcaaaaagaaaacgcaaatgaaacatga

SEQ ID NO: 31649 - DNA, 141 bp, Glycine max
  Peptide Sequence Number=SeqID_148427
atggacaacataagattcaccgcacccttcaaagttcagaagaaccttctccaagttcctttctcttatcacagacaatggctccggaactaccccaaatatgttttattccactgcgatggcgagatacatttcatccgg

SEQ ID NO: 31650 - DNA, 640 bp, Glycine max
  Peptide Sequence Number=SeqID_148428
atgtcatatgattctaaacaaggtctccttgaaggcactgttggagctgatggcctttatcagttcaagcctttcaagtttctcaccaacagtggtgctgcctcaaactcagattcaagctcaatgtctagttccagtcaattttctgttttcaataatcctgtcaattgtaataacattgtttctgttatgcaaaatgacaatgtatttcaaatgtggcaccttcggctgggccatgcccacaccagtgctgttaagaacattctaaatctgtgtaatatacctttttctaacaaaactgcaactcttccttgcactttctgttgtatgggcaaatctcatagactgcactctcctttatccaatactatttacactaaaccgtttgaagtcattcactgtgacttatgggggccagctccctttgtatcctactatggctacagttactatatcacctttgtggatacttataccaagtttacttggatatacttcctaaaagccaaaagtgatgcacttaaagcctttactcaatttaaagcacttatccaaaaccaatttcaagcatccattaaggccatacaatctgattggggaggtgaattcagagccttcacagccctgctcaatgagttag

SEQ ID NO: 31651 - DNA, 252 bp, Glycine max
  Peptide Sequence Number=SeqID_148429
atatattgtgctgtcatcccaagagaaggatcaaacattgatgatgcagatgtgctaagatattgcaagaagaatcttgcatctttcaaagtccctaaaaaggtcttaaataccaatagcagacaagatcatgcttatgcttttttgctatcgtgctcctgttccttgccactggtcttgatgaagccaagcattgtctctttgccttttaagttgtacatagttgcaaaacgggtacatgtgaaagaataa

SEQ ID NO: 31652 - DNA, 179 bp, Glycine max
  Peptide Sequence Number=SeqID_148430
atgtcggataatctagcaagagcttctagcgcaagggagtaccagatagagcttcaacaagtgggaatcaatacagcaacaagtccgatgttgaatgagatagctttcatcttccaatctttccgagctaagaagtttgaaaggggcagtcttccatgtcactcggaaggcagatcaag

SEQ ID NO: 31653 - DNA, 421 bp, Glycine max
  Peptide Sequence Number=SeqID_148431
atgcaagattgcactagtcacagagagaagacagccaatccaatagagcaagcaaccaatagagaccagttaccgagccagtcagatgcttgcctggccttgtctaactccccagtttcacaagcaagccaggcagatcaccttgttcaaggatttcagagcgagtacttccaacaaaacgtctgcctagacagagcttccaaccacttggacccgatgatacacctgcaggtcatcctctgtgaatctgcaagacagggagagaaagacatgccggactcacaagagaaagacagccaatgcagtcagaatgccctattgagcgtcatgcctgaactcatgttccggagagtgcctgtcggatcacttatgcctatgcaaggagagagcaccgctaagggaaagttcaatcattgggaag

SEQ ID NO: 31654 - DNA, 1032 bp, Glycine max
  Peptide Sequence Number=SeqID_148432
atgtcccacgatctcaacgagacgctgatcttcgtcaaagtggtcgagcaaggcagcttcattgccgctgccaaatcgctcggcctgcccaagaccacggtcagccgcaaggtgcaggaactggagacgcgcctgggtgcgcgcctgctgcaccggaccacgcgccgcctcggcctgaccgaagccggttcgatctatcacgaacattgccaacgcatcgcacgcgagcttgaagaagccgagagcgcagtgagccagttgcagtccgggccgcgtggctggctgcgcttcactgtgccttactcgatcggcatcacctggattgcgccgctgctgggccagttccatgcgcagtatccagagatccgcctggacatgcatatgggcaacgagaagctggacctgattgccggcgaagccgatctggcgctgcgcgtgggtgccctgcccgattccaatctggtcgcgcgcaagctcggcagcctgcgcacgcaggtgttcgccagcccagcctacatcgaacgttatggcgagccgctgcatccggaagaattgcagttccatcgcatcctggcgatgcgcaagccgtaccacaccggcaactcgccgcgcttcacctggcagctgggcgagaacggcggcgagctgcgcgacttccctgttaccccgctgatgaccgccaacgacatgtctgcgctcaatggtgcgctggtgtgcggcgaatgcctgctgctgaccggcgacgtgatggccaagccgttcgttgaatcgggcatggtgcgccgcgtgctggccggctggaccggcccggaagtggacttcaacgccgtgttcgccggtggccgcctggtctcgccgaaggtgcgtgcgttcgtcgacttcctggtcgagaagctcaacttcgacgccaactacatgctggcgcaatgcccgggcgcgaagctggcacagcagcacaaagaaaaggaagacgctgcgctggaaagcagcggcaagcggatcctggagaaggtggccgcttcggcggcatga

SEQ ID NO: 31655 - DNA, 249 bp, Glycine max
  Peptide Sequence Number=SeqID_148433
atggtggacgccaaatgttcttaccaaaatccggaatcgtcacacatcaaggtggacatggttgagtggggtcccaaacttagcgcgttggcttggaggggtacctttgaaagagaggggaccttcaaaacaaaggactctgacgctcaaggttgttgtagccttgtagataattcctgggttgtagataatggccaagagcttatagataatgttagacataaacatttgcttatagatagaaggtag

SEQ ID NO: 31656 - DNA, 639 bp, Glycine max
  Peptide Sequence Number=SeqID_148434
atggttagcagtcgatctggcctcagactcgagacccccctcatcgactcccatccttttctgacagctatgacaaacacaggcactttacaactacaccaagaccgcattgcgaagatggagaaacgtcacgagaaagagttgacaaagctaaaggctgaccatgaccagctagaggctcatgaaaacctctacaccaatgatgacacgatcctatgtcatgtcttccctatatcccccaagggagcagcattgacctggtatgatggactcccacctagttccatagacaacttcaacaccctcgtcgaacgattcagtgcaaattacgacaaatttgggcgcacgactgtccagatccgaaatctcaatcccgaggtagcgttggattccatgctcctctccttatgccccaacatgttcgtagacagtctttgtaaaaaaccacccgatagcatggatgaactgcatgaacgagccaaaggctacacccagatggaagaaatgtccagattccaaaatgaagtttgccacgccggacataaatttgacaagcatgaagcacacaccaaggctaactcgcacaagtcaaacaagaggcacaagctagacaagcgccgacctcgctccaaagtgtaa

SEQ ID NO: 31657 - DNA, 339 bp, Glycine max
  Peptide Sequence Number=SeqID_148435
atggcgggactgctagctgaaggtgtcccgcaactggcattggcggcaccaccctgtcccgcagacgccatcagcggcacccaccctctctctcctactcatcctctcccgccaacagcaacagcggcacaccctcacccctctctcctactcagcacatgtcccgcaaccgggactagcggtacccaccttaccaccatcggcactggcggttcaagcttcccgccagtgtcagtggcggcacccacgtcggaaacagaccctgcattgaaacgattttatgatcccaacatggttggctcatggtaccgaacatatgcaactaagaatgtagtgtga

SEQ ID NO: 31658 - DNA, 1178 bp, Glycine max
  Peptide Sequence Number=SeqID_148436
atggaggcgcgcttcaagctcaacggcaaggccttcaacggcaccctggaccagagcagccgcttgcccagctacagcttcgacaatccgcagtggctggacaacagcaactacgcgttcgaccgcttcgtgctttcgcccaagcaggtgaacgacaaggagcacagcgcgcaggtcaacgtgcgcttcgacggcgacagcagcagcatcaaattcggcctgctgggccgctggcgtgaccgcgacgtcaatgtggatgagcgcgaactgcgtgtcggcccgaaggtggcgctgtcgagctggagcacctcctcgcccgaacaccgccacggcaacctgggtgatggcatggattcggccgcgatgcgtgccttctgggcggccaatggcggccagtacagtgcccgtccgcaggacgtcggtggcaacgcgatgacctcgctggaagaggactacgtggccagcgaagacatcttcgccagctatgcgatgggcacctgggatgtgggcgcgctgcgcatcatcggcggtgttcgcgtggaaaacacccagttcaaggcagtcggcaaccaggtggacgtggccgccaacggccgcagcttcaccgtcaccccgcgcgtggccaacagcagctacaccaacgtgctgccgggcctgcacctgcgctatgacgcggccgacgactgggtgctgcgcgcctcggccaacaagaccgtgtcgcgcccctcgttcggtgacatttcaccgcgcgtgggctacagccgcggtgacgaggaagtgcgcctgggcaatccggaactggatccgtacgagtcgaagaacatcgacctgtcggtggagaagtacatcggcagcagcggcatcgtttcgttgggcctgttccacaagtcgatcgatggctacatcgttgaaaccgtgcgcaccaatgatccggcctacggtggatttgatgtgaagcagccgatcaacggtcgcaaggccaccgtgcgtggtgcggagttcaactggcagcagcagctggccttcctgccggacggcctggatggcgtcatggtcggcgccagtggcacctggctggatacgaatttcgatgccggcatcgaggaccatgcgggcgaggacttcaccctgccacgcgcctccaggcaaatttacagcgcacccattggctatgagaa

SEQ ID NO: 31659 - DNA, 438 bp, Glycine max
  Peptide Sequence Number=SeqID_148437
atgaattttgcagcgagaaagcctatagaattcaccccaattccggtgtcctatgctaacttgctcccatatccactcgataatgcagtggtagccataaaccctgctaggtttcctcaatctccattttttcgaggatacgactcaaacgcaacgtgtgctcgtcatggagaagccccggggcgttcaattgagcattgtagggccctaaagcgtaaggattttcaagtgcaagccattggtcagtttgctcaagcgacttgtgctcctgagtttggacttccaagattgttcaatcatagattactcgtcttgcatgttggtgggggtgccataaaacaacgagttgtgaaaacaaagatggatacctcagagccctacactggggcaatgaggggcatcgtgcatgaacctcaagtgaacctaggggcagattag

SEQ ID NO: 31660 - DNA, 126 bp, Glycine max
  Peptide Sequence Number=SeqID_148438
atggctcaacctctaatcttgaggacttatcagatgaatacgagacttattgggtcaaaaaccatgatagtgatattgactcctcttccgggcccgaaggaattatcactttacgtattgaaataa

SEQ ID NO: 31661 - DNA, 282 bp, Glycine max
  Peptide Sequence Number=SeqID_148439
atgttaggattcacaagcaattctcctcaaatttcagccagcccacatcaattagactttgcaccttacgcttcaaggccctacaatgctcaacggaatgcctcggggctcctccatgataagcacacgttgtgttcgagtcgtatcctcgaagaaatggaggttgaggaaccttggttggggtttttttcgctgcaaaattcatttcttggttggtgctttgggtttgtgctagaagtggtgtctagcattgggggtgtggtacacaggctttgtggttga

SEQ ID NO: 31662 - DNA, 468 bp, Glycine max
  Peptide Sequence Number=SeqID_148440
atggtggttaatttggagtttataaaggcaattgtgactgctgaagaagtgttattgcttgatcctcttcggcaggaggttcttccctttgttgagcaactcaggcaacagcttcctggcaaaagtcaacctaaacttctcggcggcacggaagagcaggaaggcgaaatgcatgtctctaatggaagacaatggttgcctacaccggaggcagccgatggtttgcagtctgagcttccgtttgagtttcaagttctggagattgctttggaggctgtgtgcacttatctggactcgaatgtggcggaccttgagcgaggtgcttaccctgtgttggatgaattggctaggaatgttagcaccaagaatcttgagcatgtgcggagtttaaagagtaatcttacgcggttgctggcacgagtgcagaagtttgttggactggtcaagacaccagttaatagcccatga

SEQ ID NO: 31663 - DNA, 192 bp, Glycine max
  Peptide Sequence Number=SeqID_148441
atgggtgccaagtacctcgaagtggtcaaacgagggtcgcatcccaacaatggatggtccccggacgaaattaggggaagtaaagataagacactaatttcgttcgagcgaaacaccattcggctagttaacctccctgccagcggaacatgcaaaaatttgaaaatgatcagtaccgactcatcatcctga

SEQ ID NO: 31664 - DNA, 225 bp, Glycine max
  Peptide Sequence Number=SeqID_148442
atgatgatgaactggagacttcccaacaggaagatgagcagaagtcaaagcatggtggtgatggttgtgatgataaggagggagcatgagcaagagaatgatggtggtggcggtggccatgtttatggtagtgatggcagtgtggtggagttgcatgcgggctgtgatgaggactgtgttgaaagtttgaagctcttgagcaaatacagtgaagcagcttactaa

SEQ ID NO: 31665 - DNA, 576 bp, Glycine max
  Peptide Sequence Number=SeqID_148443
atggcagaaccatcaaagaagagaaagggatcatcctccaccgccgccgctgctgcccatcgccaccacggaccatccgaagcacccacagcaccttttcatccctctttatcatctccaagatcatccacattgttttcatccgatgatcagcgtctacggtaccgttctcaattttcttctaggatcatcatagactctaagtacctagacgtagatttctttaatgatgaaacgtttgattgctatcaagtgtttcaaaattctggcctggttgatttcatgtccttaaatttgccacattatcctgaacttgtaaaggtcttctactgcaatttaaaaattcaggatgacattatttcttctgaggtggatggtattcctatgatcattgatcagtcattgttcttctctttaactcatttacccagtcaaggtgcaccttttgagggcaccattgttgatgactggaaatttgattattctagtcatgatgcttgccgtatggtctgcaatgaccggttgattgctggccgtgtcattaacattttgataatcgcatcatgcactatataa

SEQ ID NO: 31666 - DNA, 252 bp, Glycine max
  Peptide Sequence Number=SeqID_148444
atggacaactcattgaacttcggagtgacaccaacaaggacctccaagctatatccccaccacaattgcactgaatgcttcagacagacggtgccagtgaatactttcaccttcgtgtttgcccgcaagctcttcctaacccgacccaccccaagcccaaatcagtttttgtgcattgttgggacactccgcaccagaaaccattcgtctgttgggccgtatctcaatccagaacgtggtgattttggttga

SEQ ID NO: 31667 - DNA, 117 bp, Glycine max
  Peptide Sequence Number=SeqID_148445
atggaatgggacgaggaatgtgagtccatgagtggcaccatctacagttcgaagaatgttccttcccatggctgggatttgggggtccctctgcaagatttgaagatatgggattaa

SEQ ID NO: 31668 - DNA, 459 bp, Glycine max
  Peptide Sequence Number=SeqID_148446
atgtctggacctggtgccagcggagtcctaaaagcaacatccgctgatccctggtcggcatcgtttatggttgagactaggacgttgttcgtctttcataaatccaagaatttcacctctgactatgaaatacgaatgcccccgactgtccctgttaatcattactccgatcccgaaggccaacacaataggatcagaatcctcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggctccctctccggaatcgaaccctaattctccgtcacccgtcaccaccatg

SEQ ID NO: 31669 - DNA, 213 bp, Glycine max
  Peptide Sequence Number=SeqID_148447
atgttgaggttggatatgagatctcatgagttaatgacctctggttcggaggggaagagggagccaagggtgaaacgggaaggaggtgtggaaggtggtgggtcaaaggtgaggaggtcatacgtggtggaggtgagggacacgatgtgtgtgctaaaggggttagaagatgtcacgcccgtttcggttgtgtcgtcgagccttgacgggtaa

SEQ ID NO: 31670 - DNA, 519 bp, Glycine max
  Peptide Sequence Number=SeqID_148448
atgtgcagcgccaccgattacaaaactaaatcaatcggagggtgtccttcgcaacccttgaatattcatggcataacgctgaaaggcaaacaagatgaaaattgggagcaactgttcaccccaatgatcggtcaatggaacaagcaagttgattttagggtcgacggttatcctcgacaagaggtcttattaaactttaactccaactacacgatctttgagacattacaatacatggtgtctcctcaagggaggaatacatggacagatgatgatctcgtgccttatgtggagaaaataacaattttatcgaaagagcaagagagaatcactgagcctgtgtcacatggtccagcatcagagcatcaatttccagcacaagagtttcacattctccagtcaagtgttgaaactcaagggataggcaggcgaagggtggttgttgaagcggaagaatattcccaacaaatggcggagcgtggccatggaatgtattacacaccaccaacattttcttag

SEQ ID NO: 31671 - DNA, 495 bp, Glycine max
  Peptide Sequence Number=SeqID_148449
atgattgatgttgttgataaagaggcaagatcaaggaccatacaatatatggagcccttttttttccttaaaaacaacattccttttaatgttgtaagtactatgttttccaagactgttgatgcttcctcttacatgaagatcagagaaaaagtgtttgagttgttgtatagttttgttgaagagattggagacaacaatgttgttcaagtgtttacgtacaatgaaagcaactttaaattgattggtaagttgttggaagccaagagaccacatttactttggacgccatatgttgcccattgtcttgatttaatgttaaaagacattgacaagacaacaagagtgaaaaagactatccaagaagggattagtcttgtggtctatatttataaccacccattggtattgactaatatgaggaggttcaacaacataactaaattggttaggtatggagtgacaatgtttgccacaaacttcctcacattataa

SEQ ID NO: 31672 - DNA, 1964 bp, Glycine max
  Peptide Sequence Number=SeqID_148450
agaaaggggaaaatgataacctggggagatttctacacggtgatgtcggcggtgattccgctgtacgtggcgatgatcttagcgtacggctcggtgcggtggtggaagatattctcgccggaccaatgctccggcataaaccgcttcgtcgcgatcttcgccgttccgctcctttcgtttcacttcatctccttgaacaatccctacgcgatgaacttccggttcatcgctgcggacacgctccagaagatcatcatgctcttcgccctcgcaatctggacgaacttctccgccaacgggagcctggagtggatgattaccattttctccctctccacattgccgaacacgctcgtgatgggaatcccgctgctcatcgccattgcatcatctggtacacgctcctcctcttcctcttcgagtaccgcggcgcgaagcttcttataatggaacagtttccagaaaccgctgcttctatagtttctttcaaggttgattccgacgtcgtttcgctcgatggaagggattttctggaaacggatgccgaagtcggcgatgatgggaagcttcacgtgacggttaggaagtcgaatgcatctagaaggtcctttatgatgactccgcggccctctaacctcaccggcgcggagatttacagcctcagctcgtcgcgtaaccccacgccacgtggctccaacttcaaccacgcggatttttactccatgatggggtacgcgccgaggcattctaattttggtgccgcggatttgtactccgtgcagtccacgtcacgcggggtcacaccgcgcccctcgaacttcgaggagaacggtgcgcctgctgctgcaaccacgcagcagcagcagcaggccatcagctccccgaggttcgggttctatcccgccgtgcagacagtgccggcggcatatccggctcccaatccggaattctcttcttccgggttaacgaagagtgtgagcaagaattcgcagacacagcctcagcctcagcctcagccacagattcaagctcaagttgctcctcctcctcaacctcaagtagctcaacctaccaacagtgggaacaaagccaaccacgatgctaaggagcttcacatgtttgtgtggagctccagcacgtcgccggtctccgaagccggcggcctccacgtgtttagtggggctgatttcggagcgtctgatcaatccggtcgctcagaacaaggggccaaggagattaggatgttggttgctgatgaccaccctcaaaatggagaaaccaacaaagctgcagcagaaggagagtttggtggtgaagaattgaaatttccaggtaaagaaggagaacaagcagatgaagagggagaaaaagcaggacccggtggtttaaacaagcttggttcaagttcaacggcggagctacacccgaaatccgccgttgccgttgccggaaaacacatgcctccggcgagtgtgatgactcgtctcatactgattatggtgtggaggaagcttatccgcaaccccaacacttactctagcctcattggtgtcatatggtccctcgtggcgtttaggtggcatgtgcaaatgcccaaaataatagagaaatcaatctccatactgtctgatgctggtcttggaatggctatgttcagcttggtgcaatgtccccgacatgtggggtctggtcttgaacaacgtggctgtgcggtccagggcggtggtctgttcatggctcttcaacctaagataattgcatgtgggaactctgttgcaacatttgccatggctgttcgattcctcacaggtcccgccgtcatggcagcagcttccatcgctgttggcctacgtggcaccctcttacgtgtagctattgttcaggctgcactaccacaagggattgttccatttgtgtttgctaaggagtacaacgtccacccagccattcttagtacagcgtga

SEQ ID NO: 31673 - DNA, 243 bp, Glycine max
  Peptide Sequence Number=SeqID_148451
atgagaactcagacactgttttggtgttggattgtcgcgcctcgtccctcaccacctcagccgcaagaaaacggatttctgatccgcgaaagagatcatgttcgatctcctcgttccaacaacgaaacaaagcagggaaggatgcgtctggaaggtacaagaaagagacagtggtggtgcacgatggtggctgatagaaggagaggggaaggagagaaaggtagaagaaaaggggcaaattag

SEQ ID NO: 31674 - DNA, 261 bp, Glycine max
  Peptide Sequence Number=SeqID_148452
atgccgcaacgcttgcaagggttaggaaaaggtttcttctgcttttgggttgtctttcttttcgtgaaaaattgtgtcttctggttcgagaaaaagggaaaggggaaagtgactggtggcggaggcagagatggagtgaggaaggtgcggtgcggcagtaggggtggaaacaatggtagtaatggtggtctacggcaaagaagaatagggagaaaagagacagatgaaggggaaagaaaagataatttgggaaagttataa

SEQ ID NO: 31675 - DNA, 1566 bp, Glycine max
  Peptide Sequence Number=SeqID_148453
atgggaaagcccggagaacaccaccctctgccctcctactccgccgccgaggatcagcggcggaatgcggcgcctccgccgggatgcgccgtcggactccgatgccttgtcgtcatgcttttctcggtcgcggttttcctctccccactcttctggctaccacctttcgctcacttcgcagatcccaaggatctgcatttagattctaagtacaaagatcatgatattgttgcaagcttttatgtgcagaagccagtttcattgctagaagacaacatcttgctactttctaaggacatttttgaagagataggggtggtcatcttgtccctagatcccttaccacggtcaaacacgacaaaagtggtgtttgcagttgatcctgatggtaaatattcagaaatgtctgcagctgccattagtttgataagagcatcatttaaatacctggttatacgccaatcatatctccagctcactacatccttgtttggtgttccctctgtttttgaggtgctgaaatttaaaggagggatcactatcattccacaacagagtgtgttccctctgcaaacggtgcaaacgttattcaactttactttgaatttttccatttatgaaatacaatcaatttttgatgagctgacaagtcagctgaagtctggactacatttggcaccttatgagaacttgtatgtcatcttatcaaattctgaaggttctacagttactgctcctactgttgttcaatcatctgtcctacttgcagttgggattccaccatcaaaggagaggctaaagcaactggcacaaaccataatgggacatcattcatggaaccttgggttgaataacactcaatttggtagggttaagcaggttcgactttcatctatctggcaacactcccttcatggcaatggtggtaatggctcaccttcccctgcccctcagcctcatccccatcctcaccaccatcaccaccaccaccaccaccatcaccatcaccatcaccaccatagtcaccaccaccatgcccacgtatttcctgaaacttcacctgcacctgcacctacacctacacctacaactggggaagattctacttcacacaattttggtgcccctgctgcccctgcgagaagtttgcctgctccatggagaagttcttatgctcaacctcctaattgtcgatttgagcatagaaagagatctccccggaatactcaaaaacatgctcatctaacacctgcagtttcccctactaatgttccacattatcctgttgcctcaccaggagttggacccccagcacatcatggctttcattctttggttcctgctttgagtcctttaccaaatgtagcatttgcacatgctgagccccctcctaagaatgattcatcagctgaacgtcctaaatcacattttcaatggccatcaccgtctttttttagaaatggtaagcttgatgaagttgagctttcaactttcaaggcatgtaggaaaaggaggaatcttctcattgtgtatgggctcaaactaacacctccgcatatgttctga

SEQ ID NO: 31676 - DNA, 261 bp, Glycine max
  Peptide Sequence Number=SeqID_148454
atgggaaagcccggagaacaccaccttctgccttccggtgtcgccgccgaggatccgcggcggaatgcggcgtctccgccgggatgcgccgtcggattccgatgcctcgtcgtcttgcttttctcggtcgcggttttcctctccgcactcttctggctaccaccgttcgctcacttcgcagatcccaaggatctgcatataaattctaagtacaaaggtgggttgttaatcgtttttggaactgaattttcgatgatgtaa

SEQ ID NO: 31677 - DNA, 384 bp, Glycine max
  Peptide Sequence Number=SeqID_148455
atggatgacattgctactgagcaacattctgcccagcgaccacaatgtcgatatccccctgcggaagtatcagttgggatcgcgcccacaagacacccagtggacccagagaagtccaatagggccctgcggtttccagctctggttatgggcctttgtcagtcctacagggtgcccgtcccccctagcaagttctacggagtgcccgtcgcccccagcaaggtcatcaagcctcgtactaaccaagctttgatcaagaagtattacgcccccaagaaggcgcagggtgagacaccacagcagccagggcatggccggcagcggacaacagacgcactgccgccttctccaaagtttacctcagctcatccacaaaaaggctag

SEQ ID NO: 31678 - DNA, 237 bp, Glycine max
  Peptide Sequence Number=SeqID_148456
atgcagatacatgagtgtctctaccagcttagcctcagtcagcagggtcagggtttcgttccttttgcatgccctactcctgatcagtttagggctgaggtcgcatggcccagagattggcctgaggcccaggtaggggaggcgcttgcagaggctcccggcgatgcagaggaggcccgcatggatgaggagatgacagatttgctcggtttcttgggagggagcggagccacatga

SEQ ID NO: 31679 - DNA, 231 bp, Glycine max
  Peptide Sequence Number=SeqID_148457
atgtctcataaaaatgacgatatcagactcattcatcgttggatcgtcgtgaaatttaagaaacaggttcacaactcaattctgagcattctcaccattgggaatttcaaaatcatggagaaaaaggaaccgcatgaagatagtaaaaatggaggcttcaatcccttctcattctctctaacgtttgggaaccctatcagagcaactagaggaatctcaggaacttgttag

SEQ ID NO: 31680 - DNA, 513 bp, Glycine max
  Peptide Sequence Number=SeqID_148458
atggcggcgaagaagcatgacgccggagacaccaaaaagagaaagcgactcaatactaaaactcacgaagatcccaaggcttcaaagctcgttgcctcaaagaagcacaaactagactccgttgctaaagacaacaagaacaagaagacgactcctcttaccggccaagaacgtcgtcttcattccaaggaactagcagatgctagaaaaaagaagagaaagcgacatttcactcttgagcaagagcttgcgcgtctatgggaaaagatgagacgtcatgagattgctaaagaggacagagctaagctagtgactgaagctttgcaaaagatgaaggggaagattccagagattgcaaaaacgaataaaatggttacaaccatcccaaggatcatcattgtttgtcagtattctcttgggtcagtgtggtcagtgtttgtagaaacaacgaccttgctgcatctagggctggcaatggttttgttcgattatgcttcttctgtaaatcactaa

SEQ ID NO: 31681 - DNA, 387 bp, Glycine max
  Peptide Sequence Number=SeqID_148459
atgcaaacctctaattcatttcctcccaaattggcctgtggcagcacatcagatattaacagcgtcagttgggcagcgttggcggagaaagttagattggtgctcaatgagtatccacaactcagactaacccaagggagaaaagtgctagagatccgtccaaccatcaaatgggacaagggcaaggctcttgaatttttgttagaatcattagggtacaagaatttgaatgatgtatttccaatctatattggtgatgatcgaactgatgaggatgcttttaggttttgcgcagtaggggtcaaggaattgggattcttgtttctagagttgcaaaagaaacaaatgcttcctattccttgcaatgcaggaagcagagacaactaa

SEQ ID NO: 31682 - DNA, 255 bp, Glycine max
  Peptide Sequence Number=SeqID_148460
atgttcgccgctttcttcgccgccggcatcgcgctcggcgcgccaccggcgctgctgggcctgatcctggcgttctcttcctcgctgatgatgtcgctgacgcattacggcaccggcaccgcgccgatcgtcttcagctccggctacgtgacgctgggggaatggtggaaagcgggatgggtgatgagcgtggttaacttgctgatctggatagtgatcggcggagcatggtggaagctgctgggctactggtga

SEQ ID NO: 31683 - DNA, 279 bp, Glycine max
  Peptide Sequence Number=SeqID_148461
atgtggggcaggggaagctcgcccaggcgagctagttacttagccctaaaggcaaaagcttgcccaggcgagctgctttttgtttccttgaccaaaacattgagtgattcctggcttcgcattgtaactggcgtcaaacaacgtaattcgactagcaaggatcaaaatatcatattgaacgatattcctcagatgaaattagggtctgacgccagggatgcaggagaaggccctagggttcttatgagccttagggtagattttgagcccatgggctaa

SEQ ID NO: 31684 - DNA, 573 bp, Glycine max
  Peptide Sequence Number=SeqID_148462
atggaagaaggattctccaccaacaaaccacctctgtttaaaggcataaagtatgattattggaaagagtgtataatagcccactacaaattcattcatatagatctatgggatgtgattgaaaatggagattatattccacatgatgatcaattgaatgaaattcctagaggccaatggataaagcaacaaagactcaaatctctgctaaactccaaggctcaaaatgtaacagtgttgagagcattaaagaatcttgactatatgtcccttgaggaacttgtcgataccctcaagattcatgaacaagaacttcaacaggatgaaggacccaaaagagaaaagtctttggctctcagtaactcagatgaagataaactcgccttcatttcttggaagatccacaagatgttgagaaacaaaggaggctccaagaggaaaaactcctcaagaagaatgtcgagagaaaataaggataaagacaaaagctccataattaaggaagaatcggccaagtgtcgcaaactacctcacgatgggacagtgaaggaatataaaagaggagtcttctaa

SEQ ID NO: 31685 - DNA, 315 bp, Glycine max
  Peptide Sequence Number=SeqID_148463
atggaggagaaggtgaagctgaaaattaatggaggtttaaggagcacctacttgaagctcttgagaagaagtgagaggaggcgtcatctactagagaataagccatggaaggagaagcttcaccaccaagaaagtgtcttggataagaagcttagagaggaagcttcaatggaagaaatgaatgagagagagggggcttccttgagaagtttccttaagaagctagagtttagctacacaccccttctaatagctaagctcacctccttgagaaacttccttgagaagctagagtttagctacacacccctctaa

SEQ ID NO: 31686 - DNA, 1105 bp, Glycine max
  Peptide Sequence Number=SeqID_148464
agggctacacgtcttctccttcagaggactacacgtcctcgccttcagaagactagacgccctcgccttcagaggactacacgccctcgccttcagaggactacaggtcctcgccttcagaggcctacacgtcctctccctcaaagggctacacgccctcgccttaagaggactacacgtcctcgccttcagaggactgcacgtcctcgccatgagagggttgcacgtcctcaccttaagagggctgcacgtcctcgccttcagagggctacacgacctcgccttcagagggcaacacgtccttgccttcagaggactacacgtcctcgccttcagaggactacacgtcctcgccttcagaggactacacgtcctcgccttcagagggctacaagttctcgccttcaagggactacacgtcctcgccttcagaaggctacaggttctcgccttcagaggactacacgtcctcgccttcagaaggctacacgtcctcgccttcagagggctacacgtcttctccttcagaggactacacgtcctcgccttcagaagactacacgccctcgcctttagagggatacaggtcttctcctttagaggagtacatgtcatcaccttcaaagagctacatgcccttgccttcagaggactactcgccctcgccttcagagggctacacgtcctggccttcagaggactacacgccctccccattagaggactacatgtcctcgccttcagaggactacacgtcctcccctttagagggctatatgccctcgccttcagaggactacacgtcctcccctttagaggactgcacgtcctcgcctttagaggactccacatcctccccttaagagggctacacgccctcgcctttagaatactacacgccctcgcctttagaggactgcacatcctcaccttcaaagggctgcacgtcctctccttaagagggctgcacgccctcgccttcagacggctacacgtcctcgccttcagaggactacacaacctcaccttcagagggctgcacgtcctcgctttcagagggctccacatctgcgccttcagagaactcaaggtcctccacccttaa

SEQ ID NO: 31687 - DNA, 276 bp, Glycine max
  Peptide Sequence Number=SeqID_148465
atgggtggtttaacctctcattatcatgagacacctaactatacaaaagagatgaaaatgtgtggaggaatggaaagaagatgggcgtggaggctctccaagcagcttcctcacgctaagccgggatcttttcggctttccgctaagcgactacaacgtgctaagcgagcctggtgcgctaagcgagaaccatcaggcttcaacttctcttcaatccctcatttgtgttcctccaaaacaaaaatcacccaaaacagtataaatctaacagtttag

SEQ ID NO: 31688 - DNA, 573 bp, Glycine max
  Peptide Sequence Number=SeqID_148466
atgtatcaggcagccttacctctaaaactagagaagggattaaaggttcgttctcacattatgcttggaattccaaagcacgaggaggttccatcaaccccacaacgtcctctttcagcaatgggtgaggcttgttcaagaatggacctaactgcaatacatcagatcttggttgcgacacactacagagacgatgaaggaactaatgagttgtcgttccaagagtggactcaacagatgagagatatgctggaggcaaggaagcgtggagactatgcattccgtgacaaggactttaagacagccattgataactattcccagtttattgatgttggaacgatgatctctccaactgtttttgcaaggcgcagtctgtgctatctgttatgtgatcaaccagatcctgcactacgagatgcaatgcaagcacagtgtgtttatccagactggcccacggctttctacatgcaatcagttgctcttgcaaaactggacatgcacaaggatgcggctgatatgttaaatgaggcagctgcattggaagagaagaggcaaagaggagcaagatga

SEQ ID NO: 31689 - DNA, 3720 bp, Glycine max
  Peptide Sequence Number=SeqID_148467
atgaggcaaagcagtaacgcagagactcgtttctctggcaccatttcatccccatccctcaaaaaatttcttcccagatcactctcttccaaacaaaaacccacttcaaaccctaacatccgaaattcagatgcagagaacactcctcccaccgatcccaacatcctgatcaaccatgaacaatcgttgttgccttccacaaccaaacaatcacactcaaaaacctcaatttctcagaaccacctcaaacaatcgaaatcccctcttgaatccgacccatcagtcaaggttgtagtgcgaatcagacctaccaataacaatggaatagatggagatcgaaccgttaagaaggtttcttctaacaccttgtgtgttggggataggcaatttacatttgattcagttttcgattcgaacaccaatcaggaagatatttttcagtcagtgggtgtccccttggttaaaagtgctttagctggttacaacacttcaattctgtcatatggccagtctggaagtggaaagacttatacaatgtggggtcccccaagtgccatgtttgaggagccctcgccccacagtcacaagggaattgttcctcggatcttccaaatgttgttttctgagcttgagaaggagcagcatgtatctgaggggaaacaattcaactatcaatgtcgatgttcttttcttgagatatacaacgaacaaattggggatttacttgatccaacccagcggaaccttgaggcatgcatatgccatccgtttgtgctacaatttatcataaaaacattattgactaatacactaatgaaagatgattccaaaaatgcattgtatatagagaatctgactgaggaatatgtcactagctatgatgatgtaacacaaattttggttaagggcctttcaagcagaaaagttggagcaacaagcttaaattctaagagctctagatcacatataattttcacttttgtgattgaatcttggtgcaagggaatatcatcaaatggtttcagtagttcaaaatctagcagaattagccttattgatcttgctggacaggacaggaacaaagttgaggatgcaggcaagcaatgtctaaaggaaaacaagaatgtaaagaaatccttatctcagcttgggcacttagtagatgccctgactaaagaaactcactcaggaaaagcagaagaaatttcaaacaggaattcctgtttaacatgtttactacaagaatcacttggtggaaatgccaaactctcattaatctgttccatctccccagataacaagaataatggtgaaacgctgcgcactctcaggtttggacagcgagtaagaaccattaaaaatgaacctgttatcaatgaaataaaggaggatgatgttaatgatttaagtgataaaatccggcaactgaaggaagaacttattagagcaaaggctgaggttcatagctcagatgggagtaaaaatggatacctccaggtacgtaatgtacgtgacagccttaatcagttgcgagtcagcttaaaccgctctctgctcctaccttgcattgataatgacgctgatgaagaggtaaatgtggatgaggaagacataaggcaattacgccagcagattgatgaattgtaccattcatgtgaagagaaccctaaaaacatatctgtcagtgaagattgtgtccagtattattctgttgctgaaaattgtgacacagatatgaccagtggtgatgaaattgaaaaagaggaagtatgttatagagaagcaatgagtaagctatgtctcgaggaaagtgagggatcaactaccacattgtatacatcagcagatgactttgcatgcacggctaatgcctcaaggacaattaaatctacattcagagatagcatttcagttagctcatgtagtcggtctccaatacttggagaaccacagttgtctgagtctccaaaaatcaagaatgtccataggaaaagtgtggcttattcacaaagttgtcttggaagttggaacaatatggcagaggagaatatgagttccagtaatgatatattaaagcaatcatttaaagagggtgagcagatgcgatcgtcactacggtcaagcaaggtttttcaaggtcctacccaatccttggcagcaagccttcagaggggattgcagataattgattatcaccagcgcaactcagcattaaacaaatcttcagcttccttctcttttgagtgcttaaccttgacaccttgtccagaagataaggatgattcttgtgatcaaataatgcaaaagaagaaatattctgtcgacgaaagaactgctagcttgctttgtgaatcttgcctcaaaagaatatacgatcaggattctacagaggttcaagatagcataaagtctagggttgaaacagctgaagcagaaaatccagatggactaacagataaggttccaaaagatttacagagtataatggaaaaagcaatcacgagagaaaaggaacttgagaatgtttgcaaggagcaagctgctagaattgaagaactaaatcaattggtggagaaattgaaaggagaaatggaagtaaaatcttccatcattgtgtatgatccagaaagcaataaacagactaggcatgaagaagagtataactcattgaaagatgaagacaagcttccaaggggaacttccttagacaggcatttaccagatattatagaggaaaattgtgaaattaaagaagtccaggaagaagtaactcaaagagacagctctttcaatgcagctgagaaggaagaacttcttaaggagatccagaatctaagaagcaggctgcaattatgtagtgatgcaccagttaaaaagtccaccgacaaactaagatcatccttatcattaatgtcaagatccattcaactccgaaaaagtggtgtattttctcttgataatggtggagatgagctagagaaagagagggagagatggacagaaatggaaagtgaatggatttgtcttactgatgaactaagagttgatcttgagtccatccgccagagggcagagagggtagagatggagctgagtttagagaagaagtgcactgaagagttagacgatgcactaaaaagagcgattcttggacatggtagaatggtggaacactatgccgacctccaagaaaaatataatgatttggttgcaaagcacaatgctataatggaaggcgtagcagaggtgaagaaagcagcggcaaaggctggaaaacggggtcatgctcgctttgccaaatctcttgctgctgagctttctgcattgagggtggagagagaaagggaagcaaaattcttgaaaaaggagaacatgaatctcaagattcaacttagagaaactgcagaagctgttcatgctgctggagaactacttgtcagactaagagaagctgagcatgcagtgtctgttacagaggagaatttcacaaaagtgcaacaagataatgaaaagctaaaaaagcaaatggataagctgaaaagaaaacacaagatggagattattaccatgaagcagtaccttgcagagagcaaattaccagagtctgcactgcagccactaattagagaggattctgatgttgttcacaaggatgcaacttcccgtgatgatcaggcatggagagtagagtttggagcaatctatcaacagcattattaa

SEQ ID NO: 31690 - DNA, 1854 bp, Glycine max
  Peptide Sequence Number=SeqID_148468
atgcagaacacaagagattttgctgtgtttctaaggaggctagttttctttgctatcattttctttatcatagactgtacaagaggtaagtcatcagaatctgagtctttcttaaatttcttaagggcccttgatcccagaaacgagcttaacattacctggaatgggtcaccatcgcatccatgcttggtcaagttgaatggtgtaagatgtaactcaaatgctaccaatgttgtacatataaggcttgagaacttgaaccttagtggcacaatcgatgcagattccctatgcaggctccaaaagttaagagtggtaagcttggctaacaacaacattagaggaaccataccacagtcaattttgcattgtacaaggttgacacatttaaatgtaaccagcaaccaattgagtgggaggttgccaaatgccttaacaaaattgaaacatcttaggaacttagacatttccaataacaatttttctggtatgatccctagtaaacaacaatattataggcacctccttaggtattatgtgactccaagtaacaagttggaaagcaatagtaccaaagagaggctaaaggaaagtgacacaaacacaatactgcaagagcaggcaacaccaccaggtgctttaagtaacagcacacctaataatgggaaggattcatcgtcttggagggtggaaaccttgggggtgttccttttgggtgctggattgcttttgtcaagcatttactttattgtaaagaagtcagcaaagttaagtgcagagaaagaggttgctgtagttaaagaccatcgtcgtgtgtctccaataataaaggctacaactcatgaagttcaagaggtgaagctaaaggaaggagattctgagcttgttttctttgttgaagatcgtgaaaggttcacactcgaggaccttcttcgagccactgctgacttgaggagtgaaggcttctgcagcagcctttacaaggtgaaattggaacacaatgtttactatgctgtcaaaagattgaagaatttgcaggtatccttggaagaatttggtgaaacattaaggaagataagtaacttgaagcatcagaatattctcccccttgttggttatcgttccaccagtgaagaaaaattcatcatttacaaatatcaaagcaatggaagcctgcttaatctgttaaacgattatatagcaggtagaaaagatttcccatggaaactgcgtctgaatatagcatgtgggattgcaaggggtttggccttcatatataggaagttggatggagaggaggaggtcgttcctcatggaaatctcaagccctcaaacatccttctagatgagaacaatgagccactaataagtgagcatggcttatcaaaatttatggacccaaatagaggtttcttgttttcctctcagggatacactgctcctgaaaagagcctaacagaaaagggtgatgtgtatagctttggagtgattctcttggaactactaacaggaaagagcatagaggtgagtagaatagaccttgctagatgggtgaggtccatggtgagggaggaatggacaggagaggtatttgacaaagaggttagggaaaatgatcatcaatgggcatttcctcttcttaatatagccctcttgtgtgtgtcatgtttccaagaaaataggccaaccactgtggagattttggagaagattgaagaggtcatggatcaacatgagcaacatcaggaacgttatgcttccaaatgctgttccaatggatccaaccgcgatgaatgctgttcacttcacaaaatcatacctgaaacctgggattctccaggatcaaattattga

SEQ ID NO: 31691 - DNA, 600 bp, Glycine max
  Peptide Sequence Number=SeqID_148469
atgccggaccaagatatttgcagttacattaatgaacctcgtcttgtagccagaaagttcttggccagacctcagcatgagggtgttggggctgttgttagaagaagcatagggagatttgagctcaagtactttgatcctttcattgtcttggatgaattctcagtcaccgctcctgctgggtttcctgatcatccacatagaggatttgagacagtcacatacatgttgcagttgagccaatgcaagtatcagctcaatatggtgttaatctgtgtgctggtggtgtggcaacatggagctataacgcatgaagattttgaaggacataagggaacaattgaagctggtgacttgcaatggatgactgcagggagagggatagttcactcagaaatgcctgcagctcaaggaacccaaaagggtctccagctgtggatcaaccttgcttcaaaacataaaatgttgacgcgcgtctcatggaatggacacagtactaaacatatcatcatcatcatgggtttggaggatcatatcaatgagacaaaaaggaactccactcttcacaaagaaacagtcaaatctttaaaaactttctga

SEQ ID NO: 31692 - DNA, 777 bp, Glycine max
  Peptide Sequence Number=SeqID_148470
atgctaacttcagtaattaacaatctatcattgcaaaatgccgtaaaaacgattggagctacaacacagcactgccaagaacaccgggatgtcgcaaatacgaagccacacagaattgaaactaggattctcgtggtgtgtataaaggaaggctttgggatgaagaggagtaggtcatcatctgaagatgaagctgagactgaggctgaggttcagtcactctctgtgtcaaattaccacattgtagatgatgaggacaatcctgtatcttttgctgtgttgccaattcattggagtgattctgagaactctgaagccgccaacaaaggaaaggtgttcatagatggggacaccgataatgggctgaagaaaattttcatgcaagtcaccgcgtggagatttgatctctccaatgtgagactcgagatatctttgctttcaaaggatggaaggtggatcaagcttcagaaacctaggaaggggtttcagaataaaataaggaccgttttgatcacccttcacttcctgcatcgtgtgaagaaaaaacgtcaaatgtctgagatatctgtctggcaagacttgagtaaggatacggagttgagctcttctggggttaagccttcacaaaaggatttatcggaccatgtgcctttgattcgtgaagctgccaaaagggactcagtcttagctaaatccaagcgttacacggtgtttatgtggactgctaaaaaaactacttctgcagtagaaaaatttctagcggttttacaccaataa

SEQ ID NO: 31693 - DNA, 1194 bp, Glycine max
  Peptide Sequence Number=SeqID_148471
atggttttggagaaactgaatagtcaaaaacttcttgataaggaagtcaacgatttggctcaacctggacttacagttgttggaattgacagtgatatgatagatgaatctaatgaagaatcagaagaaagggatgatctggatgtttgtgcactttgtgacaatggtggtaatgttacttgttgtgacggagtgtgcatgagatcatttcatgctactgtggaggctggtagagaaaatagttgtgtttctcttggttttacccagaaggaagttgatgagatccaaagcttttattgtaagaattgtgaatattatcagcaccaatgctttgcatgtggcaagctggggtcatctgataaagttaagggtgccgaggttattaaatgtgtttctgcgacctgtgaccgtttttatcatccacattgtgttgcaaagttacttcctcagctagctaagcctgttgcagaggatcttgagagaaatattgctgatcgggcgttgtccaaagtcatatcatcgcaaatgtttgccaagagggttgattctcaaattgcttttatcagagaaattgctcctagcaacagaggtaacaaaaatattatacaaagggcttgggaaggtcttttaccaaataaccgcattctgatatattgcttaaatcacaagatcgatcgtgaacttgggactcctgtaagagatcatataaaattccccaatatggaacctactgttcaaaaaattaatactactattgagcagaaggaacctgcaactaaagagagggttatactgaagaagaaaaatgttgacttagataattcatctggcaaaagcattgctaaaggatctaaattgactggaaaactgtcttctcacaaagttggtagcaagaagactaaaaagattatttctggttcaaatatctcaagaaagccaaaatcaaaagaaacatcaaggtgtttgactgaaaataagaggtcaatctcaaagaaatctgaaatgtctgactctgagcaaaactataaccagcctacaataggtgagatatatgctctccaaaaagagggtttgaagcgaatcaagcatgacaataaggtcaataatgtgattactaatcccctgtctgtgaagcctatcgaatcactgagtgttgaattgcctccattggatgctgattcagaaaagaggtaa

SEQ ID NO: 31694 - DNA, 546 bp, Glycine max
  Peptide Sequence Number=SeqID_148472
atggggaagctggaatactcagttaatgctgttcaaacagctttaaggaaattagagagtggatgcagcattcaggatgtaaaagctttttgtgaccctgatgatctgaagcagttatttaagtggaaggatgagctgaaaatatatcttgctcccgttctatatggtaaccgctatacatcatatggtcgccattttacacttgtggaaaagctggaagggcttttatatcctccttcctcgttaaaccatattattgatttaggacttcccttgagcatgcaccataggtttctaggtgaggcagatatcatggataggagaaataatgatgaccctgcagatgctgggaatgaggggggtttctacactgtagagtctacagttatggtggcacagtggtttagtggcagtgatgatgtactattggggattatgcacacgctgcattttgtgttcaagaagattgttctaattgttgaggctaggttgattgtggattctgataaggaaaaggttcctgccatattggctctaattcgctga

SEQ ID NO: 31695 - DNA, 261 bp, Glycine max
  Peptide Sequence Number=SeqID_148473
atggcatccatcatggaagccatttgttctatcaaagccgacatgtcggctttcatctgttcctgtacttcctctaggtcatccatcatcctagatttggatatggtcgacaaaagcggggcttttgctcctacgtaccctccattgaagaggaaatcagacctacgtagttctttctttaagagtgaatcaagcgattcttgttacttgaaaggtgatcattctaaggcgttggaccttaaaaatgatccatttacttga

SEQ ID NO: 31696 - DNA, 615 bp, Glycine max
  Peptide Sequence Number=SeqID_148474
atggaccaaaggaatgcaaggccacctctactctccctttggagccgtcctgactggactactaaacacaaggtcatagcccaagagaatggtcatgtatgcagccagcatgaagtattagatacaactgatcatactacggatggaaattatgctgccaatttaaagtcaactgataatcaagaagatcaggcatctactagtgaaggtcagaaaagaatcttacattatggtaatagtcaactcaatccaatcaaaggaaaatcctcaggtgaaggtcttaagcccaaatctgatgaggttggtgacgttgtacctggtcacggtccttcctggggccactcgagaaataataacgagcaagtagtttcagagacagagtcatcttgtaagacgaatacaccagctattggacaatgtgaaccttgcctaggtaatttaaaccatgtcatgagaagctctttggtttctgaacctcgtacattcagtacaagtggcagtcttggacgtagcgtaccccaatctagatatggtggtgggggtttgcttggttttgcttctggtccgaactatgcatatgcaagccagcattcgtgtggttggctcgaggagtaa

SEQ ID NO: 31697 - DNA, 252 bp, Glycine max
  Peptide Sequence Number=SeqID_148475
atgatatttcacctaactttggttcttactgcaacaacatgctgctggatgatatgcaactcttcagaatgtgaatcactagttagacgctggagaggagttgatttcagctctcataaatcattcagtgtttactctggctggatctgtatgtattcttgttggataatgacgtttcagttggatcttccattgccggcattaccccatgttacaatcgttgtattcaaccctcgttcgttccataagtag

SEQ ID NO: 31698 - DNA, 315 bp, Glycine max
  Peptide Sequence Number=SeqID_148476
atgacgaggatgacccgtgattttagggatactatgcaaaaagatgcagtgccggcggtgtcggctgatataatatttgcttctcttcggtttcctaattacaaaatcggagttaacaatcagatcatggagacaaaggatagtccaaaagtgctatctatgaaggaggttgttgcgcgagagactgcacagctgttggaccagcagaaacgtctgtcggttcgcgatcttgccagtaaatttgagaagggtttggcagctgcaggggagggaagagcaacagtgaaagggaaaatgggtttacttcatttttga

SEQ ID NO: 31699 - DNA, 825 bp, Glycine max
  Peptide Sequence Number=SeqID_148477
atgtatggaaatggaaggagaaatcaagagcttaatgaaggtatggatttcaatcctagcctccctatgttactgttatttcatatcatcaagggtacccaaaggcttgttgaggtttttgaccctctccccagtgttgtacctattcaccatcctacctcttcaactcaccactgtcctcccaacagtctctcactcatgagccttaaagatcaatacaaacaaaaacttcaccctacaattattttgggcatatattgtacccttctgtatcttttaatggatgttgttttgggactatgcaacattgtggtcaatgctgcatttgggattgagcttcagttgccgtcggatgacccttatttgtcaacttctttgcgtgatttctgggggagaaggtggaacctcatagtaacatatactctgcgtcacactgtatacaaacccgtgaggtcattattaatgtccaagaccgtgttgggcccccagtgggcctcggtgtccggagtcatggcaactttcttggtgtctggtctaatgcacgagctgattttctactacgtcacacgtgttagtcccacgtgggaggtcacgtgcttctttttgctccatggggtgtgtgccgttgcggagtttggtgcggtgaagtggttgggcgctaaatggagactgcattgggccttgtgtgggcccattacggtggcgtttgtgatagtcaccgccgcgtggctcttctttccaccgttgatgcatgatggcacagatgagagaaccatcaaggagttcaacgatgtagttgagtgtgtgatgggaaaattttactag

SEQ ID NO: 31700 - DNA, 726 bp, Glycine max
  Peptide Sequence Number=SeqID_148478
atggcaccctcaatttgttttcttcttctatcccttctgttcctttcatcctccacaagtggtactgatgaagagggtttcatctctgtgatcatatctgataagggccttgattttgccaaggatattctgatagaccaagctgttgcctctattgttcagtctcagctgccacagattgagaagactgtgcaagtccctcttgttggaaaagccaaagtggttctttctgacatcactatcaatcatatccaagttaattcttcatctgttaatactggagagacaggcattgctcttgtcgtttctggtgccactgccgacttgagtttgaactggaggtactctgttagcagttggttagtcccaattggaatttcggacagtggaaccgctactgtgaaggttaatgatttgcaagtgggacttactgtgaatttaagaaaccaagaaggaactcttaagttgaatctcctggattctggatgtcatactgtgggacctgaaactgggaggccagataagagtgtttccgttatcttctgcaacaaaaactattctggggaatataaagctatatttcaatttttttgcaggctagtagatgcttttgcaggaaatatagcatctgcagttgaagaggcaatttctaagaaaataaatgaggggatatcattagtaaaaaacagctaccatcatttcgaattccagccccccccggcctaa

SEQ ID NO: 31701 - DNA, 525 bp, Glycine max
  Peptide Sequence Number=SeqID_148479
atgcaagcgtttcttgtgcatagaaataaccaaaaattaagagataagagcttgtctgccctaattgaaaacaagattttcagtgttcatggcggtctttctcctgccatttcaacactggatcagatacgaaccattgatcggaagcaagaagtacctcatgatggtgccatgtgtgacctcctatggtcagatcctgaagatattgtggatagctggggtcttagtccccgtggtgctggttacttatttggtggcagtgttgttacttcctttaaccactccaataacattgactatatatgtcgtgcacatcagttggtaatggaaggatataaatggatgttcaataaccagatagttactgtctggtcagctccaaattattgctacagatgtggcaatgtagctgcaattctggagttggatggaaatcttactaagcaattccgggtgtttgaagctgctccacaggaatcaagaggaacacctgctaagaaaccagcaccagattactttttatga

SEQ ID NO: 31702 - DNA, 795 bp, Glycine max
  Peptide Sequence Number=SeqID_148480
atgctgagatgtgggattaagcctgatgcagttacttttgttgccatcttgtctgcttgcagttatagtggtttggttgaagaagacatgttagggagggttgggagggtggtcgaagcctatgagtttgtccagagattgggtgaggatggtaatgccatagaaatctggggttctattcttggggcctgcaaaaatcatgggtactttgaattgggaaaagttattgctgaaaagttgcttaatatggaaacagaaaaaaggatcgctggatatcatgttttgctctcaaatatctatgcagaggaaggagagtgggaaaatgttgatagagtgagaaatcagatgaaggaaaaaggtttgcaaaaggaaatgggatgtagttgggttgagattgctgggtgtgtgaacttctttgtatccagagatgagaagcaccctcaaagtggtgagatatattatatcttggacaaattgaccatggacatgaaggatgctgcagtcacaggtgatgaacaacacattcaattcatgtacaataccattgtgcagttgaatagtgacacaagtttgatcctaccttttacccctgatacaagaaatggtgtgatgattactgttatattgagcaaagtgttttgggtgatagtggagatgttatctcatgaagaagtctacgaggttgatgatacatttattcaagattcttgccatagtgatgttataatgacaatatgtggcaaaagctcaggaacatctatgttgaggcaaacttgcaactatgattattattga

SEQ ID NO: 31703 - DNA, 1392 bp, Glycine max
  Peptide Sequence Number=SeqID_148481
atgaagaaagctgcacgagtggtgtttatcccttctccaggagttggtcatcttgtgcccaccattgagttcgccaagcttctcatcaaccacgatgagcgtctctggatcagtgtgttggtaatggacaccacaagtgctgcttacacagagtcccttgcatcccaacgtctccagttcatcaacctccccgaatcaccctccaaatctgaaccagcaatgacctctctcctcgaacaacaaaaaccacacgtcaaacaagctgtctccaacctcatctctgacgactccgccccagcactcgccgcctttgtcgtggacatgttctgcacaaccatgattgatgtggccaaagacttgaaggttccttcgctggtcttcttcacctcaggccttgcctttcttggtttgatgcttcatcttcacaccctgagggaacaggacaagacccacttcagggagtcccaaactcacttgctcatcccctccttcgccaacccagtcccgccaacagctttgccttctcttgtgctcgacaaggactgggaccccattttcttggcctacggggctggcctcaagaaagccgatgctattatagtaaattcattccaggagctggaatcccgtgcggtgagctccttctcctcccacgccatttatccggttggacccatgctaaacccaaaccccaagtcccatttccaggatgataacgacagggacatcctcgactggctagacagtcagcctccctcctctgtagtattcctgtgcttcgggagcaagggttcttttggagaggaccaggtcagggagattgcacgtgctcttcaggacagtggcctccgcttcctatggtccctgcggaaacctccccccagtgattccagtttcatggccatgccctctgattaccttccctccgatttcgttgaaattttacccccgggcttcctagatcggacggcaggaatcggaaaggtcatcggatgggcccctcaggcccaaatactggcccacccggccactggaggctttgtttcccactgcggttggaattctacccttgagagcatatattttggtgtgcccattgccacctggccgctctacgccgaacagcagaccaatgcatttttactggtccgtgagctcaacatggctgtggagattgcgttggattacagggtgcagttcatggctggacctaacactcttttgagtgcggacaagatacaaaacggaataaggaatctgatggacatggatctagacacaaagaagagagtcaaggaaatgagtgaaaaaagtaggacgacttccttagaaggtggatgttcccactcttatttaggtcgtttgattgattatataatgaatcaagtctaa

SEQ ID NO: 31704 - DNA, 1227 bp, Glycine max
  Peptide Sequence Number=SeqID_148482
atggagaatcgtgggagaagtgtaaggatcataaagttggcatgtcacgagttgcagttggcggcgtttccttggatggaaaagagaggtgtcagtgctgatgctgagctccaacttgctgattttgggccggatcctgcccagacatgtactggaaatgaaaagggtgacaaggccttccggattcctcagtccagacgacctaatctatcctcactgcaaataccagcacggtcactagatattgcattatctacttttgcaaagactgatggtcctttggtttcacgatcaagtcctggttccacaagaggacttcccccaaggccaaattcagccaaagtcaggtcttcaatgagaggtttacttcctcagaggagcttcaagataaatacctgttcccaggatattgaaaggacaggtctcatagttcctaacactcccccatcagatgctcctttggataaaccttcctcttctactcatctgtctcttaataataaggttatctccccatcaacaaaagtttcacattcattaccagttactccatttgcaacttcggctgcagagaatggacacggaagacatttaggatgtgattctggtttaagtacaatggaagttcatcagcatatgatgcgatcattttcagtcccagttaatggcaaatccactaatttaagggttacagattctaggggcttgattcgtgtaatttcggcaaaaccacatcgtgaaactgttggtggaaagtcaactgacggggctttcgttccagagattgccattgaagatgctactgaggatattccagaggaacaagcagtctgtaggatttgtttggtggagcttggggaaggagggaatacacttaagatggaatgcagttgtaaaggtgatcttgcacttgctcaccaagaatgtgcagtaaagtggtttagtattaagggaaacaggacctgtgatgtctgcaagcaggatgtccaaaacctcccagtaacactgttgaaaatttataatcctgaaactcttgctaggcagggatcaaatgtgtcacaacagtcagaaatagtttattacagtgtacaagacactgccgtaaaactttaccctctgcacctgccaaattttagaattcatctaaagaaactgctcgttgctatgggtgaaaatccaaggcccatcaaacacaccaaaaagccttctccatatgctattggctga

SEQ ID NO: 31705 - DNA, 342 bp, Glycine max
  Peptide Sequence Number=SeqID_148483
atggagtatacgattaagtctgtgagcaggagtttcgtatgggcttatgcttgcttccagtttgcaattctcatcctgttatctcatctcaattttaatgcaattctctccattctcctttcctcattcactggatttgggattgcagtcagtatgaattctctcattatggaattcattggatggagaactagcaggcgggttcaatcctccattgagaatgttaacaggacacagcagcagcatcgtgagcatgtgcaacaacagggacaggaagatgaaggacaacatcacttacaaagacaacaagagcatcatctgccgcagcatggtaacagttga

SEQ ID NO: 31706 - DNA, 171 bp, Glycine max
  Peptide Sequence Number=SeqID_148484
atggagggaagcacaggcttgcattctgaaaccttattaatacatgtctcgcgaggcctttccataaagaaatcacttcaaaatttccttcagaggagaatcagaaagaaaaggaaaaatccagatctgcacgagtataatactatctggtctggcacatttcttgaatga

SEQ ID NO: 31707 - DNA, 543 bp, Glycine max
  Peptide Sequence Number=SeqID_148485
atgcaaaagctaggctgggaatttgtgaggcaggggtttgagatagcgaaggagaaggacgatgaaataaagtgggtggctctgccagaccaaaaggaagctgggcatggccatggcttcttttctgccaatactggacttccgcaacatgagggaaattttagccttgaacctgagctgccggtgatttcaacagaggacctgccatggcttgttggaacagatgcagcaaggaaagcaagatttaaattttggaaaagaactttggtgagatcaagtgctctgaaatggctcctggtgaattcctttcccgatgaaagcaaactcgaatcggcaaacaacaagaacaagtttaaaggttgtccacgtgtgtttccgataggtcctatttgtaattgtaggattgatggtgagcttttgggaagaagatatgagctgcttgaagtggctagcaaagcagaaggcgaagtcagttgggtgagtcccattggggaagcaaagtggcactcgaggcttcagggaggcctttcatttgggtattga

SEQ ID NO: 31708 - DNA, 663 bp, Glycine max
  Peptide Sequence Number=SeqID_148486
atggacaacccagtgctgagtgattctgctattgaattagaaattaatggtttattcacagggagaaatgaagttttggtacctcaagcttactacagaggatcaggcctttctctttctgcttcctgtggtggcagttcaccaaagatgataacaatttcattacatgaaagtgttttcaaatccggttccatgctttacttcactgcagatagtatgcaatggattgttgatgaacttcctgatcaggcccttctgaacactgctgaatggagattccttattccacaattatacaaaaaatatccaaatgacgacatgaatcttaatatctctgtatcttctccaccagatatacaagtgacaaacaaagatgtcagtgtcaacattttcatagatataacaattgatgttctggaagatggtgaagtcatacctgttgcatgcatctcggtggattttagtgcctcttttgctgtggaaatcttaggaaacaatcttgctggttggcttaaattgagaaagttttccacatccttgaaatggagtaaaatagggaaactgcacatgaatttgattcagcttgctgctttgtattttgatatgaaattggatgaaattgaacaacaaggcaacaacatgagtgttttctgtttcaattag

SEQ ID NO: 31709 - DNA, 387 bp, Glycine max
  Peptide Sequence Number=SeqID_148487
atggtgtttgttcgtcacagacgtacggatgacttccggatcaagttgatccatgagtggatgtatgaaataatgtctgaacgagcggatatggattatgaaaatgcagaatcatgtggtgcgaatgaactacatgttgattgttcggatgcgttcaagacttctcaggtatttgagtgccgagaggatgttttgcggtgggctcgattcgtggctcatgaaaacggatttgtggcgatgattttaaggtcggacacaaacacaggagtggcgagtataagtgtaggaaaaaagaatttatcagaagagacactgagactaggaaatgtgggtgtcccttcaagcttcgttgcaagccagtggctggaggagaaggctggatggtga

SEQ ID NO: 31710 - DNA, 2769 bp, Glycine max
  Peptide Sequence Number=SeqID_148488
atggaggatgccgtccccgatccccaaccggaggagcagccgcagcgtcctccgccgcttctgaacgggtactccgacgagcgctgcgccaagaaacctaaattcgacgaaggcgccgaattgaagagagtggcggagattgtgctcgttctctccaccatggccactgtgcgtgccgggaggaagccctccgacgccgaggtcgagctcatgagggaggctcgcgccaagctggcgagcctctgcgagggtttggctccgaaggatattgtcgccggggaagctattggcaccgtcatcgaggatcttggattgaactccaagcttaaggaccagagattagggtttcgaactcccaagatgtccattgccgagaggtattcccatgctaagtggaagatggaagaagcaaagaaattttctgcatcttctacaccttctacaacacacacatctcagcccttgcaaacaaacattggtggaccagttgacaatcgtgtgccatcacatgttgttcgaatttttccttctgataaatcaagccacccagcaatcccttctatgggtaccgtagtgcctattcctgcccatgtttctgcgggatcttctgcagcattgcaatatcaagtaaccggcaatgaagtaagaccaccagtggtttctggtgtgatgcctagcagtcacttggggagaaattcatcttccttagcattgcctaaagttgaacgcccacagtttaaagttgatggaggatcaaatgggtctccttacatgctgcaagtccaagcaaattcatctgcaaaccaacctttggtgaatgctccaacatggtctatacagactcaagctgcttcattagccagaagtgcatcagaaaacaaggtgcctgttcataactctgtcaaggttgagggaacacctgatgcaactgtatcaagggcagggacacaaataacaacagactcgagctttagaccatttatcactcaaacagcccctggaaatttacctagtgtgcaccagccattgcaggccacaaacattgttcaggctcctttgattcctagtcacactgatattgctaagattgtccagaaagtgttacaaccaaagcttcctgtccatcccacgtggactcctccatcaagggattatatgaataaggctttcacatgtcagatgtgtgaactcagtgtcaatgaggttgatactgtacttctctgtgatgcttgtgaaaagggatttcacttgaagtgcctgcagccatcagtcttgagaggaattcataatagagttgattggcattgtatgaggtgcttgagtttaagtggtggaaagcctttgcctccaaaatatggtcgtgtcatgagatcctcaaacacaccgccaaaattgccctctaatacaggtggcgttcaaccatgttctgagaagaaagtagagaatatcgatccaaaggtcatcccacagacgttagcaacaaatgggagctctgttccaactgtttccggtggccatcacaatgttgagttgccatccgaatcaaagataccagataccaaagatatgcaagggactggcatttcatccaccattgaagctattgataagaagcctgatccaaagaactctatgaaatctcttagtgcagcttatagtccttccccttgcttgctaggtgaaaattctgctcaacaaataaattctaaggttttgactggtagagagacttcggaatctgagtctcttcctaaattatctgagctagctaagtgtgaaaatttgcaatcatcacaagattttcaagttgaacatacaatgtcacaagacaatgctgaagtatcatcagataaacatgttgacagtaatatgatgaataaccaacagaaggaatctcatggagaagaaaatttagtttatgatataaagcgtgatgaccaagatgctgcacttgaaaattctgttggaacttctggaactaatactgatggtagacagcactctgcattatcttcagatagttcacatgctgtagaatggattggtgatgtagtacaacttgtagatgagaaaaagtattaccaatcttgctgtgttgatggatctatgtgggaagattgcaaaactgggttaaagtgggttaaggtgacaaactgctactttcctgatgatttgcctgggaatattggtcatccgtgtatatctgaagtcaacgaggtttatgaatctaatagtgatagaactgaaatggctagctctattcgagggccatgtgaagtcctcccatctgataaatttaaacaagagaatgacaggcgatgtcagttacgaaatgaggaaagttctagagtgcagcccattttcctatgcagggtggatggcaagagtaaaggatgtctttggagaagagaaagagagaagaggagggtggctgtagtgcccagcggctgctctgtggtgctattgtgtcctattaatcaccttggaaacagttgtccggagaagaggtcatctctggtgtgggtgggtgggcaagagaaagaaagaggagggttttggtgcgttgctgctgggggacttgccaaacatgacaagagaatgcagggtctatgcctcaaccacgaagcccatagcagccacaatagcagatggagttgtgattgtggatccaaggagttcggtaatgcaatagcactaagtggctatttgacaacactagatgtggctgtagtgcccagtggccattctgctgctattgtgcactactaa

SEQ ID NO: 31711 - DNA, 597 bp, Glycine max
  Peptide Sequence Number=SeqID_148489
atgactcataatataaacagtgaacgaccacagtactctctaaaatgtgcatataaatctcaaagattacctaaggaggactcttgttatggaaaggccagtttagtagtatggattgttgaaaatctcaagcaaacatacttgctgaggaagaagaggatgcaaaagacgaataaagaggggcagcagcaacaacaacaaaaaatggggaaggaggtcacattagaggagtggcttctaaaatcaccaattatagaaaagggtggtaactgcaatggtgaccattgtggttttaagcatgtatctgggattgattatccctcagtaactagagaaggtaactatttttctgactttgggggatatagtttgtctttggagcaacacttagatggtggtgattatacagatttgtctgtggagaatcttttgaaagatgaaaaggttgatgtaaaagaaatggggtttaattcattgactagaagccaaagtagcaaggtgaggaaaaggttgattttggcagaactttacatgtgcctctatgtggggaaatcacagtctttgttacctccatgggtttcactaccagatccttag

SEQ ID NO: 31712 - DNA, 1197 bp, Glycine max
  Peptide Sequence Number=SeqID_148490
atggagaaggaaagatactccatctataagagtggagtgacgaaaagttggattgatgttaaaattagagaagctcgaaagttaggagtagcagcaaaggagaagaagaggagcagagtagtgaagaaggacagactcagcaacttacccgatgaagtgcttcatcgcatactttcctctttggacgcaaaatcagctgttcaaacgtgcgttttgagcaagcgatggacgcacgtttggacttccctcccagttctcaacttctgcgactcttccttcgacgattctctttacttccagtgtttcgtggaccatgttttatctcgcagagactcttccagcaacgtctacgagctcaactttgcttgcacagatgaacttgaagatggccacatcgttgactccgtcgttgaccatgtttctctcacaagcattcaggttcttagcatcctcgctgaatgtgtcattgggaagcttcctcaactctctctctgtcaatccctcaccactctcaaacttgctcacatatccactgaaacaacaacctttgacttcgtttcccttgaaaacttgtaccttttggattgtcgtttcgagtgtggggtggaagagcttctcgacccttttaggggttgcgttaatttgaaacacttgtatcttcatcgttgtcagtattatggtggaatccacaggtttcaaatcttcgtcccccaacttacccacttgagcatttcctggatgggaatgaatgaaatgtttgattctgattgtgttgttgagcttttcacgccaaagcttcaatattttagataccatgactctgatctgtatgatttttctattgagggcaaccttccttttatagaacaagtggatattgatgtgggttgtttgaccaacgacactgattcactgcttttgctgattcaattgtttgaaatgatgggaagtgcccggtttgtatccttatcacctgctatcattcaagctctagctatgattcctgatctactggatggtcgggcttcccctttctctagagtgcatactttcgagttaaacatggatagaccttcctcctcctttgttatacctcctaatgtcatggcctacttatttagtggatctcctgcatttgatttccatgaatgggaaggtatgaaaagggttcaaaagagtgcaaaacaatctgattga

SEQ ID NO: 31713 - DNA, 615 bp, Glycine max
  Peptide Sequence Number=SeqID_148491
atgaatgatgttggtgcgtatttcttcggtttctattttgggagaacacctctgataaagctttctccaaagaaaacctgggaaggtttcattggagcgtctgttgccactatgattgctgcattcacgtttgcaaacttcttaggtcgcttccagtggctaacatgtccaaggaaggatttagcaactggttggcttcagtgtgaccctgacccaatttttaagccagattatattccattgccaggattgatttctcattggcttccttggaaagagatagcagttttgccagtacagtgggatgccttgtggatgggactatttgcatcaattatagcaccatttggaggtttttttgctagtggtttcaaaagagcttttaaaatcaaagactttggtgacagtatacctggacatggtggatttacagacagaatggactgccagatggtaatggctgttttcgtctacatttaccatcaatcgtttgttgtaggccaagactattcagttgagacgttattggaccagataatgaggaaccttggttcagaggagcagctatctctctacacaaaactcgggcagatattgcaggaaaggcgtttatga

SEQ ID NO: 31714 - DNA, 489 bp, Glycine max
  Peptide Sequence Number=SeqID_148492
atggaagttgatgaagtgtattttgactgtgccattgagctttttacgccaaagttccaatcttttacgtacagtgtttttgacctgtatggttttttcatcaagtctaatcttccctttgtggagacagtgcatattgatgttctgggttgcaccaatgatcctaatttgcaactaaagttgattcaaatgtttgaagtgatggggagtgctgagtttgttgccttgtcaactggtatcgttgaagttctatctatgtttcctgatctactggatagtcggccttcccccttcactaaggtgcagacttttgagttaaacagggaaatacctgcttcctccgttgatatgcctgctaatgtcatggcctacttatttggcaaatctccaggatttgatttctatgaatgtcgatgggaaggtatggaaatggcatatgaaaccccttattgttttcttttagcacttatcatagatgcagaacattga

SEQ ID NO: 31715 - DNA, 348 bp, Glycine max
  Peptide Sequence Number=SeqID_148493
atgggagagttgagaaagatttcctacgatggtgttgtttggtggtgccaagatgctaagaacctgaatggcggcggagattggtggtgtgagggtaacatagtcaatgatggaatcgatggttttggcaagatcaagttttttgtcttggcacttgaagttgagatggtagacattggtggaagcgtctctgcgagacaagaaatggtagacgaaggagcggaagaggagagagtcgttgttgaaggaggaggagtggaagttgaggatgggaagggaagtccaaatgtacctccaccgcttactcaaaacgctcgtttgaagcgctgcttttgcgtccagagatga

SEQ ID NO: 31716 - DNA, 642 bp, Glycine max
  Peptide Sequence Number=SeqID_148494
atgggggagacacatgaaatgccccaccataatctagtggactttgagccttgcctcggatatgccactgaagggcaagcagttggtggtatacccctacaaaacactttggagggccctcagtatcacccacaaccacacccctcacattccacagcggttaaaaaccctcatgctatggcagaaataggaaagttgggtcatttagaggaaaggctcagggccattgaaggaggcaaagattatgcctttattaacctagaagagttgttcctagtacccaatatcttcacccctcccaagttcaaggtgccggactttgacaagtacaaggggactacttgccccaagaaccatctaaagatgtattgttggaagatgggggcatacgcaaaagatgaggaactgctgatacatttattccaagaaagtcttattggggtagctgttacctggtacactaacttggaaccttcccgagtccattcttggaaagacctaatggttgccttcgttgggcagtatcagtacaattctgatatggctccggataggatgcagctacagaacatgtgcaaaaaagggcacgaatctttcaaagaatacgcccaaaggtggcagctcaagtggcacttccaatga

SEQ ID NO: 31717 - DNA, 306 bp, Glycine max
  Peptide Sequence Number=SeqID_148495
atgttaaccaatgaagggcttgtcccttcaataacgtcaggaatacccggtagaggatcgtttcatccatggtgtaaaagctcactaggatggggaatagtgtctatacacacactcagattagtggccttgggtaagctgactgtggttgattcagcctcccttccttttgacgagttagcctcaggttgtcgggacctatgtgcctcaccgagttcttgttattggcatgaactcttgggctttggatatatcttacatggccccacgatggacaccaaaatattcatgtcacaaatggactag

SEQ ID NO: 31718 - DNA, 201 bp, Glycine max
  Peptide Sequence Number=SeqID_148496
atggccctcgtcaacatgcagcaagagaagaaagacccgttgcgaaacttcatggaacatttcgggaagatggaagagttggccgattaccggaaccaggtatgggttgaggccatgtcggccaagaaggataatgacaagctcaactctaacaaagctcacgatgatgggaggtgtaacatcccattttttcgtaaataa

SEQ ID NO: 31719 - DNA, 144 bp, Glycine max
  Peptide Sequence Number=SeqID_148497
atgccatatgaatatctcctcaatggtcctaaaaaaagtatgtgcgagtggaaggaagttaaaagctctgagtttgatcctgtggcagtattaaaagttgaattaggaatgggaaacacaaaatattcaaagcaaaagacataa

SEQ ID NO: 31720 - DNA, 423 bp, Glycine max
  Peptide Sequence Number=SeqID_148498
atggaaggagttcaaccttgtccctcacttccatattgtcgcaacctacatttcggtgggagggcgaagcgagggctcacgggtgcgtcttccaagaaaggaaaatgcgcggagtcgccaccaacatttattcgaggaaaacgtcgaaaaaaccgaaaaaggtgtggtctacgaactttaagtgtgaaaggttcgggagttgtatttacgcacggggaaggtgttggaccatttaaacgatcctttgattcttttgaaaggagaaaaatgttaaggtgttggaccattaacgatctctttgtttttgaaaggagagaaaggttaaggcgttggaccattaacgatctcttggggtggtcgacaaaagcggggcttttgctcctacgtatcctcaattgcgatgaggaaatcagacctacgtag

SEQ ID NO: 31721 - DNA, 630 bp, Glycine max
  Peptide Sequence Number=SeqID_148499
atgcgtagtgattgcctagtgcaattctccattctccacttttgttcggagccccatgaattgattgtcgttcatgcatcctccacccgtgagtctggagccatgcgtagggattacctagtgcaattctccattctccacttttgttcggagccccatgaattgattgtcgttaatgtatcctccacccgtgagtctggagccatgcgtagtgattgcctagtgcaattctccattctcgacttttgttcagagccccatgaattgattgtcgttcatgcatcctccacccatgagtctggagccatgcgtagtgattgcctagtgcgattctccattctccacttttattcggagccccatgaattgattgtcgttcatgcatcctccacccacgagtttggaactatgcacagtgattgcctagtgcaattctccattctcgccttttattcggagccccatgaattgattgtcgttcatgcatcctccacccacgagtctggagccatgcgtagtgattgcctagtgcaattctccattctccacttttgttcggagccccatgaattgattgtcgttcatgcatcctccacccatgagtctggagccatgcgtagtgattgccta

SEQ ID NO: 31722 - DNA, 129 bp, Glycine max
  Peptide Sequence Number=SeqID_148500
aggaataggtgcttagcggttgatggatcgcttagcgctgctctggccctcacccttggccagcttagtggaccaaatcagcctgagatgcaagggttaagcgctaagcgccagagactctcggcttag

SEQ ID NO: 31723 - DNA, 105 bp, Glycine max
  Peptide Sequence Number=SeqID_148501
atggctagaacggaagtgagagatcaacttcattaccagagtttgaatgcatctcctcaagttaatcgagatttaatatccaatgagatgcaacaagtgtgctag

SEQ ID NO: 31724 - DNA, 498 bp, Glycine max
  Peptide Sequence Number=SeqID_148502
atggatgattttagtgaggatgaggatcaacagttctttgatcacatcaatcaccaaagcgatgaccaaaccgatgacgagggtattggcagaccaatgacacctctgtcgcctccattgcaatatcagcaacctaggtgtctagtagacttgaactttgaccacctaccacactacattgatcgacaccatttttttcatcaacaacacaatgtacaaccaccagtcggtatactcaaggttggcatgacctttgatgacaaagcacaattgtcgatgctcagacaagatcatcgccaactcgacgaacacgttatagcacagatcatccaaccaattgtcaaaacaaacccaaccgtctccatcaagacgttgattgaagagatcaaaacgttcatgaattataccccatcctacaagaagacatggttagcaaagcaaagagcgttgaagatgattcaaaaacacaagacatttgtcggtgtcatcgttggttga

SEQ ID NO: 31725 - DNA, 141 bp, Glycine max
  Peptide Sequence Number=SeqID_148503
atgcaaccaaaggtggtctgggggagcaaaaaccgtgagtcccgggttgctcgcccagcgacgttttccgcttgtccagcgctgggaagggatgacgatccgtcggttgtgaccctatcctccatttgcatccgtccctaa

SEQ ID NO: 31726 - DNA, 646 bp, Glycine max
  Peptide Sequence Number=SeqID_148504
gctgcacgccctcgccttcagaggacagcataccctcgccttcagaggactacacggcctcgccttcagacggctacacaccctcaccttcagaggactacttgccctcgccttcagaggactacgcgtcctcgccttcagagggctacacgtcctcaccttcaaaggactacacgccctcgccttcagagggctgcacgccttcgccttcagagggctgcacgccctcgccttcagtggactacccgtcctcgccttcaaagggctgcatgtcctcgccttcagagggctgcacgtcctcgccttcagagggttgcacgtcctttcctttagaggactacacatcctcgcctttagagggttacacatccttgccttcagtgggctacacgtcctcacctttagaggactgaacgtcctcgccttcagagtgctacacgtcctcaccttcaaaggactacacgtcctccccttcagagggctacacatcgtcacctttagagggctgcacaccgtcgccttcataaggctacacatcctcgccttcagaggagtacacgtcctcgcctttagagggctgcacatcctcgcattcaaagggctccacatctgcccctttggagaactcaaggtcctctgcccttaa

SEQ ID NO: 31727 - DNA, 309 bp, Glycine max
  Peptide Sequence Number=SeqID_148505
atgtgggtgcaagccattggtctgtttgctcaagcaacctgtgctcctgagtttggacttccaagaccattcaatcagagattactcgtcttgcacgttggtaggggtgccgctgttgcttctggaggaagcaaccttgctcgcctgggcgagctgggtggcaagctcctcccctatttcgctataaatagggggaggagtgaagggagaaggggttcagccttcttggcacttctcattctctcgaaattgctgaggaaaattatttctgtgaagaaaatccaagccgaggcgcttcctcttcaacgg

SEQ ID NO: 31728 - DNA, 1159 bp, Glycine max
  Peptide Sequence Number=SeqID_148506
aaaaaccacgctggcacagtatcagggcaaggtgctgctggtggttaacgtagcatcaaaatgcggcctgacgccgcagtatgaacagctggagtcgctgcagaaggcctggcaggacaaagatttcagcgtgctgggcttcccctgcaatcagtttctcgagcaggaaccgggcagcaacgaagagatcaaaaccttctgcagcaccacgtacggcgtaaccttcccgctgttcgacaaaacggaggttaacggcgagcagcgtcatccgctgtaccgtcagctggtcgctgcgcagccggaagccgaacgcccggcaggcagcggtttccttgagcgcatggagagcaaaggccgcgcgccgaaagcgccgggcgatatcctgtggaatttcgaaaagttcctcatcaacaaacagggtgagtgccacggcctgcgcgtgcccggacggctgagcgcgggggagctgacgctctgccgcggtgagcgtgtgcacgtggtcggccctaacggcgccggcaagagcacgctgctgaccgcgctcgctggcctgctcgacgctgaagggcagctgacgctggccggccagccgctgcgaagctggtcgggtgccgcactggcgcagcagcgcgcctggctcccgcagcagcagccggcacctgcggcgctgccggtgtggcactatctgcggctgcacagcccgccgggtggcgactacgcgcaggcgacgctcactgacctgctgcagcagcttggcttgcaggataaactgacgcgtccgctggcacagctctccggcggtgagtggcagcgggtgcgcctggcggcggtggtgctgcagatccatccggcaattaattcgcgcggtgcgttactgattctggatgagccgctcaccgcgctcgacatcgcacagcagcgcgcggtggataagctgctgttgcagctcagcgaggccggcatcgccattgtcgccagcggacacgatctcaaccacagcctgcgccatgccgatcgcgtctggctgatgcatcagggccgcgtagtcagtcagggcggggcgcgcgaggtgctgaccgccgagcgactggcgccgctttatcaggccgaattcgtgcagctggagacgccacaggggccgctgctttatcttccctga

SEQ ID NO: 31729 - DNA, 180 bp, Glycine max
  Peptide Sequence Number=SeqID_148507
atgcccgccgcttacaacaacaacgatggggacgaagagaccaccaatgtcccaagcccagtgatacagctttccacaacgggaaagatggcaattattacctaccaccgtggtcgtttaccttaccaggattccctcaaagcacttgaggctgatatacagcacaccaatgctttgtga

SEQ ID NO: 31730 - DNA, 327 bp, Glycine max
  Peptide Sequence Number=SeqID_148508
atggcggtgatggatctcagccttgggtatcccttgtatcgaaagtcttcctggcggggggaggctaccatgtggaagagactcacacttgagggagagatgtgttggagtacaagtgtgaggttttgggttagagtgtggtatcaggtttttttatgtggtggctcgtggtccacaggaatctccctgatatcggagcatcttgaagccgaggcgagtcaagagaaaggtctcagaggcaacctcacggccgagggaagacctagtggtggtggcggtggcggtggtggtggtggaggcagtgtcaacagagacggagggcaatga

SEQ ID NO: 31731 - DNA, 310 bp, Glycine max
  Peptide Sequence Number=SeqID_148509
atggctgaccttgtcaaagataagatctttcacgagctcaatgtcattgacggtgtcatcgagcttcttcacgatcttgacatcgcagagattgaccatgtcaggcttggcgacatccatgatgaagagaacatcgttggcataaaggggagcgatgggcgtggagtattggctgacgaccttgctattgagggaagtgttggcggacttcacgagggagtcgcagtcgaagagctcgatggggacgaccatggcggtgagaacatcgaaggccttgacggcaaccttgtggagggcattggagacaacg

SEQ ID NO: 31732 - DNA, 300 bp, Glycine max
  Peptide Sequence Number=SeqID_148510
ttcttccggaagtgcgcgtcttccggaattcttccggatgaaccacttcttccggaaagttcccggaagaggttttccggaagtcttccggaagaagtgttcttccggaagacgtttggttacttccggaagaacacttctttcggaaactttccggaaaaggttcttccggaacttccggaagaacccctaacgggtcttccggaagacgccgtcgtcagccttttgtgccattttttccggcgtcctctcgtcttctcccctctcgtcttctaccctaggtttcgtcttctaccctaa

SEQ ID NO: 31733 - DNA, 138 bp, Glycine max
  Peptide Sequence Number=SeqID_148511
atggctagttctttgaaccaagaaccaagaaggggaatggttctaccatttcaacctctttcatttgcattcaatcatattagctactatgtagatatgcctgcagaaatgaggagtcgaggaatcaataaaaattga

SEQ ID NO: 31734 - DNA, 601 bp, Glycine max
  Peptide Sequence Number=SeqID_148512
atgaatgcaaagagaagagaagatatggttggtgtgcttccaaagagaagaatattgatgcagcatgggaagtcgcaggggaactgggacacaacgacatacaccaacgtacccgaccacaacattcagtcaacggcgcaaggcatgacccagatcctccgcgccggcgagcacctccgttgcgtgatggatagtgacagctgctcccctgactggcaagcgcaattctacatgtccccctacgcctacactcgctcgatgctccacgagctcagacgatgtttcttgaggaagatgatcatcgtggatttcaggttctaccctgcatgggcatttggtttgcctatatggcttctcaggatccctctgtacattatggaattagggatatggattgcccatacatattacaccatagggtttgctccttctgctagcagatttatccggcaattcttggcattatttggcattcatcagatggctctctctttatttcggttccttgctgcagctggtagaacactagttgttgctaatacactgggtaccttgttcctgcaattggtatttgtgctaggaggttttgttattgctaaag

SEQ ID NO: 31735 - DNA, 1784 bp, Glycine max
  Peptide Sequence Number=SeqID_148513
atggaaagaaaagttgcttcgaaggttagaaaccctcaagcggggaaaaataaacaagttgtggggaagggcaaaactaaacatttaagtgccaagaatagcctcttgactaagaatcaaaataaaactcttactagacgcgcgcctcaagtaggggagtcaagtaagcaaaacctaagggaagaggtagttcaagagaatggaattgctaaagaaagtttggttgcggacaatattatgaagtctcttgagaagaaatttttgcacgatgttactttggataagggagggactatgcaattaggggttgatatgaatagtcccctcggggtggatggtcatgtggttacacacaatgaagaggttcaaaggatccatgataatatggatgttagcacttcaacaagtgggaaaacagtttcacggttgataaaggatttggtgcagaaataccatatgggcttgttggctctatttaaggctcagattagtggtcagaaagcagatagtgtgctttgtaaactagggatggattataggtttaaagtgggtgcatgtggacgtgctgggatcccctatgctcagtgtgttcatatttgttgtattcctaaggatgacaatcctgagttcttggctactttggtatatggcaatcccacacctgctatccatcatgaactttgggaggaaatgaaaatttttgcagaaactgttagacatcaatgggtggtggtggtttacatgttctcggctttaaggggcctccgttcacttaggaaggaagggtctaaccacaaagctatttcgtttacatttgatggcaaaacttatgctgcgagtatgaaacctttcagatttatggcaagttggttggttgaccgatcattccaagatgtagtgaaagaagaggactttgatagttggcatgatgctgaggaagaaggcgatacttggaacttgtgcaataactttccaagaattgatgatgatcttttgatgaatgttcagaaggcctttgaggataaggagattaaggaagtgatgttcagcatggggcaacttaaagccctagggccagatggtttgcatcttatcttatttcatgccaattggagcacagtgggtgaatcagttgtggctattgttcttaagtgctatgatgatccctcagctattgaagatattaatagtatgtcgttgggaaggcatgggacagataatgttgtgattgccggagaaattttccatactatgagcaagaagaaagggaagggagggcttatggccgttaaagttgatttggaaaaggcctacgataaagtttgttgggattttatcattgatactttgaaggaggtgggttttcaagaacatttctgtcagttaatcctagcttgcattcctctccttccatgtaggtgggctcatttgattgatagagaagtgagttgccatcgttggaagccaactaaaatgagtaagtttggactatctatatcgcatttgttttttgcagatgatttactcttgtttggggaagctagtaaggttcagatggaaaccattattagtgtcatgtccaaaatgcgcatgctagtgtctaataatgtcaaccatagtgtggctaggaagttaagtgagatgtcggggtttgctctaacgaggggtcttggaaaacaccttaggattcctttaattcgaggccgtaaaaagaaagagatggagattgacattgcccaaggcggttattgtgaccatgcctacctacatgatgcaaactatgg

SEQ ID NO: 31736 - DNA, 267 bp, Glycine max
  Peptide Sequence Number=SeqID_148514
atgtttatgtctttcagaggtccttggggtgcactttcacctatccctgagaataatgttattgctgtcaatactcagggggatctgtttttgccgcatctggtgattcttgtgcatattgttgggatgtggtatgtaattatgtattcatggaaggaaactggtaaagtgaaaatggtattcaaggggcacatggactatttgtattgtatagttgctcgcaactcatcaaatcaggtcttgattgttgaccttattgtcatttaa

SEQ ID NO: 31737 - DNA, 447 bp, Glycine max
  Peptide Sequence Number=SeqID_148515
atgttgaagttcctcagagccactggcattgaaggatgtatgtcattagatggagttgtgctttcaatcacaggagtggaggcaatgtatgttgccttgggtcatttttctgcactctcaataaaggcgagaccacatttctctctaagcaccatcatgacattcaagaaagtttctacaaagccataccaggcaagaaattatttcaagaaaccacaagctgctaaggttatttatggcctctctagtgtaattttcatagtggccactcttgctgccattgttggaagtcaagcagtgattttcgacaaccttttccattcacaagcttgcacaaagatcagagagagtgaaatgtatggatctacatcgaacaatggtaatgcctcttctgctgctgttgttttctttctgaattcaattcctgatgtgaagctaacatcataa

SEQ ID NO: 31738 - DNA, 3486 bp, Glycine max
  Peptide Sequence Number=SeqID_148516
atgagtggtggaaggaggaggaagctgcttttaagcaagatctactcatttgcatgctgtaaggcatcttttgagggagatcatcattattcacagattggaggaaaaggttattccagagtggtgttctgcaatgagccatatacttttgttgaggatggtgttaagaattttgcagacaattctgtgagatctacaaaatacactcttgccactttctttcccaaatcattgtttgaacagtttaggagagtggcaaacttctattttttggtcactggcatcttggccttcacaaaacttgctccatacactgctgtcactgctatccttccactgattattgttattggggccaccatggtgaaagaaggtattgaagactggcaccggaaaaaacaggatattgaggtgaacaatagaagagttaaagtgcataaagctgatgatacttttgaatatactgcatggaagaatctgagggtggggaatatagtgaaagttgagaaggatgagttcttcccagctgacctcctgttactttcatccagttatgaggatggagtttgctatgttgagaccatgaacttggatggtgagacaaatttaaagttaaaacaagggttagaggtaacttcttccttacaggaggatctcaacttcctaaagtttaaagctacagtcaaatgtgaagatccaaatgcaaatttgtactcatttgttgggagcatggagtttgaagagaaaaattatgccctttctcatcagcaacttcttctccgagactctaaacttcgtaatacagactacatttttggagcagtcattttcactggtcatgacactaaggttattcaaaattctactgacccaccttcaaaaagaagcagaattgagaaaaagatggacagagtcatctatttcttgttttgtattttattcctaatggcatttgttggatctattttctttggcattataactaaagatgactttcaaaatgggttgatgaaaagatggtatttaagaccagatggttctactattttctttgatccgaatagaccagctgctgctgctttatttcattgtttgacagccttaatgttatatgggttctttattcccatctctttgtatgtgtcaatagaaattgttaaagtccttcagagcattttcatcaatcaagatatccatatgtactacaaggaagcagacaaaccagctcgagctcgtacttcaaacttgaatgaggagcttggccaagttgatacattactttctgataagactggaactttgacctgcaactcaatggagttcattaaatgttctattgctgggttagcttatggccatggtgctacagaggttgagaaggccatggatagaagaaaagcttcaccatcaatttatgagcatgatattgaatcagaagcagataacattaggggtttgctcgataaaagggtactcattaaaggttttaactttgctgacgaaagaataacaaatggaaattgggttaatgagcctcatgcagatgttatccagaagttttttcgcctattggcagtctgtcatacagccatacccgaagtggatgaaggcacaggaaatgtctcatatgaggctgaatccccagatgaagcagcatttgtgattgcagcaagagaacttggttttgaattctacaaaaggggtcagactagtttatcgacatatgagctggatccagtttctcacaagaaagttgaaaggaaatacaagcttctcaatgttttagaattcaatagctcaaggaagcgaatgtcagtgatagtggaagatgaagaagggaaaattttgcttttctgcaaaggtgcagacagcaccatgtttgaaaggcttgccaagaataggagggagtttgaagagaaaaccatggagcatgtgcatgagtatgctgatgcgggtctgagaacccttatactggcctatcgtgaacttgatgcagaagaatacaaggagtttgatagtaaattctctagggccaagaatgtagtcagtgctgatcaggatataatgattgaggaagtatcagataagattgagaagaacctaattcttcttggtgccactgctgtagaggacaagctccaagatggggttcctgaatgcattgacaagcttgcccaagcaggaattaaaatttgggttttgactggggataaaatggagactgcaatcaatattggtttgcttagacaaggaatgaagcagattgtaattcatttggatagtccagaaattcaagcactagagaaggatggagacaagatggctattgccaaggcatcaatgcaaagtgtccaccttcagatatctgaaggtgctgcacaactcactgcgtatagagggagctctcatcaggcatttgctctgattattgatggaaaatcacttgtttatgcattagaagataatatgaagaacttgtttctggagcttgcgattcgttgtgcatctgttatttgctgtcgctcatcaccaaagcagaaggcactggtcgctagattggtcaaatctggagctgggaaaacaacattagctattggtgatggagccaacgatgtgggaatgcttcaagaagcggatataggggttggtataagtggtgttgaaggaatgcagatatgctattttttctacaagaatatcacatttggttttactctattcttatatgaggtgtatgcatcgttctctggacaacctgcatacaatgactggtttttgtctctctataatgtctttttttcatcacttcctgtgattgcacttggagtatttgatcaggatgtatccgctcggtactgcctgaagtttcctttgttacatcaagaaggagtacagaatgttcttttcagctggcatcgaatactcagttggatgcttaatggatttatcagtgccataataattttcttcttctgcacaaaagcgatggagctccaggccttcgatgtggaggggagaactgctggaaaggatatactgggagcaacaatgtatacttgtgtagtttgggttgtaaacttgcaagtggcactagctataagttacttcaccatgatccaacattttttcatctggggttccattcttttctggtatctttttctcctggtatatggagcaatgcctccacacttttctacaaatgcttacaaagtcttcgttgaagctcttgctccttcccctacctattggattgttacattctttgtggtgatctcaacccttataccatacttctcatacgcagcaattcagatgcggttctttcccatgtatcatgaaatagtgcaatggataaggtatgaagggaagattaaggatcctgagttttgtgctatggtgcggctgaaatcattgcagccaacaactgttggttcaacagcacgcttagctgctaagtctcaccacgctagagacaaatgttaa

SEQ ID NO: 31739 - DNA, 351 bp, Glycine max
  Peptide Sequence Number=SeqID_148517
atgacacatagggcttgttttagaaacattttaccaaagagggtttcttttcaaacttattacagacggggtttgttatggacgtggatgccgccattgttgccggcgggaaagcttgtaccgccattgacaactgcgggaacaaggatcccgccattggcaactgcgggactcagcctaaaccgccagtacgaacggcgggacaggctgagtaggagagagagaggttgtaccgctgatagggctggcgggacgaggagagatggagccatgccgccattcctcctgacgggacatgccaacgtggcagtcccgccactgcctcctgcggaacaccttgacgggacgtga

SEQ ID NO: 31740 - DNA, 711 bp, Glycine max
  Peptide Sequence Number=SeqID_148518
atgggcttagaaatctaccctgaggttcatgagaaccctaaggtcttcttcaacaactttagcccaatcctcttggagtctcttgctcatggatctagtgactggtcccttcctagggaggattgcatcagttataagatgccagaatttttgaaatttgtaggagaattagaaaaatctactatagaacatgaagcctattttcaaacagaatatggtgatttagccatcgatgaatttcttaaaataaaatattctcctagttctttgacaacaaatgtttttacttggttcaccacattaccaccaaattcaatatatactagggcacaactcgaaagagtgttccatgaacattcctttagaggagagactaagaggaataaaggatctagttcccatttcaaagcattcgaagttaatgatttggcatttctaagaggaggaactactgaaggttccaagaaagggcatgtcttgagagattatgttagggaagattactttgatggcctttttctaagcccaaaagccatttgtgtcactcaagtttctcgttctactcctcatcgaaatgctacagtctttgatcctcctactgatgccatgaggtgtcacatgaagccactctatttaccaacaatggaggaagaacaaatcattaataagatattggtagatggaggagttgcaatcaacatcttaccatga

SEQ ID NO: 31741 - DNA, 897 bp, Glycine max
  Peptide Sequence Number=SeqID_148519
atggcagaaccatccaagaagagaaagggttcttcctccaccaccgttgttgctagccatcgccaccaaggaaccgtcgaagatccaacagcaccaattcctccctccctttcatctcctcgaccatatatattgttttcttcagatgatcaacgccaaaggtacaattctcaattttgcaatagagtcattctagaccctaagtaccttgatcttgatttttttgatggtgaaacatttgattgttaccaagtgtttcaaaattctgctttgactgagtttatgtctttgaaactgccttactttcctgaattagttagagtcttctataataacttgaaaattcatgatggtattatttattctgaggcattacgggccaatgcacctctcccttatcctcaccttgtcactctttttcttcatcatttcaatattcctttggatgacgaaccatttgtcatggtcatgcaatctttctctattggtactggtgcggttacctcctttggttaccgaaaagatgtcgatggtcagtgggttcgtaaacaagacttgcctttgcctattcctgacgaacgtaccccatctcctccaccacaaagggctgattccttttctcttctgaccgatgtcctcacagaactctgttgtcttcgagcgtttgtaggtgaacaatttgatgcaatggatgcacactttgatgggatggatacgaggatcactcatctcgaagatgatatgaacttcattaggcgttgcttcgatccccgaccgactcttagtttctattttcctagtttctataatttccttagccttgttgccaaagggggagagaacaagggtagaaatcataaacctttaggcataaattccaaacttaagggggagtaa

SEQ ID NO: 31742 - DNA, 567 bp, Glycine max
  Peptide Sequence Number=SeqID_148520
atggagaaaaacaaagccaatggcagagtcattaacccaaaaggaaacaccaaattttctcaatattgtccaaaaaatattctactctttccaaaagcttgttttggtctaatttcagttatccctatccaaatcccccaccaaggtgataatgaagattgggaggataatgatcaagggagtttgcaaaaatcttctcaaaagagaaaaactccttcctctagcaacacaggaaataaagtatcaaagaaaaccaccagtaccaagaatgatgatcaagtgaaacttccaccaaaaccacccaagttccaaaaaccatccaaggaagaagaggatgctcaaagtcatagtgaatcatctccatcaaaacaactagcacctccagaaccaatggttcaggaaaatactatcaaggttgactcgaaccctaatattcctttccatcatgaggcttctcaacacactccaattaaacaagaaaagcctttattcataaaaccttttgctgttattgttactattccgattgtcgagacaaatgaaccacttattgatcaaggtacataa

SEQ ID NO: 31743 - DNA, 567 bp, Glycine max
  Peptide Sequence Number=SeqID_148521
atgaagcggaagagtggaatgactgacagtgaaggggagtcacaagcacaaaagtggagtaacagcccaggatacactaatgttagtaatgtaacgaataatagtcccttcaaaactcctgtgtctgcaaaagggggaagggcacagaaggcaaaggcttccaaagaaggcagatcatgtcctccgacacccatgtcaaatgctggttccccttctcctcttactcctgctagcagctgtcgctatgacagttccttagtactagagcaaaattcttacatcaaaccttataggggaattgaatcttctacgtctggtgaggtggatggtgatatctctgtgcttaaggcagaagttgagaaactttctttggaggagcagggattagatgatcaaataagggaaatgcaagaaaggctgaggaatttgagtgaaaatgaaaacaaccagaagtgccttttcgtgactgaagaagatattaagggcctgccttgcttccagaatgaaactttaatagcaattaaagctccgcatggaaccaccctggaagtccctgatcctgaggaa

SEQ ID NO: 31744 - DNA, 351 bp, Glycine max
  Peptide Sequence Number=SeqID_148522
atgagggaaggggtgccattgaaggaacatcttgatgagctaaactttattctaatagagctacgtgacattgatgtaaaaatggaagacaaagatctaacaatgattttgttagcctttcttcctccttcctataagaattttgtgagtcctcttagtgtagacaagaactcctttacacttagtctctattctagagagcttcaactaaaggcgtatgggaatggtgatgaagcctctacgtctagattattagtgaatgattttgctaaaaggcggaagaagaacaaaggcaaaggtggcaagaaaagcaaagttgatcctaaggacatttgcaattactgcaaataa

SEQ ID NO: 31745 - DNA, 744 bp, Glycine max
  Peptide Sequence Number=SeqID_148523
atgacaacaaaagatgatgacaaaggtgatgaacaaaaagctcaaagatcaaagaacaactcaagtgaatcaagaacaagtcaagagttcaagattcaagattcaagatctcaagaatcaagatcaagattcaagactcaagattcaagaatgaagaaaagactcaatcaagataagtttaacaacctgagatctttgtctcaacacattggagggtacatcctttgtggtacaagtagagggtacatctacttgggtttgactgagaacaagagagggtgcatctcttgtggatcagttctagtggagggtacatccactaggttcaaagagaacaagggagggtacatcccttgtggatctttgcttgtaaaaggatttttacaaggttctatacaaatcaaaatacatgatggtgttgttagaaccttaattgaagtctgtcacattctagagcttatgaaaaatcttgtatctataggtgccatggattcaaaaggtttttcttgttgggttgaagatagagttatgaaagtcatagggaaagggaagtttgtggtggaatctcttcaactttgtaaggattgcatctatgagaaacaacaatggatgaagttctcaaaggttgtgcacataacaaaggccattttggactacgtccattctaactattgggggcctttgagagttccatcactgggagggcaaggtatttcctctccatcatcgatggttactccataa

SEQ ID NO: 31746 - DNA, 1362 bp, Glycine max
  Peptide Sequence Number=SeqID_148524
atgagtgttcatgctcctgttccaaggctgacgtggagggttgacatgtgtctcagagtaccattaaagggtgatgactttgtcgaacccccaggtatggacgagtgtttgttcgatgtcgggtgtggtaacctcgacagttgttcgggatggacatgtatttggcatgccagtactcttgcatacgtgtcactcagagagtgggcacgtactggagtcgtggtgcatggtagatgtttgatttcgggtcatcgttactttgatctcttgcttcgttgccttctacttgcaatccttttccttcgttcactttcttcgattcttaaaggtattttgtttttcacaatgccttcattcttgtctgattctgccatcggcatgggtgacaatgattctgggggctcgattgaacaacccatgatggactgggaggtcatttctattggcagttccttgtcagaggatgctcgttgttgtgcctctgacaaagagtcatcctcttcggagaggcctgtcctgactattgtgatcctcccccattctacttctgggggtgtgaggagaggtagtggtggtggagatgtgagggacgacgtcttgaaatataagtcctctcttacctttgcggcgagtgtcgttgctcttcaatgccaggtgaagctggcgagccttgggaattcctgcaagatagtcgttcaggcttgcgggagtgatgacttccctttcttgagggcagcgtcagctgcgggtgggattgtgccactaaatgttgttgctcctgtttttggagaagagggtcaacctgctagtgaggttggctctattgctgttgttgttgagatcacctctggtgccccttcctctgttttggcaatgaggaaacaagaagatggtgttgggccatctggttgtaaaaaatggaacgcccctatgagcctgtgtgccctgaggcagactacagggttgatgctggacctgggtcacctttcaagtgagcaagttgtgcctccagctcaatcggtcgtcgaggctcctgcttctattgttgctactcctactccttcacctcctcctactgtacctgttcaagaggccactcctactactgttgttaatatgccaaccactttggctggtcttgtcatggttccgtcgtccatcgttgctgcacccttgttgagtgctggagtggcgaatgttagtgcttctgtagtgctgcctcctccttcttcggctccaccggttccaccctctgttgtattggtgatggcatcaccttcctcatcttctcgtcctcatgtctcgttagatcacctatacaccttcagcggtgctgattcatcgtggggctgcaaattatag

SEQ ID NO: 31747 - DNA, 470 bp, Glycine max
  Peptide Sequence Number=SeqID_148525
atattctttcaagcatatttgttagactaaccctcatgctggggatggtggttagtcaatttgaagagaaatttgaagaggttaatggtgctgagctccccatgatcccacttgcttccagttctggttccaatgagcaactaatgacggaaatggttcctgctgaatgcagcggaaaagaacttgaacctcaaactcagctctcttctcatgcattctctgatctaaatgcttcacaggagtttgctggtggcatgatgaagattgtcccttcagatgttgatattattggcttctatcagatgctgactaccatactttattccttaactcccaacaaaacagctactgttgattggaatggtatagacatgcttcatcctgattttggaatcatttcgaggcctcaaagtccatcatctgggcttgctgaagtgccatcaacaggagcaaactctattcagaagtga

SEQ ID NO: 31748 - DNA, 735 bp, Glycine max
  Peptide Sequence Number=SeqID_148526
atggagtcagagatcgccaaatggagggctactgctcacactgtttggagagtggagtgtcctaaggtggctaacaccaccatcgcctttgttgaggtcgtaaggttgaactgtcaactgtcttccaaagttggtggtgtgttggccaagttgttgtgcaccaggttggattgtgatgaattgttcagatgctacaaggatttacaggtagagaaaaaggaattggttggcaaggtggagggcattgcagaggagaaggacaagcttgcgaaggtggttgttgatttaaaggcccaacttaaggagtcgaagtccaggctggaggagtccgagctacgggttgttagggaaaggaaatctagcaaggagcttaaggaggaactgctcgtttacaagaaggaggctatggagcaatatgaaaaaaggtttcataaggccgtcaggaaggtcgggttcttcgtcaaggaccttgacttgggtttctttgaccctttcaaggatgtgaaggacggtgttctacttgacgaggaggaaattgctggggagaaggggattgttaatgaggagcaaggtcttttcaacaagtctgggggtaggtcgcttgacctattgagtttcttctctgatggttatgaggatcatgtggtagttcgtgttgttgaacttggatctttgatggtggtcgccgtagtttctgcgagtgagcggaccaatgggatgccatgggttttgtag

SEQ ID NO: 31749 - DNA, 999 bp, Glycine max
  Peptide Sequence Number=SeqID_148527
atgacctcccagtccatcatgggttgttcaatcgagcccccagaatcattgtcacccatgccgatggcagaatcagacaagaatgaaggcattgtgaaaaacaaaatacctttaagaatcgaagaaagtgaacgaaggaaaaggattgcaagtagaaggcaacgaagcaagagatcaaaggaaacaaccgtttcaataactggcgggagcggaagtggtgccctgaattttcacaccacgacgcaccccactcacccatgcaccacgactccagtacgtgcccactctctgagtgacactagcagacaaaacgtaatgtttgtcttcaatgcaccttccaacagtcagaaaagggcaaaattgtcaaatctggaggcttccctcacctggcatgccaaatacatgtccatcccgaacaacttgacagaagcagcgggacaacacttgtccaagctcgggggcttggtaggccacatcaacctacaattctctcacctgtcgaggttaccacacccgacatcgaacaaacactcgtccatacctgggggttcgacaaagtcatcaccctttacttgtcaagactacaaccccaaacatcatatacttacctttgatactagacaatctctttcacccgcaagccggctcagagcttggggggcttatgtactatccagggtccacaaaatacatgtggcaccctacatgagtcctttgttttgcaagtcccccccctcctgtcctcctaacaaaggtatctctcaaagccgatgtgtgaagttcgggagcctactttggccacgtccaccttggcgtgtcctagctccgtattttggatctggtccttatggcttcataggaatgatatcatctttaaccaagctcaaccatgtgcccaggaggtttttgatggtgcagtttgtcagtcatggttatggattactgctaaagtggacaaagctaccttctccttctatgagtggtccaggaaacctataa

SEQ ID NO: 31750 - DNA, 1758 bp, Glycine max
  Peptide Sequence Number=SeqID_148528
atgatgaagttgactaccttctacttttcccatttttctgtcgagttacatggtggaaagttcgtggcaagtgttttgccgataaaggggggtcaaggacgtcttcatagcaaagaaaaggaactaataggcaatgtcaaacttcatgtgaatctaccgaggttcaggcgaagagagggaatgcaactaagccaagagcaaccagaggggggagacaaaggtagagggtcgaagggtctttgtagaacactagtcaatataaaggggacaggaagtcctttgatgggaaccaaagtaggaagcgttcgggggaaggaggacttccacacaactgatgggctagagttgtgggaagggtcagatatgttggtggagacaacaaatgaggcatggctaagcaagagtcttgtaaggaggctccatgaaccagagaaaatctttgacttacaagatatgtttattctagatgctttaagctcgatcaaggcccaatatattggtgataaccgtgttctacttattggccacgatagtgatatcttactactcgatatgtcggataataggatagtggaggagcttggtgacaaaagggacaagtgttgttgtttccatgagaaggagaatgagggggacgaggaggagtttatcgtagccgcattaggcagagttgttagcaaaaggatgagaagcatgagtagttggggagtccacagggatatttggggtgtcaaaaggatatttcttttaaggatgttcagaaaccgtaagtctgctaacaggtgtaggcctgatggaggagctttattggctaagaaagctttatctctgggaagggtgggggctttaattgagtcttctatgggtaaggcaaatacaggccttagtaacttaagcccaattcttccaacccaaagaaagggatttgtggatgtatctgagacccaatatatgaaccctctattggatgaccctactaacatcactgggcctatggctgatgatggggaccatgtcctaaaggtgattgatgtagccattcggccacctattgcgccacctaagtgcaaggaaaacgaaggtgggacaacagaaggattatgggaggtggaggggtgttcaaaggagcctatgagggaactaccagagccttacaagatcatatggacacactctaaatttgactcaggacctcgttcaagtagtgagtgtcaaggatctcaatggataaaagacgatcaacaagaggctaaggggatggcgagggttgcttatgaagattctttcacacaagatgcaagggttgggaggaaaggcaagaggcaggggattaaaaggctaagcatcactgtcgataaacatagtaggcgaattgttgtgcatttggggcaaaaaggatttgtgggaagcattagaaagagagaaccagaaggtggtgttgcatgggagattcaatgcaattcggcacaagaagaaataaatgggagaagatggcaagatgtctatgagtggcatggagtagcagcttgcagtaggttagataggttcttattatcaattggatggcttgattttgatcctagttgtgcccaatttgtcatgaatagaaagttatcaggccattgtcccattatgttgacgtttacaaggcttgactggggctcgaaaccattctggtttattaatggttggctaacaatgtgcacttttgatgagtttgttaaggagaagtacaccaatcttcatatgcaaggatag

SEQ ID NO: 31751 - DNA, 492 bp, Glycine max
  Peptide Sequence Number=SeqID_148529
gtcatcctgagtagagatgtcatctatgacaaactcactatactggattctaaatttggtgaagatttaggcaaagctaaggatttcactaagaaggtagtagatgacattgatgtgttcagaccatctacttatcaggaagcaatttcttgttctgaagccagggagtggacaaggaaatctggatcacctactgaagaagttgtccattataaagcatgtttgattgctaaaggctacatggcaactctggacatggagttagagcaactcgatattgaagaggtctctttatgggctgaagcaatcaccaaggtggaggatggttcccacatttgtctagtgctctatgtggacgacaagcttatagcatctcaaaatttgttggcaattcagaagttgaagtcactactcgatagtgaatttgagataaaggacatgggagttgttgaaaatattctaggcatggagatcaagagggatcaagtatag

SEQ ID NO: 31752 - DNA, 1086 bp, Glycine max
  Peptide Sequence Number=SeqID_148530
atgccacattttaagaaaggatatgggtgggcaagcggagctggaagaacagtggggaatggtgtaggaggttctcatcttaagcaagttcctagtgttctatgttttaaatatgcagaggcgagaaggaacaagaacaacttgcatgagaaagcaagagatattgtggaagaagggatggagtggctataccaaagcttagtcagaagtttgaaggatgttgtaatatttgataagcttcaagatgttttctttatggagaaaaatagagagttgaaacttaggtatttgggtgacaaattagtgttaatctttgggatgggtgaaaaaacttcacaagaaaggatagaaaagggagatgaaggattctttgaggagttgggggagcttggcatggtggtgaaaatggataaggatactgagaagtatggtaagttggagtatgtgcgtgttctagtgaaaagtagtgctcataagatcctggatgtgtacaagagagtccaaattagtgcgttggttcaccaagagagagttatggaggaaacatcttcaatggtgttgcaatgtaagtgttggttatggaacaagggagcttcctcgaatggtgattccatgagtaaaagtaatattagagtggaggttatgtcatcaaatttggagtgctctgtcattgacgagggggatggtttcatcattaacccaatgtggcaacctcataaaggcagccaccagcgaggagaaccaaatgtggacatggtcgaagggccattacaagcaatggtgatggagaggccattagaaatgatggtggagaaccagatgtggtcatggtctacgaagtcaacaaaaaagtgcacaaaaggaactaatgaggttgcatccttggacgagacccacgacaacaacatgtcaagaggccttgttgatgttagtcaagcttcttctagtgttcttgaaaccccaagagcgagacaaaattatttatccaatgaaatcacaagggttgtaaaagataggagggcacttcaggagggtggggatttcaaatggattgagaatccttcagtgaattcagttggaggactt

SEQ ID NO: 31753 - DNA, 600 bp, Glycine max
  Peptide Sequence Number=SeqID_148531
atggctaacaaacacaactcagtttctgagatcaatgccgagaaagagagttggagaattatggttagggttgtttgtttgtggatggtatctaatgtttcaactcacaaacaaacatatgcaagcaaaataccattatccatggagatggtgcgggtggactcaaagggagatagaatccatggttttgtaaagaggactctcatttataagtttgaaaaaagcttacaagaagggaaagtgtattctgttcaattttttggtgttactgacattggaggtgttgggactgaaagagaaaatgaaaaaaatggaaggagaacaagaatgaatgtcatccaaatagaggatgatgagtttagcatagagtgtactttgtgtggtccatttgtggatgaacttaatgcatttcttgcatctggagaagttaaagatgttgtgacaaaatacatcttccccagtacaagagttgtgttcaatgctgaatgtgaagaggtaaaggagttggcgacaagaaaaatcggcatcccggatttgctaaccgttggatcaaattcaaattttgttaggaggttactaaaacaattatccgcattctga

SEQ ID NO: 31754 - DNA, 891 bp, Glycine max
  Peptide Sequence Number=SeqID_148532
atgtccggctggatcatgtgggtggtgaacggcatcttcgaaaacatcggcatggtgcaggatggcctgaataccattgcgcaaccgctcagcgtgcaggatgcgccgcaggcgaaaaagctgcaggtgacgcgcggccagatccgctttgaggatgtgcgttttgactatggcggcggccgccaggtgattaaccgcctgaatctcaatatcaagcctggcgagaaaatcggtctgattggcccgtccggcgccggtaaatcgaccctcgtgaacctgctgctgcggctgtatgacatcaacggcgggcgcatcctgattgacgatcaggacatcgcgcaggtcacacaggcgagcctgcgcagtcagattggcatgatcacccaggatacgtcgctgctgcaccgctcgattcgcgaaaacctgctgtacggtcgcccggatgccagcgaagccgagctgcaggcggcgattgtacgcgcccgcgccgacgagtttatcccgctgctctccgatccgcagggccgtaccgggctggatgcgcacgtcggcgagcgcggcgtcaaactctctggcggccagcgccagcgtattgccatcgcccgcgtgctgctgaaagatgcgccggttctgatcatggatgaagccacatcggcactggactcggaagtggaagcggcgattcaggagagcctggagacgctgatgcagggcaaaacggtgatcgccatcgcccatcgcctgtcgaccatcgcgaaaatggaccggctggtggtgctggaaaatggcggcattgttgagatgggtaaccatcgcgaactgctggcgcacggcgggctgtacgcgcgcctgtggcagcatcagaccggcggatttgtcggcgtcgattaa

SEQ ID NO: 31755 - DNA, 291 bp, Glycine max
  Peptide Sequence Number=SeqID_148533
atggcatggagaggaaatcttttgaaaaacataaaagaacttcggtttttgatgtgccagtcatcacctgcaagctcacccataagttatacttacatgccatatgcttttgtggaaaggaattataaggaactaaagacattgaacccaaaattgcccattttaatccgtgagtgtagtggagttgaaccccaattatgggcaagatatgatttgggtgttgagaaaggcatcaaattggaaggcttgtcagaggcacagatctttaaggcacttgaagatttgaggtaa

SEQ ID NO: 31756 - DNA, 904 bp, Glycine max
  Peptide Sequence Number=SeqID_148534
tcacctgtcatcgctggcggagatcaccgctgccgaatgggatgcgctgttacctgacaatcaaccttttttgcgtcacgcgttcctgctcacgctggaagagagtggcagcgtgcgcgcggaaaacggctggcagccggatcatctgttgtggcgcgaagacggcaggctgcgggcagcgctgccgggctaccgtaaacgcaattcgtggggcgaatatgtgttcgatcacgcgtgggccgatgcctgccagcgtgccggtattccttattaccccaaatggctcggcgccattccgttcagcccggtgaccggtgcgcggctgctgggtgacgagacggccattattccgatgctggaagcgctgcccgatgtgttgcagcggcacggcttaagcggggcgcatatcaacttcaccacgccgcacgccaacgcgctgctggcaacccagccggactggctggcgcgcctcggcgtgcagtatcactggcacaatcgcggttaccgcgattttcacgactttctcgacacgctgatgtcgcgcaaacgcaagcagctacgcaaagagcgcgaacaggtggccagcagcggctttgcgtttaactggtatcgcggcgatgagctgcgtgaagatcagtgggattttgtgtatacctgctacgccaacacctacgcggtgcgcggccagagtccctatctgacgcgctccttcttcagcctgctggcggagcggatgccgcaggcgattcgcgtggtgatcgccacgctacagcagcagcccgccgccatggccttctgtctggtggatgacgacacgctgtatggccgctactggggctgtctggcggagtttgaccggctgcacttcgagacctggcgagcacaagctggtgcgcggctttga

SEQ ID NO: 31757 - DNA, 438 bp, Glycine max
  Peptide Sequence Number=SeqID_148535
atgtatcctttgaaccacattgatgacttactcaaacggccaccgaaagaaacattttcaaccattgatttcgcatatgaggaagaactttcagatgtctggaagttaattgataattataagaatgtagaagaggtaaatgttgtaaagactaagagagagaccctgatcctcgaaaatggatggcgtcaggttaaagtcaacaatgaagtgatggaggataaagaggtgtattttagatatctaggtgactcatattttcacattagtttcaacaaaatagatgaagaagaggctgcaaagaaagtagaattggaacccaaaaaacctaaaaacttgggaaatagttctaatgttcccaaaactgggcatcattctaagggaaaaactcctgctttgtttgttccacctaaaagaagaagtgcaaagtccttatag

SEQ ID NO: 31758 - DNA, 416 bp, Glycine max
  Peptide Sequence Number=SeqID_148536
tccgagctctaaaatccgaattaggaaaagcgagacttgccaaagaaaaattcaagttggtcgctacagacgtccggaaagagtgtgccggcaacaatgagctcaagcttctaagggaagagagagaccaatcacgagcacatagcatggtcttgaaagaggagttaaccgcttgctcaaggtccaaaagaaatttgtctcagcgtttatgcgagacagagaccaacatgttagccattgtcagcaagtaccaagaagaactaaatctagccacgacccacgagcataaagtggcggacgagtatgcccaagtgtactcggaaaaggaggttataggaagggtaatcgattcgttacctcaagaggcaacaatgtggatggaccgatttgctcttaccttgaacgggagtcaataa

SEQ ID NO: 31759 - DNA, 223 bp, Glycine max
  Peptide Sequence Number=SeqID_148537
cccaccaaaccagtctcagaaaaatgacgatctcgaacccgttcaccgttggatcgtcgtgaaatttgagtatcatgttcgcaacacaattccgagaattctcaccgttgggaatttcgatatcatggagaaaaaggaatcgtatgaagacagtacaagtggaggtttcaatctcttctccgtctctctggcgtttgggaattctatcggagcagtcggatga

SEQ ID NO: 31760 - DNA, 447 bp, Glycine max
  Peptide Sequence Number=SeqID_148538
atgggtgaagtagaggaggtgcaagaacagatgaaggccgacatggaggccatgaatgtgcgaatggccacaatgatggaggccatgatgagcatgaagaagataatggaagccaatacggttgtagttgtcgctaccagcactgttgctaaggtaaacccgatgcccccatctgatctcaaccaaatgactcatccaacctcaggtatggtgggcaaagatttgggaagtacagacggccccatgatgtgcaaattcaaaacaagcacgccttctcgccgtatggcttgcctcccaactatacaccacccaatgtggcgtacactcccaatgagaatgtcaataactccactcccatactcattgagagccgacaaacccaaactaatcatgcacatgtctctcaacccatgggggagacacatggattgccccaccacaatctag

SEQ ID NO: 31761 - DNA, 390 bp, Glycine max
  Peptide Sequence Number=SeqID_148539
atggcaacgatgcttgctttccccttccagaatgttgcgaaactttacggattacacaacaatgcttgtttggacttccagggtattgtgaaacttcatggattacgcaacaatgcttgttttgacttctggagtgttgcaacactttacgaatttcgcaacaatgcttgttttgacttctggagtgttgtgaaactttacggattacagaacaatgcttgctttgacttctggagagaccaaacaaagttcccaagccgatcgccagtgtacccgaacgaaattaggaggaagtttttagaatacttggttcttcatagagcttttcctcctcttgcaaatttttgcaagttaggcctcacccatgtgtggggtggaaagaccttctaa

SEQ ID NO: 31762 - DNA, 339 bp, Glycine max
  Peptide Sequence Number=SeqID_148540
atggcacaattcactgtactggaaaagtttacagatatatttattggatggctgccaatgtatggattgatgaagctggtgctctttgtctacttgtggtatcccaaaactaaagggacaggatatgtttacgagactgtgttggggccttacgtatcaaggctgataagtcatgaacatgacattgacatgaaattattggagttgaaggctacaggatgggataatgtcatatattactggcaatactgcgccaaattttggcaaagtgcttttgtcaaggctcttcagcacttggcttctcaatcaagtggattttctgccaaccccaatacagag

SEQ ID NO: 31763 - DNA, 504 bp, Glycine max
  Peptide Sequence Number=SeqID_148541
atgggtggtggtgcatggccgttcttagttggtggagcgatttgtctggttaattccgttaacgaacgagacctcagcctgctaaatagctatgtggaggtctgtgatgcccttagatgttctgggccgcacgcgcgctacactgatgtattcaacgagtctatagccttggccgacagatcattgcaattgttggtcttcaacgaggaattcctagtaagcgcggagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 31764 - DNA, 258 bp, Glycine max
  Peptide Sequence Number=SeqID_148542
atgcaagacgaggtaaatggctcgactgggaataacaaaaccaaatggtacccgacttcgttaaagaaaaggggtccgactggggatcacatgattttactggggccaactgatgacatgaaacagaggcaaatgatgcacaagctgttcattaaagaaattgccactcgacggagagagggtgacacctttggatcagacccattggggatgacacttggggaaatagagggttacaaattattcatgattgattga

SEQ ID NO: 31765 - DNA, 348 bp, Glycine max
  Peptide Sequence Number=SeqID_148543
atgatacgcggagataccttacggttattcgcacccttttgtcatccagaggcggcgggcccgatgacaagcagagaccaagtttggtcattctgcacccttgtatcatccagaggcggcgggcccgatgatacgcggaaatacccgagtgagactgacatagtcttctgcaccttttgttcctccggggacaacaagtcatttacatgcagaagtttcatggtcgcccgcgactctcgtcaaccgagaggagcgaaattagtgtcatacactgattatcggggacctttgcttgatgacatgcgaccattctttggtccttgtgagatgcttggcatccatcattag

SEQ ID NO: 31766 - DNA, 285 bp, Glycine max
  Peptide Sequence Number=SeqID_148544
atggattggatcgaaacgactttcctgtcgaacccctttgtgtctagagcatgggaaaaagaccaaagatatcatagggagcgtcgcgtcttagcttgcacgcgatctcatccatgtcctaggtggcagagtgttgatctccatccgcccggaatgccactctgtcggccaattgccggaaggttgcggactgcaaacccgcagtctgtaggtcctcccgcattcgaaggagcttacttaaggactcctctccagtggcggtacgaagattatccagagctctag

SEQ ID NO: 31767 - DNA, 147 bp, Glycine max
  Peptide Sequence Number=SeqID_148545
atgcctctactggtcatcatgttgttgctagtcatttgcctgctggtcctgttggtgttggtgctgcttgcaacccaataccaactcctaagtcttttgttcttcagcaggtctaaaggagtgagttgtgattcaccaacactttga

SEQ ID NO: 31768 - DNA, 502 bp, Glycine max
  Peptide Sequence Number=SeqID_148546
atgggtgaagtagaggaggtacaagagaagatgaaggccgacatggaggccatgaaagaacaaatggccacgatgatggaggccaagatgatcatgaagaagataatggaagccagtgcggttgcagttgtcgctaccaacactgttgctaagtacggacgaccccatgatgtgcaaattcaaaacgagcatgccttcccaccacatggcttgcctcccaactatacaccacccaatgtggcatacactcccaatgaggatgtcaataaatgctcattgagagtcgacaacctcatcatatacatgtctctcaacccatgggggagacacatgaaattccccaccacaatcaagccgacttcgggccttgcctcggatatgccactgaagggaaagcagactacaagtcctcgccttcagaggactacacgttctcagcatcagagggctacatgccctcgccttcaaaggactagacgtcctcgccttcagaggactgcac

SEQ ID NO: 31769 - DNA, 147 bp, Glycine max
  Peptide Sequence Number=SeqID_148547
atggcgagtccgatgacatgtggggaggaaagcgagccaattgacccgcagagattaacatcgtcttctgcacctttgtcatccagagacgacgagtccgatgacatgcaggggtatcttatgattatctacaccattgtcatctag

SEQ ID NO: 31770 - DNA, 276 bp, Glycine max
  Peptide Sequence Number=SeqID_148548
atggctttccaaaccataccaagcgaaaggaaagtcaggaagtttgttcacatggccctgcatttgattgctatagttcttggcattgttggtttgaatgccgttttcaagttccatggtatggaaaacattcccaatgtttacagcctccattcatggattggcattgtcaccttctgcttatttggattgcagaaaatagtttatggtaagggaggttgtcttgtgactatgtcatgggccaaattgaaggttatgactagatctgtcaaatga

SEQ ID NO: 31771 - DNA, 605 bp, Glycine max
  Peptide Sequence Number=SeqID_148549
gttgcactctgtttgctaacaagagtgcaaccaatgtccatgttgtctacttggaggcccttcgtgacctcagtgtgacagagaggtacgcctggggagtggctactttggttcatatgtacgaccaactgaacgatgcatctatgagccacagtcgacagtttgtcggttacatcacactgctgcagtggctgatttacgagcactttccctcggtcgcgaagtccatcgctgatcaggactacgacgaggcttctccacgtgcgtgcagggagcgcctggaccgactccggattccggatgtctgttggatcccttatggggagcatcaggaggtccaggacttccacaccattcctgctcctcctgtcgattcatgggtctcgtatgatgatatacacggcaggtggatgcactacgaggatcatatcgtaccagcaggtgaggccccgcaggcaaatatccctcgcgtgctggagccaggagcatcatcgacatttgcggaggagcccagacatgcagtggaagtttgtgatgacattgctgagaggttggagcgccatctgagtctaggggtggtcatgtctggctcatcgacacatgag

SEQ ID NO: 31772 - DNA, 318 bp, Glycine max
  Peptide Sequence Number=SeqID_148550
atgaccactcttacatggatatggatgacgttgttatttagcaacattctgccccgcgaccacaatgcaaatctccccctgcagatgtatcggttgggatcgcgcccacaagacgcccagtgggcccgaagaagtccaacagagccctggggtttccagctctggttacgggcctctatcagtcctacagggtgcccgttccccccagcgaggtcatgccatcgtgacataggaatcgcacccacaaagacacccagtggacccggagaagtccaacagggccctggggtttccagctctggttacgggcctctatag

SEQ ID NO: 31773 - DNA, 183 bp, Glycine max
  Peptide Sequence Number=SeqID_148551
atgaggatgcgtagccctctaaaggcgagggcgtgcagccctctacaggcgaggacatatagtcctctaaagattgactgtccttttgaaaaaggtgataattcatgcaaccttatcctatcttttgcaaatctctccgggaactccctcagagtgtatattctatttgattcagtcacttga

SEQ ID NO: 31774 - DNA, 136 bp, Glycine max
  Peptide Sequence Number=SeqID_148552
gtgttttgaaaagtcggttttggagttctctccttccgatgtttcttcaggtatgggagcggtgtacggcatcgcgaagagcggcatcggggttgcgtcgatgggtcacgccggagctggattgattttgtgcttg

SEQ ID NO: 31775 - DNA, 967 bp, Glycine max
  Peptide Sequence Number=SeqID_148553
atgggtgaagtaaaggaggtacaagagcagatgaaggccgacaaggaggccatgaaagagcaaatggccacaatgatggaggccatgatgagcatcaagaagataatggaagccaatgtggttacagttgtcgttaccagcactgttgctaagtacggatggccccatgatgtgcaaattcaaaatgaacacgccttcccgccatatggcttgcctcccaactatacaccacccaatgtggcgtacactcccaatgagaatgtcaataactccactcccatactcattgagagccgacaatcccaaactgatcatgcacatgtctctcgagccattggggagacacatgaaatgccccaccacaatttagccgactttgagccttgcctcggatatgccactaaagggcaagcagtcgttaaaggaggcagagattatgccttagctaacctagaagagttgttcctagtacccaatatcatcacccctcccaagttcaaggtgctggactttgacaagtacaaggggactacttgcccccagaaccatctaaagatgtattatcggaagatgggggcatacgcaaaagatgaggaactactgatacatttcttccaagaaagtcttactggagtagttgttacctggtacactaacttggaaccttcccgagtccattcttggaaggacctaatggttgctttcgttaggcatgaatctttcaaagaatacacccaaaggtggagggatcttccagcccaagtggttccctcaatgacggagaaagaaatgatcacaataatagtaggcacattaccagtgttttactatgaaaaatggatcaaagtgggtctgaaaagaggcaaatttaatcatcctgcttggacgaatgagaaaactggggcaaatgaagagggtgaggatgagcgagaaacccatgctgtgactgccattcctatacgaccaa

SEQ ID NO: 31776 - DNA, 174 bp, Glycine max
  Peptide Sequence Number=SeqID_148554
atgtgggccatcatcgatgagtacaaggaaaagctatacctagcggcagctcacaggcaaaagctagaggatgagtatgccaaggtatcagtcttgcaagcggaaagggaagcaagggaaaagattctcctttactttgaatgggagtcaaaagcttcctcgactgctagctaa

SEQ ID NO: 31777 - DNA, 714 bp, Glycine max
  Peptide Sequence Number=SeqID_148555
atgcggagacacttcataagcccaagtctaagagccactaaaagggaggaagacgaagaggtccaagcccttaggacagaactcaagcaagctcaaatagtcaaagaaaggttcaaatcagcagctcttaaaatccgaaaggagaattctgaactgagagatataaatatagctaccaccaaggctttggaacaagagaccaagagggctcgtagggaagagcacggccggaacaagttccgaggggctctgtggggtagtaacaacgagcttaaactccggagggaggaaagggaccaatcgcgagtagacagattgatcttgaaagatgaattgaaggcttgctcgaggtccaaaagaagtttgtctcagtggttatgcgagacagagaccaacatgttagctatcatcaccaagtaccaagaggaactaagtctagccacggcccacaaacatagagtggtggacgagtatgcccaagtgtacgcggaaaaggaggctagaggaagggtgatcgactcgttacatcaagaggcaacaatgtggatggaccgatttgctcttactttgaacggaagccaagaactttcccgattgctagccaaggccaaagcagtggcgaacacctactctgccctcgacgagatccacgaacttcttaactattgtcagcatacgatagacttaatggcccatatgattagaaaccgctag

SEQ ID NO: 31778 - DNA, 772 bp, Glycine max
  Peptide Sequence Number=SeqID_148556
atgttgataccctcaaaactgagtcgtcccgttcgtcctgaaagcacggttacccgcgatcgtctgctgcaaaagctcagcgcagcggcgaattaccggctggtgctgattgccagcccggcgggctacggcaaaaccacgctggtatcgcagtgggcggctgataaaagcgagctgggctggtattcattagacgagggcgacaatcagccggagcgcttcgccgattacctgatcgccgcgctgcagcaggctacccgcggcgcatgcagccgcagcgagacgctggcgcaaaagcgtcagtacgtgaacctcaatgcgctgttcgcccagctgtttaatgagctggccgcgtggcagcagccgctgtggctgatcatcgatgattatcatcacatcaccaatcctgccgtgcatgaagcgatgcgctttttcctgcgccatcagccggataacctgacgctggtggtgctgtcccgcaatctgccgcagttgggtattgctaatctgcgcgtgcgtgaacaactactggagctgggcagccagcagctggccttcacccatcaggaggcgaaacagttcttcgactgccgcctgagtgcgccgctcgcaccggatgagagcaaccgtctgtgtgatgatgtagcaggttgggcgaccgcgttacagctgatcgcactgtccacccgtcagggcgcggcatcggcgcaggactccgctcgccggctctccggtattatgccagccatctttccgatatctggtcgaggaa

SEQ ID NO: 31779 - DNA, 681 bp, Glycine max
  Peptide Sequence Number=SeqID_148557
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacagctattggaattatggattttcagtttatgggggccagtatgggatccgcagtaggtgagaaaatcacccgtttggtagaatatgctactaatcaacttttacctcttattctggtatgtgcgtccggaggagcgcgtatgcaagaaggaagtttgagcttgatccaaatggctaaaatctcttctgctttatatgattatcaaaaaaataaaaagttattctatgtatccatacttacatctcccactactgggggggtaactgctagttttggcatgttgggggatatcattattgccgaaccaaatgcttatattgcatttgctggtaaaagagtaattgaacaaacattgaataaggcagtacctgaaggttcacaagcagctgaatatttattccataagggcttatttgattcaatcgtaccgcgtaatcttttaaagggcgttctgagtgagttatttcaattccataatttcttttctttgactaaaaatgataaggcatag

SEQ ID NO: 31780 - DNA, 192 bp, Glycine max
  Peptide Sequence Number=SeqID_148558
atgggaactgaaggagggaagactagtggatacgcgatccatgacttatcatcagtggaagaaatgagtggggttagtatgaggtatcttggggatgatatagttcttatagcagggatggatgaagatggtgcaaaaaagatgatggctagagaggaagacaactacctctctatctttcattcaatttaa

SEQ ID NO: 31781 - DNA, 1449 bp, Glycine max
  Peptide Sequence Number=SeqID_148559
atggcgggttgttcttcaaattttgctgtggctcgttttgccaatgtgaggaaagaagttgttttggggaatgaagagacaaatttgattaggttgagtttcaggggtgtgttgaatgaatctgcatttcaagttctacgtgggagtaagtgtggtagatcatgtgtgcctatgcaagagaaagcaatgtttcttataatgagtatgtcgcagccatcggctgagaacgaatcgcaatctgctgtgacttccataggattatcagaagggggaggtgataatgtcctgagcaatgatgacgggactcgggatagcgagccagactccaaaaatgaaagaaatgatgataatggagttgtattggatggtagtggtggtaatgggaactttggaagtggtggagctggagatgggagtggagggggtggcggcgatgatgatggcaatgacaatgaagaggaggaatttgggccaatactaaaatatgatgaggtaatgagagagacagaggctcgaggcgctacacttccattggatatgatagaggctgctaagagtgtgggaatccgcaaggtgcttcttcttagatatttggatctgcagggatctttttggcctctaggatttttcatgaaatcatgctctatgcttcgcaatcgaatgctggctgatcccgcatttcttttcaaaattggctcagaggatatagttgaacctccttggtttgctttccctatcttgaacgctagaaattgtggtactaaaatagctttcctatgtaacaagattgtcatcgatacatgttgtgctacttttgctgaaattcaaaagagaggcaaagacttttgggccgaatttgagttgtatcttgcagatcttcttgttgggctggttgttaatgttgctttggtaggtatgttggcaccctatgctcgaatagggaaaccgtcaatatctagtggattccttggtagaatgcagaaagcttatgcagccttgccgagcagtgtatttgaagcagaaaggccaggatgtaggttttctgtacagcagagacttggaacatacttctacaagggtataatgtatggagctgttggatttggatgtggtattataggccaaggcattgcaaatttgatcatgactgcaaagaggagcataaagacatcagaggaagacatacctgtaccaccacttgtgaagagtgccgctctttggggtgtctttctagccatttcttccaacacgcgataccagatcgtcaatggactggaacgtttggttgaagcgtcaccattggcaaagcaggttccccctgttgctctggctttcacagttggtgtgcgttttgcaaacaatgtgtatggtggcatgcaatttgttgactgggccagtatattgatggatgaaattcagattccggaatccgtagtgagcaaaggttga

SEQ ID NO: 31782 - DNA, 720 bp, Glycine max
  Peptide Sequence Number=SeqID_148560
atgggaacacttattcgaatcttcagtgatggcaccatagaacgacctttacaaacaccatttgtgccactaaagcttgatgagccacacactggactttcatccaaagacgttgtcatttcacataatctcccggtttccgctcttgtttatcttccaaaactcaccaatgaagctgacaaagttccaatcttggtctactttcatggtggtggcttgctccagagcatcttcttccaacatgttacaatgattgttggactgcactcaagtgggtctcctcccataattattctacaaagaatcatcccaccaataatgctgagccatggtgatttcaatagagttttcatagggggtgatagtgctgggggtaatattgcacataacatactcatgcgtgctggaactgaggctttacccgggttgactggacttgggtgctctagaatgattgcttgtgttgctggtaaggatagtcttagggagagaggagtttcgtattatgaatctgtgaagaaaagtgggtggcaaggaaaattggaattttttgaagaaaaagatgaaggtcatgtttatcaattgttcaatgtagaagctactcgcgtcgtggtggtctttgtcatcgctgttgtgctgccgtgctgtactgctagtcctcgtcatcgcaaaagattgaaacttgaaagtcctcactcgtcgaaagccctcatttcatga

SEQ ID NO: 31783 - DNA, 477 bp, Glycine max
  Peptide Sequence Number=SeqID_148561
atggttcgacccccatctagcacacctaattgtaaaagcttagccgcgagtggcaccaagtctggatcggagaaggaacacactgagttcctggccggggcactcgtcggggttgatgagatgaaacgattcggaatcggcgttgcccaccacgtgttcgaagttggcgcgcatgtacatgagttcctcggaggctgcggcggcggaggaggcgaagccggaggggatgacgccggcgccgacggagacgcactgcatggtgcggaggatgttgcggacgcggtctccggcgcggcggcgggcggcgaagccggtcttcttgccgttacagaaggcggtccagagggggacggagcggagggggcaggcgttggcggcggcggagcattcgagggcgatgcggacgatgccgttccgcatttcgcggacaaggtggtcggtggagagcggcagctcaagaagaagggaaggctttga

SEQ ID NO: 31784 - DNA, 186 bp, Glycine max
  Peptide Sequence Number=SeqID_148562
atggctataggaacaactggtgtgcaggttggatggaaggctgcaagctggtgctgggcaaatattggtctacaaatcatgaggcaacatacaagaaaacccacaaattttgaaggtagggctgtaattgggttgctggtttttgcagcaacagatacgttctttgttatagtgtgtactaattga

SEQ ID NO: 31785 - DNA, 306 bp, Glycine max
  Peptide Sequence Number=SeqID_148563
atggggtgtttttgcttccgaaagcataaaagtgataatagcaaaaacaagagcaatggaggattgcaaggtcagcataaaaatcataaaactgatacaagtagtcatgttcaacaacttcatgcctccaaagacagccccaacagaatcaaaggtagtggtggtgtcaaagatggtgatatgactattttgactgctgcaaccacaacttgggttgaaagtcatgctcccacaggtcatcatagaagtgatagaggcagtggtgatggcggtgatggcggaggtggaggttgtggtggtgattag

SEQ ID NO: 31786 - DNA, 165 bp, Glycine max
  Peptide Sequence Number=SeqID_148564
atgcatcaaaaagtttcaagcaaggaagatttggaagtgcatgctgaagatctcactcagcgtgcaagattcgctaagagaggcgacccgctcagcgcggaaaagaactcgccaagcgcgaagaagaaccctagagaatacaaagtcagagagctgcgtgcttag

SEQ ID NO: 31787 - DNA, 390 bp, Glycine max
  misc_feature (27)..(27): n is a, c, g, or t
  Peptide Sequence Number=SeqID_148565
atgattttagacctcaaaaggataggncagtggtcagagaaatccctttccaacacaaactggctggaattaaactcagaaatgctagtggagttacccactatgcattctgaagctgaagcactagaacatatgaaaaaaagagatacaggccatgaaagtgtgtcattggagaataagacaggagattcaactatgatgaagataggagattcgactaaagttgtgataaaacaagacatgaagggaagaagacataaatatgggtttaacaacaataaacgtgagaagccagagaaggtaagggtggtggatgatgaaactggcgacaaacatcagctgcatgaagtcctaaggatgccatctacatgtgtatttcttaagatatag

SEQ ID NO: 31788 - DNA, 321 bp, Glycine max
  Peptide Sequence Number=SeqID_148566
atgggatgtttttgcttccgaggtagaaagaaaagcgatgataacaaatacaagaacaatggggggttgcaaggtgcaaatacaagatgcaaggttcaacaaagtcatgcttataaaggcagtgccagcagagtcagaaatggtggtggtgacggtgatatggtaattttgacaggtgttgctgctgcagcaaccacaacttccgttggaactcatggttacacaggccatcatggaagtggtggtggtggtggttgtggtggtggtggttgtggtggtggagggtgtggaggcggcggttgtggtggtggcggctgctga

SEQ ID NO: 31789 - DNA, 145 bp, Glycine max
  Peptide Sequence Number=SeqID_148567
atggcacatcaaaagcccccaaacttagccttttgcactcctgggcaaaatgaaataaagaacaaaatccaaggaatgaaaggaatgggtaacatcaaattagcttacgtatttctcaatgaacgtcaaggaatgaaaggaatgg

SEQ ID NO: 31790 - DNA, 786 bp, Glycine max
  Peptide Sequence Number=SeqID_148568
atggcgaatcaagaggagcgggtcccgtttatggacgtattagcattgcttatctttggggttgtcctctttccaaacatggatggtttggtggacctagccacaatttatgctttccttgcatatcaccatagcaaagagagccctgtggtagctatcttggcggacttatttgacacatttgaccgaagatgcgagaagagtagtgcacggatcatctgctatttacccgctctttgtagaagagtagattgggaccaacacttggctgggataggaggcaaaacaatcaactggtttcctcgatggaaggaaggaaaggagggagttctcttctcatgtggggacaacccaaacatcccgttgataggaatgaagggttgcattaactacaatcccgcacttactataagacagttagggtaccccatgaggggagcaccgacggaagaaagcctctatcctttcctagtgagagatttcggtgcacaaagtttcaagattatacaaagagtccatacggcgtgggaaagcccgttaaggaaagataaagaacttaggggcattcgtaatggcatcatcgatggttatcatgaatggctgaaagtttgtacacaagggttagattggctctccaagttaaatattatcaacgaagagaacttcgaagctccggaagaggatgaagaaacgtctggaaagagtgtgtcgggttacgagaagaaaatgcagctaccgcaagagcccttgaacaagaaaccaagagggctcgcaaggaagagcatg

SEQ ID NO: 31791 - DNA, 711 bp, Glycine max
  Peptide Sequence Number=SeqID_148569
atgctgatcaaagcggttccgttcacgtcctttgccggcgataaaataggcgtcttcgagatcggtactgatgcgactaagctcttggcggaagcccgttcatcgctctggaccatgatcgctgtcactctcctgacctcactattagctcttactgcctttttcctgttcgctaaatctcttggcaatgcaatcggccggctgacgggtacgatgaccaggctcgcatccggtgatctttcgacggatatagacggtgaggatcgctctgacgagaccggtgcgatggcgcgcgccgtgcgagtcttcaaggacaacgccttgaagacaagggaactcgaaaatcaggcggatgaacagcggcaaatgaccgaggagcaacggcgccaaattgccgagcaggaacgtgtccgtgcagaggcgatggcagaggccacaaatgggctcgctgcagggcttaagcgtctcgcctcaggcgatttgacggtcactcttgagcacagcttcgcaccggatttcgaaagcttgcgaacagacttcaatgcagctgtcgaacagttgcaagggacactcggatcggtttcgcaagccgtagcgtctattgacagcggctcgcgtgagatcagccagagtgcagacgacttgtcgaggcgcaccgagcaacaagcggcgtctctcgaagagactgcggccgcccttgaccagattacg

SEQ ID NO: 31792 - DNA, 633 bp, Glycine max
  Peptide Sequence Number=SeqID_148570
atgcggatcccaccgcttccctcaatcaggaaacggggcccgttccggcgaccgcggatgcaaagcgaagcttcgggtctgaaccgccggtcgatccggcgcgtcagaccagacgacagggcaaaagccgcctcagaagggcggctcgatgtcgatgacaccctcctgctcggccatgatcaccgccaactcggcgcatgcgagttccagctcgacctcgatttcgcggcgttagtcgcggtacacggcgtttcgcaattcggctcgcagttcttcaatgtgttgttccagaagcatcgtcgtcgtctccttgacgtttgtgaaagacgacgcgcgcggtcatgggggcgtggcggggtcaaggatcgcgccagcgaccggcggagccggcgagtgggggagccgaatttgttggagcgcagggtaccggagcggaggcaaaattgggggcaccgctcgtccttgaggccggcatgccgccatggcatcctcagacggactgagcagacatttcctctccgtatcgcacccgaacccgaagatgggctcgatgcccgtctcggggtcactgatacggtgaataactgtggagatccggggctttccgcagcatttgccacagtgtgtcgatga

SEQ ID NO: 31793 - DNA, 687 bp, Glycine max
  Peptide Sequence Number=SeqID_148571
tacccttgcctccagaggactacacatcctcgccttcaaaggactacacgtcctcaccttcagagggcttcacgtcctcgccttcagagggcttcatgtcctcgccttcatagggctacatgccctcaccttcagaggactgcacgccctcaccttcggaggactacacgtcctaaccttcggaggactaaacgtcctcgccttgagaaggctacacgtcctcgccatcagagggctgcacgccctaaccttcagagggttgcacaccctcgccttcagaaggttacatcccctcaccttcagagggcttcacgtcctcgccttcagagggcttcacgtcctcgccttcatagggctacatgccctcaccttcagaggactgcatgccctcaccttcaaaggactgcacgtcctcaccttcgaaggactacacgtcctctccttgagagggctacacgtcctcgccatcagagggctgcatgccctaaccttcagagggttgcacaccctcgccttcagagggttacatccccaaacttaagaggactacacatcctcaccttcagagggctacacgtcctcaaacttcagaggactacacgtcctcaccttcagagtgctacacgtcctcaccttcagagtgcttcacgtcctcaccttcaggggactgcacgccatcgcctttag

SEQ ID NO: 31794 - DNA, 294 bp, Glycine max
  Peptide Sequence Number=SeqID_148572
atgacgaaggatgtgatccacggtcacaactctagagcatcttggctccacttttcgtcttctccttcttcttccttagcctctgcttttttttctctattatgcttctactggataaaacaaccaaggagtgcagacaaattttcccaggcgagttgtagctcacccaggcgaatttgttgcttacttttgaagacttccacttgccaaagcaagctatcacttgcccaagcgagctatcactcgcccaagcaagctatagctcgcccaggcgagttgcttgctaagggctga

SEQ ID NO: 31795 - DNA, 405 bp, Glycine max
  Peptide Sequence Number=SeqID_148573
atggagtcgccaaatatcggtcatgaagaatattccagattcgggattatctttacgtttgaggaaggtattagcacctctcacgtcgacaaaagcggggctcttgcttctatgtaccctccatcgaagaggaaatcagacctacgtagttctttcaaaaggggaaaatcaagcgattctttttacttggaaggtgacactcatgtatttgaacctgtccacggtggttggccgcctgctggcaaaccaaatgctgtaaataacgctctacgcccagtgacccatctggactggcctgccaaggtggtggcagtgcgcctgcggactgatgactggcaaaggcccatgatcagagccggaaaccccagggccctgttggacttctacgggtccagagggtgcctg

SEQ ID NO: 31796 - DNA, 171 bp, Glycine max
  misc_feature (26)..(26): n is a, c, g, or t
  Peptide Sequence Number=SeqID_148574
atgactcgtaggatgcgtgttccacngaaaggaatagcgcggagtctccaccaacgttcatttgaggaaaaagtcggaaaaaccggaaaagacgcgatctacgaacttttaagtgaaaggctcgagatttctattttacgcgcggggaagattaagcgagaaatgacttaa

SEQ ID NO: 31797 - DNA, 408 bp, Glycine max
  Peptide Sequence Number=SeqID_148575
ctaaaggtttcaagcgaggcagaggctgaaacccccgaggagagtgaggaggtgcaagtcttaaaggaagaacttgaaagagcacaagcggtcaaggaaaaattcaagacgacggccatcaaggtccggaaagaatgcaataaactaagagatgtcaatacgaccactgctaaagctttagagcaggaaacaaagagggctcgaaaggaagaatggggccgaaacaagttccgaggggctttgtggggtagcaacaacaagcttaagcttcgaagggccgagagagaccagtcgagagtcaaaagcatgatattggaagatgagttgaaggcttgtcaatggtccaaaaggagtttgtctgagcatttgagcaagaccaacgaaaacatgtgggccatcattgactaa

SEQ ID NO: 31798 - DNA, 234 bp, Glycine max
  Peptide Sequence Number=SeqID_148576
ggtggtgagacttcaagttcaactgagagcaatggtggcagtcaaaatgtccgtttgtcaataccaattttaccaaattccagttcttcattagtttcaatgacatactctccttctttcaactctagtcaacttgttgctcagaggaaactgtttgcagaatcccaaataggaaggaccagttttcagaggcttttggagccaaactcaggttcctggaattgctccttatag

SEQ ID NO: 31799 - DNA, 264 bp, Glycine max
  Peptide Sequence Number=SeqID_148577
atggtggcaactcaaaggaagaagacaaattacatcaaaaacctggttaactctgagggggtggaagtgaaagatatggaagttttgtgtgagaaagtcaaagggtactttagggaattattcaatggctgccacgcaaatatgaatctggtgttggagcttacaaggtcccaccgaaagccttggcaaattagttacaaccttttcttgaaaaatgtatctccaagaaacagtccgctttcatggaagggagggcaatcttag

SEQ ID NO: 31800 - DNA, 729 bp, Glycine max
  Peptide Sequence Number=SeqID_148578
tgcctcgccatcagaggactgcatgtcctcaccttcgtagggctacacgccctcacctttagaggactacacgtcctcgccaacagagggttgcacgccctcaccttgagaagactacatgtcctcgccttgagaggactacacgtcctcaccatcagagggcttcacaccctcacctccagaggactacacgtcctcaccaacatagggctgcacgccctccccttgagaggactacacgtcctcgccaacagagggctgcacgccctcaccttgagaggactacacgtcctcgccttgagaggactacacgtcctcaccatcagagggctgcacgccctcacctccagaggactacacgtcctcgccttgagagggctacccgccctcgccttgggtactagttaccctcaccttcagaggactacatgtcctcactttcagagggctacacgccctttccatttgaggactgcatgtcctcaccttcggctacacgccgtcaccttcagaggactgcgcatcctcatcttcgtagggctacacgccctcacctttagagggctacatgccctcgccatcagaggacttcacgtcctcacctttgtagggctacacgccctcaccttcagaggactacacgtcctcgcctttagaggactacacgtcctcgccatcagaggactacatgtcccccgttttcaaagggagacatgccctcacctttag

SEQ ID NO: 31801 - DNA, 393 bp, Glycine max
  Peptide Sequence Number=SeqID_148579
gatatgcggaaaaatgcactggccatccagaagcaaagcactgccccccatgtgttgtctcatgagggttatgaacatttagaaaagaagctgatggatgagaagacaaagaaaaaactagaggaagctgctaaatttggaagcactgacatgatcattgatcatccatctcccatcagacgacatgcgtcacagggttcatttgtcgcccatggacgtcaagatgtattgactattgccattggacttggagtagctgactcaacaaatcagggactagttggaggagttgatcacagaaaaactgacttgatagctaatgttatccttcaaccatatgcaatcccagtttcagttacagatgcaatcacagggacttgcactacctcctga

SEQ ID NO: 31802 - DNA, 478 bp, Glycine max
  Peptide Sequence Number=SeqID_148580
atgggatattcacatcatggtgcagatattttgtccactattccttcagctgggactaactcacatgaccttgacaaggtcagtgcaattaaacagaatctttcctttttgatggtgggaacagttgagccgcgtaaagggcatttacaggctattgctgcttttgatcggctttgggcgtctggtaatgagtctagtctggtcattgtaggtaaagaaggatggaaggggttgcctgataatgcgaggcgtaccatcccggaaattgtacatacgattaaaaatcatccgctcctgggaaaaaaacttttctggttcgataatgccagcgatgaactcttgagcgaactttacgcaaacgcagattgtttgctctatccatctgaggatgaaggatttggactaccgttaattgaggcctcacagcataataagcctttgatagcgcgtgatattccggtgcttcgtgaggtggctg

SEQ ID NO: 31803 - DNA, 291 bp, Glycine max
  Peptide Sequence Number=SeqID_148581
aagctcatggctgagaaaacaaagaaaagactggaggaaactgctcagtccggaagcactaagggcgattctttggaagagcaggcgtcacagggttcgtttgtcccccatggacgtcaagatctcctgactgctgccattgggcgaccagaacaccttggccgtgtgcgtgctactggagccggtgtcaccatcaagcaatacttcggatcggctccacaaagctcctgcagttcctcctccatgcctcccgaaaaactcaagcagctgactcaacaaatcagggactag

SEQ ID NO: 31804 - DNA, 900 bp, Glycine max
  Peptide Sequence Number=SeqID_148582
atgcggatccttcggcggcagcggcaccagcacgtagcgcttgcggcccagccagaacacgaaggtggcgatgaacatcaggatgcccgggataccgaacgcccactgcgggccccagttcttcagcaccagcgggatcagcagcgaggcgaacagcgagccgaagttgatgatccagtagaaggcgtcgaagacgatcttggccaggtgcttgttgctctggtcgaactgatcacccatgaacgaggccaccagtggcttgatgccgccggcaccgagcgcgatcaggcccaggccgaggaagaagccctcgcggctgttctcgaacaacgccaggcacaagtggccggcgcagtagaccaggctgaaccagagaatggtgtggtacttgccgaagaacctgtcggccagccagcctccgagcagcgggaagaaatacacgccgatcatgaagctgtgcatgatgtccttggcttcaccggcacggccttccgcagtgatttcctgcagcagcagcgaggtgatcaggaactgcaccaggatgttgcgcatcccgtagaaactgaaccgctcgcaggcctcattgccgatgatgtacgggatctggcgcggcatctttccctggccggcgatgggggcaactgcgtcgtggctcatcctgtaaggcaatcctgcaaagcgaaaggcgcaagattaccggaagcagggcttgcgaagcacgctgcagggctgcatgacaacggtgccaatccatggcagacaccgcatgccatgccggaagtcacggcacctgcacgacaaaagcgtgcaggcgcggccgcaggcaccggccacaacggccagcgaaagcgagccccgccaactgaccgtggccgcgctggagctgcccagccgcgatga

SEQ ID NO: 31805 - DNA, 255 bp, Glycine max
  Peptide Sequence Number=SeqID_148583
atggagacttgggttgaaaacctacaatccaaatttaaaggcgatccaatgcttaacaagtccaagatcgtggttttaccgaaacagctcaactgccattccttgacctggaacccaatgattttgatcaggagagtatggatgttgtcataccttaatttcgtccggggacgatcatttgcaaacatttggattctttcctgccgaattgagccgcttaacacaaattgcctcacattccgaagggttttgtga

SEQ ID NO: 31806 - DNA, 1359 bp, Glycine max
  Peptide Sequence Number=SeqID_148584
atggtcccaactattgaagagtttgaggaaatattaggatgccctctaggggggaggaaaccgtatcccttctccggttttcttccttccttgagcaagattgcggctgtggttggggattcagcaaaggagttggatcgcacgaagcaaactcggaacggcgtagtgggcttgcctcggaaatacttggaaggaaaggcaagggatatggtgagccaagagaagtggggctcgtttacagacattttagccttgctgatttttggggttgtcctcttcccgaacgtcgacggtttggtagacttagccgccattgatgctttcctcgcatatcactatagcaaggaaagtccagtggtggctatcttggcagatttgtttgacacctttgaccggaggtgtgagaaaaacagcgcgcggattgtctgttgtttacccgctctctgtgtatggttgatttcacacctattccgacaagacacgagacacccgtgtccgcttcaaagctatcgatcatgcgccgaaaaaggaagagtcgattgggaccaacatttggctgggatagggggcagcgcgatcaattggtttcctcgttggaaggaaggcaaggaaggagttcttttctcgtgtggggactaccctaatgttccactgatagggactaggggttgtattaattataatcccacactcgccataagacagctagggtaccccatgaggggagcgccaaccgaagaaagtctctcgccttgccttgtgagggatctaggcgcacaaagtctcaaggcgatacaaagagtccacaaggcgtggagaagtccgttgaggaaagacaaggagcttaggggcatccgtaatggcgtcatcagagattggctctccaagttgaaagttatcaatgaggaggacttcaaagctccggaggaagatgaagaagtccgagctctaaaattagagttagggaaggcaagactcgccaaggagaagttcaagtcagctgctacacacatccagaaggagtgcaccgagttacaagaggaaaatgcggccactgcaaaagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcttgcgcgaggtccaaaaggagtttggctcaacacttggaagccacggagcaaagcatgctaactatcatagggcaatacaaggaagagttgaaccagtctgtggcccatgaacaaaagctagtggaggattttgcataa

SEQ ID NO: 31807 - DNA, 717 bp, Glycine max
  Peptide Sequence Number=SeqID_148585
atggaggccatgaaagagcaaatggccacaatgatggaggccatgatgagcatgaagaagataatggaagccaatgcgattgcagttgccgctaccagcactgttgctaagatgaacccgatgcccccatctgttctcaaccaaatgaatcatccaacctcatctatggtaggcaaagatttgggaaccaatgttgcgtacactcccaatgagaatgtcaataactccactcctatattcattgagagccgacaaccccaaactgatcatgcacccatcggcgagacacatgaaatgccccactacaatctagcgaactttgagccttgcctcggatatgccactgaagggcaagcggttggtggtatacccctgcaaaacacttgggagggccctcattatcacccacaatcacacccctcacattccatagcgattataaaccctcatgctatggcagaaatgggaaagttggatcatctagaggaaaggctcagggccattgaaggaggtaaagattatgcctttgctaacctagaagagttgttcctagtacccaatgtcatcacccctcccaagttcaaggtgctggactttgacaagtacaaggggactacttgccccaagaaccatccaaagatgtattgttggaagatggggtcatacacaaaagatgaggaactattgatacatttcttccaagaaagtcttacgggg

SEQ ID NO: 31808 - DNA, 261 bp, Glycine max
  Peptide Sequence Number=SeqID_148586
atgaggcagtgcaaggaacttcttgagcactgtggatcactactcaaggcttttgataacttcaaaagccagaagacacttgtggaaaaccaaataggcagaaaaatcaagaggttccgtactgataatggtcttgagtttgctctgatttcaatgccttctgcaaagagaatgacattacaaggcagaggacaactcttggcacccgtggccaaaatggttgagctgaaagattcaccaagacccttttggagagagtga

SEQ ID NO: 31809 - DNA, 417 bp, Glycine max
  Peptide Sequence Number=SeqID_148587
atggcgcaaattgcagaaaatcccctgattctggtagatggctcttcctacctctaccgtgcatatcatgcctttccgccgcttaccaacagtgcgggtgagccaaccggcgccatgtatggtgtgctcaacatgctgaaaagcctgctgatgcagtatcaacccaaccatgtggctgtggtcttcgatgccaaaggcaaaacgttccgcgatgagctgtttgaaaattacaaatcgcatcgtccaccgatgccggacgatttacacgcgcaaatcgcgccgctgcacgaaatggtaaaagccatggggctgccgctgctggcggtgtccggcgtggaagccgatgacgtaatcggcaccctggcgctggaagcagaaaaccatgggcgtgcggtgctgatcagcacccggcgataa

SEQ ID NO: 31810 - DNA, 1095 bp, Glycine max
  Peptide Sequence Number=SeqID_148588
atggcagctttttcataccaataccatccttttcttgttgaccctgcattcttccccaacaacttaaacaccccttcccctcctcctcatcagtttcaacaactccctcatgaaacatcatcttttaatgtcacaaaccaggagactagctgtgttgatcagagctccaagatcaccatcagtgacaatgagccttctgtcactgaaaaccttagccctcagtcctccatggtagtggacaagcttgaaactggggagcaggtcactcagaaggtgaacactcctgtggagaagaaaaggaaaaccagaaatggatcttccttgactagtaacccccaatccaaggatgctgcaacagaaaggaaaaacaagaaacaaaggaagggcaatggtgggttgaaagaagaggacaaggcaaaagaagagaagaaggaacagagaaagtgtcccgaagagcctccaacaggctatatccatgtcagagcaagaaggggtcaggcaacggatagccacagccttgctgaaagggtacactgtaactctcttattaacaacttgaaaaattaccatctctatggctacgtgggccccaccagtgtgctggctttccctagaggtttcatcttcatgtttcattcctctaatgttgcaagaaaatggatttttcaggtgagaagagagaagataagtgaaaggatgaaggtgttgcaacggcttgtgccaggctgtgacaaggtgactggaaaggcccttatgttggacgaaataatcaattatgttcagtctctacagaatcaagttgagttcttgtcaatgaagcttgcttcagtgaatcccatgttttatgacttggcaacggatctagacaccctcttggttagaccagagaaactaaatagcatggcatcaccatcaccaccactaccatctgtgtcacattgcaacagccctaacaaccaagccactacttttgctgatacaaccaccatgacccccaccaacatcttccacattgctagtgactatcttttggataattcagtctcattttttcttcaagggcagaggtcaaatgtgttctctgaggaggtataa

SEQ ID NO: 31811 - DNA, 316 bp, Glycine max
  Peptide Sequence Number=SeqID_148589
gtcgactctagaggatcccaccgagccggcagggctgcgcgccgcgcagcgcggattccagctgcgcatcggacaagggcttgaagagatccagattgcgcagcagggcatgacaaaggggcgacggcatcacgggctcctggcatggggggattgcgctttcatggtggcaccgccacccggccgtggcaatgcgcgagcggcgccaggctggcgccgagtttgcgctacagcaaagaacgggaagggcatgcgccattcaatagggttgccgacctacacggcagttgaaaacccgataaggagctggacatga

SEQ ID NO: 31812 - DNA, 897 bp, Glycine max
  Peptide Sequence Number=SeqID_148590
atggcagaggttccggcgccggaggcacagctcaacggcggagccccaacaacggcggcgaattcctcggatcccatcggatcgaagcggcagcggcggccgagcgtccgattgggcgacatcggcgaccagccctacgactcccacccccgccgcgccgcagcgaaaacgtggcgcctcgcctttgaccacccccggaactccgccgccgtcaagccctccaagacccgccccctcacgaacctcacccccgccgctgccgagttcggcgaaaccctagagagcgacggcaacgtggacagcgttgtaattggaagctggaaggttaaggactccaagaagcgcggcggctcgaagcgaatcagatccaattggatttcgcgaatcgacggcggcgaagaggatgacaaagacgtcgacgtcggcgtcgtcgacggttaccaccaccgagacttctccgcggaacactcccaaagccccttgagggaggagcagagccctattatggagaatttgggcgtggatgaagaaagagaggtgctgcattaccacgaaaggaatggtaattctggaagaggagacggtgttagggtttggctcaatgggttagggttaggtcgttacgctcccgtcttcgaaattcacgaggttgatgacgaggttttgcccttgctaaccttagaggatcttaaggatatggggattagtgctgttgggtcgaggaggaaaatgttttgtgcgattcagaagcttgggaaaggatgcagaaagactgatcacgagaagggggaaaacgatagaaaggttttggttctaataagggaaagtgctgttttattatgttgtgtgtcatcaggtgcgagtggcttgctgtttcttgatgctcctgaagtttga

SEQ ID NO: 31813 - DNA, 210 bp, Glycine max
  Peptide Sequence Number=SeqID_148591
atgggattccggggcttccgggacacccctgttttaagtggaaaaaattgtttccgtgaagaaaatccaagtcgaggtgcttctgtaatgcttctgagatgtttccatgagcgaatccgtgtagatttttcgccgttcttcaacgttcttcatccgttcttcgttcgttcttcgttcttcgttcttcgttcttcgttcttcaacgggtaa

SEQ ID NO: 31814 - DNA, 144 bp, Glycine max
  Peptide Sequence Number=SeqID_148592
atgacagctgattcattagaagatataaattctgaatctccacaagcatctaattctaattctttctctgaggatgaaaattatgaatccaatactaatgaagctgcaatcgatactgaaggctattctgacttgggtgattag

SEQ ID NO: 31815 - DNA, 177 bp, Glycine max
  Peptide Sequence Number=SeqID_148593
atggaagaagagcttgagaagaaatctatgcaaggtgatatgctaatggtgggaaggctcttgggaagtcagatccagccattggacgacacccaaagagaaaatattttccacaccagatgtataattaatggattgttgacagagagggacaccacttccagagatggaagttaa

SEQ ID NO: 31816 - DNA, 471 bp, Glycine max
  Peptide Sequence Number=SeqID_148594
atgactaaggctcctattctacgtttgccagactttgcactttcatttattctcgaaacaggtgcttcaggcgtaggcataggagcagtattgtctcaacaagggcacccaatagctttctttagcaaagtcttttgccccatactgcttaagttgtccacatacatttgtgagttggaagccattgtggtgactgtcaagaaatggctgcaatatcttcttgaccatcatttcacaattatcacagactactacaacctcaaagaacttatgactcaagtgattcaaactctggagcagcagatgtatatggcctgtttaattggctacaattatgatattcagtaccgtgccggaaagtccagcacagtgcaatgccgcatatggttacctaaagatactcgtttcatacctacattgattactgagtttcatgcttcccctttgggtggtcacatgggtgtcacctag

SEQ ID NO: 31817 - DNA, 414 bp, Glycine max
  Peptide Sequence Number=SeqID_148595
atggttaaagacttgacccaattatccagtaaagctgtaccatttgaaggtacactaaatgatgattggaaatttgatttctatgtgcatgaggcccgccggttggtttgcaccaaccaagcggatatgaccggaaggcttcttcccgattcattggcttttgagagccacatccttcattatctcattgtgcaaatcttacttccaagatcttcaaaccttgcacagagatccttcttaatcggtgccactgtgattgcatcctttggttatcgtaaagagcatgatggctcttgggtgaaaaaaggtgctcaacccattgatgaagaaggacatttacatggtggagaagattcctctcttcttcaaaaggttttggacaggttcgatggtcttcaaacgttcaggttatga

SEQ ID NO: 31818 - DNA, 339 bp, Glycine max
  Peptide Sequence Number=SeqID_148596
atgagatttatgcaacacagaagcataaaccaaggagggtggagagtgtcaatgctaatgcagaagcctttggtgatcattgggaaaacaagagattcaactgtggtcaagataagtgagaaaaataataatgctgataccgacgactgcatgattcttgatgaccatgaaggagaagagcattgttgtggcataggaacaaatgcgaggagtgtttcttttttgccaagaagccaagagaagatacgagattcgactaaagttgtgataaaacaagacatgaagggaggagagcataaatatgggtttaacaataatagacgtgagaagccagagaag

SEQ ID NO: 31819 - DNA, 1932 bp, Glycine max
  Peptide Sequence Number=SeqID_148597
atgtctccctcgttcacatcgacgccaaccttttccacctcttcttcttccgcctccgacaatacgttcaaactctttggtctcactccatctcttcatataatactcattcgtcccaaaggaaacaatatgcaatgcccaaaaaacatggcattggaagaagacccaacaacacttctcaagctcgagtcagcatgttccgacctaaaaaccctacttcgagcctccgaggaaacagaagaaaacctgggaaacacagacacaaggctcgatcttttacaaagatcactctccacagcctccaagagaatcgtccctttacaatccctagccatgtcgaggaaagccctcgactcgagaatcaccagagccttggccccggcacttgcactcctcaacacgttcaagttgacagaatgtctccagaacagtctcgtcgagctctcgacgaggctgtcctcggagaagccgcttcagaagcggcttgagaggcttctggagtacactaaatacgtggatcaactgaacgaggggttaagcaacataagtgatgaggtggaagtggtgatccagaagctgcaggaggtggtggagttcataagccggacaaaggcggcagaccagtaccgggaggcaaggctgagggaggctctggggactctgaaggggctgtatgagattgaggtggatgagatgagatttcaggggctgctggaccaggcgttggtgcatgtgcaggatgagtttgaagggttgttgctgaggatgaagcttaggaacctgcagggggatttggtgcaccaacatggtgatgatttcagggaattggggtcggaactggaaattgaagtcctcagaagaatttcaaccacacttgctgccaatgattgcctagacatatgcattgatatatacgtcaaggcaagatatagaagggctgcaaaggcactaatgaagctaaacccagattacctgagaacatacaccccagaaggaatcgaagaaatggagtgggaaaccttagagacagccacaaccctttggatccaacacttggaagtggcagtaaagaaagtcctccttgcagaaaagaaactctgcgagagagtcttgggagatttcatggagggactaatctggccagaatgcttcatcaagatttccgacaagatcatggccgtattctttcgcttcggcgaaggcgtggcccggagcagcaaagagccccagaagcttttcaaactcttagacatgttcgagtccttggagaaactcaagcccgagatgtcacaaatattcgaaggcgaacctggcttagacatatgcacaaggttccgcgagttggaaaaactcatcatcgatgcttcgagcaaagttttatgggaattcggcctccaaatcgaaggcagcatcgacggtcttccacctgctcaagacggttctgttccaaaacttgtgagatacgctatcaactatctcaagtacctcaccacggttaattacagaacatcaatggttaaggttctccgaacacaacaaacatgggaagatagaagtatcaatgacatgtcttcggacgagggtttgttaaagcatgcaattagcaatgtcatggaggcgctgcagcggaacattgaggcaaagcgtatgtgttgtagggacaaggttttggtgcacgtgttcacgatgaacacgtattggtacatttatatgaggacgaaggacacagagcttggtgaggtgttgggtgagaggtgcatgaaagaggattacaaggctgtggcggaggaaagtgcttacttgtatcagaagcaagcgtggggtggtttggttagggttttggatggaaatgatgtgaggggggaagggaaagggagtgtgggaagagtggtgagtgagaagattgaagcttttttcaagggtttgaatgag

SEQ ID NO: 31820 - DNA, 1107 bp, Glycine max
  Peptide Sequence Number=SeqID_148598
atgatcaagaccttgaatccttacccaaatccagcaaaaactgctgagatcatgtcaaggtacaggccaatagcaccaaagcctgaaacctctccaaactcgtccatgagtgagggctcttgttcctctctctcccagaagatcaatcaatctccttaccttaggaatttatggccacagcttcaagccaggcccaccaggactagaaagagaggtagagctcctttgacactaccctcttcctccctcaagagacacaaaacaacacatatcctaggtttttgtcccccttgtcatgttgttacatcatccccagccaaaaacctttcttttcagggttttgctcctcttcctaaccatggacttggagtgctcaattgcaccatggaaaataacaacactctcaccgcaaatccaagcttagtgacacttccactccttccatgttctccttgtcctgcacccaaattggaatcaaactcaacattaaccaagccttgtgtgggagaagtaatagatttgaacaccaaggtgagtgttcctgaagagaaagatctcttgcagcaacttcaaaaaccagtttcttccaacatcaatgtcataacacctcaaccagttcgccccattggttcttccataagtgttgtgtgcattagtgaagacttaactctgccacctctatctcaaacaccaaaaaggccaaatgaggttgaacaagaggttgagaatgaacccttgccagctgtcatatcagactcaaaccacagaatcaggatggcaaattctgcatacaaggagatggtgggccagccattatgtccttggcttgagtccatggtgaataataatggtggtggtgaatgcaagaggatcagtggtgaggtaacacttcatcttagtgactcaactattgttccaacttcatcaaacggtttctcttgctgggtgaggatagagtggcagagtgaacacaacaataagaagaactgtgtcaatgctttctgtgatgttatgaagttggcctgtgaatccagggactatctcttcacatggaggttccacactcgtactaccagggaagcttctcaatcaagttgcaacgcttga

SEQ ID NO: 31821 - DNA, 168 bp, Glycine max
  Peptide Sequence Number=SeqID_148599
atggggagagttataaaggatggaggcttaaggctcatgaaggaggacatgtggggattgggcagtgaaagtgggtccatgcatggttacacatacatagagatactattggtaattttaatttttaacactactattggattggataagaacgttcaagctagttag

SEQ ID NO: 31822 - DNA, 216 bp, Glycine max
  Peptide Sequence Number=SeqID_148600
atggcatgtccgaaagggcaaaaagttgcttttggtacatacgctctagtggaagaagctgagtattggtgggagaatactcgccaatgcctagatgctgaagattgctttacaacaagagaccctcagtctcttaatcccttttcagatgtaagaagaagaaaagaaggaatctctcttgaaagagatagattgaacaatggagcactcaaataa

SEQ ID NO: 31823 - DNA, 132 bp, Glycine max
  Peptide Sequence Number=SeqID_148601
atggtttttgccactggaactggcgacttaggggcaatgctttccaccagtttgattggcgaattacctacagcggggcgtaggtgcagagggctacgaaggcttgtagagcagcacgcagagatattctaa

SEQ ID NO: 31824 - DNA, 156 bp, Glycine max
  Peptide Sequence Number=SeqID_148602
atgccacaggaaattcaatctagtgcgcaatgtgttgagtattttgctaggttttgggtggatcttagtcctttctatgatgttacatttcctggagtccatttggatttggaaaattttgatcctgatggtcttttccatgatgttagaatttga

SEQ ID NO: 31825 - DNA, 1812 bp, Glycine max
  Peptide Sequence Number=SeqID_148603
atgaagtttcttcattctagtcgtgtgattgaattaaaaggggatactgatttggagctgcattccattacatcattgcaattgcatcgcctagtctgcaaggatggagccagtgggttcttccatattgaagggtatcatttgtctgagcataagccttttttcatccctgttctcttagtcaagaaacaggatggcacgtggaggttttgcgtcgactatcgtgccctcaatgtgatcaccgtcaaggatcattttttgatccccaccatcgacgatttgctcgacgaattaggagcagctcaacttgcctttgagaatttgaagattgccatttccatagccccagtattgtctttaccgaatttttgtctacccattgtcctagaaacagacgcgtctgacactggcatgggtgctgttttgtctcaacagggtcatctaatcgccttcttcaacaaatcctttggtctgaaattgcttcatgactccacttacgttatggaattagctgccattactaccgctgtgaagaaatggcgaaaatgtctgttaggtcaccattttaccattctcagggatcatcaaagcttaaaggagttgatgatgcaggtggtacagacaccagaacaacaattgtacttagctcggctcattggctatgactattcaatacagtattattcaggcaagactaatatagttgtagatgccttgttaagaattccagaggtttccacaagcagattcttatttctttttgtgcctaacttcgcattcctaacagtgcttaagagcgcattagcacaacatatggacttcattcagttctggcaagctatcgacagttgcccaaatgaccacattgactgcgtgcttgcacaagactcaattttgcaacaaggtcacatttggttaccctcaaacttcaaactgattctgacactgcttgcagagtttcattcaatgcccacaagtggccacatgggtattatgaagacccttgcacgggttgctctgccccctgccagtgccgtcccggctgtggaggacctttccttggacttcatcgttggtttactagtgtactgcagacatactactattttagtcatcgttgattgcttttctaaaggaattcacttgggaatgctcccttcccattatactactcatacggtggccttacatttcatggaaattgttggcaagcttcatggtatgcccaagattttggtctcagactgtgacccattgtttattactaaattctggcaggaactattccaattaagtggaacaaaactgcgcataagttctgcgtactacctgcaatccaatggtcagaccaaagttcttaatcgagtcattgagcaataccttcgtgcttttgttcacaacaagccatcttcttggggaacctcaacaaatgatgtagttgacaacttcttaagtaatagggaagccgcttttgcagagctgaaaaagaagcttttgaaagcacaagaggttataaaggaatatgctgattccaaacgaagagaaatcaattttaagagtggcaattgggtaatggttaaattgcgtccctactggcagtcttcggtttctggaatcagcaccttatattccaagcttgaaaagaggttttacggaccattccaagttttggagcagattggcaagttctcagaagcaacctattcacctctacctctgcctcctgaaacaatcgataatcatcctgtcatctctcccttggccatcattagtacacgttgggactatgaatctactccacataagctaaag

SEQ ID NO: 31826 - DNA, 1695 bp, Glycine max
  Peptide Sequence Number=SeqID_148604
atggctcaagaaaatgctgcatgcaacaacgcaagcagtgcccctgacaacaactctgggggtggcgccaaaaaagtggaggaggtgaagccacatgctgtgcaagagcaattacctggagttcaatattgcatcaagagtcctcctccatggcgagaagcactgctattggggtttcagcattaccttctgactcttggcattaccgttctgattcctactatacttgttcctcaaatgggtggaggaaatgctgagaaggctagagtgattcagacacttatgtttgtttctggaataagcacatttcttcaatctttattcggaactcgacttccaattgtagttgttggttcatacacttacataatacctataatgtctattattcaagccagcagatataattcatacacagatccctatgagaggtttactcagataatgagagggattcaaggtgccttgatcataacttcatgtttccagatgactttgggatttttcggtttatggaggaatgctgttaggtttcttagtccactctgtgtagccccttatgtaactttcactggactcggtctctatcgtcttggtttccccatgtatcttaatcgttatattggcaccaagaagcctatatttgaccggtattcagtgctattcactgtttcaagtgcatggttatttgcactgtttctaacttcatgcactctgtataaccacaagccagaaagtacacagaatagttgccgcactgatcgtgctggacttatgagtgccgctccatgggtgtattttcctcgcttcttcccatgggggtctcctactttcaatgctggggaggcttttgctatgatggctgcttcttttgtttctctttttgagtatactggtacatgttatgccgtggcaagatatggaagtgccacaccagtgccaccatctgttatcagccgtggagctggatggatggtaggattcaccaaactttgcaagtctcccttgactcttgtgtacataaaagattggagtaagtactttgctcaatggcatgtttggttctataactggatgtacggcatcagtggttgctatcttaccttggaactctctttcccctgtatttttctgcttatgctttacttctatttcacagggaaaatgcagtgtcttggtagtattctagtgttggagatcctacatagagttgtaatatgcccaacaatagtggtatacgagaaaggcaaatttggagcattttttgcttcagtacctatgccaattatagcagcattatattgtgtgttattcggctatgtgtcttctgcgggtcttggttttctccaattctgtaacctcaacaatttcagaaccaaatttgtgttgggcttctcattcttcctaggcctctccataccacaatatttcacagaatattatcatgtgaagcaacatcatggagttcctagatggttcaatgatgttgtgactgtgatcttcatgtcccacacaacagttgctgccttggttgctttcgttttggatgtcacactgtcccgtgaagatgatgcggcacgtaaagccatcggtttgcagtggtgggaaaggttcagcttgtacagctcatgtgttaagaatgatgaattctattctttaccgtgcaaacttgataagttttttccacccatttaa

SEQ ID NO: 31827 - DNA, 502 bp, Glycine max
  Peptide Sequence Number=SeqID_148605
tgtatgcaaacaagatcccaaaagcctgagctgttagaagaacctgagatagaaaggcttcctcatagattgagaaaagagcagagagaaaagataatggttgaggctaaagatgctacacggacccttatggagtatctcacccatcacttaagggaaaccaacaacattcaactgtcagccttgcctcgaggggttactttggaattcaaacatgggttgtgtgacatgatcaaccaacctaacatcatcaaggaggacatcagcaaatacttctttgtgatgaagactaacaagctgcaaagggatgttggcaacttcactcaaagattgtcttctcacaataggataagccttgatgtttcatgtcaaggtaacttgacaatggagccaccagccgatgccattaagatcatagaggacatgtgcttcaatctctacaacaattctaggggtaggagaaacatgaagagggttgtcagccatgtggaggatgaagcag

SEQ ID NO: 31828 - DNA, 393 bp, Glycine max
  Peptide Sequence Number=SeqID_148606
atggagaatgtacctatcattgtgtattgtgatgatgaaatgacttcatcatctaaagagatattgtttgaatgtcctagtgattctaaagtcatcttaataagtgaggatatgtcacttgatgctttaaggaaaacaattatagacaccattggaggagatggttgtgttgaatacgagtgtatggagcttaaacgcgacgatgatgtaggaaaaatatttttcatcttttcaaattttagtagcaaaggtctaattgggttgaatgcaacttttagtcaatctccatatgaagtccttaccctgctgtgcaaaccaaggaaacccagatctgctgatgagatcattgctctgattgtaatacatctgtgtagtcatgtttgttctttataa

SEQ ID NO: 31829 - DNA, 2478 bp, Glycine max
  Peptide Sequence Number=SeqID_148607
atggctgaactctacaggctcagctccgtcgagtggagcccttctccggtcatcgctttagccaccagcttcgacggctcccgagtagccgccgctcgcaaagacggctccctcgaaatctggctcgtctctcccggctccatcggctggcactgtcagctgactatacacggaaaccctaacggaagagtgacgtcgcttatttggtgccccggtggccccgacggaagccgcttgttttcgtccaacatagatggctccgttactaagtgggatcttttccacttgacgcagaagacggtgctgccatcggacggtgtcacaatctggcaaatggcagggactttccctaagggtgacgagatcgatgataaaaggaagggtgaaagaatggggaatgggtttcatggttttgatgaacatgagagcagtgaaagtgatgacgattctgattcacctggttctcccgagctttcagttggtgagtatccacgcgtggcgattgctctcgacaatggatgtgtgaaaatttatgatatctccgacacagatgaatttattcatgtaaaatctatgccccgggtcaaagggcgagttttaagtgtgacttggagtacagattctaattacgtatattcaggaagtagtgatgggttgatacgatgctggaatgctacattgggcaatgaaatctataggattacagctggacttggagggttgggcagtggacatgaactttgcatatggtcattgctgtctttaaggtctggtacacttgttagtgcggacagcagtggtagtgtccagttttgggacagtcaacatggaactctcttgcaagcacatactttacacaagggacatgtacacgctctggcagcatctcctagtcataatagggtgttctctgctggttctgatggccaggttattctttacaagctatctagtagtcagtcagcatcatccgatgatatcaattctccatcaacaatgaagagatggatttatgttcactatgtaagggctcatacacatgacatcagggccctagctgttgctgtaccgataagtcacgaaggcatttggcatgttccgttccttagctgtgcatttttgtgtagcacagatattaagccagaaaagaggattaaaagagctcgacgtgcagaaaatcccattagtttccgttaccataagtgggctcatttgggggttcctatgcttatctcagctggagatgacacaaaactttttgcatacccagcgaaagaattcaccatgttttctcctcatgatatctgtcctgcgcctcagagaacacccattcaactagtgcataattctgtctttaaccaacgcaaactgcttttaatccaatcttcgcaaaagatagaggttcatttgctacaactaaaaaaggtctgcacctctggaggctttacaaagaacgatgtagtggctgaagtcaagagtaagggatctcggaagataatttgcagcaccatttctaattcaggggcactatttgcgtactctgatcataaaaagcctagtctttttcaattgaaaaggaatgaagttggaaaaatcaaatgggatgttagaaaaagggagcttcctcagatattaccatttggccattctatgatttttactcatgactcctccaagttgatagtagcaggtcacgataaaaggatatatgttgtgcatgttgggggggcagatgaagttaagtcagaattactgcatacttttacaccccttcgcgaatcacaagatcaagaattacctccaactgagccacccataacaagattgtttactagttctgatgggcagtggttggcagctgtgaactgctttggggatatatatgtatttaacttggagatactaagccagcactggttcatttcaagattggatggcgcctctgttacagctggtggctttcctccccagaacgacaatgtactgatagttacaacttcctcaaatcaagtgtatgcatttgacatagaggccaagcagttgggagaatggtccacaagacacacacatgctcttcctaggagataccttgaatttcctggtgaagttattgggctctcattccctccatcagaaacttcatcttctccatcggcaacttcatcttcggttgttgtttacagctccagggctatgtgcttgattgactttggattgcccgtggagcaagatgaaagtgatatgctaaatactaaagattcaagggcaaggaatttacaaaattttaatgttaagaagaggattgaagttatgaaggaacataataggaggaattttgaagttatacctttcgagaatcctgttttatttttaggtcatactgcaaaaaattccatctttatggttgacaaaccgtggttgcaagtggttaagagtttagaaggccgaccagtccacagacatatatatgggacatga

SEQ ID NO: 31830 - DNA, 603 bp, Glycine max
  Peptide Sequence Number=SeqID_148608
tccggcgttcaatgcagaacaaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcggtacttgcgatatttcggcttgggacgcattttatttggcagttttctggatgttaaataccattgggtgggttactttttattggcattggaaacacattacactatggcagggtaatgtttcacagtttaatgaatcttctacctatttgatgggatggttaagagattatctatggttgaactcttcacaacttatcaacggatataacccttttggtatgaatagtttatcagtctgggcatggatgttcttgtttggacatcttgtttgggctactggatttatagataaaccagtggctctttccattgtgcaagcaagattgggtgggactagcccacttttccgtag

SEQ ID NO: 31831 - DNA, 452 bp, Glycine max
  Peptide Sequence Number=SeqID_148609
atgttacagaacttcacggattgcgcaacaatgctttcttttaacttccggcatgtcgcggaacttcacggattgcctaaccatgggtgccaagtacctcgaaatggtcaaatgagggtttcatcccaacaacaagatggtccccagacgaaattagggtatgacaaaccccttaaggctagtatgcaagagaagactaactccataaagtgctttaaatttaaatgtcttggaagaaggcacattacttctcaatgccccaccaagaaaaccatgattatgaggggccaagacatttatagtagccaagatgagcttactacttcaccttcctctagtgaaagtgaagaagcaaaaggggaagaatctagtgaagaaatatacccccaagaaggaggacaacctttaatggttaaggaggagtgtaaggatctaagtgtctcctccaagag

SEQ ID NO: 31832 - DNA, 157 bp, Glycine max
  Peptide Sequence Number=SeqID_148610
atgagtggagaagaaggagtaagagacgttgagctcaagttattcatgaagtctgtccaagatcaaatgaagggttactacaagaatatggaaatagccatgattagagtcaatattgaggaagaccgtgaggcaactatggctaggttcattggag

SEQ ID NO: 31833 - DNA, 366 bp, Glycine max
  Peptide Sequence Number=SeqID_148611
atggaagcttgcttgtggagcttctatggaggctggatctttgagcttcaaagaggtccttcaatggtgattttgcaccatggagatgcagcggaagacaaaggagaagaggctaagtgcgcatccactgctaagcacagctttagcgcgcttagcgtgacagaagaatctgccagagcatcaatattagggccgcgcgctaagcgcaagatcagtgcgctaagtgcaacagttgtctttatccaggctcagcgcacgattggcgagaatcaccatcacacagagaagtcagagcccaccacagtgcctatttcgggaaacgaactctggaggcaacaagaggagcagctttacagagatacctag

SEQ ID NO: 31834 - DNA, 708 bp, Glycine max
  Peptide Sequence Number=SeqID_148612
atgcttcagagaatccgaaaagcgtggaatacattggaaagaaaagataaggtgcttaggggaagcagcaacgatatcatcggcggctatcttaagtggttgaaggctcagacgcaagggataacttggctcccaaagctaaagagtccaagtggggaagaagctaaagtccctaaggaaagcgaagaagtgcaagccttgaaagcagagcttgaaaggacaagagtggtcaaggaaaaactaaagacgacagtcaccagggtcaggaaagagtgtgacgagctaagggatgttaacatgaccacgatcgaagccaacaataagctcaagcttcaaagggccaaaaaggacgagtcaagggtggaaagtatgatattagaggataaattgaaggcttgtcaaaggtcaaagataagtttgaccgaacaactaagtaggacgaaagagaatatgttgtcaatcattgaccaatttaaagagaagctaaacctagctgctagccatgggcagagactagaggatgagcatgcaatggtatcagctctacaagtggaaagggaagcgagagagagggtgatagaatcattgcacggggaagctatgaaatggatggatagattcactctcattctgaatgggagtcaagagcttccaaggctgttagtcagagccaaggcaatggcagatgtatactcagctcctgaggaa

SEQ ID NO: 31835 - DNA, 849 bp, Glycine max
  Peptide Sequence Number=SeqID_148613
atgaacagatatctgcaacaacagaatcaaatgtggactcggttgcagactcagtacttctcatccagcgagtggactcggtcccagaacaaggtgttccccatgttcccggaggaggaaggggagggtcagtgggagaaagttgctgaggagatcatgaaacgctatcatcaagcattgtttcgtgatacgatccatactgagtcgactcgggttgagttgccagctgactcggatgactcgccggtggatgatgctaggtcgccaaagtctattaggagaagaaaagggaaatcctggaagccctggactgaacaagaacacaggttatttcttcttggactgaaaatatatggcaaaggagattggaaaaacatttcaaaacattgtgtcaagtcaagaactcatattcaagtagctagtcatgcccaaaaatatttccttcgcatgaaagttacgaaaaaagagagcaaaagaaaaagcatttatgacatagcattaaaggacaaacatacagaattgcagcgattgcaagcacaaaatcaagaacgtggaatgatgcagaagaattcactagatgactttgcaattgaatttgaaattttagttgaagatccctctgtaattgatgttgaaatagctcacattgaacttaccaagctacgcggagttaggaaagtagaccttgggaaaatagatttagttcaccatggaagagtcgaatgcaactaccacaatatatcaatagcttttcaatataatccatgcaacaatgaatgggtgcacttgggaaacttaaaaaggatcatcactaaaagacacattctaagagggtcagtgggcggctga

SEQ ID NO: 31836 - DNA, 162 bp, Glycine max
  Peptide Sequence Number=SeqID_148614
atggatgaaaaatgttaccaaatgcaaggaaaaaatcaggaaatgaatgaacatgcagtcaggtttgggtttaggcttaccttgcttgaggcagtcgatgaagcgggagacatggtgatgaatgacctgtctaatgctgaagtcgataatgatttggcatag

SEQ ID NO: 31837 - DNA, 294 bp, Glycine max
  Peptide Sequence Number=SeqID_148615
atggaaaaatccgacaagatgaatttcaaagagaagaaagaaaagaaaggatatatcacttgggaagataatgtcttaaattattcaagtgattcagagaagaaaatcataagtttgggtatcatgatgaaagactatgaaaatggagaagagcaaagtcgatacattgatagcaatttctccaaacacatggcatgcatcaaagtttattcatatttctccccaagaaaagtgaatatgcaatttatggagacaacaaacaaaggccacttgatcaacaaccccaacaagtaa

SEQ ID NO: 31838 - DNA, 174 bp, Glycine max
  Peptide Sequence Number=SeqID_148616
atgaaccagaaagtcaagtttgtggatcagaggcttcaagtttcagataaaacaatggcagcaataattgctactgagaggaagataaatgacactggatcaactgtcaaaacaagcaggccattagccagaattgtaactgcagaagcatactgggggttttctcatagctaa

SEQ ID NO: 31839 - DNA, 291 bp, Glycine max
  Peptide Sequence Number=SeqID_148617
atggatccgtggaaccctatatcaaatgtcattgagtcagttgattcgatgaaggacattgtgttctcagttcttagttctttgcagcaggctcaacaagctaactttgccacaatcttttggagcatttggagaaataggaacgaatctttgtggcaagaggtgaacacttccttttgtgactgggcacaaacaacaacttcagtggataagaggtttgttctccacactcctgggcctaactatataactgagcagccccccaatcagcttcatgaaatgcaatattga

SEQ ID NO: 31840 - DNA, 153 bp, Glycine max
  Peptide Sequence Number=SeqID_148618
atgcgtgacgagggaggcaggagagtgattgatcgactgagggaggagaatggtccaatgagggaggagagtgatcgagtgagggtcgacaaatcgagtgcgagtgcaagcgatagaggtaggcacacagatggtaaacgaagtacgacctag

SEQ ID NO: 31841 - DNA, 380 bp, Glycine max
  Peptide Sequence Number=SeqID_148619
atgatgaaagagaagaaagaattccctaaggaagagttctcaggctttagtggacttgggcatgtgtactcgcgcttagcgcgggtgcctgaattcgcgcttagcgcgcctattcctcacttaatgtcagtgcttgttttcgtgttgaacgcgtcttggattgacgaactgcctgtaactggtgtcgttactggtgatatgcgtgttgcctgtcaggccttattaggctacattccacctaataagtatatcaagggaaaattgatttatctaacttggttgtggcaaaattttcaagaacttattgttgatgttgatgatgttgtgattgcacaacatgctatagctcatatcatgatgctcataagcggatgtttgat

SEQ ID NO: 31842 - DNA, 2199 bp, Glycine max
  Peptide Sequence Number=SeqID_148620
atgggtgatgtttctatcaaggtagatgcattattgttcgaattgaagggaattgatatggtccttggtatggcatggctggcttctctgggaggaatatgggagaaatgcaagcacctaaatctgagaaaggatgcagtgagttgtaggagaaggaatttgaggctctacttaaacgatatgagcaagttttttaggaacctcaagggccctataaatgtgagactttatcgttatccgcatcaccagaaaaatgagagtgagaagcatgtgaaagaaatgctcaatattggaatcatcaagcccagccaaagcgccttttctagtcctgtgattttggtaaagaaaaaagatgttgcgtggaggatgtgtgtggactatcatgctatcaacaaggtaacaatacctgataaattcccaatcccaataattgatgaattattagatgaactacatggggcttatttcttttctaaattggaccttaaatcgggttatcaccaagtgcgggttaggcttgaagatatacataaaaacccttttagaacccatgagggtcacttcgaatacttagtgatgccttttggtttaatgaatgccccttctacttttcaatcgttgatgaatgaggttcatcaattggtggctaataaaaagaaatctttctttgcccaaaagtctgtggagtatttaggccacattatttccaagaatggggtagcaatggatcccaataaggttgctagtgtgctgcaatggcctatcccaaaaactgtaaaaggggtttgtggttttttaggattagcagggtactatcgaaaatttattaaggattatggcaagatggccaccacacctgtcttagcattgtctgatttcactaaggagtttgtcatagaaaatgatgcatcaagtttgggactaggagctattttgatgcaaggaggtaaacccatcacctatttcagcaaggcccttagcgaaaaaaatctgatcaaatcagcttatgagaaagaattaatggctgtcaaactgctaggttattactttgatcttgtgtacaaaccaggccttgaaaataaaggagaatatgcgttatcccgcatgtatgaagagggtcatttccagagtttagttcactgcccaacatggttggagtgcgacaaaatcattaacgagattggtgattttgaagacatctccttggatttcgatgttgttgcaagaattccatgccactcctcaaagaggccattcagacaaaaatacatggctactgctccagggggtttactccaacctcttaatgttccttaccaaggatttaaggccatcttagtggtcattgataggttgtccaagtatgcccactttattctccttaagcacccttataccgcaagggtagttgctgaaatttttattaaggaagtggagcgactgcatggtatccctgcatcaatactcagtaatagagacccaattttcgtaagtagtttttggaaagagttgtttaaattgcaagagacacagttgaagataagtattgcataccatcctcaaacagatgggcaaacgaaagtgattaatcgttgtttggagacttttctgcggtattttattttggatctgcctaaatcatggttgcagtggctgtcatgggttgagttctggtacaacactactttccatatctccataggcactacactgtttgaggcaatttatgggagacattctcctaagttaatctattttctactaggggaggttaaggtggaggttgtacgcagggaattacaagatagagatgaagtacttagacaattgaagtttcatttagctagagctcaaggacaaatgaaagttcaagcggataagaaacgaattgaccgcagttttgaagtagtgggtgcaatggcctaccgcctccagctgcctaaatctgctcatattcatcctgttgctaagaccatttccaaacaaggagaaactgttaataagttgttagttcagtggaaagggaaatcgattgaggaggccacttgggaagaagagtttgttattcgaagccagtttcctgagttcaaacttgaggacaagtttgctattcaagggggaggcaatgatgaggctctagataagagtatgggctcaaagaattccgttttctctgtaaggagtagtgctctggtataa

SEQ ID NO: 31843 - DNA, 1266 bp, Glycine max
  Peptide Sequence Number=SeqID_148621
atgcaattttttcagccatctaaggagagagaagatgagaatgcgaagattgaagaagctggtgtggatctgaaggtgatgattgaggaaatggaatccattgatgtgccttcagtgttcatctgcccaatctcccttgaaccaatgcaagaccctgtgaccctttgcactggtcaaacctacgacagatccaacatcctcaaatggttctcacttggccacaaaacatgtcccacaacaatgcaagagctttgggacgatgttgtcactcccaatagcaccctctcccacttgatgctcacttggttctctcaaaagtacttggccttgaagaagaagctcaaggatgttcaaggaagagccttggaaatcttgaacatgctcaagaaggtaaagggtcaagctagagttcgagcacttcaagatctaaggcaacttgtggcttctcatgtcaatgcaaggaaggcacttgaggaaaatggtggggttgctttggttttcaattttttgggtcctttcacttcccatgctgttgggtcagaagctattgggatcatagtgtgtttggatttgagttctgaagtgaagagaagtctcatgcatcctgctaaggtgtcattgttggtggatatcatgaatgagggaaccattgagaccaaaatgaactgtgccaagttgattgagatgttgttggtggaagggaacaatgagactgtttcaagtttgagtcttttagttgggttgttgaggctagtgagggataagaaacacccaaatggggtggtctcaattggtctcatactactcaagaaggctataatatgttcccatgaatcagttagaagctctttgataagcctaggagcaattcctctattgattgagcttttgcctagtttgaacaatgagtgtttggagaaagcactctacatacttgaggtgttgtcaacacttccagagggaagaatggctttgaaggagtgtccaaatatcattcccaatgtggtgaagttgctgatgagagtctcagagaggtgcacacaatttgcattgtcaatattgtgggctatttacaagcttgcccctgaagagtgtgcctccaaggctgtggaggctggattggcagcaaagcttctgttggtgattcagagtggctgcaaccctgtgttgaagcaaatgtcttctgagtttttgaaaatgtgcagtctgaattactcaactagcatcttggtttccaagtgtatgctcaccacaacaatacaatga

SEQ ID NO: 31844 - DNA, 1773 bp, Glycine max
  Peptide Sequence Number=SeqID_148622
atggttggtaatggccatgaaatcgaatgtcgtcgactctgtgaacaggttctggtgcacgttcaaggtcaagcattctcgatggacttttatgttctacctctttgtggtgccgatttggttctcggggtgcagtggttaaaatctttgggaccaatcttgacagactacaatgacctcaccatgaaattccttcgctccgatcgtgtggtcaagctcaaaggggataacaattctaagctttatgccatgagtccaccgcaacttcatcgattgatgcaaatagatggagctaatgaatttttccacattcatttgttggtcgctgagcttccttcgacccaaacacctccctctatttctgccattccaaaaatagcttcccttatcacacaaaagaaggatgagtcttggaggttctatgtggattatcaggccctcaatgtgatcaccatgaaagatcgtttctcgattcccatcattgacgagctactcgacgagctcagaggtgcatgttggttttccaagcttgatttactccagggctatcatcaaatcctcatggatgacgaggacattagcaaaactgcctttcaaacccatcacggtcgttttgagttccgagtgatgtcagttggcctatgcaacacatctttctcgtttcaggaacatgtcttgcatctggaaaagacattccaagtgctcatggaaggaagattctttctgaaattatccaaatgttcatttggtcagcagcaggtggagtatcttggtcacatggtttctgcacaagggttcaaaccaatccatgctaaggtgcaagcaatacaacaatggccttccccaaattcatttaaggctttacgcagctttttgggacttgcgaggttctatggccgcttcatccacggctatgcttccatagcagcaatctcggcagcccttgttctgctattgcccgattttttgattctattcgttttagaaatccatgcctcgaagattggtatgggtaccttcaacgcaaaactcctccaggcttcaatgtatgtccgggaattggccgccattactgctgccgttaagaaatggcgccagtatcttcttggtcaccacttcacaatcctgactgatcataaatgtctcaaggaacttatgacgcaaaccaacatggtagctgatgccctttcgcgaattcctcaagtcctttctggtgaactttttcttctctctatgcccaattttgagtttataaatgaactcaaacgtgaacttgctcgacatgcacaattcattgagctcagacagaacattatcgagcaacctcaacatcacaattattacaaactcacccaagactttattttaaaagagggacacatttggttgccatcgggcttcaaactcattccattgttgttgacaaaatttcattcgacccctaccggtggccacatgggcatcatgagaacaatggcagggctcagtgatagctttacttggtccaacatgaagaaagatgtacaggaattcattgtggcatgcttagattgtcaacatacgaagtatgagacaaataggtttacagggttgctctgccctttaccagtgccggcaaggccgtgggaggacctatccttagattttattgttgggctacctccatatcaaggctacaccacaatcttagtagttatgaatcgtttttctaaaggagtacatctaggaatgctttcctctcagtacactgtccacaatgtgggaagtccttag

SEQ ID NO: 31845 - DNA, 1122 bp, Glycine max
  Peptide Sequence Number=SeqID_148623
atgaagacctttcagttagcaaatgagtcttcttctctactttccttatctcctaaatttatcctcccagaagatgaaagaccacaactttcagaggttacttctctggactcaattcccataattgatttgagtgatcacagttatgatggtaataatcattcatcctcattggtggttcagaagatttcacaagcttgtgaggaatatggattctttcagatagtgaaccatggtattcctgaacaagtttgcaacaaaatgatgacagcaattactgacatctttaatctgcctccagagcaaacaggacagctctacacaacagatcataccaagaacacaaaactttacaactattaccttaatgtggagggtggagagaaggtgaaaatgtggagtgaatgtttcagtcattattggtaccctattgaggatatcattcatcttctgccacaagaaatagggactcaatatggggaggctttcagtgaatatgcaagggagattggttcattggtgagaaggcttctaggtttgttatcaatagggcttggaatagaagaggatttcttactgaaaatatttggggatcagcctagactaagagcacaagcaaatttctatccaccatgtccagatccagagttgaccttaggtcttcctgtgcatactgatttcaatgctctcacaattgttttgcagtcacaagtttctggtctccaagtgatcaaagatgggaaatggattgcagtacctgttattcccaatgcatttgttatcaacctgggagatcaaattcaggacaaactaaaggccttccagctggaagccattgtcttcagcatgtgcatgcacgttcacaggaccatggttcttagcaacggaagattcaaaagtgtacatcacagggctgttaccaacaaattgagtccacgggtgtcgatggcaatgttttatggcccaaacgtggacactacaattggcccaatccaggacttgatagatgaagaacaccctcccagataccgaaattatcgcttctctgagtttcttgaagaattcttcaaacaagaaggcacgaggaggatggttaaagaagtctttgagttgccatgttag

SEQ ID NO: 31846 - DNA, 315 bp, Glycine max
  Peptide Sequence Number=SeqID_148624
atggattgtacaagagtatcactagagttcacaagtataacacaatcttttttgttgctccggtccctcaagccttttagcatgctagttgatgaggtcttgcctaaaaaggagttgattgttggagcatgtaggaggccaaatttggctgtggttgaaaggaataagtttggcaatgcatttatgattgttgccaaacaacttggaaaagctaagttgtttcttcatccttcatggattgttttagattcttttgatgtgatgcccttcatgaaggggttgttgaagaatatgtcaagttttgaaatctactaa

SEQ ID NO: 31847 - DNA, 516 bp, Glycine max
  Peptide Sequence Number=SeqID_148625
atgttttcggggttggtggtggaagctgaaaaggtagggtgggatgagaggtgggaggggtgtatggtgtttgctaagggagggggttggtgtatcggctacgggaaatgtgatgaatgtcgcaaaatttctcttcatgtagtctggccaaaccaactacttgcgtcagagttagggatgctaaacacacttccaacgcctgaaggaacccagaccaagacaccagttgattgttgtgcaccagccactggaaccatgcgagcgtcaagccgtccattatctggttgcgccgaagaggaagaaggagatggaggtcgagactcgaggttagccaccttctgcaagagttcatcaagcttaagggtcatggaattttggttggctattaacaaaagttggttcgacgtaagttttgcaatagcttcctcaagacgatccatgtttgatttggaacttgttgattatgccatagtgctcaatgaaagcacccgaaatgatatgttctctagagtttga

SEQ ID NO: 31848 - DNA, 441 bp, Glycine max
  Peptide Sequence Number=SeqID_148626
atgacattgctacttaacaacattctgcccagcgaccgcaatgccaatctccccctgcaaaagtatcagatggtctgtgtcgtcccgacatggggatcgcacccacaaagacacccagtggacctgaaaaagtcaaacagggccctggggttttcagctctgggatcgcacctgcaagacacccagtggacccgaagaagtccaacagggtcttggagttgtcaagctctaattacgggtctctgtcagttctacggagtacctgtcacctccagcaagggcatcaggccccctactaatcgagctttcatcaagaagtactgcgcccccaggcaggcgcagggcgaaacaccacaacagcattgggatggccggcagcgggcaacagacgcaccgccatcacctctagagttcacctcagctcatccacaaaaaggttag

SEQ ID NO: 31849 - DNA, 141 bp, Glycine max
  Peptide Sequence Number=SeqID_148627
atggcgacttctagcgtgaggaatttagcaaatggtgaagttaggaaaattgaaagaatatcactgactactaaatataaaatcctcaactgtaacaaaattaacgaaaaatcaactgattcaaaaagggtcataaagtga

SEQ ID NO: 31850 - DNA, 441 bp, Glycine max
  Peptide Sequence Number=SeqID_148628
atgttcttccacgaagaagccgaagcggttcagtcctcatactttccggttctcgaaaccatgttcactccaagcgaaatagaggagctgttttccctcgttaacgaaccggccagcccggggtcggggtctggatccggttcgcagggttcgaaccgggcggtccggtcctcgcacgagagaaagcttaggcgaatgcagtcgaaccgggagtcggccaggcggtcccgctggagaaagaagcggcatttggagaacctcatgaaccaactgaaccggttgagaatggaaaaccagaaatatagaaaccggttattcttaaccatgcaccagaatcttctactctccctggagaatgaacgtcttagatccgaatccatgacccttatggctagactctcggatctctatcaaattttaggcaccatgatttcacagtag

SEQ ID NO: 31851 - DNA, 558 bp, Glycine max
  Peptide Sequence Number=SeqID_148629
atggtttcgcttcatccacatacactaacactagcgtgccctttgtccgtttcctcttcatcctcccgttttctcagatgctccgtaaattctgccccgaagcgaagaagaagcagcttcattactgcttcgtggcaagagctcgcgggagttttactattctccgcgattcctttcactgccgtgaaagctatagctaatagtccgctaggggagtcgcttcagaggaaaatggaggagagaaagacatttgctgtagaaaactcgtctacattcaaggccttagccggcaaggcccgaaaggagagttctccgacaaaaggggtggaatgtgttagacaacttagaaaagggaggatacagagatggggtagaggatggggtagaggcaggaaattagggattcttttgttcactggaattgacgccaatgactgggttaatcaggttgagaagtattttcagttgaaaaggatttcagatagggagaggatacaaatggttacaatcgcaatgaaaggacatgctctgtcatggtttcattggtgggattcttga

SEQ ID NO: 31852 - DNA, 222 bp, Glycine max
  Peptide Sequence Number=SeqID_148630
atgtctgttaatagtcctagagtgtggaagctcgaagaggcaaaatccactaggccagttgtcggatggcaaggggaccgttgcgcaacttcattgatcaatgaaggtgggcgccaagcgtctttgtgccaaacaatagaggtggattacgggactttatacccttgttccaaggaggaagtcatgaaagcgaggtcaatgtattcagactggttgtcctaa

SEQ ID NO: 31853 - DNA, 321 bp, Glycine max
  Peptide Sequence Number=SeqID_148631
atggctcggcttttggcagagaaggagagacgagaagctaccattgctactgcaatgacggttgtgaatgacgttggtggatcaaacacaccgatcaccccacaactgaacattaatgttgctgggaatacccccaactcccaaaagagggctcaaacggagattgggggactagattatatacatgtggattcaaaggaattggatgctcatccgattacattgaccagatctaatggtcaatccctgattgaggcaatggggggaaattggaatcctcaagagcttggtaatccacaaaatgagggcatttccttttag

SEQ ID NO: 31854 - DNA, 441 bp, Glycine max
  Peptide Sequence Number=SeqID_148632
atgaactcgagttcaccgataaagtgcgatgaacgctttcgggaagaaagaaatagggcattcatttcaaagtggctaagaagaccgttgagagtatatgaaaactttgatttgtcattggagggactaaaatctttctttgagaatgccaaggaacattatggcataaatacagtacgtgccacacagagtttgggtttaaatggggatgtcgtccaaaacaaggatcagaatgcatggttcacaagaaagaaaaaacagaagctgaacaagtctggtaatggagatgggagagaaacatcagtgattgagaataacatctcttttcccacactaacctctccagatcttattgagagtcagccatcagctcaaaagaatagtaacacatacaattgtaaatatctccctcaatgcagtaatcagacagagccaaggtaa

SEQ ID NO: 31855 - DNA, 402 bp, Glycine max
  Peptide Sequence Number=SeqID_148633
atgacgacgctgggattaggctgtctcctttcgctgattacaatgattgtggagactctgaccctcaagcatatattgggcattcacatagctcagtcattgagtcaactgggcattctctatattcacttgattgagccaaggatgcaccaattaggaaggccttcaaagacgggacttttattgtggctggtggctaggataggactgagggatcgaaatgaagccatatccactggtgctgcccatttggtcgcttatggccgcctttttctggctaataatccagatctccccacaagatttcacctcgatgctcacttaaaccaacccgatgtcaccaccttttacacacatcatcctgtgctttcttcaacccaaccccaagtaatgttattatga

SEQ ID NO: 31856 - DNA, 1200 bp, Glycine max
  Peptide Sequence Number=SeqID_148634
atgaatcaggggaatctaggcgagttaatcagaatgcacttgagcgagaacgaagggatagaggggaagaccttcgtggtcaccggtggactgggattcgtgggatctggtctctgcttggagctcatacgtagaggtgccgtagaggtgcgagcctttgacctccgcctctcttctccttggtcgcgtcctctcaaggacaagggagtcctctgcatccaaggggatgttgcccgcaaagaagacgtggaaagggcccttcgcggtgccgactgtgtattccaccttgcggccttcggaatgtcaggcaaagagatgctccaatttggtcgcgtcgatgaagtcaacattaatggtacttgccatgttatcgacgcttgcctctacctcggcatcaaaaggcttgtctactgtagcacatgcaatgttgtctttggcggtcaacagatcatcaatgggaatgagacattgccctatttcccaattgatcaccatgtcgatccttatggccgcagcaaatctattgctgaacagttggttcttaagaacaatgcccgcactctcaagagcgattcctccgggaatcatcgtctttacacttgtgctgttcgtccagctgcaatctatggaccgggtgaagacagacaccttccaaggatcgtaaccatggcaaggttgggtctccttttgttcagaattggcgaccaaactgtaaaatcagattggatttttgtggataaccttgtccttgctcttatattggcgagtatgggacttttggatgacaatcttagcaagggaaaacgccctgtagctgctggccaggcctactttatatctgatggctcaccggtcaattcttttgaattcctgcagcctctacttaggagtttgggttatgaactgccaaagacttccctaccagtcgaacgtgctcttgttctcgggaggatttgctgggctgtttatacaatcctatatccatggctcaatcggtggtggcttccacagccattcatcctcccctctgaagttcacaaggtgggagtgacccattatttctcttatcttaaagccaaagaggagattggctatgctcccatggtgacctctcgagaggggatggctttgaccatatcttactggcaagagaggaaacggacaactctggatggaccgacaatctatgcgtgttgtttt

SEQ ID NO: 31857 - DNA, 1731 bp, Glycine max
  Peptide Sequence Number=SeqID_148635
atggatccctacaagaatcggccatcaagcgccttcaattctcccttctggactacaaattccggtgctcccatctggaacaataactcatcgctgactgttggatctagaggtccaattctgctggaggattaccatctggtggagaagcttgcaaactttgacagggaacggatccccgaacgtgttgtccacgctcgtggagctagcgcaaagggtttctttgaagtcacgcatgacatttctcacctcacatgtgccgatttccttcgagcccctggagttcagacccccctcatcgtccgtttctccactgttatccacgagcgtggcagccccgaaaccctcagggatcccagaggttttgctgtcaaattctacaccagagagggtaacttcgaccttgtgggaaacaacttccctgtcttcttcgtccgcgatggcctcaagtttcctgacatggttcatgccctcaaacccaaccccaagtcccacatccaggagaattggaggatcctcgatttcttctcccaccatcccgaaagccttcacatgttctccttcttattcgacgacgttggtatccctcaagattacaggcatatggatggcttcggtgtcaacacctacacccttatcaacaaggccggcaaagcactctatgtcaaatttcattggaagaccacctctggcgaaaagtctcttttggacgacgaggccatcagggttggaggatccaaccacagtcatgccacccaggacctttacgattcaattgctgctggaaactatcctgagtggaaactctacatccaaacattggatcccgaaaacgaagacaggcttgactttgacccccttgatgttactaagacctggcccgaggacgttttgcccctccagcctgttggccgcatggtcttgaataagaacattgataacttctttgccgagaatgaacaacttgcattttgccctgccattattgtacctggtgtatactactccgatgataaattgcttcaaactcgcgtattctcctatgctgatacccagagacacagacttggaccaaattatctgcagcttcctgctaatgcccctaagtgtgcccatcacaacaatcaccatgatggtttcatgaatttcatgcacagggatgaagaggtcaattacttcccttcaaggtatgatcctgtccgtcatgcggaaaaggtccccgttcctcctcgtatcctaggtgggaagcgtgaaaagtgcatgattgagaaggagaacaacttcaagcaacctggggagagataccgatcctggccctctgacaggcaagaaaggtttgtccgccgatgggttgatgctttgtctgacccacgtgtcacccatgaaatccgtagcatctggatatcatactggtctcaggatttggagaaactttgtgggagtgaggtggacaatccatggtttgaagagaatactgtatggaagattggaagaggagacaagtgtagattttggaaagatgtatgggttaatggaaatagtttagcaaacttatttccgagattgtacctaatctcggagcaaaaagaggagcttatagaagttatgggatgttggagggggccttttgagtgggaaagtggccttattcaacaagtaaaagctctggtggagactatcttagtaaacaaagacgaatcagattactggaagtggtcaagatgcggttag

SEQ ID NO: 31858 - DNA, 2127 bp, Glycine max
  Peptide Sequence Number=SeqID_148636
atggcgggtcagtcctccaatgaaggctccagtactggaaacatttcagcagaatgttcagattcaactgttcagctcaatatcaagactctagattcccgcatctacagttttcaagtggacaaaaatatgcccgtctcgttgttcaaagagaaaattgcaaatgaaattggtgttccagttaatcagcaacggctgatatttagaggaaaagtcttaaaggatgagcacgctctttctgagtattgtatccttcaaattgcttctggtacgagttctggtgagtcaactggtacaagtggtaaccgaggaaatgatgtaggctcaggggctcctcgtaatcatgttgggcaaatttcacacagtgttgttcttggaacatttaatgtgggcgaacaaggtgaaggaattgttcatgatctcactcgggtcttggcaataatggttattgggcatgttttaaactctattggaaacggtggccagagcacacttagtggtcctaatgctacacaaacttcttcagttcacccatggaatgaaactgaaggaatgcatgctggaaatcaaaactcagcaggaaatcaggcaccatctggacagacatttcatggcccaacagttcaatctgtctctcatgttgttcagattcctgtggcagcaggggccatacccattccttctctcaatgcaccaattcctgattcattgaacacactgtctgagtttatgaatcgcatggaacagacactaacacaaaatggttatcaatcaaatctttcatccgctaaccctggagatcagcaagcggaattgccttctaatgcacaagggttgccaacacttgaagcattaagcactgtcttgcattccgcagaacggttacttggtggtcaagctgttgctgcactatctggtgctgaagtatggagatggacatcctttgtatcttttagtctgaacatacttttagaaggtttgcacttcacaacgcatattgcagggcgcttggaaagagaaggaacttctgctgatctgcgcgtaagggatcaaatacaatcagagtcagtgcaaataggacttgctatgcagcatttgggtgcacttctacttgaacttggccgaacaatgttgacactgcgtatgggacagtcttctgcagaatctgttgttaacactggaccagcagtttacatctctccatcagggccaaatccaataatggtgcagccttttccattacagacaagctccctctttggtggtccagttcccccctcaactcctgcaactttaggcaccattggtattggaaatgctcctaggaacgtaaacattcatatacatgctggtacctctcttgcacctattgtttcagccattggttctggggcaaataatggagaggggacaagaagtgaacaccgtaatgagcctggctctggtgattcaggttcaacacgggtattacctgttagaaatgtcatagcagcaactatcccatcacaccctcctggtgttggaatctctagtagcacacaaactgggtttggtattcctacttcacagccaccttctgattcagcttcattgtcatctgttttagcagaaatcaattctcgccttagaaacgttgttggtaatatgcatggagataacacagttccatctggtcaaatggaatcaaacagcagggacttgccttctggatctgaatcaagacctgctacagtaaatgaacagcgagataccatggacatgaatggttttggggctactagtgcttcctcagttggctgcacttctgaaagtgaagtacaaaagctccaaactaaggcagtccaaacctctagtaatgatgagagagatgttttggttgacaaatttgtttcaagttcttccaaccaagatttacgaagttgttctagtggagaaacaatagtaaaaccagaaaaagaacaagatgttccggctgtaagtgaaagacaaaatgtaactgaacctgccaaagctgctccgctaggattgggtgtgggtggtttagagcgcaagcaccacctatgtgagtattgtactcagttaagtgagttagagtgtggttttgacagctggcaactaactgattag

SEQ ID NO: 31859 - DNA, 184 bp, Glycine max
  Peptide Sequence Number=SeqID_148637
acaaaaaggaagcactgagtgcgactattacgtcatgcactggatgtccatgataatcttaggaaatttcaggaataattgggaagtgtattttgatgatgttagaccattgaaagcaaagagattgaaggcgcttcgcatccaatgggctaaattttatctgaaagttagaaatgaaagttag

SEQ ID NO: 31860 - DNA, 273 bp, Glycine max
  Peptide Sequence Number=SeqID_148638
atgacgctcaacatagcggctttggctgtgttgtgtatttctgtctttggcatcgctgtggtggctgaagatccatataggttcttcacctggaatgttacatacggagacatttatccacttggtgttcgccaacagggaatacttatcaacggtcaattcccaggtccagacattcattctgttaccaacgacaacctcatcatcaatgtcttcaacagcttggaccagccatttctcctctcctggtacttactttacattttcaattaa

SEQ ID NO: 31861 - DNA, 345 bp, Glycine max
  Peptide Sequence Number=SeqID_148639
atgaaggcacaggccatccagaagcagaatactgccccccacgttttgtctcgtgggggttatgattatttggagcagaagctcctggctgagaagacgaagaagaagctggaggaagctgcacagtcaggaagcgttgatggtgtcatcgacccttcatcaccggtcagacgccacgtgaagtggaagatggcccacatgaagaagacaggggaggggagacgacgactgaggctgcaaaggaaatcgctgagaagattgatttatttgaggagcaggccacacagggatcgttcgtcccccatggacgttaggatgttctcgccgctactattcgacgtctag

SEQ ID NO: 31862 - DNA, 330 bp, Glycine max
  Peptide Sequence Number=SeqID_148640
atgattaaagttgttttgcaggtcattcccacctatgatatgagtgtctatctcttggcgaagttaactatgaaggaacttcaacgtatgagacttcaggtcctactgctgcctctattggatgaatttgaagaggataaaagaatttggaagttttccacagatggattatactcagtgaagtcgacttacagactcgttatggatcgtttggagaccagggaattttataatggcccaaattggatggctgggagcaaactttcaactgcaaacttgatctgtgagcccgccaactacccatttaacccacttatgtcttatgtataa

SEQ ID NO: 31863 - DNA, 635 bp, Glycine max
  Peptide Sequence Number=SeqID_148641
ctgtccctcctgttcagttactgacggggtggtgcgtaacggcaaaagcaccgccggacatcagcgctggcaagtgtagcggtcacgctgcgcgtaaccaccacacccgccgcgcttactgcgccgctacagggcgcgtcccattcgccattcaggctgcgcaactgttgggaagggcgatcggtgcgggcctcttcgctattacaccagctggcgaaagggggatgtgctgcaaggcgattaagttgggtaacgccagggttttcccagtcacgacgttactcgatcgtggaggatggatgaatgagaagctattcatggggctcgggataagatttgaggggtggaggatagaggaacaacgcttggcaatcaactcgtggggctccagactcaatggtggaggatgcatgaatgataagcatttcatggggctcctgataagatttgaggggtggagtattgacgaacaacacatggcaatcaattcatggggctccagactcgatggtgaaggatgcataaaagacaaccaattcatggggctccgaataagatttaagggtggaggatatacgaacagccctaggcaatcaattctcggcgctccagactcgatggcggaggatgcatga

SEQ ID NO: 31864 - DNA, 600 bp, Glycine max
  Peptide Sequence Number=SeqID_148642
atggtttacttactctatgatgatcatagcttacataacaacaaatggggctcaactcattctagtgaacaactgtggggaaagtgtatggccagggatacttggcggtgcggggcagcaaacaccaaaagatggtgggatgcatcttggaagtggaaagaagtagtccgtgccagagaagtggtcaggaagaatctggggcaggcaggagggcaaggaggggtgccaccagcaacagtggttgaaatgacacttggatcctcctcctccccgttgcacttctatgatctgagcctggtggatggcttcaacttgctcgattcgatgaagccagtcgggggtggagttgggtgtggagtggcttcctgtgaggtggacttgaatgtttgttgtccatcagcacttgaggtgaagataaatggcaaggttgtggggtgcaagagtgcttgcttggctatgcaatcagcaaagtattgctgcacaaggagttattctgaccccaaaacttgcaagcctaccctttttaatcatctatttaaggctatatgtcctaaggcttacagttatgcttatgatgactctagcagccttaacagatga

SEQ ID NO: 31865 - DNA, 189 bp, Glycine max
  Peptide Sequence Number=SeqID_148643
atgagtctcaatgtagatgatgatgagttagtgagtgaaatggatgaagcacccagttttgcttcatctctaccagtccccaatgttcaagaaatggtccctgtcattgatttagcactgctttcaaatggaaacaaagaggagttgttgaaattggacgtagcatgcaaagagtggggcttctttcag

SEQ ID NO: 31866 - DNA, 411 bp, Glycine max
  Peptide Sequence Number=SeqID_148644
atggcaggcaccatgttttctgttttacagtcagaaaaaggggttaatgagtttgaaatctgccacaaaaagttcaaagtttatgttttacaaaccaagcccattgtcgagactattcaagaactcatcgacgaactcgagtgtgagttcaacccttctgtgactcttcaaaccctactggctcgacaccatggctccgtgaagccaaataaggcctctatccttaaagggagtgagtgtgagattgggcttgataagagcttcggcttcaccaaccacttccatgctcactttgagcttaggcccaaggttggggtgacaccgaagaggggtctcatgaacaaaatcaaagacgaggtaggaaggggtctcatggtcagggtagaaggatggggaagggcttttttctag

SEQ ID NO: 31867 - DNA, 141 bp, Glycine max
  Peptide Sequence Number=SeqID_148645
atggcaacattcttggactatttttcttccgttccaggtgccaagaggttaccaagggctcagccagctcagaacccagctgggatggtacttgttgatagacccgccgaaggaactagggctgcatcatgttgttcataa

SEQ ID NO: 31868 - DNA, 769 bp, Glycine max
  Peptide Sequence Number=SeqID_148646
atgacaggtttatttattgtactaacttgccttgcctattttcctcccttgtgtttggctctggaatttcaagctgttattaaaaccagaacaatttttatgcctacagaccaacaagcaaaaatttataaccaaattattcaggctgtcaataaaaatgaaggtgagatgtttttcttatatggatatggaggagcaggaaaaacatttatttggaaaacacttgcagcctcattaagagctgacaataaaatagttattatggttgcttctagcggcatagcttctttattattgcctggaggaaaaacaacacattcaaaattaaaaattcctgttccgatatttgaagactcgacatgcaatattcatcaagaaacacaattggctgaattattgaatgaagcaagtcttatcatctgggatgaagcccccatggctcacaaattctgttttgaagcacttgatcaaagtctaagagatgttattaaggcgaaatcaagttctgataaaatctttggtggtaaagttatggtatttggtggagatttccggcagattctgccagtcattcctaggggtagccggtctgacattcttaatgcaactataaattcatcttatctatggaatcattgccatgttttgacactgtcgaaaaacatgcgtttagaagccaatatagatgcaacagacagagaagaaacttcagcttttgcacagtggatccttgatattggtgatgggattgttaggcagcaaaatgatg

SEQ ID NO: 31869 - DNA, 663 bp, Glycine max
  Peptide Sequence Number=SeqID_148647
ctacacgtcgtcgccttcagaggactacacgtccttcctttcagaggactacacgtcatcgccttcagagggatacacgtcctctctttcagaggaagacacatcctcgccgtcataggaatacacgtcctccccttcaaaggactacacgtactcgctttcagaggactacacgtcatcgccttcatagggctacacgcccttgccttcatagggctacacgtcctcgccttcagaggattgcacgtcctcgccttcagaggactacacgtgctcagcttcagaggactacacgtcctcgccttcagatggctacacgccttcacctttagagcacaacaaatcctcaccttcagaggaccagatgtcctcgccttcagagggctacacgccctcgcccgacttcagaggactacacgttctcgcattcaaaggactacacatcctcgccttcagatggctacacgccctcaccatcaaaaggctacacgccctcgccttgctttcagaggacaacacatcctcgccttcagaggactacacgtccttgcgtttagaggactacacgtccctgccttcagagggctacacgtccccgctttcagaggactacacgtcctcgcctttagaggactacacgtccttgcctttagaggactacac

SEQ ID NO: 31870 - DNA, 234 bp, Glycine max
  Peptide Sequence Number=SeqID_148648
atgtggagaacattgttggagtggaagtgcatatttcataatgacagcttctacaattttttttttgtttgtgtgctggaaggtgccactcataattcaatcaaggttgctcaatggatgctccaagttcctggtgcaacaagttacatgggtggcataggaaaggataagtttggggaagagatgaagaagaactcaaagcttgctggtgtaaatgtaggtttaatcttatga

SEQ ID NO: 31871 - DNA, 2607 bp, Glycine max
  Peptide Sequence Number=SeqID_148649
atggaggcgaatagactcacttggcacgaagatccttggtcaggccacgaggaaggttgttgtcattgcccttcgctttcttgcaattggttcagcgaaagccaagaagttccgcatagggttcgtcctttgagggaatgggatcgaagtagagttgaccggagcgattctgaagatggcccagaattcaaattcagcggttgggccgcgatccgcgagggcatttccgtcaatttgaaaaattcaaatgaagtaaaagagaaaagggtcgtagcagagcccgctctatccatcaggaaggcaaaaatggagaagatctgcgtcgccgttcgtcttcgccctcaggtttcccaagactcttcctcttcctctgtcggaaccttctggaaggtcgaagataaccgcatctctcttcacaagatccatggcactccactctccgcttcttcttacgctttcgatcacatattcgacgaaagaagcagcaatggtagtgtctacgagctcctcgccaaggatatcattcacgccgcgctcaacggcttcaacggaactgcatttgcgtatgggcagaccagtagtggcaagactttcaccatgaatggctctgaaactgacgcaggagtgattcctcgcgcagttagagacatatttgcaacaattgagatgatgtctgatcgggagtttctcatacgagtttcatacatggagatctacaacgaagaaattaatgaccttcttgttgttgaaaaccagaaattgcaaattcatgagagtttggagcgtggggtatttgttgcagggctgaaagaggaaatagtaaataatgctgaacaagtgctgaatctcattaaagcaggggaagttaacagacactttggtgagactaatatgaatgtaaggagtagcagatcgcacacaatatttagaatggtgattgaaagcaaaggaaaggattccaattcttccaatgattgttcaattaacgatgttgttcgagtttcagtattgaatttagtagatctagctggttccgaaaggattgctaagactggagctgatggagtacgtttaaaagaaggaaaatatattaacaagagcttgatggttttgggaaacgttattaacaaactaagtgagggttcaaagcaaagggggcatatcccgtatcgtgatagtaaattaactcgtatactccaacctgctcttggtggtaatgccaaaacgtccattatttgcaccatagcaccagaagagattcacattgaagaaacaaggggaactcttcagtttgctagtagagccaagcgcatcacaaattgcgttcaagtgaatgagtccatatttggccaagcccgtgtcttgacagttggaattttacagatattgacggaagcagccttgttaaaacggcaacaattagagatagaggagctacgtaagaagcttcagggatcccatgctgaggtgctcgagcaagagattcttaaactcaggaatgatttgctcaagtatgaaatggagcgtgggaagcttgaaatggaactgcaagaggagaggaaatcacgtgatcaatggattagggagcaacggatgaaaattgaaaattcttgcactactaaatctttctcagattgtaggacaaacgacagtcagggaccaggattttttagacgcggatttatggaagagtacagtgacattagtagtagtatatctcaaggagatattttcaaatctcctaaggtagatcccagtgcttttgtagccaggcgatcaaagtattcaacattgccagatcacagcccccttccagatgctttcggtaatgtggctgatgaagatatgtgggtgaaaatgaacaacggttatgttgcagatcttgattcccttcaaactactcctcccaccaaccgaaaagttcagccattcccgacaagtgatgcaactgctggttgtacaagtgaaattgagaagtatgaacgagaggttctagatctgaggaaacaactggaactagctaaagaaagaataaatgaactcgcgcaaaatcattcagaagaagtgccatcaagcaagcaattattagttgagacaccaaaacatcaacaagaaacacgactaactcatgaattacctctgaggttatctgaatctgtgggaaacttcaaagatagctttgaggaggctttgtcagtaatgcagagatttgcatcggatggcacattatcaactgcgaagatactttcaaccatgagtgaaattggagatcatctatttgcaactttggaaggtcattttgcagtgaatacgggtggtgaaaggtcttccactgggaacggtactctaatcaatgaacaacaaaaagtgttttgtgagaggattgataacataattacatcactggagttatccgaaagctcaataacagaaggacaggagtggaaacataagtgcagctgtgaacccaagggcttatgtcttttgtcagaactccattgccttagtacaatagtaactgaagccttaacttgcacttgtctctataagagtcgacttgcttcatgcttgtcctattcatatgaattgtcagtacctccaaagtga

SEQ ID NO: 31872 - DNA, 501 bp, Glycine max
  Peptide Sequence Number=SeqID_148650
atggcttccactccttccagttcagttcctcaatcatttcccaattttgtggctgaaaaacttgatgattccaactatcttcactggcgtcaacacgttaaaccgattattaagtcacacagattgcaacgtttcgtggttaatccgattattcctcctcgttatctcacggaggatgatcgtgttgctgatcgtatcaaccctgattatgaagcctgggaggtccaagatgaaatgctcctgttactcttgaacggcaaaacaattgaagagtacttgagaaaaatcaaagggtttgtggatgaacttgctggtgttggtgttcctgttcgtcacgaggaatatgttgacgcgctacttgaaggacagcctcggattatgcgtcagtggtttctgttatcgaaaacaaaaagcaaactctgtccatcgcagagattgaagcgttactctacgaacatgaaactcgactcatgcgctacaacaaagaagcacaagtgttga

SEQ ID NO: 31873 - DNA, 1089 bp, Glycine max
  Peptide Sequence Number=SeqID_148651
atggcttcagcaacacccaaaccacaaaaaagactagcagaatttctcgatgaggagcaagaacctttcctcctaggggtttacctttcagaaagtgagtattcaaaagggtggagtttggatggagattcaagcaacacagagaaatcaaccaaatctggcttaaacaaaaggaaaaagggtcaactcccattttgccaagttctaaaagctatatataacaagcttggtttccacaatgaaagcaaaaatagtctaaccaaatttcatgaccaaagaaccaaacatgaagaaggtgctcctgaacctagccaggtcaatgatattgttcagttttcatcagatagattctctactatgttcaattcatgccaagatattgatgaagaggttccctccatattatcacataaagaccagcacttgttttattctcacactttatgcaacatgggaccccagagaaggaagcggcggagattcatagaaggtggccatgaattactgaggaagattcctgtacgaagagctccaaatgtgagtgaggaagttaggagaatgcaacagagaatacgaagtggtggtgttattctaccaaagaaaatcagagaggactcactgttatcagcagcaatctggagtagtttacttgatcagtcaataaataaagggaattgttgtactagggagttgggagtgctttttcctgggactagtgatgtttcccagatattgaaatccaaaagggtgttgcataggataaagaagatgctgtttgattgtgtgaaagatattgccataacccttccaacacaagacgacagaaagaaaggtaacagaaaattcatggggcctctacagattggaaaggtccttcctcagagaacaaaaaaatggggccaacaagttggctatggagaaaacctcacctacttactcactttggattacttgaactcaatcatggaatggagaaggttcgaaccgcacgtgaagggcatcagcgttgagatcactgatgcaattttggatagcatccacaatgagattgtgttagaaatgataggaactttcacacgaaatagataa

SEQ ID NO: 31874 - DNA, 591 bp, Glycine max
  Peptide Sequence Number=SeqID_148652
atggctctagataccatgttgaataaactgagagagagaagaaagagaaaacttgttgaacaaaaaggcggaccagttcaggccagactttatgtaggccaggtcgtaggctcctgtaggcaggctaaaaaggagaaagaaagagaagagaaacggaaggagaaggaaaaaaaagaaaaggatagagaacgtgaaaaagataagtctaaggaacgtaataagaaggatgaaacagatagtgataatcaagacatggctgacagccatggttacaaagaggagaagaaaaaagaaaaggataaagaaaggaaacatcggaaaaggcatcagagcagtatagatgatgtggattctgaaaaggaagagaaggaagaatctaaaaaatcacgaaggcatggcagtgaacgcaagaagtctcggaaggcatctgaaatatgtgggactataatcttgcagcatgcaaactctcctgaatcagacaatgaaaaccggcatagaagacacaagagggaccactgggatggttccaggaaaactggggggcatgaggaacttgaagacggggagctcggggatgatgctgagaactag

SEQ ID NO: 31875 - DNA, 2447 bp, Glycine max
  Peptide Sequence Number=SeqID_148653
tcactcaagctcagcaagggcaaccatttgttccaatgaattcacaacaatttgggcctgcaggacatgctattccttcttcaaatgcggggatgcctgtcattcaaggtcagcaattgcagtattctcaaccaatgcagcagttgactcagagaccaatgcagcctggtcatcctgctccttcatcacaagctatacctatgcaatatattcagacaaaccggccactgacatccattccaccacattcacagcaaaatgttccccctttaagcaatcatatgcctggcttggctgtttcagtagcagctcctcattcttcatatttcacactatcttatggtcagcagcaagataatgcaaatgcattggctcaataccagcatccacctcaaatgtttgctcctccttctggtcaaccttggccatcctctgcatctcagagtgctgtggctgttacatctgtgcagccggctggggtgcaatcatctggtgctacatcgactgatgcgagagctgatgcatcaactgtttggaaggaattcacttcttccgaaggaagaaagtattattataacaaggttactcagcaatcaacatggtcaataccagaggaacttaagttggctcgtgagcaggcacagaatgctgcaaaccagggaatgcagtcagaaacaagtgatacatgcaatgctgtagtctcctccacagaaacaccaacaccaacagcagctaatgcagctagcttgaacacttccttgacatcaaatgggcttgcttccagcccgtcttctgtcacaccaattgcagcaactgattctcaacggttggtttctggattatctgggacctctgtttcccattctatggctaccccaagcaccacaggggtagaaccaagcactgtggtaactacgagtgctgcacctacaatagttgccggaagctctggactagctgagaattcacctcaacaacccaaaatgccacccgttgttgaaaatcaagcatctcaagattttgcttctgcaaatggatcttctcttcaagatatcgaggaagccaaaagaccattgcctgtggttggaaaaaataatgtgactccacctgaagagaaaaccaatgacgatgaaaccttggtatatgcaaataaactggaagcaaaaaatgcatttaaagcgcttttggaatctgtgagtgttcagtctgattggacatgggaacaggcaatgagagaaattatcaatgacaaaagatataatgcactaaaaactcttggtgagcgaaaacaggcttttaatgagtatttgggccaaaggaagaagctggaggctgaagagaggcgcatgaagcagaaaagagcccgtgaagaattcacaaagatgttggaggagtgcaaggaacttacatcatccatgaggtggagcaaagctattagtatgtttgaaaatgatgaacgattcaatgctgttgaaagaccaagggaccgagaagatttatttgaaagctacatggtggaacttgagaggaaggaaaaggaaaatgctgcagaggaacaccgccagaatatagcagaatatagaaaatttctggagtcctgtgactatgtgaaggtgaatagcccttggcgaaaaatccaagatcggttagaggatgatgatagatacttgcgacttgaaaaaattgaccgcttgctagttttccaggactatattcgggacttggagaaagaagaagaggaacaaaaaagaatacagaaggatcgaattcgtcggggtgaaaggaaaaaccgtgatgcatttcgcaagttgcttggagaacatgtttctgctggaattcttactgctaaaactcaatggcgagaatattgcttgaaggttagggatttacctcaatatcaagctgttgcgtcaaatacctctggttccactccaaaagatttgtttgaggatgttgctgaggatcttgaaaaacagtatcatgaagacaagacgctcataaaagatacagttaagtcaggcaagatcactgtagtgactacatcagtatttgaggagtttaaggtcgctgtcttggaaggagctgcatgccaaacaatatctgagatcaatttgaagcttatattcgaagagttgttagagagagctaaggagaaggaggagaaagaagccaagaagcgccaacgccttgctgatgactttactaacctgttatatacattcaaggatattacaacttcctcaaaatgggaggattgcaagtcactttttgaggagactcaagagtacaggtcaattggagacgaaagctatagtagagaaatttttgaggaatacatcacatacttgaaggaaaaagctaaagagaaggatcgcaagcgtgaagaggaaaagacaatctggtttcctaagcctttgcactgtgtaatgatctggtttagtcattga

SEQ ID NO: 31876 - DNA, 518 bp, Glycine max
  Peptide Sequence Number=SeqID_148654
atgccaactgccatccttcttcttcaccaacagtaccaaagtgggggtatcggtctggaagaggtgagagtatttcaagaggaattggtggatagcaggaagtgggtggtgttgcgtgagggtgatggagaaagaacgaccgacatggtggaactgcatggtcagtgtgtcgtagttggtgacaacaggtccaagttgtttcagccattgaatgccgagagcaatgttggctccactgatgggaaggacggtgtcgttactgacagtgacctgaagaggaatggcaatgatggtgaacagactcgtacaggcgaagggcttccgggtagtaatactggaaagggcgttgaagctaatgaggacgtgggcgaggttaggagaaggtgggataggtggttcggtactagaggtttcaagtgcacaagccttattcgtgtttgcgagttgggtgatagcttcctcgaggcggttcgtggttttggaacgggtgttgtgttctgccatgacagcgctggcag

SEQ ID NO: 31877 - DNA, 825 bp, Glycine max
  Peptide Sequence Number=SeqID_148655
atggtggaaggactctacaaactcaagatgattcctatcaagtataagtacaagtctgattttgctagttctagcatttccaatttttctgccttttcatataagcaatttgtgtgtgaaacctgtcattattcaaagcagaaaagattatcatttcctattagtgaatcacattctttttgtgcttttgctcttatacatgttgatatctggggtccttgcaatgtaacttcattaaatggttacaagtatttccttactataatagatgattactcaagtactctaacaactaatagaaagaaactagatcctaggactgctacttttgtatttttgggttttaaaccaaacaccaaaggattcattatgtttgctcttaaaaccaaggccatatctgtctctaggaatgtgatcttctatgaggattgttttccttccattggtcaagacaaacctgatgttgttactatccttcctattccttcttctcatgccatcaatcaacctaatggtgtctcattagaattaccagttgatcatatcatgcccgtaccaaataatgctgattttgatcccttaactttagagcagtcctttaatacaaccagaatatctctgagacagacacacaaaccaagtacttgtctttatcctcttaattttgttctttcatatagaaaattttctccttcttatcacaatattgttttatccattacacaaagtcttgaacctcagtcatataatgaagcttctgaggatcttgtatgggtagaggcaatgaatgcaaagattaaggctttagaacttaatgatacttag

SEQ ID NO: 31878 - DNA, 918 bp, Glycine max
  Peptide Sequence Number=SeqID_148656
atggcatgttgcttgcgatatgctacccactggtggggaaaggctgctatttatgcggaaaatgcttgtgccattgaaatcattgctacagatgttgagaggtgttttcatggtgctttggtcggcattattgatggtcacaagagggagtctaagggtagcgctagtaatgaccttgagaatacttgtaatgctaggagtgatagctcaacctcttgggtcgagtattctaacaaatacagaggaagatccttacaagcgaaagatatggaagaagggtactccaccaacaagactccactattcaaaggagaaaaagagtggagactacaagtcataactctaagagtagcaaagaatcttgattcaatgtctatagagaaattagttagaacattgaaagttcatgaacaggaactacaacaggacgagggaataaaaaatgggaaatctttagccctaagtgcacaaaagacccaaaagtcatcaatatccaaagaattctcctctatatcaacatccagggaagcctttaatgcagacacatcctttggcgatggatctgatgaagaagaatcaaacaaaaatgatcaactagcctttatatctaagaagataagaaagaaaccaggacacttcaagttcgaatgtctaaacctggataagacaaaggacaagaagaactacttcaaggaaaaagacaagaaggtgcttttgagcacatgggaagacccagatgacacatcatccgatgaagaaactgaagaagaagcaaacttttgcctcatgcctgatacaacatcaaaagaatctgaatcagattcaaacgaggaaaaacttgaggaaggatttcaaaacctttccaaagatcagaccaagcctaaaatggctcatcaagatatcaatctctcaacttaa

SEQ ID NO: 31879 - DNA, 1218 bp, Glycine max
  Peptide Sequence Number=SeqID_148657
atgttgtctgtcggcctcatccaactcagtcagagtcccttctcatcactggtactgttggtgaagaagaaggatggcagttggcatttttgtgttgactaccgcgccctcaattccttgatcgtgaaataccactttcctatgcccacgattgatgaaatcatggacgaattgggcaatgcttcctggttttttaaactggatctccgacaaggcttccaccagattttattggcggaacaggacaccgcaaagacagttttccgcacacactttgggcattacaaatacaaagtcatgccattcggcctctgtaatgccccttcaacgtttcgggccactatgaatgagctacttaagcccttcatccaccacttcgtcactgtgctttttgacgatatcctcgtttatagtccatctttcgaggatcacctccaccacctcacacagagcgacgctacacagatcgccttcgatagcctcaagcatgccatgactcaggccccagtgttggctctcccggatttttcagtgcctttcacactcgaaacgagatcttcgggcctcgatatgggtgtcgtcctcatgcaacatggccaccccttggcattttttagcaaaaccttatgcccaagattacaacgcgcttccacgtatgtcctcgaactacatgcaatcaccacagctatacgtaagtggcgccaatacctgctagggcatccattcatcattcttaccgatcacaagagcttgtgcgaactcatgaaccaagttatccaaacaccagagcagcaagtttacttgtccaagttgcttggatatgactactcaatccagtacaagtccgacaaagcaaatgttgttgttgatgctttatcatggcttcctcaatactccactaggcaatgcttaatcttgtccatgcctcactccgtattccttgctactatccgtgattacatgcgctccaacaatttgatccagaaccacattcaccaagtgacctctcttcccaacccacaacctgatttcaagtttcatggcaggttacttttcttcaagaacaaaatttggctgcactcggaccacccatttcgtacatcactcatagaggagttccatactacccccatcggcggccatatgggattcgctaagaccctgcaccgacttcaagccaacttccactggtctaacatgcgtcgtgacgttcgctaa

SEQ ID NO: 31880 - DNA, 972 bp, Glycine max
  Peptide Sequence Number=SeqID_148658
atggtgttggattatgggtattttgatgatgttctctctttggatgctattgattgttttaaccattataggagttttgtaatctttggagaaactttattatatgatgaaacaactgaatctttcaaatggctatttaagacattcttggaagcacatagtcataaaaagcctaagaccattttcactgatcaagaccaagcaatggctgaggcacttgttgaagttgttgagtttggggaggcttggaccaagttgattgcaaactacaatgttcaagaaaataactggattaattcaatttatgtcctaaaagaaaaattggcttcttgttacatgaaggaagcattcacacttgggatgcgaagtactcaactaagtgaaagcttaaattctcatttcaaagcttgtatgaagccaaatgttgatataaagaaattcttttgtcactttgaaggagttgttgaggagaagcattacaatgagctagttttatttgaagcaaatgatataaaggttgttcccgaaaaatacattcttaagaggtggacaagagaaggtcgtagtggcattatacatgatattaggggaagagaagttgaaaaggatcctagactttctagcacaaggaggtatcgacatttggcatctaaattgattagggtggcatctaacgtatctccttctaaagaatattgtcaactgcttctcttacaagcacaaagcattgacaagaacaagcatgatgccccaacattggtgatcaatgattatacacaacctaaggggttcaagcaacgacctagcataaagaggcacaaccaaaaatgtctcaatagttggcccgagttacaattaaagaggaataaaaaatctctaactagaggtcaatcacaaagtcaaacatctaaggggtgtgtgtgtgcaccccttgatgacagagatgtttcaacattagatgacaaattttaa

SEQ ID NO: 31881 - DNA, 233 bp, Glycine max
  Peptide Sequence Number=SeqID_148659
tcaaccattgtctgaacagttgaaacctcaagttcccaaagctgatgaactggagctatgtccaatttggcagatccaatatgaagctttagccaaatcaaaaccagatgtgttgttgttctttgccgaagtcatgccaactttgtctcattctgagtctcagcgctcgtattcttggtggtgggatagccacctaccaaagaattcaagatggcttcaggaagaccttgcag

SEQ ID NO: 31882 - DNA, 1368 bp, Glycine max
  Peptide Sequence Number=SeqID_148660
atgcatggggctttggctggtgtgagagggccattcactccgtcacagtggatggagcttgaacaccaagccttgatctacaaatacatcacttcaaacgtgcctgtgccaacccatctcatacccattagaaaagcacttgattctttgggcttctgcaacttttcaactggactcctaaggcccaacgcattgggatggggaggtttccatctgggattctcgaacaacacagaccctgagccaggcaggtgtaggagaacagatggaaaaaaatggcgatgctcgagagatgccgtagtggatcaaaagtattgcgagcggcacatgaatagaggacgccatcgttcaagaaagcctgtggaaggccaattaggccatgccctcaccaccaccaccaccaccaatacacctaatgcttcctccaactctaccgtggtgccccgcaacaccaccaccaccaccacctttgcacacaacaatgtgcaccaccctcttccacctcattcgtctcaggccaacaccatcaataggatgtttacaagcaacaaagagaataacagtaccagtgagaggctgcaggaccctgctcttcccatgctgcctcccactcttgagctgaaaccaaaggagaacaatcctttcatgattcataaacaccacatcccagctgatgaatactcaaggaacagcaatgagtttggactcgtcacttctgattccttgcttaaccctacacagaaaagaagctttacttcttcacaaaaggatgattctgagtcccaacaacaacattccctcaggcacttcattgatgactctcccaaaccacagtctcataatcatcaccaccatcatcattcgtcgtctatttggcccgaactggacagcatgcaatcagacaggactcagttatcaatctccataccgatatcttcctcagattttatgtcattcactacttcctcaccctccaacgagaaactcacgttgtcaccattggggcattcgagggagttagaccccattcaaatggagttgggaatgggaagtggtgcctccaatgaagcaaacaccaggcaagccaattggattccaatcacttgggagagttcaatgggtggtcctcttggagaggtattgaaccttagcaataacagcaatgcaagtgatcaatgtggcaagaacaacaacacttcagctctcaacctcatgaaagatgggtgggacaataatcctccactagggtcatccccaactggggtgcttcaaaaatcagcatttggatcactttccaatagcagtgctgggagcagtccaagggcagaaaacaacaaagaaggtgccaccttgtgcaatgccttgtaa

SEQ ID NO: 31883 - DNA, 366 bp, Glycine max
  Peptide Sequence Number=SeqID_148661
atgcatggagaagatgaaggttttggaagcttgatcagcggaaacaatagaagggaccctagggatcctaggtattcgatcgaggagagcgtgacatcaaggcattcaaagtatatcacctgtgagaattctggaggccaagcacgacctttactctgcagtaatctgagagaaggtgtgcatgaagattggaaatggttcatggtgcccaactgcgagggaatggacactatcaacttctggtcacaattacgctgtgtggcacaagtagtgttctgttggcatgacccttcttctccactggagtactcgcagataagagaagggaattatgagcttcttatatgcttctcgattgagtcttaa

SEQ ID NO: 31884 - DNA, 270 bp, Glycine max
  Peptide Sequence Number=SeqID_148662
atggaagtcatccaggttcctacctttctcttcatcagagatggcaacattgagggcaaaggggagctcattggggaaattctcagaagttcatttcaacaaacatcttactttactaccagtagggaagggaactttgtgagaaaggaacaacatactatatatgaacttgcatactctgtttccaattgttggaagcaatcagaatgttggggatgggatgagatgcagggtgtgggtggttgctatgagctgagttccgatatctaa

SEQ ID NO: 31885 - DNA, 453 bp, Glycine max
  Peptide Sequence Number=SeqID_148663
atggacatggaggagctggaactacgtagggagatgttcggggaggttaagatggcgggatggtgccggtgccggtggcggcgatcacagcaggctccacctgctggaggagccactcgatggtttcactgttcgacttatggccccgctcgtggggccgacatttggatgcactgcccgcgcccgtccaccttcgtgtgtcggtccttggtcgaggagcctccgccgcagccgccatggagagctggtcggattgagtggaattggacgtgctcggttccatggagattgctaaggaagggtaaagggaggaggtggagcatgaggcggtttcttggtcttctttcttctcaagtagctggaatgggaagttgttctgacggtggtggaatcctcgcctccctccatgatcgcatggagaggaagaaaataaaatttggtggtggtgtgtga

SEQ ID NO: 31886 - DNA, 690 bp, Glycine max
  Peptide Sequence Number=SeqID_148664
atggacattgatgcagatctaaaaatgtatatggatatgagaagtagccaggggaaaaaacttcattttggttctgctggcatagacacaagacagataggagacaaacttcaacatgtcactttttgtgttagtgtccataatccaatccctgagaacttgaagtatgacaggactagttttttaggccaactaagtgtgttagtcttggtatggaataatggttttcatttttcggataaagagtatcaggttcaggggcatgcaaatacatatccaaaccctccctcacttctgcaaattggtaaaacccaaactcacttagtaaaaacatacttctccatcaaaatcaaggcattggatatgagtggccatgaagcaaagcttcatgatgaatcaagattgattcaaagatgttttgatgataacaaagatgatgacaaaggtgatgacaaaaagctcaaaagtcaatcaaagaatgagttcaagatgttcaacatagaatcaagaacacttcaagattcaagaggaaagttgaagaacacttcaagattcaagaggaaagttgatttcaaaaatcaaggatcaagcttccaagaatcaagatcaagattcaagactcaagactcaagaatcaagagaagacttaatcaagataagtatgaaaaggttttttcaaaaactgagtag

SEQ ID NO: 31887 - DNA, 1632 bp, Glycine max
  Peptide Sequence Number=SeqID_148665
atgaaaaagcacaaagtgcaaataccaaagcaaaaacaagaagcgaatggccaatgcaagttgagtttgcttaaccaaaaatcctctggcatgaaaatgggagtggggttctctaaggtgttaacaaagaaaccagagcatgaaattcccattaatgcctccccagattacactcctcaactgacctacaaacaaccaaggaaaaaccttctaattgcacctccacttccacttcctcctcctaagcctaccgaatgttgttcacaaacagaaccagttctagggaaaccttacgttaaaataaagcaaatgtacgagatgaaggaagagctgggaagaggaaaatttggagtgacttatctgtgtgtagagaaggccacaggacgagcgtatgcatgcaaatccatagcaaagaagaagccgccacaagaaatggaggatgtgagaatggaggttgtgattctgcagcatctttcggagcaacacaacatagtggaattcaagggagcttatgaggacaggaagaacgtgcaccttgtcatggagctgtgtagtgggggtgaactcttcgaccgcatcgttgccaaagggaactacaccgagcgtcaagccgccaaaatcatgagacagattgtgaatgtggttcatgtctgtcatttcatgggtgtcatgcatcgagacctcaagccagagaatttcttgttcgccaccaaggacgaggatgccccattgaaactcaccgattttggatcctctgtcttctttcacaaaggtaaagtatgcacagattttgttggaaatgcatattacgtggctccagaggttttgaaacggagtcatggaaaggagatagatgtctggaatgcaggagtcattttgtacattctcttgagtggggtgcctccattttgggctgaaactgagaaaggcatatttgatgctattttgggaggaaagttagatatggatagcgagccatggccttctatttcagaagctgcaaaagatttggttagaaaaatgctgacttgcgaccctaaggaacgcattacagctgctgatgccctcgaacacccttggttgaaggaaggtggtgaagcatcagacaagcttccagacagtgctgttttaattaggatgaaacggtttagagcaatgaaccagatgaagaagcttgctctgaaggtaatagcagaaaatatttcagagaaagaaacaaagggcctgatacaaatgttcaacaatatggatactgatggcagtggcacaatcacatttgaagaactcaaatctggattgtttagattgggttccctggttaatgaatctgaaatgaagcagctaatggatgctgctgatattgacaagagtaggactattgactactttgaattcattgctgccactatggatcggcataaagtggaaaaggaagagagtttgttcaaggcttttcaatactttgacaaggataacaatggttacataacaagagatgaacttagagaagcaataactgaacaccagggagatgaagctgctatagatgaagtcttcaacgatgttgactctgacaaagatgggaaaattgattatcacgagtttatgaccatgatgaaaaatgaatgctaa

SEQ ID NO: 31888 - DNA, 453 bp, Glycine max
  Peptide Sequence Number=SeqID_148666
atggcacagatgaatcgttcacttgtttctttatttcctcttcaaaacaccacgtattctcctttgccatgtatgatagttgaagagcacaccaagtgtttgcgaaaatgtgctaatgatgcttttccaattcttatagaccgtgttttgaaaatgaaagaaacattgttttgtttgtattcaggaagaggctggatagtttctctttctctctccatggatcttcaggatttccttatccgtgctcgggtcttgaggctttacagacaagcattgagaattgctggtcgagccccttcttccgctaaagctgaactgaggcagacaattaggcaagagatggaaaataatagaaactgcaatgacaagcaaaggatccgtttcttgattagtgagggattggataaactgaaacgactggatgaaatgctagatatgcaaggttatcgttga

SEQ ID NO: 31889 - DNA, 249 bp, Glycine max
  Peptide Sequence Number=SeqID_148667
ttcatcgctgccaccatagacccgcataaactagagaaggaagagcatctgtataaggcttttcaatactttgacaaggataacaacggatacataacaagagatgagcttagtcaagctttgactaagtatcaaatgggagatgaagcaactatatatgaagtcatcaatgatgttgacactgacaacgatgggagaattaattaccaagagtttgtggatatgatgagaggggatcctggatattga

SEQ ID NO: 31890 - DNA, 864 bp, Glycine max
  Peptide Sequence Number=SeqID_148668
atgaacatgcaaagattcgataaaatccggagggaagaaattgaaatactaaccttcctggatgaaaatggagagtccaaaaccagtggctttgacagctgcattgggatggttggtggccaacatgaaattctcgggcttgaggtatcgatgcatgacggccatgaaatggcagacgcgaacaactctatttgtgtagtagaggatattgttgtaggaaactcaggtttcattgttcctaaatttgagtttcttgatgccatacgcaaaatcgccaaggagaataatgcacttatcatctttgatgaagctatgaccggattccgtttggcgtatggaggagctccagagtattttggcattgttcctgatttgacaactctaggaaaaataattggtgggggtctgccagtaggtgcatatgggggaagaagggatattatggaaatggtggcaccagcaggacatatgtaccaggctggtactttgagtggaaaccccttggctatggctgcaggaatagagactctgaagcttattaaggaaccaggaacttatgagtacttagataaagtcactggagaacttgttcaagggattcttcaagttggaaagagtgcaggacattccatgtgtggtgggcatataaatgggatgtttggttttttctttacagaaggacctgtcttcaatttcgccgatgctaagaagagtgacttagccaagttcgctaggttctaccggggaatgttgaagcaaggtgtatattttgcaccttcacaatttgaggttgggttcacaagcttggcacatactactgaagacatcaaaatgacaatagcagccagatatgatatgatatga

SEQ ID NO: 31891 - DNA, 1284 bp, Glycine max
  Peptide Sequence Number=SeqID_148669
atggggatctgcttaagcaaatccaacacaaacgaaataccattcaactatgatcattcaccaccctatcatcattatcagccacggagaacccaacaacctcaacaacctcgttacccctatcataatccaaactcagacccatctcaatctattgctccatcatcatcctttggtgaccaacaagcacgaatattagacaaaccatactttgacatcaatgttctttacacccttgagagggaactcgggagggatgaaatcagcatcactcgtctatgcaccgagaagaccacaagaagaaaatacgcttgcgagtccattccaaagcagaagctaagtaaaaaaaaacatattgatgataccaagaggcaagttctcatccttcagcacctctcgggacaacccaacatcgtcgagttcaaggttgcttacgaggatcgacagaacgtgcatttggtgatggagttgtgtttgggtggtacactctttgatcgcatcactgcaaagggtagttactctgagagtgaagctgcttctatatttagacaaattgtcaacgtggttcatgcttgtcattttatgggggtcatgcatagagacttaaagcctgaaaatttcttgcttgctagtaaggatcctaaggcacctctcaaagccaccaattttggattgtccgtcttcattgaagaaggtaaagtgtataaagaaattgttggaagtgcatactatatggctccggaggtgttaaaccgaaattacggaaaggagatagatgtgtggagcgcaggaatcattttatacatccttctaagtggggtgcctccattttggggtgaaaacgatagaagcatatttgaatctattttgggaggccagcttgatctagagagtgcaccatggccttctatttcagctgctgctaaagatttgatcaggaaaatgttgaattatgaccctaagaaacgcattacagctgttgaagcccttgaacacccgtggatgaaggaaggtggtgaagcatctgacaagcctttagataatgtcattttgactagaatgaaacagttcagagcaatgaacaagatgaagaaacttgctttaaaggttatagcagaaaacctttcagaggaggaaacaaagggcttaaaacaaatgttcagcaatatggatattgatcgtagtggcacaatctcatacgaggaactcaaatctggattgaccaaattgggatccaagcttagtgaatatgaaataaagcagctaatggccgctgtaagttga

SEQ ID NO: 31892 - DNA, 522 bp, Glycine max
  Peptide Sequence Number=SeqID_148670
atggatgggggtggggcttttggagagctttccttgtcacatgcgaaacagcaaaactttaaaagggaacagcgatcttctcaatcaaatgcaaacaacctttcctttccttattctctaccaacgccaacaaacatgctcggttccgttcttctggcggttttcttgccgtgcatcggcatgagcgccgctttgatcgtgtacatgtgccttctctactacttcaccgaccacttctccgaccccgcgctaccggccaagccagcctccgacagcgggctctccccttcccagctcgacaagctacccagaatcaccggaaaggaacttgtgatgggaaacgaatgcgccgtctgcctggaccatatcggaacagagcaaccggctcggctggttcccggttgcaaccacgccttccatttggaatgcgccgacacctggctctccgagcaccctctctgccctctctgcagagccaaactcgacccagcgcttttctcttcctcccaaaatccatgctga

SEQ ID NO: 31893 - DNA, 264 bp, Glycine max
  Peptide Sequence Number=SeqID_148671
atggatcggtaccagaaggtagagaagccaagagctgaaactccaatcgatgaaaacgagatccggattactagtcagggaaggatgcgtaactacattacttacgccatgagcttgcttcagccctttgtgtttggttatgacgaaattgtatgttttggattttggagcgaatgggaaggatcagtgtgtgtggtaggtggcgtaccttaccctacttgtttgtacttctatttttcacttttaaataaaaaacgaaggtga

SEQ ID NO: 31894 - DNA, 216 bp, Glycine max
  Peptide Sequence Number=SeqID_148672
atggctaaggaagatagcacgctgccatcgctaagctctggcttggcctactgctgcagcatggtggtgttgagggtgttggattggaaattgagaagtgttgatgtgttgttattggtattgtcggaggaaaaggctatgccgggaagaaggagaatcggagctgggaggggacggtgttcggcttctggcaagtgcaccggatcgcacaagtag

SEQ ID NO: 31895 - DNA, 1173 bp, Glycine max
  Peptide Sequence Number=SeqID_148673
atggtaggactgacactattctttgataaacaaacgcataagatgagtgaagacgtggagatgaaagatcaggcaacgccttcacactcgctttcttcagttcctccatctgcattgcagcatttgaaggaaatagcatcaattattgaaaccggttcgtactcaaaggaagttcgtcgaattgctcgtgccctgcgccttacatttgcattgaggcgtaaattgacagcaccagttctctcatctttcctcgattatgttcttcctcccgcttctgaacctcacactaggttatcctcttttctccctaatcctaaggagggtgatcgagagatggaagtggacagttcaacatctactattcaaaccccggcggcaaagcacttgttgcctgagctagaaatctactgttacctccttgtcctactttttctgatcgaccagaaaagatacgacacggccaaagcttgttcctcagcaagcattgttcggctgaagagcctgaatagaagaactgtcaatgttattgcatccagactgtacttttattactcatatagctatgagctcactggaaatcttgctgaaattcgaggtaacctccttgcattgcaccggattgctaccctgcgccatgatgagctgggtcagatgggtcatgtcttgtacttacctggtgacgtgatgcaggaaacccttctgaatctgttacttcataactacctacactacaacctatatgatcaggcagagaagttgaggtctaaggctccacgttttgaggcacattcaaaccagcagttctgccgttatctcttctaccttgggaaaattcgcacaattcagctggagtacaccgatgcaaaagacttgctcttgcaggctgctcgtaaagctcccagtgcagcacagggttttcagattcaatgtaacaagtgggctgtgatagtgcgtttgttattgggagaaatacctgagaggataatctttatgcatagaggaatggagaaatctttgaggccttactttgagcttactaataaaatgggtgagaaatcacaattttacccacaaaaacccctaaacaaagatgtttcaggggtagaaatggtttttgaatcccatcacggtagtgctgctaaagcacatagaaagccactattttgtgcatga

SEQ ID NO: 31896 - DNA, 1110 bp, Glycine max
  Peptide Sequence Number=SeqID_148674
atgcttgatttcattggtagatcacggaaggaatgtgaggaagatagattgtgtaagaagcaaagcgtgaatgaagaatatttggaagcgttcagaacaaagtcttacatcgaaatatgcaacaaagcacaaggggggattggaaagacaagcaccaaaatgctaacttcttcttcttcttcttcaattcctttgtgcatgcaactcacggagtatttactagagccacggcaagagatgatagcaaacataacacagagattgaagcttcatcatcttcttgtggactacttcgaagccagcttagaagcgtgtcgttgttgtgacacaatccttgaagccatccattcaatgcgactttcttatcgacgaatcacgagaattgttaagctaagcaaaacggtgcttgatgatgatgacaccaagggtgtaatctatagagagctcgcttcctttgctctgcaaaacaaccctttgtccgttgctattagcagcgtgaagttccgtgacattcatgacagatacgtggaactcttgaaaagactgaaatcaacgagtaaggaaattcgaaggaggttgacattaaagagggtttgcaagaaggttgcggggattgctcttattacttctcatagtgtggttcttgttgctttgttggtgtttgcttttcatagcattgtagggttggtggctgcgcctagtatcgtgggtgggttggttggtttgttcgtgaagaagggtcgtcaaaggtttatgtcaattagctctaataataataataataattgtgaagagaggctgtgtgagcaacttgatttggctgcaaaaggggtttatgttctgatcaatgatttggacacaatgagtaggatggtgaagaggttgaacgatgaagtggagcataggaaagtggttgctgaggtttgtgtgaggaatgggaagagtgagatactactgaagcaggttatgagggattttcatgagcatgagtctagctttctggagcagttggaagagctggaggggcatatctacttgtgctttctcaccacaaacagatcaaggaggcttgttgtgcaacaaattacggacaaaaaagtaaaacattga

SEQ ID NO: 31897 - DNA, 3216 bp, Glycine max
  Peptide Sequence Number=SeqID_148675
atgactcttgaagatttctttacgttgactgaaatgaaagatggcctcatggccccttctcgagtgcaagagttggtctctgtaatgaagaaggagcaagattgtgttgctaagaatgctggtgatacaacaaggcagtgggctgctgttgcaagcactattgctgctacagagaataaagattgtcttgatttttttattaaattagatggacttgggttcatcaacaaatggttaaaggataccctgaatttgggtgctgataatactaatgatggcttcattgaagagtcaattactgcaatgttacgtgcaattgaaaaactgtatctagacagcgagaaatcaatttcatcaggaatttctgtgactgtaagtaaccttcttggtcatcgtagctctaaggtgcaggatagagcaagagtattatttgaccgctggaaaggaggtggagatggagatgctgaaccaactgataattcggatcttggtagaatcaacaatgtgagtgatgaaattgtcagtgagaaaggccaaccatcttctgtgaatgaagctggcaatgaagatgatcatgtatctcaacctgctggaggtgagaagtctctactgggaggctcagatagtcagctacaagaaaaagtttctagcatacagatacagagtgctgacaatgcactccagtcctctgtaaggttggattgtgaagatgccaaagagagatcaaaccatgttgatagtgttttggcttctgttcaagaagttgctaacataaatgaaggcggcaccacatcggctgggacctgtaacttacctgttaataaacaagacagtttcaaaggtcaacaagatgatttagagttaaatgacttgtccaaaaaggagatgcaagatgaaaatgttaatgatcctccagaagaattaagagcatcagatatctctttggcatctgcaaagccagaacctgaacctgtctccattggtgatagtgaagcaaaagcactggaatctgtgaaagaagaacctgctttagaacataacgctgaaagcaatgaaaatatcatttgtcctaaaataaatgtttctggtagcatgagaacacctgcgtcagatgggataagtgtgggagatgatgtcagagctataaattccagcaatccacaacttcccaaagcatcagaaaatgatgactgttgttctcaagcattgcaggacttatcagtcactagcagtcacttggaaaagcctgagatgtctttcctcaaaacacaatatgtaggagcagttaaggaaagcaagggccaagagtctgatcaagatgatgatacctcagatggttctgactcttctaaccagggtaaaggtcccacaagccctaacattattgacaagaattctgacatggaacttgagtatggtattgttgatgctttagaagttgctcgactagttgcccaggaagttgagagggaatgtgtcagccctataaagcaagggcatggccaagtttcttataaagtcaacagtaccacaaatggttctgattcttttaaatggggaaatggccccaaaagccctaatgttattgacaagagttctgatattgaacttgagtatggtattgttgatgctttagaagttgcccgacaagttgctcaggaggttgagagagaagtttgcagctcttcttcagagaaaatctcagaaggtggaatcaggcaggcagccagccctgattttgtagggagaaaggatgaagtcactcgtgtcctacatgaggaggtatcatccaggcaaagcaactctgatgaggtgtgttctgaagaggcaggacatatgagtgtttccgataatattgaggctgggcaagatgacttggagtcctcgcaggtgactgaagcagctcgagacccaggaggtaactcagagaaaagtctctgtacctttgatctcaatgaagaagttggttctgatgatatggatgtttctgtgaatgccatgtctactatgccaataccagttgtttctgcttcaaaacctgcactgacttcttggttgccaatggcccctttgcagtttgaggggacccttggatggaaaggatcagctgccaccagcgcctttcgtcctgcatctcctcgtaaaaattctgataatgagaagaatgtttctgttggtggaaactcctcagagatttccaagcagaggcaggattgccttgattttgatctgaatgtggctgagggtgaagaaggactgctaaaacaaattggtgaatcttcaggccttccttctggccaatcatcagtggaacttagtcctaaaagatcaagcaggttcaaattggatttaaatagtatcggtgatgatggtgatgcccaaccttcagatcagaggatggaggggccactttttcccagaagaaatggttattggagcccatcacctgcttcatcgtcatcatcaatgcaacctttagtacgaaacattgatctgaatgacagaccattctttcaaaccgatttagtggaccaagggcttagtaagtcatcttcgattattgaagcatataaacaatccaagtcggatgctcctgtgatctctattttgggtgccaaggtggaagttggtacaagagaatatattcctcaaactttgtcttttccaaatggcaaggctattgagcctgcaatggatcttccattgtcaggagcaggtagcgttttaggaatgggccccacactatcctacaatcattcaactgcttttgggtacaacggactgacatcagtgcctgctttatctttttcaccagccatgtatggatcacctggtggcccaattccatacatggtagactcaagaggaagtccagtcgtgcctcaggttgggggatcttcctcaactgccctgtcatcttattctcaacctccatttatcgtgagcattaccggtacacagcttggtttaaatggggttggatcttcacgccccaactttgatctgaactctggcttcacgattgatggagggaacagagacatgttgactgcaaggcaatttttctttcctgctcaaggcagagctatggaggatcatgtgaggacccttccacaatcctcaagttctggagttagtgtgaaaagaaaggaaccagatggtggctgggatacctatcctcttagctacaaacatcagcaacctccatggaagtag

SEQ ID NO: 31898 - DNA, 1314 bp, Glycine max
  Peptide Sequence Number=SeqID_148676
atggcaggaatgaaagtctatgtgactgacgaaaaggagttgattatggaaccatcagtgaagtgggctgggaatcctaacattatagttgcaattaaagcatttgggcttcgagccacagtccaggttgttgatctgcaagtatttgctgctccgcgtataactctgaagcctttggttccaagttttccatgttttgccaatatttacatgtctctcatggagaagccgcatgttgattttggactaaaactgcttggagctgatgcaatgtctattcctggcctttataggattgtccaggaaatcattaaagaccaagtcgcaaacatgtatctgtggccaaaggccttagaggtgcaaataatggatccaacaaaggccatgaaagttccagttggaatccttcatgtgaaagttgtgagggcagagaagcttaaaaagaaagatctactgggggcgtcagacccttatgtgaaactcaaactcacagaagagaaacttccttcaaagaaaacaactgtgaaatacaagaatttgaatccggaatggaatgaggaatttaatgtagtcgtcaaagatccagaatctcaagtcttggagcttacagtttatgactgggagcagattggcaagcatgacaagatgggtatgaatgtcattccactgaaagagattacacctgatgaacctaaagtggtgactcttaatttactcaagaccatggaccctaatgatcctgagaatgagaagttgcgcgggcagctaactgttgaagttctgtacaaaccttttaaggaggatgagttacctcagagtacagaagattccaatgcaatagaaaaggctcctgaaggaacacctgctagtggtggtttacttgtaattatcgtccatgaagctgaagatgtggaaggaaaacaccacacaaatccatatgtgcgactgctatttaagggagaagagagaaaaaccaagaggataaatttgacattagacagtgaagtgctagcaagagcaaagaataagggtagcagaaacgaaaatgttgagcatgtcaagaaaaatagagatccaagatggggtgagtcgtttcaatttatgcttgaggaaccgccaaccaatgagagactatatgttgaagtgcaaagtgcctcctcaaagctaggcctgctgcatcctaaggaaagtctgggttacgtggatataaaattgtctgacgttgttaccaacaaaagaatcaacgagaaatatcatctcattgactcaagaaatggacgaattcaaattgagcttcagtggagaactccttga

SEQ ID NO: 31899 - DNA, 331 bp, Glycine max
  Peptide Sequence Number=SeqID_148677
atatggaaaaaccgaaaatagcaagcagtatccaccattgcagagacacacctttgtaaagtggtggtcacaattcgatacctcaaaggctgctccagaacaagtcaagaactggtttcagagcaaccctgagtttctcaaacctgctgatccagagacatctttgtttctgaatcagaagtctcaacttgtagcatttttggcaagctcaaaatctaaagaaagtcttactcagaatcttaaggaaatgtttgaacagtacttcctggaagtacaacagtctaatattttagttgagtggtactgtagcagtaagacccgtggtggataa

SEQ ID NO: 31900 - DNA, 565 bp, Glycine max
  Peptide Sequence Number=SeqID_148678
atgaagaaggacaatcaagtgccgaagaagatcatgatcactttcgctgatgcagattgcaactgcttacagggaagtgggtacgcacctcaggttgggttagcagaacactttaaggtaaaattttgggaggatctagaaggggtacttcaggatataccccaaggagagaaagttttcctaggaggggatctcaatggacatgtaggtagcgtggctagaggttttgagggggtgcatgggggttttggcctaggggaaatgaatggggagggtaaatccatcttggagttttcggaggctttggatctttctatagccaatacatggtttaagaaaagagaggaacatcttatcacttacaaaagtggagggacatgttctcagatagatttcttccttatcaggaagtctgataggaagtattgcttgaactgtaaagttatcccgggagagagcttgactacccaacatagagttttggttatggatgtaagaattagagatagggcaaagagaagaagtcctatggtagcaccaaggatcaaatggtggcacttgaagg

SEQ ID NO: 31901 - DNA, 1179 bp, Glycine max
  Peptide Sequence Number=SeqID_148679
atggctgagagcagagcgaatcacacagtgagcgtatctgggtgggcagctcatgattcgtcgggcaagattaccccctacagcttcaaaagacggcagaacggtgtgaacgatgtgacaataaagatcctctattgtgggatctgccacacggatctccactgtgctaaaaatgaatggggcatcactatgtaccctgtggtacccggacacgagatcattggggaggtaactaaggttgggaccaatgtgaaggggttcatggaaggagacagagtgggtgtgggctgtttggcggcttcatgcttggaatgtcaccactgcaagaccgatcaggaaaactactgccaagacctccaatttgtctacaatggaatcttctgggatggcaccatcacctatggtggctactcccaaatctttgtcgcggattacagaagacattatcttgaaattcacgttgctttcaaaggcatggcggtggtggttgaaggcaaccaatacaagccccactacactgcttggcaatatgtggtacacattccggcaagcctaccaatggatgcggcggctcctctgctatgcgcaggaataacagtgttcagtcctttgaaagagcacgatttggtagcaacagcggggaagaggattggggtggttggactgggaggccttggacacattgctgttaaatttggcaaggcttttggccaccatgttaccgtcatcagcacttctccctccaaagaaccagaagctaagcagcgtttgggtgctgatcacttcattctcagctctaatcctaaacaattacaggctgcaaggagaagcatggatttcatattggacactgtttcggcagagcactctctcttgcctattttggaattgctcaaagtcaatggaaccttatttctcgtgggtgcaccagacaagcctttacaattgcctgctttcccattgatatttggcaagagatcagtgaaaggtgggatcatagggggaataaaagagacgcaggaaatgttggaggtttgtgcaaagtacaatataacgagtgacattgagttaatcacaccagacaaaatcaacgaggctatggagcgccttgctaagaatgatgtgcgctaccgtttcgtcattgatattgctaatgctgtcacttccaacaacaactga

SEQ ID NO: 31902 - DNA, 1557 bp, Glycine max
  Peptide Sequence Number=SeqID_148680
atggtcactgctgctaaatcttcaaaccaccattcgccgcccagtgctccgtcaccggcgcagcccagcgacgccaacagccctaagttcaggcgcaaaaatcttccctccccgtgggttcagcttgttcacggtggcgagccccaaccggggagcggcattcaccaatcgccgccgtcatcgtcgtcctcgtcctcgtctctggttgctgaccaagccccagaggtggataattctaatacggttggtgatgtagatagttccgatggcgctgagggcaatgcggatcgttctaaaaagctcgtttggaacaagccctcaaacggcgttgtcgtcgagactgggcctgtaatgggcgctgctgaatcatggcccactttgcttgcgtccaccaaaggttctgctaaattgcctcctgaatcgtcctccaatactgttatcgattatggatcactctccacttctcctcaggggccaatggcttcacaatctcctcagaaacaagcgaccactaatgcaaaacctaattctgctccaaattataatgtgcctggtagacaaagatcaatgaagcgggtaggtggcagcagcagcactgtgtctgatccttcacagggcaacttctctaaccctcccccaccaccgccgcccccgccttttcctgtataccagctcccaccagttagctattgtaatatggtaccaggggtccctgaccctgctccaagagatcattaccggaacaataactgggatgcaggaccaatggtagggggttttgtgcctgccatgaatggatatcggggttcctctcgcaggggttattttgggcctcatccccgaggagatggttcctatcataatagttatggtagccggcgtgatcatcaagatcgtggaaattatgtgaatactagagatgcatttgttcctcaaccaaggatgcctccaagaggattaccgagacacacaccaccacctactactgctgctgcatttgtgggacctcagcctattggaccatttgctaaacccattggttttcctgagttttattactaccaaccagtaacagtggaacagtttacgggtatgtcgttcttcgctcacagccctcctcctacaccgttcttctctgctgcagaatctcctctctctaatatgatagtctatcaaattgaatattactttagtgatgctaatttagtgaaagatgcgtttttaaggtctaaaatggatgaacaaggttgggttcctgttactttgatagcagacttccctcgagttaaaagtttgacaaccaacattcagttgatactcgattcgatcaggacttctgctatcgtggaagtgcaaggtgacaagctaaggagacttaacgagtggaaaagatggttgtcctctactcagcgaggttcaacatctcccattggatcaagatacaataaccttacaactaatcttcaaaccatcaaattggaagaaacaattaaagatgaagatccaagaatgtcaaatggtggtgatgctaccgggagcagcagtggaaacaactaa

SEQ ID NO: 31903 - DNA, 573 bp, Glycine max
  Peptide Sequence Number=SeqID_148681
gatgatggggaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaagatctcgaacttaatgatttggatagaagtatgaagacacaacaaaccgataagctctctcagttggatgagcagaatcccagaaaacatatgaagaaggattcgggcacaaactga

SEQ ID NO: 31904 - DNA, 147 bp, Glycine max
  Peptide Sequence Number=SeqID_148682
atgtcgctatttcaagggaacatgcaaaatagctgcaaatataaggtgagtatggtggttaagggagaagaaaaggaggggaaggtagcgggttcgatccctcatgctaataagactaatattctaataactaacatttgtcaataa

SEQ ID NO: 31905 - DNA, 3753 bp, Glycine max
  Peptide Sequence Number=SeqID_148683
atggcagagaaaaaggatgatggcaacaagataagtgacgaatccaacaaagatgaaagtgggtctcatttgaagaaacagatctctccctacgatctgtattcaagtgataacccaggaaatatcataacccaggtacaattgaagggtgaaaattatgatgaatgggctcgtgcagtccgaggctcgttgagagcacgacgaaagtttcgattcgtagacggatcgattaaaaaacctgatgatgctgcccctgaaatcgatgattggtggactgtcaattccatgattgtttcgtggattttcaatacgattgaaccgaaacttcgatcgaccatcacatacagagaaaatgcacaagaattgtgggatgatatcaatcagaggttttctatttcaaatggacctcgcatccaacaattgaaatctgaattggcgaattgcaaacagaatggagactcgattgtcacatattttggacggcttaagaagctgtgggatgaattgaacgatttcgaccagatacccatgtgcacatgtaatgggtgtaagtgcggcatatctgcggcgctaaataagaagagagaagaggaaaagcttcaccaatttctgatgggccttgatgatactcagttcaggaccgtgcggtctaatgtcctgagtctagacccgctgccgaatctgaacagagcataccagatggtggtgcaagaggaaagagtcggagtaatgactcgaggcaaggaagaacgtggagatccaatcgcatttgctgtcaagtctggtaggacatcgagttgggaaaagaaacctaacacagggtcggagaaaccatgctcacattgcaaacgtgatgggcatgatatcgactcatgttttcagctggtgggttacccagattggtggggagatagacctcgatctgtaggtcgtgcgcttggacgtggaaagcatgtgcatcgaccaatgagtggcgcgctaaaaggaagaggcaataatgcaaaagtgaatatgacacaagttgttgatgacactgaagtaatgaagtatgaagatgatcaggtgctgccggggttgagttcaaagcagtggaatgctcttcttaatgcgattaacacacaaaaaggtgggacgagtacaagactaacaggtgagaattcatggattattgacacaggtgcctctcatcatatgactagcactcttgcgtgcatgaatgatgttcgagatatagagccttgtccggttggaatgcccaatgggacacggacatatgcaactaaagaaggaatggtcactgttggtgacaagctaatgttgaagcatgtcctttttgtccctaatttaaattgcaatctcatctcaatctctcagctcttacatgatgctgattatattgttcactttactaaaacaatgtgtgttatacaggaccgtacttcgaggatgatgattggagcgggtgaacaatcagaggggctttatgtgcttagtgtggtgacaccagtccgtgcataccaagcaaatggcattagattttgtgagttgtggcatagaagaatgggacacccatcatctaagataactaccaatttgcctttgaaattttggggagagcgtattcttactgctgcgtatttgattaaccgaactccttctgcactacttgatgggaaaactccttatgaagtgttgtttgatgctaagcctgcatatacacaaatccgaacattcggatgctacccttatggaaaaaaggggtgggaaatgtatgatattgaaactgaagagtactttgtatctcgaaatgtgaactttgtggaagacatattccccttctctagcaatgacaaggtgagtgaaacacacgtagatgaatggggatggccgcttgatccaattgatgaatgtgaggaaaggaatgagacaagaaatgtagtgactactaacgacttgggggctgtagttgtgggaaatgatgttcaggacattgaaaaccatgaggaagtacatgttatggagcaacaaactgagacaattgaagatgtagaccaaggtgagagattggattctcaacagagtattcgaagtgatgaacttcttggtcggggacatagaatcaagaatccctctacacgtctgaaggatcatgtcacacacactgcgactgtaagcctctcgaccagttcaccacttcattcaaaatcctcagggtatgagccaaattcttttgccgaggctgttaaggatgagaaatggcgaaatgccatgaaggaagaaattcaagctttggaggacaatggtacatggacaaccgaagatttaccactgggaaagaaagctataggatgcaaatggatctataagatcaaatataattcagatgggtctattgagcgtcacaaagcaagattggttattcatggcaacagacaagttgaaggcgttgactataatgagacatttgctcccacggcaaagatggtgacagttcgaacatttttagccattgcggcagccaagaacttccaactacatcaaatggatgttcgcaatgcgttcttgcacggagacttggaggaagaagtgtatatgaaattgcctcctggctttgaaaagaaatctcccggtaaggtgtgtcgccttcgaaaatctttgtatggtttgaaacaggcccctagatgttggtttgctaaattgtcggatgccttgaaaacttatggcttcgaacagtcctactctgattattctcttttcatgttgcgccgccgtaacaccgagctgtatgtcttggtgtatgttgatgatatagttatatcaggaaatcaaagtgatgctatacataaattcagggattatttgggccactgtttccacatgaaagaccttggaaagttgaaatatttccttggcattgaggttgctcggaatgctacaggtatttttctctcgcaaagaaaatatgcattggatttgatatctgattgcggactactgggagcaaagcctgcgaccattcctcttgaacaaaatcatcaattggcccttgttgaaggggagggcatcaaagatccaactggatataggagtctcattggacgacttatctatttgactattactcaccctgagttgtcgtattgtgttcatatcctcgctcaatttatgcaggctccaaagattgagcattggaatgcagctcttcgggttgttcggtacctaaaaggcaatcctggtcaagggattcttctaagaactgattgtgatttgcgcttgtatggctactgcgacgcagactgggcaggctgtcccctcactagacgatctttgacagcttattttgtgatgttaggtagttcccccatctcttggaagactaagaagcaaactacagtgtctcgatcttcggccgaagctgagtaccgctccatggctgcagctacttgcgaactcaagtggttgaaaggattgttgagctctcttggtgttgagcatactgatcctatgcaactttattgtgacagccaatctgcccttcatattgctaataatccggtcctccatgagcgtacgaaacacattgaagttgattgccattttgtgcgagatgaaattgtcaagggtagcatccaacctttgtatgttcacacttctaaacaactagctgatatcttaacaaaggctctaggaaaacgtcaatttgactctttgctgtccaagttgggcgttcttcatctccacgctccaacttga

SEQ ID NO: 31906 - DNA, 243 bp, Glycine max
  Peptide Sequence Number=SeqID_148684
atggccgttaggattcacaagagagcattatctatactgaaaggacataatggagattgtcgcaacgtgcccttttgcgggcgagcgagggcgaggctcacgggtgcgctttccaaaggaggaaaggtgcgcggagtcgccaccaacgtttatttgtggaaaacgtcgggaaaaccgaaggaaaccggtcaaaatgaaaattccaagttcgggagttatatttacgctttaggaaagtattag

SEQ ID NO: 31907 - DNA, 354 bp, Glycine max
  Peptide Sequence Number=SeqID_148685
atgaatgaaaataaagaaacattcaaattcatagacatccagcggataacaattaacaacacaaagaaagagccaatggataacaacacaatgaaagagaaagagagagaatgtgtaaaaagtttaaaggcatttgaagttttgaacaaatgtggaaccacactaaacacgaataaatctgaggcgagggacccaaggcacatcaacccttcaaaggcagcaagaaaaaccagagaaaaaatagggagcaagggcctacctgtgtggggaaggaaacggaggcgacgtgtgcagcaatggaggcgcttgcgggaacagcaaggagaagatgtagaagagttgttcttttggtaa

SEQ ID NO: 31908 - DNA, 297 bp, Glycine max
  Peptide Sequence Number=SeqID_148686
atggctgggacgccacatgtcgggctcgacccataccctcctggattggatcatgtctcgatctttacaccctcatcctctatgtgccccgtgcttgaggctagggggttgagtaccttcttagatcagatcatgtctcgacccttatgccctcagcctctatgtgccctgcgcttaaggctaagaggttgtgatgtagctccatatggagcttgtaggccttggatcttcttcatcaatggagtcctttgcttcttgaagatcaatggcagcggaatggagaaggaagaaagatga

SEQ ID NO: 31909 - DNA, 102 bp, Glycine max
  Peptide Sequence Number=SeqID_148687
tcaggaaattctcaagtacggttctaaggaaaggaattgactcacctattccgaccgaggagacagccattcgacagggagactcggaattgcggagtcttg

SEQ ID NO: 31910 - DNA, 1002 bp, Glycine max
  Peptide Sequence Number=SeqID_148688
atgggttccttggcagagctgcagtctttacaaattcgtaacaacacactctcaggaatatttccaaccagtttgaagaagaataaccaattgatatccttggaccttggggaaaataatctttcaggatgtattccaacatgggttggagaaaagctcttaaaagtgaaaatccttcgccttcgatcaaacagttttgccggccacattccaaatgaaatatgtcagatgagtcatcttcaggttttagaccttgcagaaaacaatctgtctggcaatataccgagctgtttttgtaacttgagtgccatgacactaaagaaccaaagtacagatccttctatctattctgaagcacaatatgttggtagctcttactcttccatctatagtatggttagtgtgctactatggctgaaaggaagaggagatgagtatagaaacattctgggtttggtaacaagcattgatctgtcaagtaacaaattattaggagaaatacctagaaaaatcacaaatctaaatggattgaactttttgaacttgtcccacaaccaattgattggtcatattccacaaggcattggtaatatgggatcattacaatccattgatttttctaggaatcaactttctggtgaaatccctccaaccatttcaaaattgagctttttgagcatgctagacgtgtcttataatcatttgaagggaaaaattccaacaggaactcaattgcaaacctttgatgcctccagctttattggcaacaatttatgtggtctaccactgcccataaactgcagctccaatgggaaaactcatagttatgaaggaagtcatgggcatggagtgaattggttttttgttagtgcgacaattggatttgttgtgggattctggatagtgattgctcctttactgatttgtagatcatggaggtatgcctattttcatttccttgatcatgtgtggttcaaacttcaatcttttcgctcaggttga

SEQ ID NO: 31911 - DNA, 171 bp, Glycine max
  Peptide Sequence Number=SeqID_148689
atgggtgcaagggataaatcaatcatgcacaagggaaataaaaatcttgtgagtgatcctggttctgtggtggtggtgggtcctgatccatggcctcctcattcaagtccagtgcaggagtgcctgctggagatgcctgtgtggaatcaatgttttccaagtttattttga

SEQ ID NO: 31912 - DNA, 524 bp, Glycine max
  Peptide Sequence Number=SeqID_148690
atggtctagcagttactatcagaggggccaagagagcgaggacaaggccagctgaggccccttccacatctacaactcttcttccagcacgtaccctaacagctccttctgcctcagctcctgcagattttcagtgttttgaagccatgcttcaaagcatccatcaggggcagattatcttattacaaagtttacaaatggtggcacctccagacactattccttcaatagagcagtttaatgagtgggaagcctggcccgtaactcagtcttctcttcacaaggaagatgaaggtcccacagcccaagtaccacagcagatggaggatgagtcatccgagactaccattccagagcccttggtcagaaggaagaaggcagatcaaacacaagaagttgcagccactttcgacaaatctcttcaggccacttctgagccttcagtaccagtggcagatacagcttcacttcagcaggcaacatacccttccactcctgtgttggatcaagtggcctcggaataa

SEQ ID NO: 31913 - DNA, 204 bp, Glycine max
  Peptide Sequence Number=SeqID_148691
atgactagaggcatacttaaaaggacccaacacagtgatgaggacacaactaagggcaaggaccatgaagcacttgaagggcctatgaccagaggcagacttaaacaggttgattccttgtggcgtcaccgtgacttatcttccacttttggaagtggcgtccctctccgtcaacaatcttgtatcaaacgatccgcctcgtaa

SEQ ID NO: 31914 - DNA, 414 bp, Glycine max
  Peptide Sequence Number=SeqID_148692
agaactctggctggagggctaacaagaaagtgctcagaaaagtacaattacgcagccaggttgttcaattccaaactttcaaaggaacttgattccctcggtcacaacttgtcagataccaggatagtttacattgatgtttactcccctctgctcgatatcattgataactaccaaaaatatggctataaagttatggacagaggttgctgtggcacaggcaaactagaggttgcagtgttatgcaaccctttggatgacacttgttccaatgcttcggaatatgtcttttgggatagttatcatccaacagaaggagtgtacagaaagatcgtaaatcatgttcttgaaaaatttaatattcatagcaggcatcgatccatctcagggacgtttcagatttttcctctgtga

SEQ ID NO: 31915 - DNA, 843 bp, Glycine max
  misc_feature (792)..(792): n is a, c, g, or t
  Peptide Sequence Number=SeqID_148693
atggataaggtattatgggagagactagtaatggttgtgtttgttttctttgctatcccatttcccaaagtattagttgttaacggagcaattccggcattgtttgcatttggtgactcaattcttgatacgggaaataataacaatatcctagcaataactaagtgcaattttcctccgtacggaagggatttcccaggaggaatacctacgggaagatgttgtaatggaaaaattcctacagatttaatagcatcggctttgggaataaaagaaacagtgccagcatatctgagtggtaacttgagtcctcaagacctcgtcaccggggtatgctttgcttctgctggttccggcattgatgatgccacttctaggttacagggagttgtatcactgccaagccaactgagattgttccaagaatacataggaaagcttacagcactggttggacaacaaagagcagctgacatcatatccaaaagcgtattcctcgtctcagccggcaacaatgacattgccattacctattcttttctattagccccaacattgcagccttttcctttatattccactcgtttagttaccaccacttctaattttttcaagagtctttatgaacttggagcacgacgagtgtgggtattaagtacattgccacttggatgcttgcctggaggtagtactgtggcagggggaccattaaggatttgtgcaccctttgcgaatcaatttgcacagacattcaatggccaattatcatcagcagttgattctatgagagtnccctttccaattatgacattaggttcatcgatgtctacactcctctactaa

SEQ ID NO: 31916 - DNA, 396 bp, Glycine max
  Peptide Sequence Number=SeqID_148694
ggtgtcacacagtccgcccataccttgcctaaattcaccgaaagggaatcacacccctacgcagacatacctttggggtggaaaccactcaacctcgagcggtacgatgggacaacagttccagacgagcaaattgacgccttcctgacattggcgaacctctacaccaacgacgacgcgattctatgtcatgtcttccctatatttctcaagggagcagctttgacctgtgggctaagcgcacatccaccgctaagcgcgacagaagaatctggcagggcggcagcatcaaggccgcgcgctaagcgcaagattagtgtgctaagtgcagcagatgtctttagccaggctcagcgcatgactggcgctaagctcgaatccacttacccgcgctaa

SEQ ID NO: 31917 - DNA, 309 bp, Glycine max
  Peptide Sequence Number=SeqID_148695
atggctctcatgcagcttactagctctcatgttgccttattgctccgtttcatagtaatatttgctctatgttacagaacaatggctttggtgaagttgccaccaaacgcttcatcagttccggcagttttagcgtttggagattcgatcgtggactcaggcaacaacaacaacataaaaacactgattaagtgcaacttcccaccttatggaaaagattttcagggaggaaacccaactggtcgattttgcaatggaaaaattccttctgacctaatagtgccctgtatgaaaactttgaaagtttag

SEQ ID NO: 31918 - DNA, 228 bp, Glycine max
  Peptide Sequence Number=SeqID_148696
atgcagaaaggggtgatagtagatctgagaaactgggacagggaaaaaacagagaataagctagagagggtctttcgatctttggcttatcgtgtagagcttttggaagcaaacacagagccaatgacagaaaagaaaagtgtctcagtctctgaggtgaatgagagagagagagagagagagggtggagactggagaggcatgagcgaaaggaaaaagaagctctaa

SEQ ID NO: 31919 - DNA, 819 bp, Glycine max
  Peptide Sequence Number=SeqID_148697
atgagtaaagaagagtttttgaagatacagaaatgtgttctcaaagtgaacatacactgtgacgggtgcaggaacaaagttaagaaaatcttgcagaagattgatggggtgtttaccaccgagatagatgcagaacaagggaaggtgacagtttcagggaatgtggaccccaacgttctcatcaagaagcttgcgaaatcagggaaacatgcagaactctggggtgctcccaaaggaaacagcaacaacaaccagaacaacatggcgaaccagttcaagaacatgcaaattgacaatggcaaaagtggggcaaacaacaagggtcaaaagggtggtggtgtgaataaccagccaaagggtaataatcaacagcagcagaacccccaacagcagcagaaccctcaacagcagcttcagcagcacctccaacagcttcagcagatgaaagggtttcaagatctgaagctgcctcaattcaaggacatgaagctgcccaacccgaacccgaatccgaatccgaaagcggttaagttcagtttgcctgaggatgatttatctgatgatgaattagacgagttcgacgacgagtttgacgacgagtttgatgacgatgatatggatgatcctcagcatcctctgaataagatgatgatgatgaagccccctatgggtgctaagcctcctattggtagtgtccctatgggtaatggggctcagatgatgtcgaacagtatgatgaatgctcagaaaggtggcaatggtggaggtaataatgggaagaaaggaggtggtggtagtggaggacctgtgcctgttcaa

SEQ ID NO: 31920 - DNA, 1050 bp, Glycine max
  Peptide Sequence Number=SeqID_148698
atgaaacatgtgttctgcgaaatttccacttctcttaatctcagtctcaatagcaagagaataatattcttaatttttggggacagtctcactgcttttcagattgaaataaagcatcaaagaaagcttgttaggagcttgaaaaagaaatctctttggtccagaaatttggttgagatagttgaaaagcttgttgagatcgttacccatatagatcaagcaattttggagttccttggagatcatggtgcaaccgctgtcaagcattgtaatggttctgaaagacttggtgaagctggcctctcactgcactatgctaacattatcaatcagataaacatgattgcatctcgtccaaccgttcttcctccaaatataagagacacattgtatcatggattgccaaataatattaagagtgcacttccttcccggatgcaaagcattgatgctatgaaagagctctccatcactcaggtcaaagctgaaatggacaagactctgcagtggctcaatccatttgccacaaatacgaccaaagcacatcaaggttttggatgggttggcgaatgggcaaatacatgcaatgagtttggagaaaatatggccagagaaagtaacctgattcgcctccaaacactttactacgctgagaagcaaaagatggatttttacataatcgaattgttgactcaccttcactatttggttacatttgtaagatacagacacaataccatgaggccaatgccaacaagaacttctcctaggcgacttgattttcaatcaaacatgttgcaatttatatctttagacagtattaacaagcctttgggatctaaactttctcaagaggataaaagattattagaagaggtaactatgaggaaaagaagccctggagttagcaaaagcgagaatcttgaagtaaccaagaaaagaagtgccaaagtttggcatcatagcaatagtgtaggaagttcacctgttactagagaaggcttggagcaccaaagatctaatgttttggatattatagatgggctataa

SEQ ID NO: 31921 - DNA, 801 bp, Glycine max
  Peptide Sequence Number=SeqID_148699
atggtgttccatttcgtgattctagttgctgctatctcactctgcattagaaaccctgaaatgcacctattgtttgacctttccctctcgttttttagttatttcgagattgggtttgaagaactgagatcaacctcttccccacatccttcttgcttcatttgttcgtcttgcattactatcttatactttgccaaggaagaagaaaaatgtaggtttgttccattatatcccgaggcatttcagccggtcagaatcccctttcagaaaggagttggccagaaatttgctcagccttcaggaacaggaattgacctaggcttctttgagttggatgatctttcaaagccctcacctggagaagatgtctttcctctagtaatatgtgctgaaacaagtttgaaaactacctcagaagatgaaactcctggtgattccttgctagacgcatcccctcacatgcaaataactcaaggtgtcttagagaaaagtaatggtgctggtccattcctaataaaagtagttaagcagattttgtggattgatggtgttcgttatgagttgagggagttatatggaataggaaactcatccgcagctgattttgatgacaatgatcctgggaaggagtgtgtcatatgcatgactgaaccaaaggatactgctgttttaccttgtcgacatatgtgtatgtgcagtgagtgtgcaaatgctcatcgacttcaatccaataaatgccctatatgccgtcagtctattgaggaacttatagagatcaaggtgaacaatggcgatcattga

SEQ ID NO: 31922 - DNA, 510 bp, Glycine max
  Peptide Sequence Number=SeqID_148700
atgaagatcggggttatggtcgtcgacctcgaggcgcagggtgtctttgtggacattgacgtagttccttatcttcttggcggtctggtggtcgacgacgagggacgggccacgcggcgagctggggctggggctgggggtggtagtaatgctgcgggtagtgaaagcgaggggcgagagtgggagtgccgtaggaattggggttggagctgtaatagaaagaaattgagtgggtttgtgatgttggcgtcggcggcatgggagggggaggggcgtaaggggttgctgaagggagaaagtaaccttgcggctgcggtggtggtgcagggtgggattctgtatggtagtagtaagaagggggtggaggtggtggtcggttttggagttctccttctcctgcgagaaacagaactttcagaagcggaatcgctcactattgatccgattccaccgtcatcggatctttctgcagccaccgtctatcgcacttcgttgccgtcattggcgccg

SEQ ID NO: 31923 - DNA, 666 bp, Glycine max
  Peptide Sequence Number=SeqID_148701
atggaagcacagcagctggaagaagataacaatataagggagaagggatttgggcttggtggaggttatctttttgggcttccagtgggatttgttgctgactctattggtgcaactgttggtgccggagctgcatttcttcttggtagaacaattgggagatcatttgttgtttctaggttgaaggattatccacaattcagatcagtggcaattgcaattcgaagatctggctttaagattgtattactgcttcggcttgttccactactaccatttaacatgttaaattatctcttgtcggtgactcctgtttcaataggggaatacatgctggcttcctggttaggaatgatgccaataacactggcacttgtttatgttggaacaactcttaaagatctttctgatgtgacacatggttggggcgagttctcaaagactcgttgggcgtttatcattcttggtcttgtgatatctgttgttctgatgatatgtgttaccaaagttgccaaggctgctttagataaagccttggccgaaaatgaagatattgatgggattacttcctcgccagatttacctattgttgctgaaccatcagcagatcttaaccaacctctcataattaagatagattcttctgaagacagtcatgaaaagtaa

SEQ ID NO: 31924 - DNA, 294 bp, Glycine max
  Peptide Sequence Number=SeqID_148702
atgaatgcaaagagaagagaagatatggttgatgtactttcaaagagaagaatattggcgtggcatagggagtcgcaggggaatcgggacacaacggcgtacaccaccatacccgaccacagcattcagtcaacggcgcaaggcatgacgagtgcagttctacgtgtccccctacgcccgcatccgatcaacgctctgcgagctcagacggtgtttcttgaagaagagtatcatcggcatgagagaagagtcgcgagttcgagaatggaatttcaggaactttcaggaggatga

SEQ ID NO: 31925 - DNA, 1785 bp, Glycine max
  Peptide Sequence Number=SeqID_148703
tttgtgatgccagaaaaggtagagagccacagggctctttggtcttcttctattcattggcgttttgggttgctcactgctcttgttttgggtggcatggttgtggtttggaccattgatggcttcactgttaggaacgttattgaagcttggagctggagctccccatatggtccacttagtttgaatcaaaaccaaaccaatgctactaccctttttggtccccacaatcttgtgaacatcacattgtctgagcacagtgaaactgtttctgctaagaactatagtagtagtggtgtctctgataagcttgacacaaaaaccccactgaagcctgaagtcaaggggcattcaacttggctttcaagtgaattagagccaaacttgacttcaagtcttctagcaagatggttagctcctgggggagaaccttgtaaagattctaagacagtgggaatatcaattcctgggttggatgatgggaaactgatagagctatcagctggggaagtgcatgagtttggttttcaggcattggatgatttagggaaacctcgttgtttaggtggggattactttgagactgatcttgcaggggagtcatggaaatctaggccattggtgaaagatttcagtaatggttcttactctatttccctgcaagttcatcctgattttgttggggtttacaatctgactgtaattctgctttatagacactttgaaggtctgaagttcactccatggagatttgtctacgatcgagtggtttggaatgttgcaatcaggttctacaaaagcagtgctcagttaccagaacttgagacttgtaaagcttctgattttggcaaggatgtgtggtgtggaaggtggacaaggcatgcgaagaatgatggctgccaaataggtaatgatggtaggtacagatgcttggcaccagattttccttgtaatgctccatggtgtgatggttcgttgggagttatagagagtaatggttgggtgtattcaactcactgctcattcaagatgttttcagctgagtctgcttggaagtgcttgaagaatagatggattttcttctggggtgattcaaatcatgttgatacaatacgtaatatgctcaattttgtcttagatttgcccaatatacattctgtccctaggagatttgacatgaacttttcgaacccaaaagacccttctcaaacagttaggatcactagcatttttaatgggcattggaatgaaacacaaaactatctaggattggattctctgagagataaagggtttcaaaatctgttgaagaagtacttctcagaagacacaatcccagatactgtgatcatgaactcaggattgcatgatggcgttcactggcgtaatataagagcattttctgctggagcagactatgcagcatcattctggggagatgttatgatctcagtgaagcaaagggggttagcttggccaagagtcttttatcgttccacagttgcaactgggggatacgcaagatcactagcatttaatccttacaaaatggaggtgttcaatggagtgctcatagagaaattgaagaaagctggcatcatcactggggtgattgatgactttgatatgacattttcatggcattttgataaccggtgtaatgatggagttcactatggaagggctcctgcaaagatgaagtggcgagatggcaaaattggtcatcagtattttgtggatctcatgttagctcatgttctgctcaatgcactatgtgcaagatga

SEQ ID NO: 31926 - DNA, 111 bp, Glycine max
  Peptide Sequence Number=SeqID_148704
atgagaacaattaatgtcagtggtggaggcagcgacgacaattatgacagtggttatgatagtggtagcaaagatgacgaagatcttgatagtaaaggtggtgatgaatga

SEQ ID NO: 31927 - DNA, 537 bp, Glycine max
  Peptide Sequence Number=SeqID_148705
atggatgatgtctccttatcttgtgatgattctttacattcagagtcacttttgcatggtacaacaacgaatatggtgacaaatatgcagcgtcttacatggttatggggagatgcaattgatgatgaagagattccaaataaggggagtcctatcaacactatgaataatgttacaccttggcatctcttaggatacttcaaggctgtaatgggtgctcatgaaagaggggtggttagttacctcttcccatcttttgctttgaattccactcttaggcagtctatctttatggaattatatttcatgcctcactctccccaaatcataaacagatcacactcccttgcttttgtgatggaagcttgcttgtggggattctatggaggctggatctttgagcttcaatggggtcctttaatggtgattttccaccatggagatgcagcggaagacaaaggaaaggagcttggagaggatgcttcaatggaggaaaagaaagagggagagaaagagggagggggagcacgaaattga

SEQ ID NO: 31928 - DNA, 327 bp, Glycine max
  Peptide Sequence Number=SeqID_148706
atgatgaagcacggttgttcatcaaagttgcacactaaagaagagaaagaagtcgctaaaatgcttctggagtttcagcattcagaacctcccttgttgaattggggtcgcaagaggaaaagatctgcagttcaagattgtttttctccatctcttgtttttctgcaaaaccattcgcgtcacacaagaacggttatgaagaaggtgctgctgaaaacggagaacgcttccagccctgatacacctctctccttccatcccgatgaaaaccctaatctctccataaaacaacagtctcccaaaaaggagttggactcaattcaataa

SEQ ID NO: 31929 - DNA, 468 bp, Glycine max
  Peptide Sequence Number=SeqID_148707
atggtggtcaccaattttcattttgatttacagctaattaatggccaaaaaagtgaacccactttggaatttggcgggtcaatgctgcaatcggttcatgtcaatggttcagtcaacccttccggttcgaaggctcaaaatgaaaagcttctgatgatgccttttcagaatcagatttctggagcaacccaaagtgagagatttcttgtgtctggccatccaacgacgtcgttgcaagtgccattaacttcatctaatggattgggccacgaggcccatctggcccatcctggtctaaacaccaacccagtagagttcacccaaataaactcgtctcaatctcaaccgttggatgaggccacagcaaacagggaattgaatagagcccttgcagctgaagcaagacggaggaggattctgattttcaggctaaagtacagccaaaaatcacgtaatgattataggtga

SEQ ID NO: 31930 - DNA, 393 bp, Glycine max
  Peptide Sequence Number=SeqID_148708
atgaagaacggtggaaaaccttcgcgaaatcgcccacggaaacgtcttggaagctttacggaagtgcctcggcttggattttcttcacagaaacaatttttctcactaattttaagtgattctcagataccaggagggggaaaagagggaggtggttgccgctcagctcgcccaagcgagttgggttgcttccaccagaaggcaccgccttctgttggaacatcctggaagtcccaagtgggcctgattgctatttattgcgcattaatgcttcctttcgactcccgacatgtcgcggaacttcacggatcgcctaacaatggatgtcaagtacctcgaagtggtcaagcgaaggtcgcatcccacaaacagatggtccccagacgaaattag

SEQ ID NO: 31931 - DNA, 492 bp, Glycine max
  Peptide Sequence Number=SeqID_148709
atgccacagcataaaaggaaaaagatgatggctctgccaactaatgtgatgagagatgactcggacaaggttttaattcacggtcaacctggggaggaagttaatctggagttaatccttgagttgttgctgacgttgggacttccaaatgctgggaaatcaacacttctggcagccattacacttgcaaaacccgatattgctgattatccttttacaacattaatgctaaatcttggacgccttggtggtgatcccagcttcggggcaggaatgtattcatctgaagctacattggcggatttgcatggtcttatagaaggtgctcacttaggaaagggtcttggtcgtgatttttttaggcacctcagaaggacccggctattggtccatgttgttgatgctgccactgagaatcctataaatgactacagacctgtcagagaagttattcattttaacacatcaaacatgtcaagtgaacaaggttaa

SEQ ID NO: 31932 - DNA, 180 bp, Glycine max
  Peptide Sequence Number=SeqID_148710
atgtattgccctgttgtgcaaatcgccactgagactggctccattgctggtcaaatcgccatttacagtggcgagaccactggaatcgccaatggcagtagcgtttttgctgccacgtgttgtacgtcggagtttctcgccagtatcgttggcgatttacatgtctcttacgtaaaataa

SEQ ID NO: 31933 - DNA, 237 bp, Glycine max
  Peptide Sequence Number=SeqID_148711
atggcggagcggcctggggttgacggacaagacaatgataagattcacaggagacaactagagcgcagaggcatcgttctcggatacctcacttgttacaaccttttggaatccctcacccaaaaatcaaattccaaagctcatgggattcctcatccacgagtgctagaaaccctatcccaagacttccaatcttgcaaacttcttctcaaaagatcaactactcataagccttag

SEQ ID NO: 31934 - DNA, 798 bp, Glycine max
  Peptide Sequence Number=SeqID_148712
atgggatcaagtcaaacgccttcgcttaaaaagaggttctatcaagtcaaggtcaagagcctagggaccaccagtctaaaagagttagggcaattgatgggtcagctccagcgccatgcttttcgcaaagcttatgaggccattgcctcccttgcccagtattatgatcagccattgaggtgcttcacctttggggacttccagctatcacctatggtagaagaatttgatgagatcctaggatgccctccagggggaaggaaaccttacctcttttcagggttctatccctcattagctagaatttccaagatagtccaaatctcggcgcaggaattagaccacaagaagcaagtaaaaaatggggtggttggaataccgagaaaatatttggaggtagaagcaagaatcttggcaggtaaaggcgagttggtcctgttcatagatattctcgcactgctgatcttcgaaggagtcctctttccgaatgtggatgggttggtggacctagcagcgatcgacgcttttctcgcctatcataaccacaaggaaagcccgattgtcgctatgctagccgacctatatgacaccttcgaccaaagatgtgaaaagagaaatacgaggattgtttgctgtactccagctctttatgtatggttggtttcacacctttttcgccaagaggtgaggcatgcttgcccgctagaaagccaccgttcatgcacagagaaaggaggggcaaattgggaccgactcttagcaaacaaagaaggagcgtctgccaactggttcccttga

SEQ ID NO: 31935 - DNA, 408 bp, Glycine max
  Peptide Sequence Number=SeqID_148713
atggcttgggttatcgatcggtgtatggattccttgagcctcaatctatacacaatgcaaaggacagacgtggccaatgtgaagaatatatcgaaaaatgggttaaggaatcgcaacgacaacgcccattggcaaatggttgtgttgtgccctaaagacaatgtcgtggtctggttttgttcagtgcgtagaaagtctgatgttcatatcaaaactgcaattaacaatgcatacaagaaattaaacacgactgctgatggcaaagttcctaaaactgcaccccagtggcttgaactgaagtggttcggtgatggctcggcactagactcggaggtgatcacaacattacgtaaaaaatgggcagcttactttttgaaacttagaaccatccaatgtagaaagctgtaa

SEQ ID NO: 31936 - DNA, 699 bp, Glycine max
  Peptide Sequence Number=SeqID_148714
atgccctggcctgcggaggactacacgtcatcgccttcaaaggactacacgtcttcaccttcagaggactacacgtcctcgccttcagagggctacatgcgctcgctttcagaggactacacgtcctccccttcagagggctacatgcgctcgatttcagaggactacaagtccttgccttcagaggactgcgcaccctcgacatcagaggactacacgtcctcgccttcagagggctgcacgtcgttgccttcagagggatacacgccctcgccttcagaggactacacgtcctcaccttcagagggctccacgccctcgccttcggaggactacacgtcctcgccttcagaggactacacgtcctcaccttcagaggactgcacgtcctcgccttcagagggctacaagcgctcgctttcagaggactacaagtcctccccttcagaggactacacgtcctcaccttcagaggactacacgtgggctacatgcccatgccttcagaggactacacatcatcgccttcagaggtctacacatccttgccttcaaaggacaacacatcctcgccttcagaggtctacacatcctaactttcaaagggctgcacgccctcaccttgagagggctacatgccctcgccttcactgggctacacgccctcgtcttcagaggactaaacgtccttacctttaa

SEQ ID NO: 31937 - DNA, 315 bp, Glycine max
  Peptide Sequence Number=SeqID_148715
atgggtgcactagattacctctccaacttttgcactgtaaccagcactaggaccaagcagaaagcaatgcagacaacagagataaaagtgagaatggactgcgatggttgcgaaagaagagtgagaaatgcagtgagttcaataaaaggagtgaaatctgtggaggtgaacagaaaggagagcagggtggtagtgagaggatatgtggatccaaagaaggtgctgaagaggataactgaaagtgctactgtccaaactaaaataaaggagatcatatcgaatgcaaaatgtaaaaaccgatttagcaaagtttag

SEQ ID NO: 31938 - DNA, 213 bp, Glycine max
  Peptide Sequence Number=SeqID_148716
atgtcaaatgaagaattgaagttgcaggatccacgatgtcggatacaatgtcctgacatcctgcccgagaatactggagttgctgatccacgatgtcggatacaatgtcctgacatgctgcccgagaatactggaattgctgtacaatgcaagataaaagtcaagtgcagaagtgaagctgcaggatccacgatgtcggacacgatgtcctga

SEQ ID NO: 31939 - DNA, 942 bp, Glycine max
  Peptide Sequence Number=SeqID_148717
atggccgcgcccgccagaaccagcagcagtaccaggaacaccgtgcggccgcacgttgctgcggtcatccgggtcgtacagcagcgtcacgtgctcgcgcgggatgttggccagttcaatcagcgggatgaagcggcgcacgcgggcctgctgcacgctgccttcgcggtcgatgtattccagctggaactccacctgtggttgttcgttgaggtaggtgccggtctgacggaccttcaatacccgggcctccacgccgatgccgcgatacttcagcgcatcaccgcgggcatcggcgtgcagcaggcggccgagcaggcgcagccccagcgcatagccacacagcaccagcgggcataccagcagcgggtgaccgaacgacaggaaggtccagcccagcccctcgttctgcagccggtaggccaacacataggcagcggcaacggctgcgatgccgagtgctgcaccgatgccacgccgccacaggctggcgacattcagttcgggctgcgcaccgtccagcacgatgttggggaatgccccgggcgacaactgcagtttccactgcgcgaagccgcgcacctgcacgccggtctgttcggcctgttcgatcagtgcactgcgcggttcaccgtcggccaggatcgactgcacccggtgcagtgcgcgcggtggccccagcaacaggtagtgcaggaaggcgaacagcagcgtcagccacaaggccagcgacagtgcgagcagcaacagtgccggccacggcgcgctgcggtcgaccagggccaccggccacgaagtgccgaaatagagaatgcagggaaaaggcaacgcgaagaacagcaggaacgcgccccagaaccagagataggctttcatgggggaaggggaccgcggtggaacagggcgcgtagattactacgcttcagcggaactgcagggtaa

SEQ ID NO: 31940 - DNA, 228 bp, Glycine max
  Peptide Sequence Number=SeqID_148718
atgcaggacgagaaatctctgattgaacggtcttggaagttaacactcaggagggcaggactcatacgcgattctcctcaaatttcagccagcccgcatcatttagactttgcaccttacgcttcagggtcatacaacgctcaatggaatgccccagggctcctccatgataagcacacattgcgttcgagtcgtatccttagacaaatggaggtcgaggaaacctag

SEQ ID NO: 31941 - DNA, 333 bp, Glycine max
  Peptide Sequence Number=SeqID_148719
atggagcatgaaactgaaaatagaaaacaaattgaagagcaaagcaagcaagtaaagcaaagaagtgagggccagagctatgggatcaaagatccaattgcgcttgtcctttgcgacctcggaaacgttgaacctgatgaagttggccctgatgtctgtgtgggaggagtgaaggggcacataggagtagacgcacgctgtaggctgagtgagatccacgcgaggaagaggaagaaggcgaggacgaagggtatggagtggctacctcttcaacttcctcttcctggtgcaggacgcgtccgcttcgtctctggcattagggttttaatttga

SEQ ID NO: 31942 - DNA, 258 bp, Glycine max
  Peptide Sequence Number=SeqID_148720
atggagcttacatcatggaggttgatagacctttctcaagctcactacggccatctagttgctaaattcctccatggattggtgtttatgttgattgggcgttctgggtcagaggggcgttgggcaagggggggtgatgcaatcctccctaggaaaggaccagttaccagagccatgagcaagaggctccaagaggattgggctagagctaataaagaaggccttagggttctcatgaaccttagggtagatttttga

SEQ ID NO: 31943 - DNA, 303 bp, Glycine max
  Peptide Sequence Number=SeqID_148721
atgaaagatcctattcttctcagaacaaatgcttctctaaattctatcaagagtcgatatcccaacatctcaagtttatgtgaatttttcattgccaaataccaagaaaattctccaagttttaaacttgcccagaggaacttcgttcaaagtatggctagatattgcctggtgaaggataggcataatgggaacctcttaaccgaatgtgtttctttcaccctttcttctttcatatcttcgattggtgatactgccctagcaagtcctttcgataagtatgtcaagaggtatgaatcataa

SEQ ID NO: 31944 - DNA, 231 bp, Glycine max
  Peptide Sequence Number=SeqID_148722
atgtcgttgaatgtctccgttatcaaggttgaggcgggcaaggttgaagtactcgcgagcgacctagatgatggcggggtcgagctaccagtagtggaggagggtggagaggtggtggaggaggaggaggcgggcgacggtgccgacgctgaagtcgaggaaggcaagggggcagggggaacgctatttgtgctagggtttatactggattgggattctagaagcatctaa

SEQ ID NO: 31945 - DNA, 249 bp, Glycine max
  Peptide Sequence Number=SeqID_148723
atggggttcacagagcttttgtatttcccagtacttacttgcaaggattcctcactaaaggcaccaagctctttattaggtaagccaggttttgttgtacacttaggttcatttggttgggttaatgaggtagactctactgcagagcgagcagctgctaagcgcaacattcctgagctaagcgcgaggaagaatccagaagaagatgagttgtacaggttcgataagcgcaccgcttcatctctctaa

SEQ ID NO: 31946 - DNA, 237 bp, Glycine max
  Peptide Sequence Number=SeqID_148724
atggaatttacaactactcctcttctttggaaacaacatcttcacagatctggagaatcatatgctcaagctatgccttttctagatcccataattgaatctttgttggttcaagcttgggtttcagatgttgcaaagcttgaacaagttaaaatcgatgaccctttagtgattgctttggttgaaaggtggagacttgaattatacatgtttcatcttcctattgtgaatgtataa

SEQ ID NO: 31947 - DNA, 102 bp, Glycine max
  Peptide Sequence Number=SeqID_148725
atgacttcatcatcagtaaatgcaattatgtactacaatggcgccttcaaaacaactaaacatggttcaatgtttgaaactttccaacctcacaagccttaa

SEQ ID NO: 31948 - DNA, 312 bp, Glycine max
  Peptide Sequence Number=SeqID_148726
atggtcatttcgcacacctttttgccattcggagacaattgtgtccgatggcacacagagacaaattatggtcattctgcgccccatttgtcatccagaggcggtgagcatgcagagaaaaattatggtcattccgcacaccttttcgccattcggagacaatcgtgtccgatggcatgcagagacaaattatggtcattctacgcccttttgtcatccagaggcggcgagcccgatgacatgcggagataccttatggtcatccgcgccttttgtcaattgagaggaacgagttcggcggtatcaggatga

SEQ ID NO: 31949 - DNA, 213 bp, Glycine max
  Peptide Sequence Number=SeqID_148727
atggtgatgacgatggtgattgtgcatgcggagcaacgtagatctgggtgttggagagttgtacgcaaacttggagaggacaaagacatggataaagttgatgtggaaccaaacgccaccaaaatgaatagatccactcccaccaggctcaaacagtccatattcgccacctctgagtggatttgcttgccacctttgattttgaagatctag

SEQ ID NO: 31950 - DNA, 258 bp, Glycine max
  Peptide Sequence Number=SeqID_148728
atggggagagctccttgctgcgagaaaatgggattgaagaaaggattatggactcaagaagaagatctgattctcatccatcatatcaacacacatggccacaaaaattggcgtgccctacccaaacaagctgggctgttgaggtgtggaaagagttgcagactccggtggataaattatttgaagccagatattaaacggggcaactttaccagagaagaagaggacatgattgtggctgtagcaagtattgcgtga

SEQ ID NO: 31951 - DNA, 930 bp, Glycine max
  Peptide Sequence Number=SeqID_148729
atgtataccagcgcagatgtcagacgcaacactagacagttgccgctcgtgcttatcttctacatcttttgggttgcactctttttgctaataagagtacaacccatgttcatgtcgcacacatacaggccctacgtgacctcactcttgctgggcggtatgcatgaggagctgttggcctcgtccatatgtacgatcagcttaatgatgccagtctcagcaccagccgatagcttgctgtgttggatttacgagcacttttcatcagttgtaaagtgcaatgctgatttagactacgacgaggtgtcaccacgcgcatgtcggtggattgcaacaaagaagactgtgaagaaggtatctacagcgacgtacaggcagtgcctggatcgtctgagaatcccagatgtctgctggatgccatatgcggagcaccgacctgtgcagaactttcatttgattttgtgcttctcgggacagctccgttgggggcctattgttgtcagatacaggccggagagggttatacgccagttcggctatgtccagtgcattcctgcacaccctgtccattcatgggtgtcatatgatgacgtggacgatacatggacgcactactcagaccatctagcgacagcaggtgatctatgtgttgtgccaggtcagtgtgcgcctgactacatagattggttctttgtcatatcgcatccattcatgactatgccacagacggatcctcctcgagatgcatatgcgacgcagcccagtcatatccctcctgaggcaacatcggcatcgacacatgcggatcctgatgcggacgagcccagacatgcagtggaggcttgtcatgcgatcatggaggtgttggagcaggatctaaatgcgccaggattgctaggggtgtcacataagaccgcaatgtgtatgtga

SEQ ID NO: 31952 - DNA, 237 bp, Glycine max
  Peptide Sequence Number=SeqID_148730
atggagaaaggtacaagtcttcctatggagaaaggtttcaagatcctgttgtttcctatcattgatagtctaggaaaccccttaagaatttttatggagaaaggtacaagtcttcctatggagaaaggtttcaagatcctgttgtttcctatcattgatagtctaggaaaccccttaagaatttttacatgtggtatcagagcatgtgttatgaaatttatgattctccaagaatga

SEQ ID NO: 31953 - DNA, 264 bp, Glycine max
  Peptide Sequence Number=SeqID_148731
atgttgaagtccctggtcacaattattgtattctttttgattgttcgtgttcaagatgatttgggtgatgattcactttttatgaagtcactaacgcttttccgaaaggactcaacacttgaaatgctgtatgacaattgtgaaaatgctggttcccttaaagcaagagttagtcaagcagtgaagcatgaatcacaaagagagaaaagccatatagccaaaaagccaacctgtgctaaaatttatcccttgcacaattgttga

SEQ ID NO: 31954 - DNA, 297 bp, Glycine max
  Peptide Sequence Number=SeqID_148732
atgtgcaaagaccatattagtctccttgaagcagtaacttccagagccaggcagcgccagaggtggccaccagttcactctccgatccaaataagaaactctgctggagaaactgtggtggtggctaatgctcaagggcgcgagatgaaaggagtagctaaagcatcggaggaggtggaagcaaaagtgagaggctatggaaatatgtttgattgcaacatatgcttgaagatggcaagaaatcttgtggtgacctgctgtggtcacttgttctgttggccatgctattatcactag

SEQ ID NO: 31955 - DNA, 765 bp, Glycine max
  Peptide Sequence Number=SeqID_148733
atgaagaatttatgcagcgggaagaaattctctggtaccaaaagtctcgatgcaaatggtaagcttttggcagtactcattcaaggaatttccatggttgttttcctcctcgagaggaattcgcaaagtaaccactttgaagagagatcacaaatgaggagattcatagaatcaatggaagattggggattggggagctttaaagctacagggagagatggcctacaagtctgtaagactttcatcccgttagtcattgcaacgtttcttataaagttgttaccatactattggcaaaaaggagaaggtgatggccaatctagtcagcccatgccaatatctaatttggcattgtatccaacaatgaggatgctttggaatggagaagcgttgagtgctttcttctctttgcaaggtcctaggccatcttatttcatgattgttgatgatctcatcttatttgtggaagacagtcttgagcagaggctcagtcaaggacgagtctgccttcttgccattactatagagtgcaaggtgtctaccgtgtccggattgatagttgtgacactctcgacaagaagggttgagataggatcagggcacttcaacatccttcaccacccaatgttgagagaaaggttgctgactttatcactagttcagaaaaatggaattttcatatgctgtaacatctcccagggagcatttgtaataggatcagggcacttcaacatccttcaccactcaatgctgatgatcaaatag

SEQ ID NO: 31956 - DNA, 232 bp, Glycine max
  Peptide Sequence Number=SeqID_148734
aaaaaagaactcagcatcaggcccagcccaacatctcgctcaacgcaaagcacgtgctaagcgcaaaggaagcagtcgcactaagcgtgcaacacgcgctaagcatgcaaaccagaacaatggcgctaagcgagagcagctcgctaagcgcgagatgcagcacgcgttgagcgagaggagcgcgctaagcaagcttacgatggcccaagtccactttagcagctataaatag

SEQ ID NO: 31957 - DNA, 261 bp, Glycine max
  Peptide Sequence Number=SeqID_148735
atggagttgaagtatctggtcaaagttcaatgggtaaaggattttacaatacggtttgcaacatcaaggggcagcacggggacaactgaaaaaggggcagcagagaagccaggtccgacttgtgagggttctgttacgttgaagttggtcggatcgatgcatagtactagtagtcacgactcagcaggaattcttacacttaagaagagtcgagacgaaaaatccacttgtagaggagtttcacttcatttattagaatag

SEQ ID NO: 31958 - DNA, 507 bp, Glycine max
  Peptide Sequence Number=SeqID_148736
atggatgaggatcaaaagaatctaaatgatatggctaaggtaatgatgatggttaacagaaaatcaactgacatgttcaacacaattcacattaaggatcaagcttgtgtcattgccgcaaactacgctgttgagcctacaactaccgctcaacctgcaactaccgcaaacgagttggggtttgtcactgccgcgattgagcaatcgggctatagtggcccacctgttatcgtacttggcataggctacgatgatggtgtcgttttcttgggccgagaaggggcgatgctccatgggggggctaagctgattgcaccatcggagcaggcacaacttgttggacctacccttaatgatttgaacctcttcggtgctccatgggcctttgattctgctgggcttgttggggttggactcggaagagcagcaatcaaaggaagagaaagtgaaggaagagcttttgttcgttacttccattctattgagaaaaacttaaaacttagttaa

SEQ ID NO: 31959 - DNA, 720 bp, Glycine max
  Peptide Sequence Number=SeqID_148737
atgccaaagcgtggtagaaccaagaaaaccgcgaaagcaaccgaatcagtaaccgaacctcaatctcaaacgcaggcaccacaattcatcgacctcgaaatccaagcgatgcagcgacaaatcgacgcgatcagggcggttcgcgacgtcgagatcgagcacctgctcacggagctgcggttcctgcgctcgcggttcgacggcgaggagctccggaagcccgtgctgcatgttttcgaagaaaccctaccgaatctcgccgtcgtcgtgaacggcgagtgcaacaagaatctggaagtgaaatggagagagacggaagggtgtaacgatggtgtgaatttgcacgcttctttgctccaaaggctgtccatcgcttccatccctcgcttccctgggtttgaatattctaccaatgaagggagaatgagctttattggtgctgatgacctgcatttcaaggacattgctttggaggaaccatctgacactcagactctagcagtgcaagaaggtcttcagactcccgattgtgtgaatgtgcagaatagccaactgcaccatattagttcggtgactagtcagaggttgtcagttgggatgacacccaaaacacttaggctgcccaaacctggcgagatgcttctctctgtgcatggatcacctctaggtgtttacaaggataataacatggaagccatacatggtatgaaaaatggttga

SEQ ID NO: 31960 - DNA, 270 bp, Glycine max
  Peptide Sequence Number=SeqID_148738
atggctacactttttgtgattcggcctagtccattgcatgactgttgttctgtcactgtcgtcaccatcgttattgttgtcgttgtcgttgtcgttgtcgccgccacaatcgtcgaggtggtggcagcaatgacgatgacaacagtcatggtggtagttgatgacaatagtgatggcggtgacgataattttggtggtggctacaacggtggtgatggtggtgacaacgacaataatgaagatcatggtagtagagatggtgacaattga

SEQ ID NO: 31961 - DNA, 120 bp, Glycine max
  Peptide Sequence Number=SeqID_148739
atggagatgcagcgaaaggtgcatgtatccaataatgatggtgattttgttgctgctctcactcattgcttaattggaaatctcccatctatgaagctgaagctactgccctactcatag

SEQ ID NO: 31962 - DNA, 981 bp, Glycine max
  Peptide Sequence Number=SeqID_148740
atgggagttagaagttggccccttgtgttgttctccttgtgtctattctgcaattcaggcctaagtatagccacaacattcagagaagaagagcaccaagaaatctcatatgaatttggtaccaagttggatgcagttcctgtagtaaaccctacaactccaggcacagcaaattcatttcctacactaaatccaacaacaactcctcaagcacctggctcaacaggacaaaccacacccacaaccccatacatgacccctataaacccttacacaaaccccacaacaccaaaaacaagccctacaaacccatactcaaaccctacaactccaactatggctccacctagcccaactactactactactactccgacaaccccaaccactccgactactactgcatcatcaggtggtcaatggtgtattgcaagccaatcagctgcagagaacactctaaaggtggctcttgactatgcttgtggctatggtgctgactgttctgcaattcaacctggagcaagttgttacaacccaaatactttgaaagaccatgcttcttatgcattcaatgactactaccagaagaatccggctcctacaagctgtgcgttcggaggaactgccacacttacaaacaaggatcctagtaatgggaactgccgctatacatcatccaaaacaccaagcatgagtccaccaacaccaacttatgtaagccccccaaatccaccaagcacaatgaccccaactacaccaactaccatgaccccatctgcaccaagcactatgacaccaactacaccagggatcatgaccccaactgcaccaggcatgacaacaattcctggtggagcatcagtctatggcactggaccagcaggaagccccaacacagcaacatctgcttcacattctgaagtgcttctactcaccttattcggcttgtgggcttcaattcgtgtagaaatttacatctag

SEQ ID NO: 31963 - DNA, 270 bp, Glycine max
  Peptide Sequence Number=SeqID_148741
gtagttgtgctcgacaaaggcatcggtgacaagtatgtcactctcccttggtacaaattcattcaagaaggtgattttagccatggagacaagctctcattcaattataggcgtgctgagaagatttgggaggttgttgatatgaatggcaacggaatggagaaggaagagagagaggagacgccacttcaaggaaaagatgagtctagaagaagctcaccaccatggaaggccatggataagagcttggaggaagaagaagatgaatga

SEQ ID NO: 31964 - DNA, 321 bp, Glycine max
  Peptide Sequence Number=SeqID_148742
atgttgttcgaggagatggaggaataccaagaactactgagacagttggaaccgcacattgctttgagaattgctcctcatgaacaaggaggttgttatgatgttgttgcaattcaagggactttgaagtggattcaggatcaaatattgtctcaatggagcgagagttatagagaggagtggacaatgttaggtagtgttggggtgacaaacacttcagcagaaagtcacttcttccaccagagcaggtttgaacagcaaagcgcgccttttgatgaagatcaacactttcagatcttagacttcatttattctttatag

SEQ ID NO: 31965 - DNA, 306 bp, Glycine max
  Peptide Sequence Number=SeqID_148743
atgaagaagtgtgagtttaagcaagtcatgtgggttattgattcttgtcgcttgggagacaagttaaaatttgcaaaccattcatcaaaacccaactgctatgcaaaggtgatgcttgttggaggagaacatcgagttggcatattttccaaggaaaacattgaagcaggtgaagagattttctatgattattggtatgatctagattgtgctccacaatgggctcttccacctgatgaggtttctaagaaagatgaatcgattgtttctcaaggcagggcaaagaaaaaccaatctcattgttga

SEQ ID NO: 31966 - DNA, 150 bp, Glycine max
  Peptide Sequence Number=SeqID_148744
atgacgatctcggactcattcaccggagaaaaaggaatcgcagaagatagtacaagtggaggtttcaatctcttctccgtctctctgacgtttgggaattctattggagcagttggaggaataactgaaggaatctcagggaaccgctag

SEQ ID NO: 31967 - DNA, 1107 bp, Glycine max
  Peptide Sequence Number=SeqID_148745
atggaagaggaccctacattacctcatgacgagcctcaagattcttctaaaaggttgagaaccccaaatgatataatcactgaaattgaccttcgttacatggaactcaatttggatgctaatgatgaagaaaaccacacaacatatggtgcatctttgaaaagtcttaacgaacattcttcagggaaatcaacagttttttataactatagccacgatgagcaaggcaaaggagttatggatggagaaaaagatctcacaaatgagatagaatttaaccaattgtccatttcaagggaagtgcaagcttatgagatgacaaatgagtcaaattggagacctctagagagagatttgtatttgaagggggtagaaatgtttggaaaaaatagttgccttatagcctttaacttacttcatggtttgaagacttgcatagaagtaactaaatacatgtctgcttgtgacgagacaataacccatggatccataccaagttcaaccgtggacaaaaaggaaaagatcaatgcagagttcacaaaagcttcaaactacgttgattttgaaagtgagacaatattttgctataggaccaagaaatggcttcaagatcacggtcgcaacgaaaaaagggcaaaccaagaaagtttaattattctcgaaaatctgctggccttccacctagatggagaaaaattgcttatgggcaaaatcaatataataagcaatatactccttgtgggtgtcagggaatgtgtggaaaggaatgtccttgtcttcttcatggaacttgctgtgaaaaatattgtgggtgttcaaagctttgcaacaaccgatttagaggatgtcgttgtgctaagagtcaatgcagaagccgacaatgcccatgttttgcagccaaccgcgaatgtgacccagatgtttgtcgaaattgttggttgtggcgatggttcattaggggagccacctcgatgtggagatggaaaatgtggaaatatgaatcttcttctagggctaaaagagaggattcttttggcaaagtcagatgttataggatggggaactttcgcaaaggttgatatgcttgtaactatttattttagataa

SEQ ID NO: 31968 - DNA, 180 bp, Glycine max
  Peptide Sequence Number=SeqID_148746
atgggatcgagtcagatgccttggcttaaaaagaggttctatcaggtcaagatcaagagcctaggagtcaccagtctgaaagagttaggacagttgatggaggccattgcctcccttgctcaatattatgaccagcctttgaggtgcttcacctttggggacttccagttaacacccacg

SEQ ID NO: 31969 - DNA, 303 bp, Glycine max
  Peptide Sequence Number=SeqID_148747
atggatcgaacccaaatccttctcgttggattaccaatcttcctcttcttctcagacattctcaacctcttctctcctcaaccctctcccaaaccaacccatcatcatctccctcccatccaccccaaaccgcaccctcaaccgcaccttcaacaacccctcgagttccccacgcagaaacaaagtggtattggccttattggaattggcaacaccgtgagcattgacttctgcacttcctgctcttacaagtttgttcaattccttgctttttttcaattccgatctaattgtttgatttaa

SEQ ID NO: 31970 - DNA, 1671 bp, Glycine max
  Peptide Sequence Number=SeqID_148748
atggcgtgggcgtgtgcggcttcacgtcgtactagtgggggcatttctcgccctcgtaggaggacgcgacctttcactgcttttagggagcctatcctggttattgtgatcttcccctattttgcttctgggggtgtgaggagaggtagtggcggtggagatgttagggcatctcctcgcactgggttgtcatcatccacacctgtcgtcgctagctatgagtgggttaagctagcaagccctgaagacacttgcaagttagtcgttcaggcttgcgggagtgatgacttccctttctggaaggcggcgtcaggcagtccaccctcatcttttatgtatatgtgtctctttgaggtcttgggtcttattctccccttgatcgctttcccatatgctctgcttgaacacttgaatgtggcttcttctcagctccacccaaacatttgggatatgcctgaccctaccaggttcaagttgtttgacgaggatttgttgacccttatagagagggtcaaaaaagctagtttttcggcgagtgatcccctcactaccgaggacggtattataggtgacttcgcctggaggccactcgtgaaacaggtcacctctagtgccccttcctctattttggaaaagaggaaacaaaattatggtgttgggtcatctagtcgtaacaagtcaaaggtgtttatgagccttcgtgccataagacaagctgtagggttggcgcacagtgcgggtcacccttcgatcatggaggatgtttctttggctccatcgaccatcgaggctcctactactgttgtttctgctgtacttgttcagaaggccactcctgctactggtgttaacgtgccagccacttcagctggttctgttgtcgttccatcgtccaccatcactgcatccttgttcagctcatgtagtgttggtgtggcgactgcaagtgctcatatagtgtcgcctcctccttcttcagctccaccctttgttgtattggggatggcgtcaccttcctcatcttcttgtcctcatgtctcattagatcacctgtacacctcaagcgatactaattcattgtgggggtgcaaacttcgacaaaaatttgattcagttagccgaggtgcagaatgctacaaattctgccaatgtctttctccagagaagtttggcgattctagaggagaacagacaacgtcactaaaaggctttgcaccgggtggcgtccttagaggcggaggttgccaaatgaaggagataaaggacctggctggcaaggtggagggcattgtggcaaagagggacaagctcacgaaggtggttgctgatttagaggcccaacttaaggagttggagtctagtctggaggggtctgagctacaggttgccaaggaaagggaggccaaaaaagagcttatggaggagctgctcatttacaagaaggagaccatggaattcttcaccaaggaccttgacttgggtctctttgatgctttcaaggacgtgaaggatggttttctacttgacgaggaagaaattactgcaaatgaggaggttgttgatgaggagcagggttctgaggagcaaggcgatgatgccactgttaggttaccttttgtttatcttcttttcttttgcatggttggatttttggccatacaggccttgtaa

SEQ ID NO: 31971 - DNA, 444 bp, Glycine max
  Peptide Sequence Number=SeqID_148749
atgcagtcgcagatgcaatcaaaggaactcgtactgtctcctaaggttgaggttggtccttctactgcttgtgtcagcacaaaggaaagttgtgtcgattcattgggagtttatggggggtctacaaccgtccacaatgttcctttgggcaatgatcaagtgaaggtcggtgttgaggaagttcgagatgttgatgctcgtgttcctgataaacatagagttgagggaccagcgaaacttgtagataggccagatcctaatgtcgatcccctatacttgatgacattaaccatcccacaacttttccataagtcattcacatggtggtcaatgtctcagcatctctattatacaattgtggattctcacatccccctttcgccagctggcgtaatagcgaagaggcccgcaccgatcgcccttcccaacagttgcgcagcctga

SEQ ID NO: 31972 - DNA, 393 bp, Glycine max
  Peptide Sequence Number=SeqID_148750
atgacgagtgtaatagtgatgaaaccacaacgaaaggcccctcagcgaaggagttatagtatcttccaagatgggagaaattgcaatggaatgctccatcatccggctgattcctcccagtggaagaagattgatcgtttgtatccaaatttcagcaaagaggcaagaaatcttaggcttggacttgccactgatggaatgaatccctatggaaatttaagcactcagcacatttcgtggcctattttgcaagtaatttacaacttgcctccttggttgtgcaagaagcaaaaatacatgatgttgtctatgaaaatatcaggcctaagacaactaggaaatgacatcgatgtttatctcagtcccttgattgaagacttgacaaagttgtag

SEQ ID NO: 31973 - DNA, 429 bp, Glycine max
  Peptide Sequence Number=SeqID_148751
atggatgaagattcggatcgtcctatcaggattatgaacttcgtctccgaagaccaattggtagaagctaaaaaaacaagaggtgaacgtgttgaagacggcactgcccagagggatagacctctctacgagattctaaaggagaataaggacaaaaaagatgcggaatttaatgaaagattcaagcacataattgaatgtgatagtgtttggcaatggcaactgccaaggcagcttgtaaggtttaacctgttaattctttcatgtttacttggtgtttgcccttttgagataggcatagtttgtgctagttgtttgactgacgttcagacagctattttcctcacacttttctacatggttgtcttttgttgttattctgcattgaattttgacccctctaattatcacattcacaggaccacctaa

SEQ ID NO: 31974 - DNA, 279 bp, Glycine max
  Peptide Sequence Number=SeqID_148752
atgaagtatgagtcaaatatcaaagaacaaaagtctgctggaaagaagaatccagcctctcgcccattaggcttgattataaaagtcaagcctcaagctaaaaaaaccaaggtgaatcaaggaaatgctgaggaaatttcaaaagcaggaaacactcctgtgaatgataggagtaagtctttggagccagtacaggcattgaatggcgaagctgataagtcccaagttgccctaactggccttgtttcgtacagtgacgaaagtgacgatgacttgtaa

SEQ ID NO: 31975 - DNA, 213 bp, Glycine max
  Peptide Sequence Number=SeqID_148753
atgtggaagagtgtttgtccgctgctaggtgtggcgtgtgcggcacacgcgcagtactctttcatacatgtcacttgtagagtgggcatgcattggagttgtggtgtgtgggtgaattggggtgtgtcgtggtgcaaaaatttagaacaccacttctgctctcgccagttaccgaaaagtccgtctgatcgaggccgtacccgaatcaaataa

SEQ ID NO: 31976 - DNA, 528 bp, Glycine max
  Peptide Sequence Number=SeqID_148754
atgttccaattagcagtggacaagccaattatgattcctaaggaaaatttctacaagggcaaaaagaagttggttcaagatgatgaagatgcaccctctacccattatgtcaaaacaaaactagtcagactcttcaagcataaagttgcactacatcaaaagagggaggttacaagtaggaattgccaagctttgcaaagttattatagtctgggagcccattgttctaatctagaacctgaggagaagccaccattaaaaggagttcatcacaagacaagatgtgactatcagattaccaatcacaatccttttgtggtgaattctaaagatgagctacatgttgctgttgttgaagatatgatcatggaagtctatgatggccctcctccatcctggaagtatgtatgttttcatgagcaaacattgctcaaaaccagggaggcacttgcaaaagctcttcatgacagggctcatgctgaaagaagagctttagcaagcatgtccctggttttgagaaatgcttaa

SEQ ID NO: 31977 - DNA, 1676 bp, Glycine max
  Peptide Sequence Number=SeqID_148755
aagaagtgtatgtcagacaacctcttcactttgaagatcatacacttcctgaccatgttttcaaacttcaaaaagactttgtatggtttgaaacaggaaccttgtgcttggtagacaaattgaactcttttcttttagaaaatggtttcatgagtgtcaaagtagatacaattctttttagaagagaagttggcaaggatttcattatagttcagatatatgttgatgatattatctttggagctactaatgaatctttgtgcaaggaattctctgatgttataaagagtgagtttgaaatgagcatgatgggagaacttaagttctttctagggcttcagatcaagcaagatagcaagggtatctatattcaccaacagaactacactagggaccatgtcaatggcataaactacatctacatctacaaaatgatggtaggtgggaagaccttcaaggacatgttcaatcccaaggtgaaaaagaatcatattccttatggaatgctctttacccagatcttaaggctagttggaatggaggtttccttaatggaaccatcatctagagccactcagccaaaggaggatacctttgtcaagatatggattgctgaaaattttcctgagtatatacaaaggcatataaagaagaaagtgaagaaggaagtgattgagactcctctgtctaatgtggaaattttagaaacacctacccttttaccttcaccttctttagcctttccttctcaacaaacacccaaatctacttcaccctctcccagcaaggctaaagctactgccattgctaaggccaaaaagcattgttttgcaaacactaaaaggaaagcaaaagctgaaaatgccataaagaagaagaccttgacaaaggaagaggagctaagaaatgcagctgcaagtgaccaagtacctgaagaagtgggacatagagctccaaccaactatggttcaagagaaaaagttgaggaagaaagacaggctctagatattgcaatgcttcagtctgttattaaagtgtcattgcaagatgaagttgttgttgatgctttgctggctccacctatgtcagaagtagacatcttaagactagaaagcatttatggagccactaagtctgtctcctttgatgcaatgaagttcagattggagatgaggaaaagagttgacactacaactgcacctcaactcttacctcaacctcagactcaacctgagccaatgcctactttagatgacaataaatgcaaaaaggttgagcttcagaagttaaatcttgtcaagttgtggaaaggtgtgccaaggattgatcccttctcttattcatcttttgagacctttccagaagaagagttcaagatcaagtttaatttcaagcttcatgagatgaaatcaagaagattcaagaatcaagagaagtttgatttcaagggtacatactttgtggtacaagtagagggtacatctacttgggttgttgtaactgagaacaagaaaaggtacatctcttgtggatcagttcaagtggagggtacatccatttggttgttcaaagagaacaagggagggtacatcccttgtggatctttgcttgtaaaggtttttacaaggttgaaaagaaatctcaaggaccgcaggtcgctaggggactggatgtag

SEQ ID NO: 31978 - DNA, 333 bp, Glycine max
  Peptide Sequence Number=SeqID_148756
atggctgccatttttgagtgttcggacaacttgaaggagctagaatatgtgcccgaatggcatgaaaatgagagcgtgttggtgaggactccccttttaggccagcgtttggaaatggctccgaaaaagctttccacgaagaggtctaggagagacgcggcggcggaagggcccagtgccacccccgagtttgatagccaccattttcggagcgctgagcaccaacaacacttcgaggccatcaaaggatggtcgttccacagagagaagtgcatccagctcagggaggatgagtatacagattttcaggaggagatagctcgcagacattag

SEQ ID NO: 31979 - DNA, 828 bp, Glycine max
  Peptide Sequence Number=SeqID_148757
atgggtttgagaagtagccagtcttctgaatttattatcggtgtgaggatattcttgcgggtggacacattgtcccttctactttccatgggtaatgtttcttcaaattctgacattcttgtagttgatatggttggtggccttcttactggtgctgtggcagaacgtttaggaggtactggttttgtatgcaactcatatattgggcaggcaccatattccatggatattgtgaggatatttaacttaagtgatgaaatctgcaagagaattgtacggtctcccatttctgacttgttatcacaaaaagaatcacctgaacaaactctgcaacctgatgatgcgtgcaatgtggaaagccagtcaaatgatcaaatatctgcatcgaccagcatggaggatatctctcattcatcggaaaatggaatttctgatcttggggctgagaatactgaacctgctaaagaagtttggaaagctccaaaggccggagaaagggcgcaaaaagaaatcattgacttgtggaaggaaaatggtttttctagtctaattattgctgcaccagagttggatacttggacattggttagagatatcttgccccttttagcagactctgctccatttgctatttatcaccaatatcttcagcctcttgcaacttgcatgcacaatttacagcttgagaaaatggctattggattgcaaataacagagccttggctgcgtgaataccaggtacttccatctagaactcacccatgcatgcaaatgagctcatttgggggctacattctcagtgggactaagatatgcagcacagaatga

SEQ ID NO: 31980 - DNA, 162 bp, Glycine max
  Peptide Sequence Number=SeqID_148758
atggccaagagtgcacacaaggtgttcgataaaaggtgctacgaatccaacatggttactttcaacacgttgatccacgagttttgtaaaagaggtgacatggagggtgctcggagggtttttgacagattggtggagagtcaaagttgcaagccggatgtg

SEQ ID NO: 31981 - DNA, 513 bp, Glycine max
  Peptide Sequence Number=SeqID_148759
atgtgtgaaagtagtagtagcagagtcacatgggaaggttgcagcgtcttgctcgacatcaacgacggtgaccgtctcgttttcgctcgtctctcccccgctgcaaaattgaagattgggaataagaactgctctctgcaaccgttaattggctgtcccttcgttaatggtaataatgctgaagaagtaagagatggtcaagtaagtgtcgagtccagggacaaagttaataatgataataatcctgaagaagtgagagatggtcgagcaaatgttgattcgagggacaatcgtgccttggttgacaataacacggcacagagcctgactggtgaggatatagaagccatgcgaagacagggtgcgggaggtaatgaaataattgaagctctcattgccaatagtgcaacattcgagaagaaaacatcattctcacaggagaaatatagacttaagaagcagaagaaatatgcaccaaaagtacttatgaggcgtcctgttgctcgaaggtga

SEQ ID NO: 31982 - DNA, 180 bp, Glycine max
  Peptide Sequence Number=SeqID_148760
atgaagaaaaagggtgaagatgagattttgtgtgaaaggaaaagagatatagcagaggtatggaagaggattgaagaattaaagtgtcgcatagcgcatcaggaccactcagtccaagaagcctacttaacgcaagaagccaacctggaggtcaattgtagtgcgcatctgatggcttag

SEQ ID NO: 31983 - DNA, 1104 bp, Glycine max
  Peptide Sequence Number=SeqID_148761
atgaggcacaggaaaagccgacaacgtaacggttcgcggtacccgttgctgccgccgccgatctttctcagcctccaccgccagatttacctcttctcctttcggattcgcatttctctttctccaccgcaacacactcaccttcagggatacaaaatgataggatcctttctgacctgggcccttgtgatggtttttggctatgcttatccagcttatgaatgctataaagtggttgaaaagaataagccggaaattgaacaacttcgcttttggtgccagtattggattttggtggctgttttgacagtatgtgagagagttggtgatacttttatatcatgggtcccaatgtacagtgaagctaagttggcatttttcatatttctgtggtatcctaaaactaagggaacaacatatgtgtatgactccttcttcagaccatatgttgcgaaacatgagacagaaattgatcgcaacttattggaactaaggacaagggcaggggatattgcagttttgtattggcaaagagctttcagttatggtcagactagaatatatgacattttgcaatttgttgctgcacaatcgactccagctcctcgacctgctcagccacgaccgggtgtgaggggggttcgtcaacaggcacctgcaaaaccagctgctgcagcagaaccacaagttgaggaacctccatctcctacctctagcacatcttcaagtcagctccagagggaggtagaagaggaattgggttcttctccacaagttcctaaagcacccacatctgtaacaggtttaagtaaccagaaaactcctgtagcaggtgtaagtactcagaagtctgctggagcaagtttaagtactcagaagtctactggagcaagtttgagtactcagaagtctaatgttgcacctgaaacaaccaaccaatctgcaccagcagaggcagagccaaaacaaattgaagcagctccatcttcagcaaaagaaaatgggaactctcctcctacttctacaaaagagaccttaatggaagaaagcattcgagttacacgtggtagactaagaaaaacccgatcagcaggaactcgctag

SEQ ID NO: 31984 - DNA, 377 bp, Glycine max
  Peptide Sequence Number=SeqID_148762
actcatcttctccttgaagtggcgtctcctctctctcttcctttctccattccgcttccattcatcttccaagaagcaaaggaatccattgatgaagaagatcctaggcctacaagctccaatggagcttacatcaccgggcttaactctctcacagtccccagtggagtctccaactgtcgcaaccttccctccagcgggggcacgatgcgggactcaatggatgcgtcttccgaggaaggaaaacgtgaggagtcaccaccaatggtcgacaagggtgttgcccttgctcctacgtatgctcagggtcattttcgggcatttgcaactcgcctaggcgagctgaaacttagtgctgaagcaatgagctcacccaa

SEQ ID NO: 31985 - DNA, 1014 bp, Glycine max
  Peptide Sequence Number=SeqID_148763
atgaatgaaaaagtgaagagacagtgggcctccctgcgtcagattggtttgtcccagaatcgcacgattcatgtgcgggatgtgattcaagcaattcatatggaacttgaagcaagtaatcaacccaagcaagagcgttcaaggacaagatggacagcatcccttgacaagatatttgcagacttggttgtcaagcagattcaactggggaacagaccaaacaatgtttttgacaagaaaacatggaatcacattcgtgatgagtttaataggcaaacagaccttaatttcaacaataatcaattgaggaagcatctagatgttcttcggactcgcttctataatttgaaatctgcttatgatcaaaataatgactttgtaatggatgattcctgttgcattggctttgaacagtgggaagatataggggtgcagcctaggaatgaaactgttaaagtgaaagattgtccaatatatgagcaactctgcacaatattcatagattcagctgctgatgggaaatatgcccaatctagtcattacgaagagttggacaaatctatcggagcagatgcaactggctttactccatgtccagaagctaaggtctcacattatgtaaacccatcaacatcaaagtttattccagggaatatctcaactgctgagaagctgaccaagaattctatagataggaaaaggaaacgatcatgtgagacgcaaactactagtctggatcaagacacctgcaatgctatggcagaagccttgttaggtatggttgctgtttcaaggttaagggcagttgtttcaagtgtaagtgatgataaattctccataacaaactgcattaaggctctagatgagatagaaggcattgatcaacagctctatttttctgccctggatctctttgagaaccctagcttaagggagacattcatttccttgaaaagtgtcaagatacggttgacatggttacaaggaaaatgcagcaaaactcccttccattag

SEQ ID NO: 31986 - DNA, 393 bp, Glycine max
  Peptide Sequence Number=SeqID_148764
atggatcagtcgctatcgctacaactacacgatgaaggaaaaggcacgcctcacacattttggatacatccagtgcaatgttttgttcagttcttcagacacggtgtcaacgagaaacctactagatctaccttttgccaggacaggaccattaaagtttacgaggatgttggagatttcagtgatgatgacaatctcacaccgtctgagattgcctactacatggatgttattggtgaagagatacttgagggagagatgctttcaaccgacgacggaaggcaaaggagaagaggagaagggaggcaccatacactagggaataagccaaggaagaaggagtttcaccaccaagaattgccttggataagaagcttgaagaggatgctttaa

SEQ ID NO: 31987 - DNA, 327 bp, Glycine max
  Peptide Sequence Number=SeqID_148765
atgaaaagcccaatccaattaaattttagagggggaggtgagcatttgcttactacatcacacgttctggtttttccgacgttttcctcaaataaacgttggtggcgactctgcgcgccttcctcccttggaagatgcacccgtgagccccacgtcgctctcctaccgaagggttttgatggttgtttgttggatccagaaaccaagttaaaaggaagggcaaaatggttatttttccaagattttagacatccattcgcccaggctagcaaccagctcgcttgggctaatcaagtttctttaggcattaataatcaactcacctga

SEQ ID NO: 31988 - DNA, 351 bp, Glycine max
  Peptide Sequence Number=SeqID_148766
atgacctattccaactgcagacaaaaaggtcatattcaaaaaggctgcccacatcccaagaagaagcaaaatggtgggagtatgaatgaccaaactggatgcccaaaggacaccagaggagtctttactcttcatggagttgaagctttgaagaaaccatggtttctatgggtgaccttcccattgtcagagtttcgtgaagtgtttcttaaggatatatccaatttaccacctgagagaaagataaagttttatgtagatatggtacctggtgcttgccctatatccatagccccttatagtatatctcctatagagttagccgtgttggatcaagtgtcctcggagtaa

SEQ ID NO: 31989 - DNA, 867 bp, Glycine max
  Peptide Sequence Number=SeqID_148767
acaaaacctgttgggcttcccgagtctcggcatgaagagaaagagggaggtaagggttcacgagggcttcatgttataactctaggtctagaggaattaaaacaagttcgtttgtatatattgaatagcaagattgaatttatgccatacatagttcatcacgaagccttagtcaaggaaagtaacctaaaaatgaccaagaatagggtgttgaaagagcataacaagactttcctaaattggtttaaagatacaaccgttggtgatgataatgcttatgaaacgttaaggaagttagcagatgggcctcaaaaaaaatttagaagttggcagggatacaatatcagcaagtatttgttctacaccaaatcacaagacgacaagagtacaatgcaaaatagtggggttagtcttagggacgaatcccaacactttgctactgtaaatgatgacaatctccgtgtggcgtccatgccttactttggagtcattgaagaaatctgggagcttaattatccagcttatcagaatgaacctttcatcatggcaaaacaagctaaacaagtgttttatgttcaagatccttgtgatgaaaggcacatggatacaccattgagctcccctcctcctaagttagcaccttcaccatctacgtcgaagaggactagaaaagccacacagctcatatcactggccgctagacttgtcggggtggacagactagtggttcatgtggatccaaccactaggaaagctgatggtctccgcagagagaaattaaagacctatttgggggtcatcactcaagacaatgtgaatgttacatatgttaactggaagcaggttcctgtagctcagaagatttga

SEQ ID NO: 31990 - DNA, 306 bp, Glycine max
  Peptide Sequence Number=SeqID_148768
atggcttgcaccaaaatatcaagtcaaataacatctgaggcgacacgacaaattgctaataggaatggaatcgtacctcctgttgagcctcaggtaactccttctgctacccgtgtcagcacaaagagaagttgtgtcgattcctcggggcaggacccagacatggtagcatcagataagcatgggttgtatgttgatgacaatcctccctgtaggttgccctcggaagagtttatgaaggccattaataccttccttgcttgggcaacacatcttgtacaacctttttcaaaaaaggataaatag

SEQ ID NO: 31991 - DNA, 387 bp, Glycine max
  Peptide Sequence Number=SeqID_148769
atgaatcccatggaagcttacaagattgggttaacaacttggtctcaatggattgatgccaacattgatccctcaaatactacagttttgttccaaggaattgctgcatcccattctgggggtaaagggtgtctcaaacaaccacaaccagggcaaggaccgcagccaccttatcctggtgtagaaattgtgaagggcattttgagtagtatgtcatgtcctgtatatttgcttgacattactttgatgacacaactgagaatagatggacacccttctatatacacaggcaaaggcacctcttatgtggactgcagccactggtgtctagctggtgctcctgatacttggaatgaaatgttgtatgctgctttgcttggactttaa

SEQ ID NO: 31992 - DNA, 615 bp, Glycine max
  Peptide Sequence Number=SeqID_148770
atggcattctatttcaggttatgtgctctggcctttgctgttctgtggttagtggcatctccactgtaccatgtgcaaggcaatggttgtgacttttctctgggaaactgggttgttgatgactcctactaccctctctatgatgcctcaagagattgccccttcatagggcagggattcaattgccttagaaatggtagaacagatcaggaatacctcaagtatagatggaaaccctctggttgtgatcttccaaggtttgacggggtgaatttcttggagagatacagagggaaaaagataatgtttgtaggggactccataagcaacaacatgtggcaatcacttacttgtttgcttcacattgctgtcccagaatcaagttatgccttatcaactcccacaaagtatctctatgtgttctcattcccggaatatgatgcttcaataatgtggttgaaaaatgggttcctagtggatgtggttcatgacaaagaaaacggaaggattgtgaaactggactccattagatctgggcgcatgtggaatggagttgatgtattgattttcaatacctaccattggtggacccactcaggagagtctaaaacgtaa

SEQ ID NO: 31993 - DNA, 543 bp, Glycine max
  Peptide Sequence Number=SeqID_148771
atgtctatgggacaaatccatcaattcactcaggaggtcgttgacaaattatgtagacaacaccagtatttctccgatatcatgaatagaaaagccaagtatatcagaacatgcaaaatgccttacttggagatcaaatgcagcgagaagactttccattgctcaccaaagaaaaagaaagttttacaaactgacaccaacgggaaaagaaggccgttgaagttttttaggaaaagcgggaggaaaggaaaatccaggggacaaagatgtttcatttgcaaccagacaggacattttgcaaaaaattgtcctaaaaagtcacaaaaagccatcagactaatctctcatcttcaaatcgatgaatatgatgatatagaatccatgtattctgaaaagagtgaactagataaggagactgaatttgccttaaatcagacagattcttcagacgaagaatctccagcttctccaatcctcatcttctctatacaagaagaacaatcgatcaagccagcgattcctcaaccatgtgttgaaattcaa

SEQ ID NO: 31994 - DNA, 1044 bp, Glycine max
  Peptide Sequence Number=SeqID_148772
atggttaccctcgaaacgggtcagtcatcgtcaccagtttcaaccgccaaccagcactccatgagcttctttcccatcacccaccacatgaaccttgaggtgtcgtgcttcaatggttcgaaactcatggactggatcttcaagattactcaattcttcgactaccacgcaacgtcggaacatgaacgcctaaccattgccttgttctacatggaaggacctgatccaaccgacacattgttcaagctgaaccaaaagggttccgtcaatgactacttgtcaaaatttgaagctttagcaaatagtatcattgatttgcctatgcccttcttgctgagttgcttcatttctgggttggcctcggacattcgtcaggaggttcaggcgctccaacccatcaccttgattcaggaaactgctttagctttaccttctgaatcatcgtctatgcccattaagcatctctcaccggaacaaatggcgattcaccctgaaaagggaatatgctttaactgcgacaagaagttcagcaaaggtcgcaagtgctcttccaaaatcttcttgttgatagctgaagaagatgacaccacggttggaggagctgaccttgggcaacttcatttaggcccatctgaggatgtggatcagtcaccaacccaaattagctttcatgaattatcgggtcatctagcactagagacactacatttggtaggtcaaattgccaatcataaggtggtgatcttgatcgatgggggtagtacccacaactttgtccaagagtgtctgctaaaaaccttggacctcgtcactcaacccattccgtctctacgggtcatggtgggcaacgataatgaaatcgattgccaccaactgtgtgctgatgtagccatttatgtcctggggctcgacttcactatggatttacatgtgctgcctttgtgtggagctaacttagtattgggagtccagtggttaaagtccctcaagccggtccccactgactacaatgatctccccacgaaattcatgcattccggcaag

SEQ ID NO: 31995 - DNA, 243 bp, Glycine max
  Peptide Sequence Number=SeqID_148773
atgtgccacaatgccgttgaactcaaggcggagcttgagcggctccgatccccgccctcgctaaaagaggcattggagaaggagaaggcggtactggaggacggtgtgaagaagctccataagatgatcaaggacgaggacttatcattgcagatcgaacaggaagaaagggttttggcggagaaggagaagcaagaaaaggtgaaggaagagaagtggaagcagatctacgagctaaaatga

SEQ ID NO: 31996 - DNA, 222 bp, Glycine max
  Peptide Sequence Number=SeqID_148774
atgaagttgcccaaggtcagctcctccaaccgtggtgtcatcttcttcagctatcaacaagaagattttggaagagcacttgcgacctttgctgaacttcttgtcgcagttaaagcatattcccttttcaggaagacaaaaaggtggtctagcaagtggatagcggaccagaggaggttgaaaagtgtggttgaagatggaaaaaacgatgagactcattga

SEQ ID NO: 31997 - DNA, 756 bp, Glycine max
  Peptide Sequence Number=SeqID_148775
gtaacttgtttgttcgggagctcgactgctaagggccagggtaaaggacaatgtgctgaagtacaggtcaaccttgacctagcggcgagcgtcactatgtttcagtgccaggtaaagctgacgaatgctgaggtctcctataagctgggcattcatgcttgtgggagtgatgatttccagtttctaaaggcggctcctgcacttgaatgtggcccattcctagcttcacccaaacagttgggcaatgtgtccaagaagctgttcaagtttgactcaaatgtctttcaccatttgaaggaccattttttcaaggtcctggatattgatgtggtggctgatggcatgccactaatgttcaatagggacggagaggtcgacaaagcaattctggagcagctatcggcctcgctggatgcacgggccattttgtctcttccgttgacgagcgatactctcattgccttggataataagtgtctaaccttttcctcgtttgttgtctcagttgggcgtcagccaatgtctaacacgccactcgtgaagcaggtcagacttgcgggtgggatcatgccgctgtctgttgctgctctgtctactggaaaggggagccaacttgctggcgaggttggccctagtgctgaggttgctcccaatgttccttcctctgttttagctaagaggaagtgggatgatgctgttgggccgtcgggtcacaagaagttgaaggccactatgagcctttgcgccctaagatag

SEQ ID NO: 31998 - DNA, 738 bp, Glycine max
  Peptide Sequence Number=SeqID_148776
atgtgcaccataggttacggagacatagcgccgttaaccccattcaccaaaatctttgcttgcgcttttgtcttggtggggtttgggttcatagacatactcctcagcgggcttgttaacttcgttctggatttgcaagagaacatgatcctcacggggctacaaatgggtgcgagtgatcaaagggaaggtttttctgctaggaattacatcgttgacgtggcgaaggggaggatgaggatcaggttgaaggttggtttggcgcttggggttgtggtgctgtgtattgggattgggggtttggttttgtactttgttgaagggttggattgggttgattctatttacttgtcggttatgtctgtcacaacggttgggtatggggaccgagcttttaagactcttcctggtcggttatttgcagctatttggttgctattttctactctcatggtggctcgggcttttctctatttggctgaggctagaatcgatagaaggcatcggagaatggctaagaaggttttgcatagggaaattacagttgaggatttgcttgctgctgatatcaacaacactggtttcatcagcaagtcagagtatgtaatcttcaagctgaaagagatgggtaaaatacaggaaaaagatgttttgcaaatttgtgatcaattcaggaagctagacccctctaactgtgggaagataacactacctaatctattgggggggagtttatga

SEQ ID NO: 31999 - DNA, 357 bp, Glycine max
  Peptide Sequence Number=SeqID_148777
atgacgcaaggcatggtccaggtcctccgtgccgacaagcactttcaccgtgtgatagaaagcgacggatgctccccgcgggtgcagttctacgtgtccccctacatccacattcgatcgacgctccacaagctcagacggtattttttgaagaagaggatcatcggcataagggaagagttacgagtgaacgagattttcggaacttttcaggtgaaaaagaggatgcaggaagagacaggacaaaggctgggaacaggcagggcacgaatggagctatcaacagaaaatggtaaagatacagattttgccacacttcaatatgcggttcagaagccttctgacaacggtgtgtga

SEQ ID NO: 32000 - DNA, 1296 bp, Glycine max
  Peptide Sequence Number=SeqID_148778
atgcgttgcgtgaatagattgttgttgcggacgccatgttcccgcccccgcaacatgtgtacggttacatcagcaaagcttaatttcatgatcaacgcttgcatacaagacaacaacataaacaatgctcgcaaactgtttgacgaaaacccctcgtcccgcaacctcgtatcctggaacatgatgatgaccggttacgttaaacaccatcaaattgaatatgcccagcacctgttcgatcaaatgtccttcaaagacacggtttcctggaatatcatgctctctggttttcacagaatcacaaactctgatgggttgtatcattgtttcttgcagatggaagagctggtgtggcccccgatgactataccgtctccacgagcttatgccagcttaagagacgaggaggcttttaagcgagcgtttgatgatatattggcgaaagatgtcacgtcttggaatgctttggtttctggttatatggaagtgggaagtatggatgatgctcaaacaacctttgatatgatgcctgagagaaacataatttcctggactactttggtgaatggttatatcaggaacaagaggataaacaaagcaaggtctgtttttaacaaaatgagtgagaggaatgtggtgtcttggacggcaatgattagtgggtatgtgcaaaataagagatttacggatgcgctgaagctttttcttctgatgtttaattcgggaactcgtcccaatcatttcacattttcaagtgtgttagatgcatgtgctggttattcctctcttttgatgggaatgcaggtgcacctgtattttatcaagtctggcataccagaggatgtcatctcattaacctcgcttgtggatatgtatgcaaaatgtggggatatggatgcagcattttgtgtttttgagtccattccgaataagaatttggtgtcatggaattcaatatttggtggctgtgcaaggcacgggctagctacccgagtgctggaggagtttgataggatgaaaaaagcaggtgttataccagatgaagttacttttgtaaatgtgttgtcagcgtgtgtgcatgctggtcttgttgaagaaggtgaaaagcactttacttctatgttgaccaagtatggaatccaagcagagatggagcactatacttgcatggtggacctctatggaagagcagggcgatttgatgaagctttaaaatcaatcaggaatatgccatttgagcctgcgtggtgttgtggggtgcgttgcttgcagcttgtgacctgcattcaaatttag

SEQ ID NO: 32001 - DNA, 540 bp, Glycine max
  Peptide Sequence Number=SeqID_148779
atgaaatcacctaatgtgaatgaattaccaggaaatcctcaatttcctcaaagtaccctgaagggatccatggaagattttgctaagagtttgagtggatggagttgggaggagaacaaattgtttgagctagctttggcagtggtggatgagcaacaccctgaacgatgggaagtggttgcagccatggttggaggagaaaaaagtgctggagatgttcaagaacattatgtgatccttctggaggatttactcgttatagaatctggaaaattggaccatacacttggagaagttgtgccttttgtccttgttgagtgtaaagattccatatgcttgtccgacaatgatacaagcataatggaagcaagagatatctattatgaacttgcttggtctcatgtttctgttaatcaagctgtttgctgtattatgttcattccagcttggtcattcaattggagcaacttggctcatggaattcaaacaacaaggataaggcaatcgttagaaggagtcaccaggccagctttaaattga

SEQ ID NO: 32002 - DNA, 537 bp, Glycine max
  Peptide Sequence Number=SeqID_148780
atggcaatgtcagtgataagaacaaaacgaggcctagttaagccagcagaggagattcccttgaccacagtactagacctatcagccatcgatagattacccgttttaagatgcaatgcgagaaccttgcacgtattcaaacacggccctgaagcaacaagggtcataagagaggccttgtccaaagcactggttccatattaccctcttgccggaagactcaaagaatccaaaccagttgaggcatcttctgattgcacccttcgctctgtcaatttctttgatgatgttcactctattccatatgatcatcttcttcctgatgctattcccgagagccaatgcatccaccccctcgtgcaaattcaggtgacagaatttggttgcgggggttctgtgataggcctcatattctgccactgcatctgcgatggtcttggtgccgcagagtttctaaatccaatgggggaacaatcaaggggtctgagagtcttgggtaatcagcactctttgaaacaaaattatttatatccataa

SEQ ID NO: 32003 - DNA, 306 bp, Glycine max
  Peptide Sequence Number=SeqID_148781
atggatgttgatgtgatcaccattgagaactccagatcagacgagaatttacttttggtcatctgtgagggagtgaaatatcgtgctggcatttatgatattcattcacccaggattccccccacagaagaaattgttgataggatcaacaagatgcttgtagttcttgaaagcaacattctctgggtcaacccagattgtggccttatgacacgcaaatacaccaaggtcaaacctgccctcaccaatatggttgttgttatcaaacttatttgcaaccagttagctagtaccaaatttgattga

SEQ ID NO: 32004 - DNA, 1707 bp, Glycine max
  Peptide Sequence Number=SeqID_148782
atgtcaggaaagatcattatctcggctgtttctctcatcctggtggtgggtgtggcaatcggcgtggtggtcgccgtgaacaagaagggcgaggatcctgcagttgaatcccaccaaaaatacgtaggggtcatatgccaaaacaccgatgagaaaaagctctgccatgacaccctgagctccgtgaagggcatggacagcgctgaccccaaggcctacatcgccaccgctgtgaaagccaccatggacagcgtgaccagggccttcaacatgagcgacaggctcaccacagagtacggtggcagcgataacggaaccaagatggcccttgacgactgcaaggacctcttgcaatcagccatcgagagcctccagctcagcactgacatggttcacaacaacaacgtccaggccgtgcataaccaacaggctgatttcaagaactggctcagcgctgtcatctcttaccaacaggcctgcacggagggttttgacgatgccaaagacggtgagaagaagatcaaggagcagttgcagacccagaccttggacaatgttcagaaactcactggcatcacccttgacattgtgagttctttgtcccacatcctcgagcagttcggcttaaagtttaatcttaaacccgcatctcgtcgtcttctcagcgaggatgggttccccacttggttctctgctggtgatcgcaagctcttggctcgtggatggagagcacgtatcaagcccaatgttgtggttgccaaggatggctctggtcagttcaataccgttgctcaggctattgcttcataccctaagaataaccagggtaggtacattatctacgttaaggccggtgtctatgacgagtacatcaccgttcccaagactgcagtcaacattctcatgtacggtgatggccctgctaagaccatcatcaccggtcgcaagaactacgtcgaaggtgtcaagaccatgcaaactgccactttcgccaacactgccgaaggcttcattgccaaggcaatgacattccagaacacagccggtgctgagggccaccaagccgttgcattcaggaaccaaggagacagatcagctctggttggttgccacattttggggtaccaagacaccttgtacgtccagaccaacaggcaattctaccgcaactgcgtgatctctggcacagtggacttcatctttggcacctcccccaccgtgatccagcactcagtgatcatcgtgaggaagcccttggacaaccagttcaacacgatcaccgccgacggaacatccatgaagaacatggatacaggaatcgtgatccagggttgcaacatcatcccagaagccgaactcttccctacaagattccaggtgaagtcataccttggaaggccatggaagcaattctcaaggacaattgtgatggaatccaccgtgggtgacttccttcacccggaaggatggtgcccatgggccggtgaacacttcgaagacaccctgtactatgctgaatacaacaacgatggacctggtgccaacgttaacggaaggatcaagtggaagggttaccgcggtctcattagccagcaagaagctgctcagttcacccctgcccaattcctccaggctggttccaacggtggaactgactggttgaaggctctccatgttcctcatgcacttaacttcatgaaagcttga

SEQ ID NO: 32005 - DNA, 465 bp, Glycine max
  Peptide Sequence Number=SeqID_148783
atggatgccgatgaagccaaaatcttgctcggtttccctcccaattctcgtccaactccatcccaggaagaagatgctctgccatgtaaacttgccataggggtagttgttattctagaagtagttgccgtaggggtagttgttattctagaggtaaaatcagcttacaaaaagaaggtgtgggaatctcaccctgatctatttccttctcatgaaaagcctctcgctgagtctaagtttaaactgatttcagaagcttacacatgcctggaatctggtgggagaggaggagcttcaagttcaggttatgttctgagcgatgaaattggcgttgtggactttgggaacacgacagttgtcaatgtacctccacaccgaaatcttggccgccgggtaagttgcggttgcatgaccacccatcacctcaccattgcctttattttcttggagaaccacgcaaactga

SEQ ID NO: 32006 - DNA, 131 bp, Glycine max
  Peptide Sequence Number=SeqID_148784
atggcggaaccatcgaacaagcgcaagggttcttcaagtagaagccaacgacactccgaggctcaggatactccaattccttcctccatttcctcatcctcattgttctcatcgaaagaacaacgtacacg

SEQ ID NO: 32007 - DNA, 1389 bp, Glycine max
  Peptide Sequence Number=SeqID_148785
atgggtggccatgcagccacaacttactcggcggccaagatttcggtgtggtgggacattgacaactgtcgtgttcccaaaggccacaacgccaattccatcgctcagaacataacctccgccctcgtcggcatcaactacgccggccccctctccatctccgcctatggtgacaccaaccgcatccctccccccgtccaacacgccctctccagcaccggcgtttccctcaaccacatccccaccggtgcgaatgatgctagcgacatgaagattcttgtggacatgctgctatgggccgtagacaatcccgcccccgctaactacttgctcatatccggcgacaccaacttctccaacgcccttcaccaactcagtttgcgaaagtacaacattctcctcgcccacccgccgcacgtttctccctccctcgccgccgccgccaaagtcgtctggctctggacaaccctctccgccggcggcccgcccctctccgactccacctccaactcctgtaaaccccccactcccgcccctctccttcaaccttttcaattcaaacccaaacctaaatacattagaaaaattaccacaataaccccaatcgagaccaagaacaatgatgcagaaccactaccgccaccaccacaaccgctaagaaagttctttatcggagcacctcatgaattctttactagtaaatgtaacgaacccgtaaacctaatcccaaccccgactagttctaaggagattaatcaaattttaattcctcgtcgtgattcacaccaaaaaaagctaaatgaaattcctcgtgttatgaatgctactactcatcaagataattctgagtacaatgtggagaatctaattgatgttattatgagaaccctaaacttgctcaaggttgaaatgattctgccctctgaagcaaatataactgattgcattcgttatggggaccccaagtatcagacaattgatgtcaggatggtcttggatgctgccatacagcaaggtaggctagccaaacgagtctgtgggcccatgcatttgtatcttgctagaaatgacacgctctggaactgtgtcaaccatatgggtggtcatccttgtgattttccgcaagaaacatgggatagagtcaagcagttcctcacttcatcatctgggagatcgttgatgttgacatctcgttgcagatttgaagcatctgtgactctaaagaaatcatgtcttcgagaggttgtattaggggatgtgcttaaaattctagagatgatgatcacagtcaagaaatggattatacatcatcatagtgggtggcagccaattaccattaggcttaaggagagtatatttagtagctcagttgacatagctaaatcatga

SEQ ID NO: 32008 - DNA, 1107 bp, Glycine max
  Peptide Sequence Number=SeqID_148786
atggcagtcactatggcactaatgaccaggcagcatctgctgacctacatctaccttctagtttacatttcactttcatcagggtgggtcctctccacattgtattttaattttccatttccgataacactcactatgatccatatggctttttctggtggggtggcctttttccttatccgtgttttgaaggttgtgtcgccgattaaaatgaccctccatatatatgcaacttgtgtggtccctataagtgccttctttgcagctagtctgtggtttgggaatactgcttatttgtacatttctgtggccttcatccagatgcttaaagccctgatgccagtggcaacatttcttgtggctgttacttgtggaactgagaaattaaggtgtgatgtattctggaacatggtgctggtcagtgttggagttgtcatttcctcctatggggaaattcattttaatgtgctcggtacagtttatcaggtcacaggaatagttgctgaagctttgagactggttttaactcaagttcttcttcaaaagaagggcctgacactaaaccctattactagcttgtattacatagcaccctgcagctttgcatttctttttatcccatggtatatccttgagaagcctgagatggaagatccacatatgcagtttaacttctgggtatttttctcgaatgctctttgtgctttcgcattgaatctttccacattcctagtgattggcagaactggggcagtaactattcgcgtggctggagttttgaaagactggttacttatcactctttcaaccatcatatttcctgaatcaaagattacagggcttaatattattggctatgctattgctttaggcggtgttgttatttacaactaccttaaggtcagggatgtttgcacatctcagcttcaaagtatccgagatgaatccgcaaaggagctgcagacggagaaaaaagcagatgatgccatggacaacaaagaggagacttcatggaatgattcagtttctgaaactcatttagatgaagaagcacctttaatctcttcgcggatatctcattttggagttggaagaaagccagcttag

SEQ ID NO: 32009 - DNA, 273 bp, Glycine max
  Peptide Sequence Number=SeqID_148787
atggattcagctacgaatgtgaatggtgcgacgaggattagagatttcatagcaaatgaagtttctgattgggacgacgaagtgattgcctttgctcgattcaaagccttttccggtcaaagatgcgattgggaacccaccttcctcttctggaaacacttgatcatcaaaatcgccacccattttcgcctcctcctcattcgaccctcccaggtcaagaatgattggtttaatcgacgagggttaacccctttgtgtcttgacaatgtactg

SEQ ID NO: 32010 - DNA, 495 bp, Glycine max
  Peptide Sequence Number=SeqID_148788
atgggacaccttaggtttgtcatactttttggtaggagtaatcaacaagaaaatataggaaaaggtgttgagggaagaagcccagagtttcaagaacctctagatttgaggtttataggggaccctacaaatcaagggcaccctggcctacaagttaagagtaccctagtagggaggggtgagcttagctattggagggatgtaacacttgcttcccaaggaagcttctcaaggaagcttttttcctttatgtattttggcatgggggactttagtgaagctcaaagatccagcatccatagaagattctcaagcaaacttccatcagcttgtccaaggacaggttgccaacacatactagaccaaggaaaaagttctactcaaggaaaacaatacctgagcagacctactctccaagctatccagcaccaagaaggtcgggcacctcaagaccgtcatctaggagatactccaaaatcccaccatagatgttga

SEQ ID NO: 32011 - DNA, 930 bp, Glycine max
  Peptide Sequence Number=SeqID_148789
atggttcgacttggtgactgccttggaagagttctatcactaaagctagatgaatggacagatgaacaagttgatgcattggtgaagttcggtggaaatacagtaattaatatgaagtatgaagcttgccttccaagtaacataaaaaagccaaaaccaaattcatccattgaggagcgctctgattttattaggagaaaatatgagtttctacagtttttggatattgaagaaaatttgtcttgtccctttgtaccatctcatgcaagatgttcatcatattccgagcgtagttcctcgagcaacaacttcccacaagacaaaaaacattatgataaacaagaaactaaaagtcttattgggagcacatttcgaaatagttggggaagaaaagattctgagcataagagttcaaagaagagcaactcattggcaggtatgattgaatttattgggttgatcaaggtgaatgtggttaaaggcactaaccttgttatccgggatgtaatgactagtgacccttatgtcatcatatctcttggtcaccaatcagtgaagacacgtgtcataaaaagtagtttaaacccagtttggaacgaaagcctaatgttgtcaattccggataacattcctcttcttaaagtgcttgtgtacgacaaggatattttctcaacggatgattttatgggaaaggctgaaattgacattcaacctctagtttcagctgcaaaggcatatgaaaaatcttcaatcaatgattccttgcagcttggaaaatgggtagcaaatggtgacaacaatactcttgttaaagatggtaccatctcccttgaagatgggaaggtcaaacatgatatctcagtgagactacaacatgttgaaagaggagtgctagagattgaactcgaatgtgttcttctaactcaatag

SEQ ID NO: 32012 - DNA, 891 bp, Glycine max
  Peptide Sequence Number=SeqID_148790
atgatgtcatttatgaagctcctttttcctcttttctgcaacttctccatgcaccaccgctaccatcgaactacgacccacacccagaacatcccttcttctccgatcgcaaatacaaacctagaacatctaacctcctcaaaactccatctagatttcctcaaaaagagcatcgaaaagggcattgaaaattgcagaaaaaatagaggaacttacaaagttctcgacctctccgaatccgccacaccaaccctcttggaacaacacaaccccaacaccttagcaaaaacaaaagaaacccccaacccaacctccctcaccacaggcacctccagaacccaaatgaaaaaaacccccttagtagatgatgtcgtatcgataaacttcgatggagttgtcggagaagccgtgtccggggaggtcgacgaaggtgacgtggaggcccttggtgacgagggatttggcgaggtgctgataggagtaagagctaaagaccttggcggtgagggacttggaggggggggttttgttggggtgtgtttggaccttgatggtgcggtcattggagtagtggtggcgaagggggggggggagggtgaggaaccagtttttggagtcttaggggcaaagggtggaggaggtgaagatgaagaagagagtgagaagggagacaaagagggtgaagtagaactagaaggagaagggattgttgttgggtttgccatgctcactgctctctgctctgagcttccctgtggctacaagactaaagggtgtgagtgttggttacggggacaacatcattgcatgagtaatggggctgtagtgttagtctcaaactccaaggtccaccgtacaatgaatatttgtgtaagactatcgttttcttaa

SEQ ID NO: 32013 - DNA, 348 bp, Glycine max
  Peptide Sequence Number=SeqID_148791
atgcatagcccaaccaatgtccaaaaagtacagaagctcaacggtaggttaacatccctattcaagttcctaccaaagctcgccgaaaaaacgaaaccattttacaaactgctcaaaaagactgagcccttctcatgggatgagacttttgaacatgccttcttggctttcaagaagatcatagccacacctccagttttgagtcgacccaggatgagagcacccctgctcttgtatctctcagtagttgacaaagtcgtcagctcaaccctagtacaagaggaaaagaagcaccaagagaggtgtagcactagcttcctaaggaagcttctcaaggaagctacctag

SEQ ID NO: 32014 - DNA, 642 bp, Glycine max
  Peptide Sequence Number=SeqID_148792
atgggaggtttcatctggggtagccggatgggtacctccaggttgaatgcttcctcgaggatcatgcttgtgcctcttgtccaacttgtgcaagttggccttgaagtattttttgcacttgtcacacttttatctgacttggcggacttcattccagaatctagacatttctttcatctggatgtagcccttagctcgttcatgcagctcgtccatgctaccaggattgagatttttgatctggacaaccatgcacccaaatctgtccatgaactttctgaggaacttgtcgtctgcttgtcgcagattggccaaggcggccaaggtcatgcggtgagaccagctattggcctactacacactgaatcatttgacgaaggtgtcgaaggtgtctatggacctaggtgggagttcattgtaccaggcatccaggtgctcatctggatttgttgtcccattataccgctcgaggagggacttaggttgtttgcactgttgttgatgcgtcgggggtgtgattcgccttgggttcgttcaggcaagattgtttgggtctgtcataactatcgaatgaggaggggagtctgcgaagggagtctcatgcctgaggccaaactgagtgctaaccatggaaggatgtga

SEQ ID NO: 32015 - DNA, 258 bp, Glycine max
  Peptide Sequence Number=SeqID_148793
atggtacgcgtcttagggacatgccttgttcagatcagtgtagtcggtgcacattcgccattttatgttggccttttttaccatgatgacgttggcaagccaggtgaaaaacctgacctctttgatgaagttggcatggaggatcttcatgtcggcgatgcgctggtgctcataactagtgaggtccctactaagccgagtgcactaccccggtctaggtctgagttacagctgtacaagctctttgatgggttttag

SEQ ID NO: 32016 - DNA, 2397 bp, Glycine max
  Peptide Sequence Number=SeqID_148794
atggatgactgttgtgccgtttgcgctgagcctttggaatgggttgcgtacggaccctgtttgcaccgggaggtgtgttccacgtgcgtcgctcgtctccgtttcatctgcgacgatcgccgttgctgcatctgcaagaccgaatgcaacctcgttttcgtcaccaaggctctaggtgattatacgaggatgatcaatgatttttcgacccttcctttggaggcgagggagggcaaggttggatcatattggtaccatgaggatacaaatgcattttttgatgatgtggaccattacaggatgatcaaggctatgtgcaggctttcgtgcaatgtatgtgacaagattgaggatcaaccacaggatgctgcttcaaggcggcgagcaaagtttaggaatatagggcagttgaagggtcatttattccaccgtcataagttgcatatgtgcaatttgtgtttagaaggaaggaagattcacttccgtcaagagcacttcttatgtgaagatgaggcttgcctggctaagaaatttgttgtttttcaatctgaagcagagatgaagaggcataatgctattgaacatggagggcggatgtcacggtctaagcgtaatgctgctcttcaggcaataacagctttcattcctcccttacagataccaacaagcttccgatacagacatggtaatgaacatgagcaacgccgcggaagaggtcgtacgtttcgtcgtgatactgaaaatcaactttctatggccattgaagctagtttggaaacagctaatgcagagcaaacatttcttgatcaatcgacatcaagtagtgggcaagttgccgttgatgatgggaatgatgatattgatgctctcattcagccatttgaatcattagctgcaggttctgaagcatctgcaagataccttcaagccttggggcatagctctaggaatggacctctggaagattcttcctttccaccactacccataatttccagcaatggccaacaaaggtccaaacatgaactggaaggttcatctagtaacactatggctgcacgtctgcgtcggcatggcaacagaactgtatccgttatcaattctggtaatgcttggccagcagcaggtcgtggactggtacagtcatcaagtaatccttcacaatctaaactttcaacaaataatgtccttggactgtctcgtaacactgggcagatgaaaacagtaattaacagtggaccgtcatcatcaacttatgctggttctattcaggctacacagagaactgctcatggacaatttcctgctggttcatcgaggaacacacgtgacaatgtaagaattgttcactctgcatctgctccaaatctcatggagaacaattctgttgaagtttcaatttctgattttcctccagtttctgctgcacaagtaagtaagttacctgccagcagccagtcttcattgaatgtggaaaatgttcaatccgctaacaagtctttggttgaaaagattcgtggtgctcttgattttgatgaagaaagatacagtatatttaaagacatatctgcccaatatcgccaaggcacaatagatacaggtacatatctggactatgtacagcagtttggcttgtctcatcttgttcttgagttggcaagactatgcccggatactcacaaacagaaagagcttgttgaggcttacaacgcaagtttgcaaagagatgctttcccagaaattaacttggttcgaggcagcactagcacccattccaaagacagtaacgtaaacaagaaaggtaaagaagagaaagcggaggtgctatcaaggggtgattaccgcagtgaaggaggcaaattaaaaattgagcagcggattgatatgaattctggtagtcaacctacgatgaagcttggtgggaagactgaaacatcaaacgacagtttatctaatcaaagtaaagacgatgggggtggtgggaacaagcaacgcaagaaaacttctaagttcctgagagtacgccttggtgatggttctgtttcagcccttcttgatcaatcagatcctggaacaacagacggctcagaaggtaacaaggatgactctggaggagggcctcctgtgcgaggtgtttggcgaaaagggggagccgtggttgaactgcaatatgaacatgagctaaatggaatcggtgaacggaacaatgacggtggaggaccaacggttagccgaatggcgcatgcaccgtggcccctacctcggcgacatctcagctctctgttttcttcactttcccaatctctctcttccttttctgctcgtagccgaattggtcactacatagcaacattcttggctgagctcaggggactggggagtgctaaaggatcttga

SEQ ID NO: 32017 - DNA, 978 bp, Glycine max
  Peptide Sequence Number=SeqID_148795
atgtcggggttggttattgttgcatggcttgaagctttgaaggatgaaggcactctgttgaagggtctgaagaaagcgttcatggtggtccaggagtaccggagaagagtaaggactccgacttgggtgaatgtgctatcgtcggagcatgtccttgacttgtcgtttgatttcttgcttttgaaaggtgggagagttgctggtgtttggaaaagtggagaatatgccaggagaagacgatgtacaggtggaggaatggaggtgttagcagcaataggcccaggtgtgcccctgaatcacaatggcgatgtcgcgacaaaccttatcgcaggtgacctcggtgccattgcccaccataaccaccagcagaggtacaggttgggtaacccagtggaggaaatgggccagaagatcatggataaagttgtgggttggccggataaagtgtgtaggctgagttgggctaagtgtggggttgagggctggtctgtggggctaggtaaaggagagggtgatgtaggaaatagagggggaagagtagaagaagggggtaaagatgaagggggtaggtgggccaggggagatgatgaaggggggctaaagggccaagacttcgcagcggatatctggtgcgaggtcggaaatgaagcagttgaggaggaaaggggtagggagacccacaatcctgttggccaaggcttcgaacttagcaaggtaggagttgacgggagagggaaaatcgaagctctagtgcctgaagaaaggaggaccaggaaggtagctggtcgtttcggtgcatcaacagaaaccagctcagtgcaacgccgtcaaggttcatacggggtgcaggtgaatgaggtgagggtgatggggaagctgtttcgagggcgtgaaggcaagaagagagtaatggcttcttctatgcgggacagagtctgggaacgcgtattgttggccatggagaggagggatcaatga

SEQ ID NO: 32018 - DNA, 329 bp, Glycine max
  Peptide Sequence Number=SeqID_148796
atgaagtctgtgtatgaggtgcatggagctttgcagaaccaaaattttgatctttttaagaggattagcaaatggaagggtcttgagaaagtgaagggatttttatggaagcttggccatgaatgtctactaacgaactctaaaagaatgcagtttggaatgatccacttgaatttgtatcccacttgtaaagttttggaggaacatctattccacttgttcagagattgcccgaatacaattatattccaaggtgagaagtggactgttgaagtggtgatcaagaaggcttgtaatatgactcattcttacaaagataacttgatgag

SEQ ID NO: 32019 - DNA, 165 bp, Glycine max
  Peptide Sequence Number=SeqID_148797
atgattagttcagtcgctccaaactccaaatcactcctttgctgtgatgtgggaatcagcaaaggacgctgtctcgctatttatagtcatcaatccccacatgaccggacaccggaacctgaggtgtcgccgttagatttcaaaggagtcgagaaaagatggtaa

SEQ ID NO: 32020 - DNA, 435 bp, Glycine max
  Peptide Sequence Number=SeqID_148798
atgaagaaggtttcagccttagcattttccattctctttttggccttcaccatagaaccctttattggcattgctgaagcagcaccagaagtagtgcttgacacctcaagtcacaagctgagaataggtgtcaagtactacattctgtcagtgttcaaaggcaaaggtggaggcctaacaatttcaagcagtgacaacaacacatgctcgttctttgtggtgcaagagaagcttgaagtctcaaaggcacccaagcctttgtcaccaagtggtcacaagtctaatcctcgttgctccactgtagctccaccaccaaattgcttaagacccacaaatcctacgtggcacttagagaaacatgtccatcctccacatcagccttgctacaagagcgtggatgcctggcccttagcagccgagctccccaataaacag

SEQ ID NO: 32021 - DNA, 255 bp, Glycine max
  Peptide Sequence Number=SeqID_148799
atggcttctacaagtggagatgctactgcaccatttccaaaaaccacaaggctcatggtagagatgattaaacttggtgatcaaataagaataatgaattatgaaaatgaagaaaggatggagagaatgagaaaggagaatgaggagagtttgggaataatacacaggagtagagaaactttaagtatgaggggtatgaagaggataagggaggaaggaggaatgagaggtataaggagagaagaaatcatataa

SEQ ID NO: 32022 - DNA, 222 bp, Glycine max
  Peptide Sequence Number=SeqID_148800
atgttgtcacaaggggtgggtgtcaagggagggagatgtcattgttgggggtggccaccgaaggagatgttatcacaagaggtggccgtcaaaggagatgccatcactggaggtgttaaaattgacggaagggataagggaggtgttagggtggggagatgggagatgtgcaatagaaaatacataattacccatcatttctcatgctcaacacatcaatag

SEQ ID NO: 32023 - DNA, 943 bp, Glycine max
  Peptide Sequence Number=SeqID_148801
ggatacatgcagtggtggaatgaatggttacatatccttatgtggtggagaaccttgccctcctatctttaggtctcctgtcgcaagcatggaagatatcatggacaatcatgttatatgtgcaatatacagactcccagatgcacatacacacattacccgaccacctcaaggagttaaatttccaaaaaagattcaggcaggagacaccatgctgaaaatgggagcagctggtcatctagttgggctaaaactgactggttctccctttttctgtatcaggaaaaaccctccaggatctatttctggtcgggagcttggggatgcagcacacagactcatcgtcaattccttacaggcaaaggttgatactaatggataccgccatccgcataatggtcctcctatatcttatcctgcacccatgggtcatcatcgacaaccattgccttcacatggttatgaatcatgcccgggatacgttgcaatgccgccacctatttcagctccctcactccaaggcagaccacagtttgcaccttacaatgctgtccctactgctccgcagtatggttataatcaaccataccctgcgccaccggtggggtacaatcatcctcgccagcaatcaaatcctgtcgaaagaaatgactatcaacaccctagatcacataattatgaaagaaatcaccatcaaggtagtgggggtagttcaaggcatggatatcaatcatcaggaaataatcacaatgctaggtttaataattcacatggtagtcaccacagccaaagcttccaacctagagctcatcagaattggactccacgaaacaacccgagtgggcacagggatcatggtcagtattcgtccaatcaatattctttgttagatagaagaggaaacaggaatcaaatgccaccacctggttacagtcgcaaataa

SEQ ID NO: 32024 - DNA, 555 bp, Glycine max
  Peptide Sequence Number=SeqID_148802
atgaataaggttagaatttgtgaaagtactttgaagttttatccttatcactatgctccctttgcgtctgatctcaagggccttggtgaacttgatattagctttaagctgggtaccccattcaaaccatatgaccagcttctaggggtttttcctgctgcaagctctcatgcacttcctgagccatataggagacttatgactgatccaagctcaccaatcattgatttttatccagttgactttgaagtggacatgaatggcaaacgctttgcttggcagggtattgctaagttgccatttattgatgaagtgcgtcttctggcagaagttcaaaagattgaaaacttgttaacaccagaggaaaagcgacggaatgctataatgttcgacttgctctttgtgaattcttgtcatcctctctctgcgtgcataagtacacttgacaacaagtgtaaaaacatgcccaacagtgaacgggctgtggtcaaggaaaaaatcaatcccaaagaaagttgtggatttgttctgatggagcattatttatgcttgtga

SEQ ID NO: 32025 - DNA, 3423 bp, Glycine max
  Peptide Sequence Number=SeqID_148803
atgagagtcaatcagggacccaaaaatgggtgccaaaattatgagcaatcaacaatttggccttacccggttgcactgtttgcttttggggtcgtgtcttgtgtgctttttctatcgccaccgacactaccgacgagtgcatggagtcatttacttttgagtagtgttgaaaacggaagccacttgtgtggtgggtgtccgtacttttcaatggaccgacgctggccatggaagaaaaaatcgtcggacaaggctgtgcttgagaaagcagctgcggaattggactctgctgcgggtgctgctgcaactcagaagccgagctacatccaaatctcggtagagtcatattcccatctgactggtttggaggatcaagtgaagacatatgaagaaaaagttcagacactggaggatgagatcaaggaattaaatgaaaaactgtcagcagctaattcagagataaataccaaggaaagcttggtaaaacagcatgctaaggtcgcagaagaggctgtctcaggctgggagaaggctgaagcagaagctttggcgttgaagaaccatctggaaactgtcactcttgcaaaacttactgctgaggatcaggcatcacagttagatggtgctcttaaagagtgtatgcgacagataagaaacctgaaggaagaacatgaacagaaaatacaggaagttactctcacaaaaactaagcaattggacaagattaagggtgagtttgaggctaagatagcgaactttgaacaggaactcctcaggtctgctgcagacaatgcggctctgtcaaggtccttgcaagagcgctctaacatgataatcaatttaagtgaagaaaaagctcatgctgaggctgaaattgagcttctcaagggcaacattgaatcttgtgaaagagaaatcaattcactcaaatatgagcttcatgttatttccaaagagcttgagattcgcaatgaagaaaagaacatgagtatgaggtctgcagaagctgctaacaagcagcacatggagggtgttaaaaaaattgctaaactagaggcagaatgccaaagattacgtggtctagtgcggaaaaagttacctggtcctgccgcacttgcgcaaatgaagctagaagttgaaagtcttggccgagaatatggagaaactcgattgaggaagtctcctgtcaaacctgctagttctcacatgtccacattggctgggttctcccttgataatgctcagaaattccacaaagataatgaatttcttacagagcgtttattggcaatggaagaagagacaaagatgctgaaagaagctttggcaaaacgtaacagtgagttgcaggcttcaaggagtagttttgctaaaactttgagcaaacttcaaattttggaagcacaggttcagacaaataatcagcagaagggatctcctcaatccatcatccatataaatcatgaaagcatttacagtcaaaatgcaagcaatgcaccaagcttcgtctccttgtctgaagatggaaatgatgatgtgggaagttgtgctgagtcttggtctacagcatttctctctgagttatcccaattccctaaagaaaagaatactgaggaattgagcaaatctgatgccactaagaagttggaactaatggatgactttctggaggtggagaaattggcttggttatcaaatgaatccagtggagtttcagttacttcaaacaatataacaaatgaaattgtggtcaatgatctatcagaggtcagtgctgggaaagatgttccctctaacacccaagagaacagtgagccaaatccattgccaagtgaggtttcttctgctgaggaattgtcagcacctgatccccaatctgatgttccagctggcttgtcgctagcagagcttcaatcaagaatatcatcagtttttgagtccttggctaaggatgctgacatggagaagatcctgaaggatattaaacacgctcttgaagaggcatgtggcacttccatccaggactctgtatctgccattccccatgatgtcaagccttctgatactacgtgtgatgagctgggtaatgctgaagatgctggctcaaatgcagaaaaagaaatttcgtcccagaaacctacagaatttgtgcagatgacttcggatttagaagccgcaacttctcaaattcatgactttgtcttgttcctagccaaagaagcaatgacagctcatgatatatcttctgatggagatggaataagccaaaagatgaaggagttctctgttacttttaataaagttacatgcaatgaagcaagtttgctgcagttcgttcttgacctgtctaatgttctagccaaagcaagtgaatttagatttaatatccttggttataagggtagagaagctgaaactaatagtcctgattgcatagataagattgctctgccagaaaataagttagttcaagacaattcatcaggagagagatttcaaaatggtcgttcacatattcttaatccctgttctgatcctgagattcctgatgatggaaatttggccccaggctatgaatcaaatgccacgtcacagaagttctcaatggagaactttgaagaattgaaattagagaaagagaaggcagttgttgatctgtcaaagtgtgttgaaaatcttgaaatgacaaagtctcgattactagagacagagcaacatctagctgaagttaaatcacaattgacttctgctcaaagatcaaacagcctggctgagacgcaactaaaatgtatgacagaatcatacaggtcaattgaagcacgcgcaaaggagtttgaaactgagcttaatcatctgcaaatgaagacagaaactctggagaatgaacttgaagatgaaaagagggctcatgaagaagctttggctaagtacaaggagctagaagaacaactacaaaggaatgagagctcagctgctgataatgacattaagactaagcaggagagagacttggaagctgctgctgaaaagttagctgagtgtcaggaaaccatatttcttcttggcaagcagttaaaatcgatgcatcctcaaacagagccaacggggcctccttattcaaaggctgaaggcttcgcagagcgtgaacctaatagcccaaattttcaggatcaagcagagatggacagtgctagttctgcatttgtgcaaagactgggtggagagtcccccttacatttttctaacagtttatacagtccatcagataatgagtcaaactttccagccatatcttctgtacagaatccaaaccacaggcctacaaagtcaacctcttcgtctgcttcttccactcctacaccggagaaacacaaccgaggtttcagtagattcttttcatcaaaaggaaaaaacggtcattga

SEQ ID NO: 32026 - DNA, 225 bp, Glycine max
  Peptide Sequence Number=SeqID_148804
atggcttcctatggtgaagcaaaggactctattgatgaagaagatccaaggcctacaagctctacatggagctacattaaggttgaggttgagacaagtcacattcttaagaactcctcaaaacgcttaggatcagaaaaactgggactctcccagtcatcttgctttccagatgccaacaagaagaccggtaatccacttcacttgatcatcagcaagatgtga

SEQ ID NO: 32027 - DNA, 1737 bp, Glycine max
  Peptide Sequence Number=SeqID_148805
atgggagtcccagcgttctaccgatggctggcggagaagtatccgatggtgattgtggacgcgatcgaagaggaagcggtcgtaatcgacggcgttcaaatccccgtcgatacgagcaacaagaaccctaacaacatcgaatacgataacctctatctcgacatgaatggcatcattcatccttgctttcaccccgaggataggccgtctccgacgtcgtttgatgaggtgtttgagtgcatgttcgactacattgacagactattcgtcatggtgcggccgcggaagctgctctatatggctattgacggtgttgcgccgagggcgaaaatgaaccagcagcggtctaggcggtttagggctgcgaaagatgcagctgatgcggctgctgaagaaacaaggttaagggaggaatttgagaaggagggaagaaagcttcctcctaaaggagagtcacagacttttgattcaaatgtcattacacctggaactgaatttatggctgttttgtcaattgcacttcagtactatgttcatcttaggttgaacaatgaccctggttggcaaaatattaaggttattctttctgatgcaaatgttcctggtgaaggggagcataagattatgtcctatatccgcctgcagagaaatcttaaaggttatgatccaaatacacgacattgcctctatggtttggatgctgatttgattatgttggcattggctacccatgaaattcatttttcaattcttagagaggttgtatttactcctggacaagacaaatgcttcctctgtggtcagatgggtcatatggctgcaaactgtgaaggaaaggcaaaaaggaaggcaggagagtttgatgaaaaaggagaggctattgtggcgaaaaagcccttccagttcctaaatatatggactctgagagaatatctggagtatgagatgagaatacctaatcctcctttcgagattgattttgaatgcattgtggatgattttatcttcatgtgtttttttgtcggcaatgattttctaccacacatgcctacactagagattcgtgagggtgcaattaacttgctgatagcagtatacaagaaggaatttagggaattcggtggttatttaaccaatggaagcacgataaatttgagcaaggtggagcacttcattcaggctgttggatcttatgaagataaaatattccagaaaagagctcgattgcatcagcgacaaacagaaagaataaagcgtgaaaaggcacaggcaaggaggggagatgatgctgagcctcaatttaaaccagagtctttagttgcagtttcacgattccatggttctcgtcttgcttcagctccaaatccttcaccatttcaaccatctgggcattataattctcaagtgtctgcatcagttagaaaagacaataaagaagcctttgagaggccttataaagttgctagggtttcttcaggagcaactgttgctgctgctattgttgaagctgagaataatcttgaaatagatgctcaagataataaagatgaattgaaaacaaaattaaaggagatacttcgtgagaaatctgatgtattcaactcaaagaatgctgaagaggataagattaaattgggagaacctggctggaaagagaggtattatgatgaaaaattttctgccaaaactcctgaggaacttgaagcgatacgtaaagatgttgtgttgagtacttaa

SEQ ID NO: 32028 - DNA, 561 bp, Glycine max
  Peptide Sequence Number=SeqID_148806
atggggggcggttgcagcgaacttgttgtccaaaatcatctgagacaacttccgctccacgtgacccccttactttctatcaaaaggagtagaagggaggggaggggaagggaggaacaagggggagaggaaggggaaaggggagggaggaagaagggggaaggggagtggcaggaagggggagagggaggtcacacgatggcggttgctgcaagccttgtctcaacttgctgtctcagaaagcagatctatgccaccttgttgaactgggggcacaacgatgaaaggtggctgtggactattgggactattgggtcttcaaagaaattaagggaccgactagaatgtgcatcagcagcaactttggtagcatccaagtcaggccaagatattgtagccttcatttaccatgatcttacacaacaaggtacgcttttcacaggccactgtctgagaaaggcgccctccaataaagacgtgagccggttccatcgaataggccctccaaaaaaagcacaaaatccaaaaaaattggatttggatcattcaaagtatgcttaa

SEQ ID NO: 32029 - DNA, 267 bp, Glycine max
  Peptide Sequence Number=SeqID_148807
atgttcttccgtatgaaggatttttatgttacggaacaaagttcttccgtacgtccatacggaacaaccttcttccgtatgaacatacggaataaagttgttccgtatgaactcacagaagaaggggagatacaaagcactaacctcgagcagacgcaacaaatgcaccaaaaagcttcaccaacgagcgacaatggcggaaggaagaagatgttgggtgcgcaggagaagaaacgtgaactcgaaagagaagaagaaaagaaatga

SEQ ID NO: 32030 - DNA, 108 bp, Glycine max
  Peptide Sequence Number=SeqID_148808
atgtcatatttggaactgagttacatgacatcatggaagattgtctgtggctcgctaagggagaggcctatgctggaagtcttagggcgtgacgtagactgcgcatag

SEQ ID NO: 32031 - DNA, 564 bp, Glycine max
  Peptide Sequence Number=SeqID_148809
atggcatcgagaaaaagggccagagcagatgacatcccttcaccatctactccagctcctccgtcagcaacaataggaccggatgtccagagctcccaaaccttagtccttatgctacagagcttatttcaaggacaagttattatcatgcacagcttgcgagaattggctcaccaaaggacaattttaactatggagcagttccttaagcaagtaacatggcctggagctctaccttcaatggtgagacccaacgaggctactcctcatgagcccacacttgcacaggttgaaccagtgccagctaatccacaatctctagtggcaaatccaccttctcctaagcttgaagcagttcccccatctccacctattattatcatctctgattccccatctggaaaaactgctgctccccctgattccccaactggagaagctgctgatctctctgattccttatctggagaagttgttgctctctttgattcccatgttttccatttgatagatgaggaggatgctcagacacatgatacccaggacctgtctcagggattttaa

SEQ ID NO: 32032 - DNA, 159 bp, Glycine max
  Peptide Sequence Number=SeqID_148810
atggagaaatcggatcgtgaaggcgtgttcaatgcaagtcacgcgctgagcgcgaggttaccgtcatactcgctaagtgtggcaatcacgcttagcgcgaaggatttagacattgagaaatgtttatattctaagaagtggaaaatgatatctaaatga

SEQ ID NO: 32033 - DNA, 396 bp, Glycine max
  Peptide Sequence Number=SeqID_148811
atgtatcaaaagaagtatgagatcaatatcttgaagagattcaacatgactaattgtaatccaactactactccagctgaaacagcttatcaagttgcatggctggaaatcttattagaggagttaaatctaatagaggataaaccaatgaggttgttggttgacaacaagtccacaattgacttggctaagcgttctattgcacatggtaggagcaagcacattgagacaagattacacttctcatgtgatcaagtgaccaaagagaagcttgaattagagtattgcaaatcaaaggagcaagttgctgatattttgaccaagcctttgaagttggtcaagtttcataagttgagagacaaactaggaatattatctttagctgatctgaattaa

SEQ ID NO: 32034 - DNA, 150 bp, Glycine max
  Peptide Sequence Number=SeqID_148812
atgtataagaaggagaaagtgacgagggggttgatattgaccttggtttcatggtcttcaaccggttttcttgtaaactttgattctcttccatggaatgtgagtgttaagatgttgttgttggagtttacgcgagtgttcgggatatag

SEQ ID NO: 32035 - DNA, 330 bp, Glycine max
  Peptide Sequence Number=SeqID_148813
atgtataaaaatgagattgggcttatcaagaagttgatgcctttgtgtgaggtgcagcacactctccatgagggaaatcagtgcgtagacgtgttagcaaaactgggagctaattctttgagtcctcttgatgctttgcatgatcccccagttgcaggcagacgcactgagggttgtcttcccaaggctgtacagaatttggattcagagtatttcgacgcttcgctgaaagccacagaaacatgcgaccagagaagaaaccatggtcgtcactcctctgtaacgaaatcatcgaggaaatcttgtctcgtcttcccgtcaaacctttga

SEQ ID NO: 32036 - DNA, 141 bp, Glycine max
  Peptide Sequence Number=SeqID_148814
atggatttgctggatggtagcatgatgggtagccctcctagggcagggtttggaggactttgtagggttcaccatggaagctttcttgtgggcttatatggtcatgttggagggcaagagatcttatatgctgagatttaa

SEQ ID NO: 32037 - DNA, 378 bp, Glycine max
  Peptide Sequence Number=SeqID_148815
atggggggtgcaattaccttgtcggacatcccttgtgagggaaatagagtgattaaagaatctaaacatctccgaaaggggatggttaggagctttaatctgtccatggtctttgcacttgatgacgccatgtttcatacgttggatgttgtgtatgttcgtgggggaggggggtgcattgaccttgttggatgtcccttgtgtgggaaaatagagtggttaaagagtttaaacatcttcgaggggatgtttaggatctttaattcatccatgggggtgcgtcacctggtagggaactcccttgtggcccaagctgatcaccgggggggggggggagttacgatgcacgactgggtagccttgacaattactgcatag

SEQ ID NO: 32038 - DNA, 198 bp, Glycine max
  Peptide Sequence Number=SeqID_148816
atggcggcacgagcgacggcggcacagagacaaaaacagaccaagaacgaagaagaagaagcatcatttctcctggtgcccaaagcaattgtcattaaagagatgccaacccattatatgtctcagaaggaaatgaacacacccatgacccaagggaattgctttgtgcacctagcttttctcttgcacaggcagtaa

SEQ ID NO: 32039 - DNA, 867 bp, Glycine max
  Peptide Sequence Number=SeqID_148817
atgtcattaattgttaatcaaccttttaatgtgaagattatgattagagctagaggtttgggtcgggctttaggtagggttataggaagagctttaagtagagaagtaagccatgatgctgatgaaggccctcagcgacgaaggcccacaacatctgcacgtaggcaatgggaagttacgcctattgctgaggatgttaagcatgtggatcatgctactaaggaggtccatgaacaacctcaagaggcacctgctgctgatgtagttagtgatgtggagggttttccagacaggcctcacaacacatcagttttgatggactatgttcatcatgtgactgtgatagtttggaatgaagaggaacgttttgagttgaagttgttctcccatggaaggaaggtagaaaaatttggcaggtcagctcctaagattgaaagcttagtggttgtcacaggattaagtcctctgatcgcatgttcgctggacaatggtgatcggggacttgtgtctacttttgcagagaggtggcataaggaaactagtagtttccatttgctggtaggaggggtgagtatcaccctggatgatatggcatcgttgctacatctgactattacaggcaccttcaatagctttgaggttcttcatgtgaacgatgtcgtgttcctcttagttgaattgcttgaagtgagttctgaagaggcaagagcagagacgatacaatgccatggggcatatgttcgtctatcctggctacgagacatatatcggagcaaatgtgacgtggcaaagtggactatggcagctccaacatatttgttgcatctactaggttgcacactatttgctaacaagagtgccacacac

SEQ ID NO: 32040 - DNA, 245 bp, Glycine max
  Peptide Sequence Number=SeqID_148818
atggacaaccgacaccaccaccgtgaattcaccttcttaagctccgcccacttcctcgatcacatagatcctccttctatcaaagaaatggatttcttctcaacttcatcgcctcgtgatcataaaaataacactagtagccgtgataccaatgataatcattatcagaatcgtgatgatcaacatgacactcatgatcgccatggatcaccaacacgcgtcattgatcaccgtgtaaacgtgag

SEQ ID NO: 32041 - DNA, 210 bp, Glycine max
  Peptide Sequence Number=SeqID_148819
atgactcctactcatgataccctgctatattacaacaggaggtggaacatgccacaccaagatgacttcatgggttactcattcacaggaaagaatccaaaaagatttgacattccttcgggatgtagcatcgacggaatcaaggatgtgatcatgcaagttgcacctcaagggattccccttatgccaggtcattctgagtattcataa

SEQ ID NO: 32042 - DNA, 492 bp, Glycine max
  Peptide Sequence Number=SeqID_148820
atggataagagcttgaaggtaagagaagatgagtggagggagagaaggagcatgaaattttgtgcctcaaatgaggtacaggttgtgtttgtggggcccaaggaaataagaaaagggacagtgaatgagatatgtagccagattgcggacaagggaagcttgaaatggctgatactcgttgttaagagtaaaatgacttcgtttgcaaagaaagacttggagaattttccatttaaagttgagactatcaaaattgatgatttgctggtcaatatcacaaagcatgtgttgcagccaaagtatgagatacttactgatgatgagaagcaagcattgctcaccaagcataatttggatgagaagcagctccctcacatgttgaaaactgataccatagctcgctactatgggctggagaaagggcaagttgtgaaaatcactcacagtggtccagtggttaattttgatgtgtcttaccgttgtgtcgtgtaa

SEQ ID NO: 32043 - DNA, 522 bp, Glycine max
  Peptide Sequence Number=SeqID_148821
atgaatgcagagattaaagcattggaacttaataatacttgggttctcactgatttgcctcaacacaagaatttggatttgaacaatgctttcttacatggtgatctaaatgaggaggtgtacatgactcttcctcaaggaatgcaagtggcaaaaccaggcaagtttgcaaacttcaaagatgacattgtcttatcgggtaatgatatagctaaggttcaaagcattacacaactactggacaatgctttcaagataaaacacccaggtgatctaaggtctcggacgggctttaggctgagcaataggaaaagccctggagaagagaggctaggtcctcctacggtcgttgaggaattaaacgaagagcagcaacaaccacctgttgaagaaggtgttactgatgttgagggttttccaggcgaatcccatgacacatcagttttgagagattttgaaaatcgcattgctttgagagtctgggatggagaggaatatgctgagctgaagctatcttcctag

SEQ ID NO: 32044 - DNA, 2022 bp, Glycine max
  Peptide Sequence Number=SeqID_148822
atgtccaagctcgcccggacccccagtcttcggtcatgcaattcgctgctcgcgaaattggttcgctctggcgaaggagacgccgcattgatggtttttgagcaggttttgaagatggggattgtgcctgatgtttacatgattagtattgttgtgaatgcgcattgtagggaagggagcgtggagtgtgctgagaggtttgtggagaagatggaggggatggggtttgaggttaatgttgtggtgtacaatgctttggttggagggtatgtttgtaaggggggtgttgatggggctgagagggtgttgagtttgatgtcagggagaggggttgagaggaatgtggttacttggactttgttgatgaaatgttactgcaggcagggaagggtcgatgaggccgagaggttgcttcggaggatgaaggaggatgagggggtggttgtggatgatcgcgtgtatggcgtgttggtcaatgggtattgtcaggtggggaggatggatgatgcggttaggattcgagatgagatggccagggtggggttgagggtgaatgtgtttgtatgtaatgcgttggttaacgggtattgtaagcagggttgggttgggaaggctgaggaggtgttgagggagatggtggattggaatgtgaggccggattgttatagctataatacgctgttggatgggtactgcagggaagggaggatggctgagtcttttatgctttgtgaggagatgatacgggagggaattgatccatcggttgtgacatataatatggttctcaaagggctggtagatgtggggtcttatggggatgctttgagcctttggcatttgatggtgcaacgaggtgtggtgccgaatgaggtcagctattgtactctgcttgattgccttttcaaaatgggagattctgacagggctatgaagctttggaaagagattttgggtcggggttttagtaagagcaacgttgcattcaatacaatgattggtgggttgtgtaagatggggaaagtcgttgaagcacagactgtttttgataggatgaaggaacttggatgctcaccagatgaaataacatataggactttgagtgatggatattgtaaaattggctgtgttgtcgaagcttttagaattaaagatatgatggaaagacagacaatttctccttccatagaaatgtacaattcccttattaatggactttttaagtccaggaagtcgagtgatgttgctaaccttcttgttgagatgaagagaagagctctatcaccaaatgctgttacctttggcacccttatttctggttggtgcaatgaagagaagttggacaaagctttgactttatattttgagatgattgaaagagggttctctcctaattcagttatctgtagcaaaatagtcatcagtctttataagaatgatagaatcaatgaagctactgtgatcctagacaagatggtggattttgatcttcttacagttcataaatgttcagataagtctgtcaaaaatgatttcataagtctagaagctcagagaattgcagactctcttgataagagtgatatatgcaattctcttcccaacaatattgtgtacaacatagctatctatggtctttgtaagtctgggaagattgatgaagcaagaagtgttctgtcaattttgttgtctagagggtttcttccagataatttcacatatggtgccctaattcatgcctgttcggctgctggtgatgtgggtggtgctttcaacttaagggatgagatggtggaaagaggtcttatcccaaatattactacgtataatgcgttaataaatgggttgtgcaaagtaggaaatatggatagagcacagagacttttccataaacttcctcaaaaaggcttagttcccaatgttgttacctataatatactaatcactggttactgtagaataggtgatcttaatgaagcctctaaattgagagagaagatgatagaaggagggatttcttga

SEQ ID NO: 32045 - DNA, 210 bp, Glycine max
  Peptide Sequence Number=SeqID_148823
atggcaagaaatgtttttgggtacaaaaatgtttacggaaaaacaggctcttccggctctaatgtcaggacaaaactggcaatctcagcgagtatttacaatgggattacaaagtacctaccaatgggtatttctggattcaatcccaattctatacagttgtcacgatcagaacacaaggtcaaccaagtgaccccctcacccctatag

SEQ ID NO: 32046 - DNA, 165 bp, Glycine max
  Peptide Sequence Number=SeqID_148824
atgccgcgttcggagaacgccttgaggagcatgtcgaaggcggtgggggagaagccgaattcgcgggagaggagttggtggagtatggagcgggtttcggggaagagcttggcgcgggcgaggatgtggaggaggaggcagaaggaggtggcgtgggggcggtag

SEQ ID NO: 32047 - DNA, 603 bp, Glycine max
  Peptide Sequence Number=SeqID_148825
atgtcatcaggtggtgatgatcttccccaacccccgtctcatgactctattaggcctcccgatgttgcagctacaccatttccacctccgactgaagctagaccattttcatctcatgttgatgcacgtggaccatccacgatacctgcattcacaccatctccatcctgtctagcttctcatctcaaggaggtgagcttagctattagagaggaagcttctcaaggaggtgagcttagttatgagagggcatcctctccaagcttcttatccaaggctcatcttggtggtgaagctccttcttccatggcttattccttaatggatggcgcctcctctcacctcttttcctttgtcttccgctgcatctccatgggtacatcctttgtggtacaagtagagggtacatctacttggattattgtaactgagaacaagagagggtacatctcttgtggatcagttcaagtggagggtacatccacttggttgttcaaagagaacaagggatggtacatcccttgtggatctttgcttgtaaaggcttttaaaaggttgaaaagaaatctcaaggatcgcaggtcgcttgaggactggatgtag

SEQ ID NO: 32048 - DNA, 834 bp, Glycine max
  Peptide Sequence Number=SeqID_148826
atggcgggaactgaagcaaaaaaaactgaatccaaaaaacctgccgctaagcaatccggtaattcgcattactcgttttcgtgcatgttcgtttgcgtttcgtgtttgtgcatgttcgttcttctaacggcgaccgaacgaagccttgcaggtgggaagaagaaggaggtgaagaaggagactggcttaggtctcacgcatcggaaggcggagaacttcggagagtggtattccgaggttgttgttaatgccgaaatgattgaatactatgatatttccggttgctatattctgaggccttggtcaatggcaatatgggagatcatgcaagagtttttcgatccagaaataaagaaaatgaaaatcaagaactgctacttcccattgtttgtgtctcctggagttctgcaaaaggagaaggaccacgttgagggttttgctcctgaggaatattctcccggaatatcatgtatagactggtatggttgtaaagatttggagattattgcatgctcaaatcaattatttattcaatggtctagggctttcttgatcagggacatgctatgctggattgtaattttctttccagaaggatattttaacattagtacttgtctgattgtcctacttttccatcaggttgcttgggtgacaaagtctggggaatctgaattagaaattcctattgctattcgtcctactagtgaaactgtcatgtatccctactactctaagtggataaggggacatcgtgacttgcctttgaaacttaatcagtggtgcaatgttgtcagatgggagttcagcaaccccactccattcatcaggtag

SEQ ID NO: 32049 - DNA, 1011 bp, Glycine max
  Peptide Sequence Number=SeqID_148827
atggcttgtaatcaattacaaggcgtccttgtctataaatatctggattttcgtagaacccttatccctcattctcgtgtgacggcgccccttgctcccaaatcttcgtatctcactcatttcttaagaaaatcacttcaaacaaagcccaatcttcatcattttcaattctctttcaaacccaccaatcaaaatccgctgcaacatcttcaaatgttagaatcatcaaagaagcgaaaacgatcttcctctaccaccaccgctgctggccaccgccgccaaggaacctctggaaacccacccacaccagttcctccttctctttcatctcctagaccatccacattgttttcctcggatgatcagtgtcaaagatactactctcaattctataatagagtcattctagaccctaagtaccttgaccttgaattctttgatggagaaacatttgattgttaccaagtgtttcaaaattctggtttgattgatttcatgtctctaaaactgccttactttcctgaattagttaagatcgactgggcccatttagttcgatatcggatgcataaggcattacgggccaatgcacctctactttatcctcaccttgttactcttttttttcatcatttgaatgttcctttggatgatgaaccatttgtcaaggtcataaggtctttctctattggtgctggtgcagttacctcctttggttaccaaaaggatgttgatggtgagtgggttcacaaacatgacttgccttcgcctattcctgacgagcgtaccccatctcctccaccacaactaggtgattccactactcttctaactgaagtcctcacagaactccatgatcttcgagcttttgtgggtgaacgctttaatgcaatggatactcgtcttgatgtgatggatacttgctttgatgggatggatatgagaatcactcgactcgaagatgatatgagcttcattaggcattgcttcgatccctcggccgacttttag

SEQ ID NO: 32050 - DNA, 201 bp, Glycine max
  Peptide Sequence Number=SeqID_148828
atgcgtgttgggagagaagtgttttgtgagagagaaaagcgacggtgggacgagttcatcgatccaaactctgccattgagtggaacgagtttgatgactctgatgcccacaaatctgatgatgtcctcgaccccagctcatggcgccttatctttgactacaccccctcggcccttgcaagaattcaacgcttaatctaa

SEQ ID NO: 32051 - DNA, 291 bp, Glycine max
  Peptide Sequence Number=SeqID_148829
atggggtacgaagtttttttaccaaaatctgattttgacattgttcaggcattaacgagcatcgtccagcaaacaaaattaggaatgcaattcatgcaaaatgaacatcagaaagagatcattaatctaagtaagcacctgcattgcctagcttctgctgcttcaggatatcctcaagttcttgacgaaaactgcaagctatacaatatagtgcaggatttgacagctctccttgatgacgaagaatttgcgaaggctgcacagtccataacttggccttttggtgaataa

SEQ ID NO: 32052 - DNA, 225 bp, Glycine max
  Peptide Sequence Number=SeqID_148830
atgatatttgttggttgggaacctaatattgtcaactacaacaagatcatgggttctttgtgtaagggaagagttaatgaggctttaaacatcttcaagaagcttgtgcgttgtggagtattggggacaaatttagagcactggggatggttttgtgttggagtagcaaatcaaaaagaaaatttgatgcccccagatgaggatcatctaccgctcatagtgtaa

SEQ ID NO: 32053 - DNA, 228 bp, Glycine max
  Peptide Sequence Number=SeqID_148831
atggatgaatatgctttagtaggcacttcatctaaaagtatttctaagagtatgagcttcgatggagccagaaggatggctttgaaacacattaaagcttttgtccttatgttctctaatccacaagcatttgaggctcctgctacatcggtcatttgttcttgcaacattatgacagcttatatatttagtatggggcatatggtggatagaccaatcacattctga

SEQ ID NO: 32054 - DNA, 474 bp, Glycine max
  Peptide Sequence Number=SeqID_148832
atgttttgtcccttgtttttcctaatttttttgtcttcctttctccttttctgtcttgtttgtctccagccttttctgctaccaggccagtggctgctgccggtgctaaaagcagctgtggctggtggtcagatggctagccaagggggtgctgaacttgcagctgatgaaggaagaagtgctgctgctctagctgcatgtaggacattggctgaagagctgactgagtaccgatttccagcacctcgaatccttgcatttaaggagggtagctcccaggctcgatactttgtctctcgtctcattccagctcacaaggatcctccttatgagcaggaggcaagatttccacaactgaggtcgttgacatcagaacaacgaacaaagctgaaagccagttttgttcacttcgatgatcctagtttctgtgaatggatgcgaagtttgaaagtggtgccaccacaaccaagttga

SEQ ID NO: 32055 - DNA, 184 bp, Glycine max
  Peptide Sequence Number=SeqID_148833
tgtgcctagcctgctgtgcaaatcgccactgagactggctatatccattgctggtcaaatcgccatttacagtggcgagaccactggaatcgccaatggcagtagcgtttttgctgccacgtgttgtacgtcggagtttctcgccagtatcattggcgatttacatgtctcttacgtaaaataa

SEQ ID NO: 32056 - DNA, 151 bp, Glycine max
  Peptide Sequence Number=SeqID_148834
atgtcttctctcctcaaccctcacgcagtccgtctcctcctccaaccgcctcgtcctccttgctgcccccacccacaacctatctctggccccttatcttccacccttcaccaaaacctggtccgccccacactctccacccgcgccgctg

SEQ ID NO: 32057 - DNA, 252 bp, Glycine max
  Peptide Sequence Number=SeqID_148835
atgacttcaggtgcacatagaggattcaacagatggtcatttaaggttgagattttcaaagtgagcttcggtgaaggtgaagggaccggtgttcattgttgcggtggttggttcgtcggcggcggcaatcgaggtacgcatttctgctgggtgtgtgtgagtggggtggtccgtaaatcatacggatcaacttcatcggtaaaggctgatacggatcaacttgatccgtataagccttacggatcaagttga

SEQ ID NO: 32058 - DNA, 219 bp, Glycine max
  Peptide Sequence Number=SeqID_148836
tgctcctcacaggttcttgcaagttttggggaatttatttccactacctattgctatgttattgtgttggcatgttttcccccatcagactggtatcagagccgatggttcgacttggtgagtggctcaaatgggcgacatgtcccgtgggtggagcagcagtgcaagtaccgcaagtacctagagcatgtgggctctaatggttacactcgtggatga

SEQ ID NO: 32059 - DNA, 369 bp, Glycine max
  Peptide Sequence Number=SeqID_148837
atggcgatttcttggatgcccaacttgggcatagtccaagctatgtatgacatagcatccatgcttcacaggtccttattccccaatgagggagtcaagtctacatatcatcacctaatggagaacaagctaccaagaaatgaattgaaggttcaagatgtagatccacaaacatctttcaacatctcgttgcaatggtacaatgaatggtaccaagtgaggcaccataaagaacctcgtacactctccactccggaagctcacgcgcaactacctttttcgatggaactccaaatcctagagaaattgaagcttaggcactcctacacacactacaatggacctctactatgggcatcaataatgtaa

SEQ ID NO: 32060 - DNA, 225 bp, Glycine max
  Peptide Sequence Number=SeqID_148838
atgaagaagggattttgggcaattctcgaagcttttgcatgtttagagatttttagagagagaaaggttcaagttccagagagttttgagagcttttgttgtgtgaagactggcaaagaactgagcatgaagagaaagaagcttcccagatatggagagctaaatcctctattggttcttccttatagtacgtcatttcagtgtgattttgccttgatcacgtag

SEQ ID NO: 32061 - DNA, 420 bp, Glycine max
  Peptide Sequence Number=SeqID_148839
gatggaagtgttgaaccattcaagaagtctgaacctattcccgaagttaacaatgaatctgttaaagtagtagttgcagacaatcttcaggacattgttttcaactcagggaaaaatgttttgctggagatttatgctccttggtgtagtcactgcaaaaagttggctccgatattggaggaagttgctgtttcatatcaaagtaatcctgatgttattattgcaaaactggatgcaactgccaacgatataccacgtgatacttttgatgtacaaggttatccaacagtgtacttcaggtcagcaagtggacagatatcacagtatgatggaagtaggaaaaaggaagacatcatagatttcattgaaaagaaccgggataaagtggatcagcaagaatcagtaaaagatgagctttga

SEQ ID NO: 32062 - DNA, 248 bp, Glycine max
  Peptide Sequence Number=SeqID_148840
ctcatatttatgcgtgtaaagctgatcttccagggcaaaaggaggaggaagcgagggcgcaatcagctgatggcagagtgtttaagattgttccatggcaccatctggagcatagcaccagcaactccctgagcatacaggccttaagccatgatttgactggttcagataggggtggctttgatcaaattgacaaggatgattccaacctacctctggatacagctcctattaagcatgtcacgcag

SEQ ID NO: 32063 - DNA, 377 bp, Glycine max
  Peptide Sequence Number=SeqID_148841
atgtcattgcctagcgctgttcatgtgtcctccaccttcgattttggagctatgcttcatgattgcccaagtgtggaccctcaagtgcaatcctctattctcccccttttttcggagccccatgaatgtcattgcctagctctgttcatgtgtcctccattatcaagcatgaagcctctgaagaaaaaagaaggagtagagacgagagtcgtcatcacagaaagggcaggacgtacgaaatcagtgtcttatctttgctttcctcttatctccgatgagagatacttggcaccctttggtgcacaatatgtgaagtcccgagatgtgccaaaaatcaaaaggaagcaggcttacgcgatccgtgaaaattccgtaat

SEQ ID NO: 32064 - DNA, 201 bp, Glycine max
  Peptide Sequence Number=SeqID_148842
atggagttgctccagaggttgcggaccggtccatttgacccgcggagttcgtggggagggagtggatcaatttatttgatccgtgtcccttggatgataaagacaaagaatatcaaagtctcatcactgcatatatatgcaaatgttccatgtgcggtttcttatgccgcaatgaattaccccatccctccaaatttgtga

SEQ ID NO: 32065 - DNA, 255 bp, Glycine max
  Peptide Sequence Number=SeqID_148843
atggaagccttatcgaaatttgttgaagaatctagtgtccctattgtgactgtctttaacaatgacccaagcaatcacccttttgttgtcaaattctttgacaatccaaatgtaaaggcaatgatgttcttcaacttcactgttgacaatgcggattctctcaaatcaaaattccgtgaatctgccgagcaatatagacaacagggcataagctttctagtgggagaccttgaggctagtcaaggtgcattccag

SEQ ID NO: 32066 - DNA, 933 bp, Glycine max
  Peptide Sequence Number=SeqID_148844
atggaactactgcacttgttaaaattgagaataaattgtagacatctttatgaagatctagcagaagatttatttcacctgtttccttctcaaagtcaagtttttaggcaaaagaatcttttgaaaacttggaaaaaatcactggtaaaacaagaggagaataccttgcaggatttctatgataattggtctccttcagcagcaccggcaaaacaatttcagaatcaattggcaccttctggtatacaatcttctccctcttcaattctggggcagccaaagcagatccaaggagctgaaaccctatatcagaatatcataaatccatttgcggcttcttctgtgtatgggaaccttactaatacatatcctgctatgccaatgctatcacagactcagccagcactttctgggtacgaagtgtctcctggtattgtgaatcctgtgaataatttagtggactcagtcaagcctcaaatcatgacccctcaggagaaaattgaaaaattgaggaggcggcagcaaatgcaggcaatgattgctattcagaaacaacaacaacaattgggccatcaagttcctagtactagtaaatcaagcactcaaaaatgtcctccagaaattcaaagtcatcttagtgatgggactgatgacgatctaagaactcttcctgctctagatccaccaattgaacaagatgattctaatacaatgtcagtggctgttggtaatgatttcgttgaagataccgtattgtacagacttcaggatattatatcaaagttagacatcaaaataagactctgcatcagagatagtttgttccggttggcacaaaggcattatactagtgatactagcagtacaaacaaaagtagcagagaagaacttgaagttgctgcaagagaagaaagcattagccaaaacaggtag

SEQ ID NO: 32067 - DNA, 552 bp, Glycine max
  Peptide Sequence Number=SeqID_148845
atgagctttcattgtttatctcctttgcattatgcctgtctttcttctctatcttttgtttctattcctaagcatgtaggtgatgccctttctcaccctggttggcgacaagctatgcttgaggagatgtgtgcccttcagagcagtggtactagggacttcaccccccttccacttggcaagacagttgtaggttgtcattggattttcgcagtcaaagttggcctagatggtcaagtagatcgccttaaagctcgcttagttgctaaaggctatatacacagatctatggtcttgactaaccactcagtcttctattgccacttaaacaaatggaatatctaccttattaccaaggaccttgattttcttcattatttcttggggatagaagtggcacaatccaataatggcattgtgacttctcagagaaagtatgtgatggacatcttagaggatagtgacctgatgaatgctaagcttatagatactcctatggatcctaacaccaaactcatgcaaaaaacagggggatcccttttcagaccctaa

SEQ ID NO: 32068 - DNA, 693 bp, Glycine max
  Peptide Sequence Number=SeqID_148846
atgagcttaagtaaatcaaataacctaaatccctatgcggataaactaaatccctacaaactacactacaccggcaaaaatggaagcataaacgcaaaagacacaacaaaagggagaagaggcttaccgcgacgatcgacggtggagcagcgcaatgcacgtcctaccacaagagaaaaacttccaaagcaccttgaacacgccgtcaataatgttgaaaaagaacggaagaagaagataaatcgggcgcgggctgaagaagaagaagggactcaagaagaaggggcactcgcagtcgcgaaagaaggggcactcacagtcacagaagaagaagaggctaggtgcacaaaagtttttaaaaaaaggacaagggttgacgaactgttgttcaatgttacaaagcatgggaagcagcaaaagtatgaagtactgactgatgatgagaagagagcactgctcaccgagttaaagagggaagagaagcagatcaatattagaaagcatgtactgcagcagccagagactgaggtactcattgatgacgaggaagcaccactcaccaagttcaacttggtagagaagcaggcatgtgtcctcatcagtcatccctgtcatcaggcaacagaaaaagcggcatcatttcatcaacttcctccaaaatctgagactcgagttaaagacatgatttcttag

SEQ ID NO: 32069 - DNA, 396 bp, Glycine max
  Peptide Sequence Number=SeqID_148847
atggtatccgacaatgccaagtacctaaagcaccaacaagaccaggaaaggtcaactgcacacaaagccttaggtactcaagcatttgacttggtcgaatacccgagtactctcgtccttaacataaaagaggtacacgtgagctcgggtactcaggtattcagcctagtcgaatacccgaatgtctccatcactgttgtaacaggaaactcttcttttaagagtattagggtactcggcctaatcgagtacttgaatacagcgcttgctgatgtcctaaaagaagttctcttggaaggtactcacatatttgacctagctatgaacctgaaatatcccctatactattacacgacagtatccctcccttggtgctcaagtattcgactaggttga

SEQ ID NO: 32070 - DNA, 627 bp, Glycine max
  Peptide Sequence Number=SeqID_148848
atggcgcatcataacaatattagggtttcgatttgcttcctcttcgcgtcatcccttctttctctcttcgctcagatctcctccgggaaggagttcgttctcactttgaatcgctccaacttctccgacattgtcaccaaacacaacttcgtcgtcgtcgagttctacgcgccttggtgtggccactgtatgaagcttgctccagagtatgagaaagcagcctctatcttgagtagcaatgatcctccagttattttggctaaagttgatgcgaatgaggaaaagaacagagaacttgcaagccaatttcaggttcagggatttccaactattaagattctgagaaatgggggcaaggttgttcaagattacaaaggtccccgtgaagcagatggtattgttgactatttgaagaagcaaagtggtcctgcaacaactgaaattaaatctgcagatgatgctagtgctttgattgacaaaaataaagttgttattgaaaccccacatcacctacctcaattctcggaatgcaacttatatatatctattgtacaacttcacttggtgccaattggttttaagctgagatgttggggtctttccaaaattttctggggaggagtatga

SEQ ID NO: 32071 - DNA, 330 bp, Glycine max
  Peptide Sequence Number=SeqID_148849
atggcatgcccaatgtgtgtgcaaacatacccgaccagaactgaaacggacaaaactgcaaaaaaaagtgtgatttgggtgggtttaatcaggctaacgggttacaaaattggtttagtacaggttgcattggtcagttccactgtggcttgcagttctgatggtgggttatatatatcattaatggtgttagcaattgtgatggtggcttgcggctcaatggcaatggcaacattgagaaacgggtgtaattacgtgaaccgatgggttgctgcagtgggacttttcagacccgaatccgaccaaacccgaccggttgaacacccctaa

SEQ ID NO: 32072 - DNA, 777 bp, Glycine max
  Peptide Sequence Number=SeqID_148850
atggcttctagaaagagaaagagcattggtacaaggcccacatctcagtatgacacaaggagattctcttcattagatgcttggaccagatacactgataatgttctaggaagaaacattttacctgagaggaaagtagagctatatcagactgagctagatgactttgaggccgagctggagaggcataatttccataaacacctcaccaatttagccgatgggagcatagacctggctttggtgaaagatctcaacacattcctggagacacctgtcgtattagctgagggagagactctacccgcctactccagatactgcaggttgcctacaaacttcagagagataaaggctgccttatgcatacctagccgagggttcattttgaactctaagggccaacctgggaagattctcaggaaggacctgactacactggctcagcctaacacctctagacttgggttccctgctctaatcaccgcattatgcagagccagaggggttgtatctgacagccttaccttcgagtgcctgagcccggtcattaacctagcctacatcagaaagaacttttggaaccctgaggatctaacagtctctatccgaggggctaggagggcgagggcaaggccaactgagcttccttctacttctgcagctcctactccagcatccacttcagcagccccttctgttccagctcagacaaattctcagcgctttgaagccatgctccaaagcattcatcagggacatatcattttactatag

SEQ ID NO: 32073 - DNA, 1383 bp, Glycine max
  Peptide Sequence Number=SeqID_148851
atggacgagtcatggagaatgcgaatgggccaaacgccgggcctccctcgccggagatccatggaggaccgctcctccgccagaactcgcctctccatcttcgccggtgccggcgctggcgagcaggaaaccctcgaccccgacgacttcgccgacgtatttggcggcccgccgaggagcctcctggcgcacaaattctcgaggtcgaattcgttctacgaggagattttccggccgccggtgttcgcgtctccggcaccggcgaagggaggccggagcctgccggtgttccggattccggcgaagaacgaggcgttctacaacgacatattcgggtcggacgacgaccggcggtcgcgggagcgatcggggccgcagtcgaaggctaaatcgaagtcgaattcgtcgtcggcgttgagctccgaggagctgagccctctccggccgtcggccggtgatgacgcggcattgtctgcctttgcttccaagctcaggccaatcaatgtcccgtgcagatggaactcaaccactatgatgccaggggaacacccaattaaacaaggggggccattttatccatgcaatagtcagtcatttgaaaatcagtttcaggacaatgagtacaaggagagcttcaagagttctcatttgggattctccagaagagtctcctcgcccgaaactattagtctcgaatccaattcatatcaaagcatgaaaatatctgctgacgattgggaactcagttccccattttctgccgtctctggactttgtcaagaacctgaggccaaatcttcagtccatgatcacttgtttccagaactggttatagagcaggatgatgacgacgacgatgaagttatgagctcctatgtcatagaggtcaactccaatctcagagaggaaagttgtggaacagcagacattgatgaggcaatagcatgggctaaggagaagtttcaatcacgaaattctgatgaagaatcaagctcgagaaatgaaggcaatgagcaaactactacaagggtggaaggaaggtctgatgcagatgaatgccacggtgatggaatagaagttaaatcttcgaaggtacaaacagaaacagagaagttggacagagatataagattgtggtcatctggcaaggaaactgacatccggctactcctttcaacgctacatcatattttatggtccgagagtggctggtatgctgttcctcttccgaacctaatagaaagttcacaagtgaagaaggcctatcagaaagcaagattatgccttcaccctgacaaactgcagcaaagaggagcgacactcctacaaaagtatattgcagagaaggctttctccattcttcaggcattattttggaagtag

SEQ ID NO: 32074 - DNA, 567 bp, Glycine max
  Peptide Sequence Number=SeqID_148852
attgaggaggatcgttatctcttcatctatggaggcacggacgcaatgtggatccaagaattcacaacagccgtggagaaattgaagagggttgttgactcaatcagcttgcaaatagacatcacaatagagtcataccaattaggaagggaagaccctaaggttgtgccacgcttttggattgctattgatagcttgcttgcaaacaggaaacaacaaatgatgaagggtggtgatcaaggggtgcaagactttgcaacaagagagataaagaggttgcttttcctcaaacaagaccccaagggatgggtcattcttagcaaagggtacaatgtgaagctccttggtcaaggtgaggccatgtgtcgctcagttagagattttggcatatggcatgggaagttgcatgaagaagtgagctttgatgtggccttcaaagagtactatgaaagcattaaggttaaggattgtcctaaaaaatgtgagcatagtgaaatttctaactaccccacggatatattggcccatataccgtgcccaaatatggattgtgggcgttcaatggag

SEQ ID NO: 32075 - DNA, 801 bp, Glycine max
  Peptide Sequence Number=SeqID_148853
atgggtgttgatgcaggcaaagcactgtcccaaaaccctgacctacgcacagccaccatggaatccatccactccatcatctccttcctcctctccaaaggcctccaagaaaaggacttgcccagaatctttggcatgtgccccaagattctaacttctgacatcaaaactgatctcaacccagtttttgatttcatcttgagtgaactcaaagtccctgaaaacagcttcaggagggttgttaacaagtgcccaagattgctcacatcaagtgtcaaagaccagcttaggccttgtttggtttacttgaggagactagggttcaaggatttgggggcattggcttatcaagattctgttttgcttgtgtccaatgtggaaaataccctcattcctaaactcaagtttttggagactttagggctttccaaggatgaggttaggagcatggtgttgaggtgtccagcactgctcactttcagcatagagaataactttcagccaaagtatgagttttttgctggagagatggggagaaaattggaggagctaaaggagtttcctcagtattttgcttttagtttggagaacaggataaagcctagacacatggaggttgtgcaaagtgggattgctttagctttgccagtgatgcttaagagcactgatgaggagtttagggagctgtccgttgccattgatcttcaagaaacaaagaacttcattgataaagaagattcaagacctacaagctctacatggagttacatcataagagatttcatactttcctatgagtag

SEQ ID NO: 32076 - DNA, 189 bp, Glycine max
  Peptide Sequence Number=SeqID_148854
atgaacttttggtgggaagtgtgggcttcagtaatctgggaaacttggaaacaccgtaacgatatcagattcaacaacatagcacgcgattctaatgcagtgtctgatgcatgtaggaaacttgtgacatacaagtttgagaagagggtacagtgcatgttagcaaaacacatgttctgcggggtttag

SEQ ID NO: 32077 - DNA, 969 bp, Glycine max
  Peptide Sequence Number=SeqID_148855
atgttgattctggaacagctgaaagcgtattcctgggatgcaaaagcacttattgttcaagcagcttttgccttagaatatgggaaattcttgtaccttcccttgaccacacaatatcagatgtctgaaaaatcattggctgatttgaatggacttctaatgattcagcacaacacacagcatctcactttcttcaacagtgtggtgaagaaggtgatgcaagtgattgagtgcatcactgagtggaagaggcttaccagtgcagggtatgacataaaggatgtgcctaccttggcagaaactttgcatgagatccctgttgttgtgtactgggcaatcttcacctttgtcacttgtaccggccaaattgatgactttaccactgatcataagattcacaaacatgaattatcaaaaaactttgagaacaagcttgaccttattctaagaaattttaaggaacatctggaaatgtgtggcagggagatagggagaatagaagactacaccaggcgtaagaatattgtgattcatactggtaaagatattgtaaaggttttgaaagcactcatcatctccggagagaacagggaatcaagacagagtgtttttaatgttctcactggagaacagattaaaattgaagagttcaagaagaagcatgtcttgttatttatttctggccttgatagcattgaagaggagactctgcttctaaaatcgatatacgagaaattgaaggagaaaccaagagaggtagaaggttacaggaaggaggatttcaagatcttgtggatccccattgtggatgagtggaatgaggaacgcagaaaaacattagaaactaaattgcagcgtactaagtttggatgcaaattatatctgtgtggggcatcgatgggtttcctttcagaacctctgatcacacccggcttactcagcaatggaactggttctggtctgaaatga

SEQ ID NO: 32078 - DNA, 327 bp, Glycine max
  Peptide Sequence Number=SeqID_148856
atgtccaagtcactttcaagcactaatgtgcagcaagggaagactttgcttcaaaacccatttgaattcagtgacgaacagattctggataatgtttaccgaacccattttcattgcgttgagaagtgcgatgtagcatctcttcacaccgttgcctcgtgcgttatcagccactccattgaaatcacggacactgtgattactaagggtagccaactcagtgatcggttcagagaagacacgaccataacttcccaacagcttactgccaaactgaagcgaattgcttgccaggttgttgctaattttctacttggtgttaactag

SEQ ID NO: 32079 - DNA, 765 bp, Glycine max
  Peptide Sequence Number=SeqID_148857
atgagcatgatgggagaacttaagttatttctaaggcttcagaccaagcaagacaacaaaggtatctacatccaccaacaaaagtacactaaggaacttttaaagaagtttaaaatggaagatgctaagcctatgaaaaatcctatgtatgcttccaatcctctgagcaaagacgaattagcaatgccttctaagattattttgatgatgccaaagaatcaagagtcaagcaagttccaaaaaatcaagagtcaagcaagtttcaagaatcaagatcaagattcaacaataatcaagatcaagattcaagattcaagtaaagaatcaagacttgagattcaagaatcaagagaagactcaatcaagataaaacaagagagggtacatctcttgtggatcagttcaagtggagcgtacatctacttgggtggttatactgagaacaagagagggtacatctcttgtggatcagttcaagtggagcgtatatccacttggttgttcaaagagaacaagggagggtacatcccttgtggatctttgcttgtaaaggattttacaagtgtaatcaacctaactaaaaatcccatacaaaattcaaaggctaagcatattgagatatgtggaagcaatgtcttccaaggttattttgatgatgccaaagaatcaagagttaagaaaattccaaagattcaagaatctagtttcaagaatcaaaattcaagattcaagaatcaagtttcaagaatcaagattcaagaataa

SEQ ID NO: 32080 - DNA, 504 bp, Glycine max
  Peptide Sequence Number=SeqID_148858
atgttgatccgcataaaaaagggtgttctgctgttgcagacctgctatgatgaaagaagtgacttatctgctgaagtacaagacacattattccatcaacatggactttgcatgaaaaaaggacatgcacttaatgcaagcattaaaagatcaaacgagctcaagactttagacaaagagtatagtaaagaatccaaccattgcactaaagatgtcataccgaggaaggccacaactttgaccacacaccatgaaagcttcaccacaaaggatggagagtttgtggatgacatgtttggaagacttcaagttcttctaaacaatctagaagctctcggacagacatactccaaggctcaaataaacctgaaggtgttggacaactttcccaaagtatgggaacttaaaaccataaccatccaagaagcaaaagatttgaaaaatcttgcatgggatgagctgctgggcatcctaagagtccatgaagttcaccttcaaacataa

SEQ ID NO: 32081 - DNA, 358 bp, Glycine max
  Peptide Sequence Number=SeqID_148859
atggacaattctaatggaagcgacattggattggatgcagatgttgacaatgaagaaaaggctaaagatgttgattgcataggatttaaatacaaaaatttaaaggatttcacaatagatgacattacatccatggagttttcatgtgttagagcatgtcagataatgggttacatgatggatcaatatagggttcatgtaggtcttggtttcaacaagaaagactcgttcaactatattgagcagcaaaagcatgttaaaatcaaggatggttatgtacgtgctttgttaatttatcttcagggtaaggcagataatgatgctatgttttttgctaaatacatgctgatagaagatg

SEQ ID NO: 32082 - DNA, 747 bp, Glycine max
  Peptide Sequence Number=SeqID_148860
atgaaggttagactagagatcaagaaaagagttgatactgtttctacacctcaactcttaactaacatcttcaacaaaatgcatcaacatctgagcagacaagacggagactcaattgattggttgttgccatcaagacctcagcctcaaaatcaacctgagtgtgctttagacaacaacacagactttatcatggcttcaagggatacatactatttgaaggtgcacaagacaattatatttcctaaggaagattactacaaaggcaaagaaaagttgattgaagatgcacctcttacactctgtgataaagcaagaccagacagactcttcaagcatgaagtggctgcactgcataagaagagggagcttacaagagtccattgttctagtctggaacttgaggagaagccaccatcagatggagttcatcacaagacaagatgctgctatcagactataaattacaatcccattatggttgattcaccatccaatcgcgtttgtcaacggaagatagacattgtagttgtatttgggcgtaatttctcctttactattgagattccaaacttcatatatggccatggaatttatgatggtcctccttcatccgaggagtgtgtcaattttattgagaaaacattgctcagaaccagggagacacttgctgaagctcttcatgatagggctcatgctgaaagagaagctaaaagatggaaaatctttggggaattcttattttag

SEQ ID NO: 32083 - DNA, 345 bp, Glycine max
  Peptide Sequence Number=SeqID_148861
atgcctatagtaggatcaagagactgtgttagtgacaaataccgcttgtgcgtctacaagatcatggtagtggagaaggttctttacccagattttgaggctagttggatgaaggtttccttaatggtgccatcatctggagccactcaactgaagagggcagcctttgcttcagaagagattcctaaagaagttataatagtatcttggaagatcttgacaagggacaaggagctaaggaatgaaattgcaagtgaccatgtacctgacaaagtagtgcttgaggctataaaagctgcgcttgaggaggagttgcagaaagttgaattggatgccaaaatctaa

SEQ ID NO: 32084 - DNA, 447 bp, Glycine max
  Peptide Sequence Number=SeqID_148862
atgcataaggcattacgggccaatgcacctctcccttatcctcacctcgtcaccctttttcttcatcatttcaaaattcctttggaagatgaaccatttgttcaagtaaaaaggtcttttgctattggtgttggtgcgattatcttgtttggttaccgtaaggatgatgatggtcagtgggttcgaaaacaagacttacctcagccaatccctgacgaacgtactctttctcctccaccgcaaagggttgattcctcttcacttctgaacgatgttctctctgaactccacagtcttcgagcttttgtgggtgaccgatttgatgctatggatactcccctggatgccatggatgctcacttcgatgggatggatacgaggattactcgacttgaggacgatatgagcttcattaggtgttgcttcgatccaccagccaacccttag

SEQ ID NO: 32085 - DNA, 314 bp, Glycine max
  Peptide Sequence Number=SeqID_148863
tcagttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacgg

SEQ ID NO: 32086 - DNA, 345 bp, Glycine max
  Peptide Sequence Number=SeqID_148864
atgaattgctttttcgttcatgtgtcctccaccttcaagtttggagccatgcgtagtgattgcttaatgcaattctccattctcaacctttttcggagccccatgaattgcgttttcgttcatgtgtcccccaccttccagtttggagctatgcgtactgattgcttaatgcaattctccattctcaacctttttcggagccccatgaattgcgttttcgttcatgtgtcctccaccttccagtttggagctatgcgtagtgattgcttaaagcaattctccattctcaacctttttcggaaccccaagaattgcgttttcgttcatgtgtcccccaccttctag

SEQ ID NO: 32087 - DNA, 505 bp, Glycine max
  Peptide Sequence Number=SeqID_148865
cggaagaaggtgttcttccgcgggctcctgcggaagaaaggtgaaaaggttcttctgtgggttccagcggaagaagattcttccgcttgatccagcggaagaagcttctgcaggttcttccgcgggcgccagcgaaagaacgttgtcttccgtggatccagcggaagaagcttctgcgggttcttccgcgggagccagcggaagaacattgtcttccgcggatcccgtggaagaacctgcggaaccttcttccgcaggctacattatctgctcgcggaagaacctgcggaaccttctttcgcagggtacatgtccttctcgcggaagaacctgcggaaccttcttccgcaggcttcctatccttctcgcggaagaacctgggaaacttcttctacggaccatcatgttaccatactccaagagcttgctcaaagtcatcttagccagatcaaaggttggaggtccaatgaagtcatcaccaagttcacaagcttcttcccaatga

SEQ ID NO: 32088 - DNA, 333 bp, Glycine max
  Peptide Sequence Number=SeqID_148866
atggagtggttttttcagatttcgcacccttttgtgacaccgacggaggacattgttgagccgagacctgcgcctccccctccccctcatgatgatgacttcgttgagccacctgtccccgaggttccaatcgcgttggatctccctacgcattctatggttgattgcacaggatgtgtaaggattgctgagcatttggagcgggtcatcaacctcaggatggtgaatgaagggactgacttatatgatatcatggatctttgtctgaggatagctagaggtgacgacccagatgacagtcttaggccgcggcagagacgccgcataaattag

SEQ ID NO: 32089 - DNA, 285 bp, Glycine max
  Peptide Sequence Number=SeqID_148867
atggggcaagacgggggcagagtggggcaggggcggggaccagcatacctgaccccatccccaaacctgactttctcaatcaggaaaaccccgaatccaacccagtcaactcaattttttccagtcaaagtcagggcgagtccgggtcggtccccactgggacagagaggagcgaagttcggcaaatgttggtggagacacgggacaaaaccctatgaaagaacatcgctgagcctcgggacgatgaagaagaagaagagtttacgaaaaatagaacagaactga

SEQ ID NO: 32090 - DNA, 1074 bp, Glycine max
  Peptide Sequence Number=SeqID_148868
atgcctacttctgatgtagtatatgatactttgaaaattgattatatggtgattcctgttcaactcaatttgttgctgccaccaataaattcattatcagctccaagatttgggttttcttcatcagcttcaactgaaaataatgacaagaaaaacagaaataatgtgcataatggagattctacaaatgctgaccctgcaaaagcaaatgaagaggcaaaaaataatgatcaggctaggcaagacaaacctgcagataaaacagaggaatcaggttctatttcagattctcaatctcaaactgtcaaaagaaggaggagaggttttaaacgaactgcattttctgattcagattcagaaagtgaatgtgacctatccagggatgatttaattaaacttgtggctgaaaaggaagaacttgtgatgttaaagcacaaggagattgaaaaaatgcaggataaagttctgcgtacttatgcagagatggagaatgtcatggaaaggactagacgtgaagcagataattcaaaaaaatttgctttacagaattttgcaaagagtttactagatgttgcggacaatttgggaagagcttcctcggttgcaacggaaaatttttcaaaaattgatacgtctagtgactctgctgaagtggtaaaactcctgaaaacacttctgcaaggtgttgaaatgacagagaaacaattagtagagcctctttgcatatgcaagggtaaggctgcgtacaacatccctcccccataccttcgcatagcgaagagcctctgggcaatgggtaaagtgcttcgggcttcagcctattgtaaaactaattacttcagcttacaggtacttaaaaagtttggtgtagaaaaatttgatcctaccaacgagccctttgatccacacaggcataatgccatcttccaaatccccgatggttctaagcctccaggaactgttgcagctgttctgaagatacaaatccaagtcatgctctcaacttctcaccttccagcaaagcacttctcactcttgcaatcttaccatcctcagaatcatcacaaagaataa

SEQ ID NO: 32091 - DNA, 495 bp, Glycine max
  Peptide Sequence Number=SeqID_148869
atgaaagattacaggggactagaaggaaatgcagaggagccgaacgcatcaaggaaggaaggaaggaagatgttgggtgttataaggcacaagagtattcgccctgccttctccgcaatcagacacttgtcttctgcagctaaagagattactgtcagggaggctctgaactccgcactcgatgaggaaatgtcagctgatcctaaagtgttcttgatgggtgaagaggttggggaatatcagggtgcatacaagatatccaaggggctgctcgacaagtatggccccgagagggttctcgatactccaatcactgaggctgggtttgctgggattggagttggcgctgcttactatggtctaaggcctgttgtggagtttatgacttttaacttctccatgcagttatcaatcaaggatagagatgtgcatggccaacaccaaaaatgctatagcgtgatagcaactattctgaagattatgtatgcaagataa

SEQ ID NO: 32092 - DNA, 267 bp, Glycine max
  Peptide Sequence Number=SeqID_148870
atgatgaagctcaagctagagggagagggcatggcaatagatcatattattaactctgccgcaaaatcaaactacatgtctgctgggcaaatatctgtgcctattgtctttagaggacccaatggtgccgctgctggagttggtgctcagcattctcaatgttatgcatcttggtatggttcatgccctgggttgaaagtcttgtcaccatattcatctgaagatgctcgtggtttgcttaaagctgctataagggaccctgatcct

SEQ ID NO: 32093 - DNA, 1485 bp, Glycine max
  Peptide Sequence Number=SeqID_148871
atggcttcttctacggttgttcccgttcctcctgttccagttgagggcggaaagccaagccgcggcgttagcattcggtctcgcctaagcaaactgtgccaacagggacaacctcacttggcacgccatcttctggacacgcttccacgtgcctcctccgcggtctggaacaccgtcatcatcggcttcatctgcaaccacatgcctttggaggccctccatctgtacgcggaaatgaagtccagcccggacaccccttccgattgctacaccttctcttccaccctcaaggcctgctccctaacccagaacctcttggccggtaaggccattcattcccattttcttcgctcccaatccaactctcgaatcgtctacaactccctcttgaacatgtactccgtctgcttgcccccctccactgttcaatcccaactcgactacgtcctcaaagtgttcgcctttatgcgcaaacgaaacgtcgtcgcctggaacaccttgatttcctggtatgtcaaaacccacagacagcttcacgcacttcgcgccttcgccaccctcattaaaacttccatcactcccactcccgttactttcgtcaatgtcttccctgctgtccccgatcccaaaaccgctcttatgttttatgccttgcttcttaaatttggtgctgactatgccaatgacgtcttcgctgttagctccgcaatcgttatgtttgctgatcttggttgcttagactatgctaggatggtttttgaccgttgttccaacaaaaatacagaggtttggaataccatgattggtggttatgttcaaaataactgtccccttcaagggattgatgttttccttcgagccttggagtcagaggaggccgtgtgcgatgaggtcacttttctgtccgttatctgtgctgtttcgctgctgcagcaaattaaattggctcagcagctgcatgcatttgttcttaaaagtttggcagttactcccgttattgttgtcaatgctatcatggttatgtactccagatgcaattttgttgatacttccttgaaggtttttgataacatgcctcaaagggatgctgtttcgtggaatactataatttcttcctttgtacaaaatggtttggatgaggaagcactcatgcttgtgtgcgagatggagaagcagaagtttcccattgattccgtcactgcgacggcccttctttctgcggcttctaacattaggagctcttacattggaaggcaaacccacgcatatctaattcgccatgggatacagtttgagggtatggagagttatctgattgatatgtatgcgaaatccaggttggttaggacttctgagttgttatttgagcagaactgcccaagtgatagagatctggccacatggaatgctatgattgctggttatacacagaatggtctcagcgataaagccattctcattcttagagaggcattagttcacaag

SEQ ID NO: 32094 - DNA, 1746 bp, Glycine max
  Peptide Sequence Number=SeqID_148872
atggagttcgacccgatcccaatcggttcgtgctccaaagaacaccagatgatctataaggagtggttcaattacgctgattcagatagcgatggccgcattacggggagtgatgccaccaagtttttcgccatgtccaatttgccccgcgaagatcttaagcaggtgtgggctattgcagattcaaagcgacaaggatatcttggtttcactgaatttatcattgctatgcagctagtttctttggctcaatctgggcactcaataacacccgatctgctgactagtgatgttgattttacaaatggaaaacctccctcaatggagggtttggacgtattactagttaagaaaaagcataaacaaaaagaggttgatgcaaatggtggtatcaaagcgtatcctagatccattcaaagggtcacccaatatattatccacacaccaagttcaaaagtgttgggcgtgagggggtgtattgggaaaaacccaagtcccacatcagctagagataaagccaagatagagtacataagtgagagacaatcctcaccctttgagctagcttttggggttaagctaagtctagacccacattctaagatagtgcctctttcctctgtgacatcaataattgacggcttgaagagactctacattcagaagttgaagccattagaagttacttaccgttttaatgattttgtatccccattactgacaaatagtgactttgatgccaaaccaatggttatgcttttgggtcagtactcaactggagcacatattggacctgagccaacaactgataggtttgttgttgtcatgtctggatctgatgagagaagcgttcctggaaatactgttgctgtccaagcagacatgccatttagtggtcttacaacttttggcacagcatttttgtcaaaatttgtgtgttcacagatgcctcatcctctactggaacacatcacatttgttgacactccgggagttctatctggagaaaagcaacgcacacaacgagcatatgattttacgggtgtaacatcttggtttgctgctaagtgtgatttgattctccttctgtttgatcctcacaaacttgacatcagtgatgagttcaatcgtgtgatatcatccttacgggggcatgatgacaaaatccgagtggttttgaacaaggcagaccaagttgatacccaacaattgatgagggtttatggagccttaatgtggtcacttgggaaggtgctgaagacacctgaagtaatgcgagtgtatattggctccttcaatgacaagcctgtaaatgatgctgccactggtccacttgggaaggaactctttgaaaaggaacaggatgatctactctcggatctgaaagatgtaccaaaagcagcttgtgatcgaagaatcaatgagtttgtaaaacgggcccgagcagccaagatacatgcttacattatcagccatcttaaaaaggagatgcctgctatgataggcaaagctaaagctcaacaaaagctcatcgataatttggcagctgaatttggaaaggtacaaagggagttccatttacctcctggcgattttccaaatgtagagtttttcagagagagattgagtggttacaatattgataagtttgaaaaattgaaaccaaaaatgacacaagcagttgatgacatgttagcttacgacattcctaatctcttgaagaattttaggaatccctatgattaa

SEQ ID NO: 32095 - DNA, 144 bp, Glycine max
  Peptide Sequence Number=SeqID_148873
atgaccagcaagaaattatgtttacatcctttgggtgctaatgatagtgaaatatgctctcctgtacagaagctgtgctcaggtggttgtgacaatactgtgaaggtatggaagttgagatgggttcgagatgttgcttattaa

SEQ ID NO: 32096 - DNA, 1662 bp, Glycine max
  Peptide Sequence Number=SeqID_148874
atgaagccaataataatattagacattgtcgggtatagaaccaaacatgtacctccagtcccccttgacattcgcgacaacatagcccactacaggatccaacggacagttcagctaacattttctttctgttgtcttccgcaagtagtaatagtaacattttctaacctaacattagcggttctgagagtagtgcattggtgggtgggtctccaacatgggtcaagggtcccacacgtctgcatgctctgcaaactgagcatggctcctctcgcattttccttcttcttcatccttatcacattcttttcttcatcatctgaagcgggatccgttggaataaactatggaagggttgcgaacgacctacctacaccagcgaaagtggtggagcttctgaaggcacaaggtctgaaccgtgtgaagctctacgacaccgacgccaccgtcttaaccgcgtttgcaaactcgggaatcaaggtcgtagttgccatgccaaacgagcttcttgccaacgccgccgcggaccagtccttcaccgatgcgtgggtccaagccaacatctccacctactaccccgccacgcaaatcgaagccatagccgtcggaaacgaagtcttcgtcgaccccaacaacacaacaaagttcctcgtacccgccatgaagaacgtccacgcttctctaacaaagtacaacctcgacaaaaacattaaaatctcctcacccatcgcactctccgcgctccagaactcgttccccgcctcatccggttccttcaaaaccgaactcgtcgaaccggttatcaaacccatgctcgacctgctccgccaaaccggttcctacttaatggtgaatgcgtatccgtttttcgcttacgctgcaaactctgataaaatctctttagactacgcgctattcaaggaaaaccccggcgtggttgattccggtaatggtttaaaatacacgaacttattcgacgctcaaatcgacgccgttttcgctgccatgtcagcactcaaatacgaagacgttaagatcgcggtttcggaaacgggttggccttctgctggggactctaacgagattggagccagccccgacaatgcggcgtcgtataacggaaacttggttaaacgcgtgatgagtgggagtgggacccccttgaagcaaaatgagtcactcgatgttttcctcttcgcgcttttcaatgagaaccagaaaacgggtcccacgtcggagagaaactacgggctgttctaccccactgagaagaaggtttacgatattccgctcacggcggaggaaatcaaggaggcgccgccgtcaggagtagggaagagccaggttccggtgagtggtgaggtgtcaacgacgacgtctaagggccagacgtggtgcgtagctagtggcggttcttcggagaagaagctgcagaacgctcttaactacgcttgcggagagggtggggctgattgcactccaattcaaccaggtgccacgtgttacaatcctaacaccttggaggcacatgcttcctacgccttcaacagttactatcagaagaaggcacgtgcatccggcacgtgcgattttggtggcactgcttatgtcgtcactcagccccctaagtatggtaactgcgaattccccacaggatactga

SEQ ID NO: 32097 - DNA, 2244 bp, Glycine max
  Peptide Sequence Number=SeqID_148875
atgtcgtttagagggacaccgcttgtcatggatgagcttgatttctttgctcataagagaaaagtgagtgcaaatgatgatgatcatcaaagagtggaagaccttcatgttgatactagcttagatcttcttacgaagaatgataccgatgtcaataatagatcaacggaggaagatgcggcattggaaactatggatgataagagcaacgagtttatagctttgttaactgaattggaccaaatgaatgctgagaatcaacgcttaagagagttggttgatcaggtgaacaataactgcaacaccctacgcatgcaacttgtcaagctaacacagaagcatcatagccatgggaataacggagtgataggggaaaaagaagatatggttccaaggtcatttttagacattggtgttgctgagaaggatgagcctaattcccagcaatcttctgagggaaaactgagagaaagcaaaagcatggttgagttaggacatggcaaagatattgctgttttggaggcatataagttggattctactgctggaagggaaagtacaaaagctagaatggaagggaggcagataagtactgaacaagaattctctaacaaagttcctagattggatccagcttcagaaaccatgtcaatgatcaagaaagctcgtgtgtcagttcgagcaaaatcatattcttcaatgattgcagatggatgccaatggagaaagtatgggcagaagatggcgaaagggaatccttggccaagagcctattatcgttgcacaatgagtactggttgtccagtgcggaaacaggtacaaaggtgtgctgaagacagaagtgtgctgatcacaacatatgaagggcagcataaccatccactccctcccacaacatctgtagctgcctcaatgccaagcatattagaaagtgcttcacttccatgctctcggaacatggcaactctctctgcctcagccccatttcccaccatcacattggacctcactcaaaatgcaaccaattcctcacagctacaaagggaattaccactgggccaacttggcctcctatccccacttttggctcataagttcatgtcagtccctaaaatatttggacagggaatggacacaaattcatcgtttgctaacatattaaatgcagccactgcagaccccaatttcactgcagctcttgtggcagctataacatctgtcatgggaacttcacattcaaacaccaatgccaccaatagtacaagggcccttcaagtggaaagtgcaccctcattctccatggggcaaaaatttcaccttcacgatgtgattgaggctcagcaatttgacagagagactctcaatgccatatttgaagttgcaaggagcatggagagcattgaaagcaagtcatctaggagccaaatgctaaagggttacctcatggctactttgttttatgagccatccactagaactaggctttcatttgagtctgccatgaaaagattgggtggggatgttctcacaactgagaatgcaagggagttttcatctgctgctaaaggagagacgcttgaagatacaataagaacggttgaaggttactctgatataattgtgatgaggcactttgaaagtggtgctgccaaaagagcagcaacaactgctagcattcctgtaatcaatgcaggggatggccctggacagcatccctcacaggcactgctagatgtttataccattgaaagagagatagggaaactggacggaattagagttgggcttgtgggagaccttgctaatgggagaacagttcgctcacttgcatacttactagccaagtatcaggacgtgaaaatttattttgtctctcctaacgtggttaaaatgaaggatgacataaaagactatctgacatcaaagggagtggagtgggaagaaagtgctgatttgatggaagtggcttctaagtgcaatgtggtttatcaaactcgcattcagaaagaaagatttggagagaaaattgaactttatgaggaggcaagaggcaagtatattgtaaatcaagatgttttaaatgtgatgcaaaaacatgccgtggttatgcaccctcttccaagacttgatgagcagattacggtggatgttgatagtgatccaagagctgcttactttcggcaggcaaagaatggtctatatattaggatggctctcttaaaggtattgcttcttggttggtaa

SEQ ID NO: 32098 - DNA, 1986 bp, Glycine max
  Peptide Sequence Number=SeqID_148876
atggaggtgccaactaggagaaaacccgtgatctactggatttgccttttcgtcattgtcaatgcgtttgtacaaattagcaatgcattttatcttccgggaagctacatgcacacttactcaaatggagataatatatatgccaaggttaattcattgacttctattgagactgagcttccctacagctactacagtctcccttactgcaagccccttggtgacataaagaaaagtgctgagaatcttggagagctcctcaggggagatcagattgatagctctccctaccttttccgcatgaacgttaatcagtcaatctacctctgtactacgaccgccttgaaagagaatgaggtaaagctactgaaacaaagaactcgtgatctgtatcaagtaaatatgatccttgacaatttgcctgttatgaggtttgccaatcaaaatgggattaagatccagtggacggggttccctgttgggtacacaccccctgatggcagtgctgattacatcattaaccatctcaaattcaaagtcttggttcatgaatatgaaggaaatggtgttgaaatcattgggactggggaggaaggtatgggtgttatctctgaagctgaaaagaagaaggtatctggatatgaaattgttggctttcaggttatcccttgcagtgttaagcgtgatcctgaagtcatgacaaaactccacatgtatgacaatatctcttcaacaaactgcccatctgagctagacaagtaccaaccgattaaagagcaagagagaatatcatttacatatgaagttgagttcgtgaaaagtgatataagatggccatcgcgttgggatgcttatttaaagatggagggttcccgggtgcattggttctccatcctaaattcactgatggtgatctttttcttagctggtattgtctttgtcattttcttgagaactgtgagaagggacttgacacggtatgaggagttggacaaagaggcacaagcacagatgaatgaggagctttctggatggaagcttgttgtgggtgatgtatttagagagcctgatggttcaaggcttctctgtgtgatggttggggatggggttcagattcttggaatggctgctgtgactattgtttttgcagccctgggtttcatgtcaccagcttccagaggtatgctgcttactgggatgataattttatatcttttcctgggaattgctgctggatatgtcagtgtacgtctatggaggaccattaagggaacctcagaagggtggagatccatttcctggttatctgcttgtttttttcctggaattgcttttattattctgacaggactgaattttcttctctggggcagcaaaagtactggtgctattcccatttccctgtattttgagttgctcttcctctggttctgcatctcagttccacttaccctcattggaggatttatggggacaaaagctcagcaaattgaatatcccgtgcgaactaaccagattccaagggagattcctgcacgtaaatatccatcatggcttcttgttcttggggcaggaactcttccgtttggaacccttttcattgagcttttctttatcctttccagtatctggcttgggaggttctattatgtatttggtttcctgttggttgttcttctattgctggttattgtttgtgctgaagtgtcagtggtcctcacatatatgcatctttgtgtggaagattggcagtggtggtggaagtcattctttgcttcaggctctgttgctctttatgtcttcttgtactccattaactacttggttttcgacctgcagagtttgagtggacctgtctcagctatactttatctcggctattccctgctcatggcaattgcaatcatgttgtcaactggaaccattggcttccttatgtcattttactttgtgcactacttgttctcatcagtaaagatagattga

SEQ ID NO: 32099 - DNA, 2832 bp, Glycine max
  Peptide Sequence Number=SeqID_148877
atggatctggaggtggtagggcggcacgcgatgctgttcgacgacgacggcatggcggcgttcgtgaactcagcggaagctctggtcgaatggaactctctctccatcgaccgctacgatgtccgccaccttctctccgctcccctccctccgcgcctcaagcgccgccctcctccgcctgaacccgacctcgatcaacaacgttatctcgatctcccttcatcttctcctgacgacgaacaaccacaagatgatggttcaaatccattgagttcaaccggctttcatgctgttgccttttcatatggaaattccagtgtttccacggagacaaaggacaatgataccgagcctagttttcatcctaatttcccagtacctgaaagcctactcagtaacctgcctccaaatgagagagtacatcagattatttcaaggactgcaacatttgtcagcaaacatggaagccaatcagaaatcatcctgagggtgaaacaaggagacaatccaacttttggattcctaatgcctgatcatcatcttcatgcgtattttaggtttcttgttgatcaccaagaacttctgaaagttgacaaagatgatggaagctcaactgaggacatgaataggactctggggcttgatcaaacaggtggtgcattgtctttgcttggatccgtctatggatctggagaggatgaggatgctacaactgagaatacttgtgatgttgagaaaaaagaatgtgagggagctgttgacgctgttagtacttatacttctcctggaatagatcaggcagaatcttattcagatgtggccaagaaggatggaagcatttctaaaaatctgataccctctttgaaagaaaaagttcctgtcataaagcggaatcattctatcagtactgttaagactgcaaccacagctggagcaaaaggtgatggcttggattcagtatctaatgcacagaacaagttgcagacttctgtgcggagtactgctaagattgaactcccagttgttgaacctccatctgatttaaagagaactatagagaagatagttgagttcatcttaaaaaatggaaaacaatttgaggctgttcttgcagaacaggatcgacctcatggaaggttcccgtttcttctgccatctaatcaataccatacttactatctgaaagttcttcaaactgctgaagagggattttgtgcaccttgtgtattccatggattatttgggactgatgaaggtattgttaattttgactttgagatgctacttactgatcttcctaattgtttacagtttaagttactaggcaagggccaccagaagcacaatccagcaggtcatacaggtgacaataatactgctgtaaatgatgatagtgacaatctttcacatggatctatggcttctgatctaccacatgacatggaccaaaaagaaaagttcaagatgattattggcaagtcaaagaagtttggtcaagatccaattcctaaagaccaagctcaaaacacaattagcatggatgcggcagcaacagcagctattcttcaggctgccactaggggtattaaaaaccccaatttggaagttattaccaaggcatcaagtggtagtggtcaaggccttggaagtgatggtgggtatttgtccagctctgggactggtagtctgtattcatttcgaccacaaggttttgttggaaatcaaaacctgaatgtaaaggctagtgcttctgcccccgttgccaaggctattgcagaaaaagtagctattgcagcagcaggtgaggcagattcctctgaagcacacatgactaaagagcaaaagcttaaggcagagagattgaaacgagcaaagatgtttgcagccatgctaaaaagtggtgttggagcaagtgaacttccacgagcattatcagttgagccaccaggctctggagtttcaggttcagatgctgagaccgggaatcttgtgggtaaagaaagggaaggaagttctgttccatatgatgttgataattcagctaaaagtcaaaagtctgaggagaaactttctactgatattaattcagataaaagtcggaaatctgaggagaaacttattgttgatgataatgaacgccggtcaaaaaggaagtaccgttcaagatctggtagacatgaagaggatgaagaaatggaggaggaagaagaaaacaaagaagatagaagggatcataaacgatccagaaaaaaacatcgctcttcacaccagagtcaggacaggcataagcacaagagaaaacattcctcctccaaagacaagtattcttccagggggaccaagcatgattgctcctcctctgatgatgaacatcatcgctcaaggcatcatcgtcataaatatgatggctcctctgatgatgaacaacatcatcgctcaaggcatcgtcgtcataaatatgatggctcctctgatgaaaagcaccacccttccaaacgacgacacagagatgatagcttgtcagaccatgagcatagacattctcaccattctaataaagattatagttcatctgatgatgagcataggcatcgaagcagaaatgtaaggcttaagagcagatctcgtgctgaaagagaaacagagctggaggagggggagataattttgaaatcggaaaagtcagtagtaagtggtgaagttggacgtgctagtagggaggcttctgagggattatctaatgcaagggtaccatctcaatcacctgaaataactgatgtttctgatgagcttagagccaaaattcgaatattaaaatcatgtagatcataa

SEQ ID NO: 32100 - DNA, 1089 bp, Glycine max
  Peptide Sequence Number=SeqID_148878
atgtgcgaagccgtagaaattgaagaaaggcccaaatacaaagatatcagacgctattactgcgagtactgcggtatctgcagatccaaaaaaacccttatcacctcccacatcaatttgcaccacaaggaagagtatgaaaaagcaagagctgaaagagatcccgaagcagaggcttcgaaatcgaacagttgcgaggaatgtggtgccactttcaaaaaacacgcctatttgttgcagcacatgcaaagtcattcacttgagaggccatttgtgtgtgctgtcgatgattgtcaggcaagttacagaagaaaggaccacctgactcggcaccttctacagcatgaagggaagatttttaagtgccctgttgagaattgcaacagtgagttctctttgcaaagcaatatgaaaagacatactgaggagattcatgatgacagttctaccactaccagtagtgacaaaagtcacaaacagcatatgtgtccagagattggctgtggaaaggtttttagatatgcatcacagctacaaaaacatgaagattctcatgttaatttggaatcagtagatatggtgtgcttagagcctggttgcttgaaacatttcactaatgtccagtgccttcaagcccatgtgaagtcctcccatcagtatatgacctgtgacatttgcgggacaaagcaactgaagaagaatattaagcgccatcttcgatcacatgaagctgaaggcagttcatcagagacctttcaatgcgagtttaagggttgcagctgcacattctcaagaaaatctaatctagacaagcataagaaggctgtgcactttaatgtaaagccttttgcgtgtgggtttactgattgtggcatgagatttgcttacaaacatgtgcgagataatcatgaaaaaactgctaaacatgtttttacccttggggattttgaagaagctgatgaagagttcaggtcaaggccgaggggaggaaggaagagaacatgtcccactgttgaaatgttaattaggaagagggttaccccacctagtcaattggaacattggttatttatgcaggatagtgagtag

SEQ ID NO: 32101 - DNA, 174 bp, Glycine max
  Peptide Sequence Number=SeqID_148879
atgggggtaatgagaagagtggtgtttgacgaggaagttggtggtggcgcaaatttcgaacaagtcataggtatgagggttcttgggaagcatgtgcaaagggaggtgagggagttgaagcttgagatggaggtgtggaggtgtcggagaagaggcacactggagccgttgtag

SEQ ID NO: 32102 - DNA, 720 bp, Glycine max
  Peptide Sequence Number=SeqID_148880
atggccaatttgccccaatccttctccttaagcggcgcctcgtttggagctccttcttcttcttcttctgccaccaccaaggatccaaggacgatggcgtctgtggaaaacctcgttctccaactcagcaaccccgatctccgagaaaacgctctccatgaactctccaagaagagggagttatttcaggatcttgctccgttattgtggaattctcttggcaccatggcagcacttttacaggaaatagtttcaatttaccctgctatttcacctccaaaccttactccagcacaatcaaatcgagtgtgcaatgctcttgctcttcttcagtgtgtggcatctcaccttgatacaaggatgccattcctcaatggtaatgatttttttcttattcatctgaaggacgctcatatacctctatatctgtatcccttccttaatacaaccagtaagtccagaccatttgagtatttgaggcttaccactcttggagtcattggtgccttagtgaagatcttcaactatctgttaagtttcaaatacaatcctgtaacaactttctatgacgtaacagtgctacataggaggtgcataccatttatctggttaatgggattaccactgaggagagtggtcttggcacaagacaaatggactgttgaaactcttcttgacatatttggttgtagaggagtgctagcaacactctccttctaa

SEQ ID NO: 32103 - DNA, 1032 bp, Glycine max
  Peptide Sequence Number=SeqID_148881
atgtgcgaagccgtagaattgaagaaaggcccaaatacaaagatatcagacgctattactgcgagtactgcggaagagtatgaaaaagcaagagctaaaagagatcccgaagcagaggcttcgaaatcgaacacttgcgaggaatgtggtgccactttcaaaaaacacgcctatttgttgcagcacatgcaaagtcattcacttgagaggccatttgtgtgtgctgtcgatgattgtcaggcaagttacagaagaaaggaccacctgactcagcaccttctacagcatgaagggaagatttttaagtgccctgttgagaattgcaacagtgagttctctttgcaaagcaatatgaaaagacatactgaggagattcatgatgacagttctaccactaccagtagtgacaaaagtcacaaacagcatatgtgtccagagattggctgtggaaaggtttttagatatgcatcacagctacaaaaacatgaagattctcatgttaatttggaatcagtagatatggtgtgcttagagcctggttgcttgaaacatttccctaatgtccagtgccttcaagcccatgtgaagtcctcccatcagtatatgacctgtgacatttgcgggacaaagcaactgaagaagaatattaaacgtcatcttcgatcacatgaagctgaaggcagttcatcagagacctttcaatgcgagtttaagggttgcagctgcacattctcaagaaaatctaatctagacaagcataagaaggctgtgcacttaaatgtaaagccttttgcttgtgggtttcctgattgtggcatgagatttgcttacaaacatgtgcgagataatcatgaaaaaactgctaaacatgtttttacccttggggattttgaagaagctgatgaagagttcaggtcaaggccaaggggaggaaggaagagaacatgtcccactgttgaagtgttaattaggaagagggttaccccacctagtcaattggagcattggttatttatgcaggatagtgagtag

SEQ ID NO: 32104 - DNA, 432 bp, Glycine max
  Peptide Sequence Number=SeqID_148882
atgaacagattcaacaaatctgaacttctagtgctctttgtccttcctctctcaggcctacctacctttacttcatctttaacgttctcatcattgcacttggaaccgaagctgctcttctcacagattttgctaagcctttctgtcacacagaaacctctaattcccccagaactgtatgaacctgaggaaagggtggaagtagaagcctcagaacatgatgaaaagaagcctaaggttgttgcaaagtctgcttctgatgagaacattgttggtcacactgaggtgaaaaagtgtccttcaatcccaaatcttttgctcatagggtgtggagaaagtgaaggagatgtgattgaagcagaagatgaggctaggggagttaatgggcaagagttgtttgcaaaagctgaggccttcattgggaacttctag

SEQ ID NO: 32105 - DNA, 186 bp, Glycine max
  Peptide Sequence Number=SeqID_148883
atggctcacagcattgaaaaggaatcaggcctctctcatgaaaagaaatttgtctgtgccgttcagattccaactgctgatggtattcttcaaatgtcaggagatgaaaaatctcgggtgggatttgatcaaggaggtttcaatgggtgtagactgagaagattctttgattggtcaacggaatga

SEQ ID NO: 32106 - DNA, 723 bp, Glycine max
  Peptide Sequence Number=SeqID_148884
atgatacaacttttattcatacttttgatgatccaaatagcattcatcttgatattatcttttgcaaatccaatacgaaaattggtggtgatagggctcgaccttttgaagcaggggaggggccccttagtcacaaaaactgtggcagcaactatgtgtgtggtcttgagctccaccgtgtatactataaccaaaatccaaaaacgttcaaaggatgctagcatagttaatccaactgatgaggtgttgatggcacatcgtctcttggaagcagctttcttgggattctctctgttccttggattggttatcgacagacaacattattatattagagagattaatttactaaggaagaacctggaaacatggaaaaaacgaaatcacaatcatgactccttaaagagaagagtggaaactgagaagccaaatcccaaaggtcgagctcaagtaagcggaaatggctgcggtgactttgctggaggcaccggagggaacaccggagggaacaatggtgatggtgatactgatactggtggtcgcagtgacggtgacacaggccgtgatggcgacacgggcgacactggtggtggtgatggcactgcttgctcaaaggcacacgatccaaatacgcataacctcccaaaggggcatactcttccacacctaccacagttgaaaaggttcaaatttgtgtttaagcacaaacggttgcagcattga

SEQ ID NO: 32107 - DNA, 336 bp, Glycine max
  Peptide Sequence Number=SeqID_148885
atgaagtgcctccagctccaatcttcactgcttcccttgcatgcaaaactcaaacctcagccaaatcatacaagccacaccagccaaatcatacgtgcccagcatttccctttagcaagtgatccattaactaccaaggcacttccacattcaatggttgttgccccagcccaatccggtgacttatccacctttctcccaataagtgctgtgcttctatcggcatacttcatagcaaattttgtcgtgccaggttttcttaccaactctttcggatacgataagtcaaacgaagagcagaaggttgacgattcaaatgaaatagaagatgaatag

SEQ ID NO: 32108 - DNA, 582 bp, Glycine max
  Peptide Sequence Number=SeqID_148886
atgtttttgagtcgagtagtctgccacaacacacagtcgcacacagcgcaggaatataagcagagtaaacgtaatgtggaagagaggcttggtcggcgccgtgggtggtctccggcggccatattcgtcaggaggtggcggcatctcctcctccgtgaactcaatgctcctccgctccctaaaggatcactatcaagaagtcgccaaaatgaacatgccccctggtttagacatcgaatgaatgagtcacgtgccttacagaaagtgagtgctccatcgccgttcacgatcgtgaagggagctctggactcgcacggtccggttctgaagcgcagctacggcaacgaagaggtgagcatctacgtgatgcggttgttgacccccgaggacgaggattccgccatcgaccagctcttcatccacgtcgatgtctccaaacctcagcagaacgaatccttgattttcctctgcggtttgtacgaggatgctcttgggattcactctgtttccatgaggcctaaggtccaggactccggctacctcctcatcccctcccaatacaccggccctgttttcgcgtga

SEQ ID NO: 32109 - DNA, 645 bp, Glycine max
  Peptide Sequence Number=SeqID_148887
atggagagggcgatcgccagagacttgttttcacgtatactgttgttccgaacccatttgataaaggtggcaacttttgcagctgaactggactgctttttgtcaatggcattggttgcacggcagcacaattatgtcaggccttcattgactgaagaaaatttgcttgatataaaaaatggaaggcatgttttgcaggaaatgactgtagacacatttattcctaatgacactaggattcttcatgatggaagaattaatatcatcactggtcctaatttttctggaaaaagtatctatataaagcaggattttgatcatactgttttaaatagcaattatgttgaaaaggttgctataattgtttttctctcccacattggcagttttgtgccagctgattctgcaactgtgggtctgacagatagaatattttgtgcaacaggaagcaggcttatgacagctgaacaatcaacatttatgattgatctacatcaaatagggatgatgctcaggcatgctacttcgcgttctctgtgtctggtggatgaatttggtaaaggcactcttacagaagatggaattggtctacttgctgggaccataaatcactttgtcacaactgatgaacctccaaaggtttaa

SEQ ID NO: 32110 - DNA, 709 bp, Glycine max
  Peptide Sequence Number=SeqID_148888
atggaggagcagacttttgtttccaaagcgagaaccgcctttcattccgcggcggcgaaagcggagcgtgttctcttggatttcaaatccgatcgagcattgactcaatttgttgaccgtcgtgaagaagatcacgataagcaatcgtcgccaaacaccttcaccggccaacaaccagaagctgaatctcctcacaccaacgaaaacgattccaagcttcgtagtgaattgaagcatataaagtggaggcctccacatttaggaataaagcaggattggcaggatagaataaagaacatccgtagagggagaaaagaagttgaagatacagataaagttggggatgcaagcatggcagttccattttatgacgataatttgtacctcctgaacatgaagaatgatcttgaggccaaggcttcagaagcaattccctcagttgaaagcttaactgctgcaactaaagatcccattcctccatcatctgtgctaaagcaattggctatagctgttgaggctggaagtaaggcaaagtcaatgaaagatttaatagcttcatcaggagtttcttcacctgctagagagagggcaggcttaagtttctcggcagttaaggctttagtgctacgtgaaaaggaggacaaacttacatctgagtttactagcaatgagaaagttgtgcagttaattaattctctgtttgatccag

SEQ ID NO: 32111 - DNA, 192 bp, Glycine max
  Peptide Sequence Number=SeqID_148889
atggagttgaaggaactagatgaaaagatgagagatgcgtttcacagttacattgaggaacgaggagtgaacgagagcctctttaaatttcttcaagcgtggctatatgtgaaggaacatcgaaatctgatgcggtggttcaaaaccatgggcttgttcgttgatggaaagaagccagttacaggtgcttaa

SEQ ID NO: 32112 - DNA, 315 bp, Glycine max
  Peptide Sequence Number=SeqID_148890
atgactacggacaaaagtagagggccgtccttatcctctggaagaacggtttactttaagataatgtatagtgagccaatctctcatgcatatgcgtggcccttacccgtcaagcccgcaccgctcagaatgcccactccccaccccaactgggcctccttgcaggccgacattgaagcccacctcaaacaaaccattcccatcaatgaagccctcgaggttttcgagctagctcatgcaccacctccccttggcacgtgcggtgggattgcaacacgcgcagtacacgaaaagaacgttgttgttggagagtga

SEQ ID NO: 32113 - DNA, 735 bp, Glycine max
  Peptide Sequence Number=SeqID_148891
ggaatgggtagtggaggtggaaaaagagaattcaccgtggttcgtaactttcttgcagcaaaagaaaagcacctgcaacgtcctgaatgtttttcttttctttccacggatgaaggcttgtccatcaaaacgggtgagaagatcagtctcaaaagaaaagccgaaaataattataacccgtcaaagagagtcaaaagcaaggaaggggctagttcttggcaagatggtaaatcaaagtttgaatatctactagatgcagtggccttttttactgcatatgaagaggattacctacaaaaaagaatagatgaacttgatggattgccaagggaatttcaagaaaagatccaagaattgaatggatgcgaggtgaagtttgtgacgcagaagaaacttttcaaaacagacttgaacccacagcacgctcgcttgtcgatcccacccgcaaagattgccaacagatttctgacaccaaccgaggagtcttccttaaacgagcgccgaggtaaacacaaaaggctttctggcatgccggtgatggtgttggatccgtctctgagagagtacaacatgtgcttcaagaagtgggaaatgacgaaaagctatgtctacaacttgaccatgggatggaaccagattgtgggtgacaatcatctcaaacttggtgatacactgcacctctggtccttcagactctcttctcagctctgtttcgcactagtcaagggatcatga

SEQ ID NO: 32114 - DNA, 1742 bp, Glycine max
  Peptide Sequence Number=SeqID_148892
atggcgcagcttccctgcgactccgatggcgtctgcatgctctgcaaacagaaacccagtccctcccaaaccctctcctgtagaacatgtgctactccctggcacctttcgtgtctcccttcggcccctctctccctctccgactcacattgggactgccccgactgttccgacacctccaaccattaccccgtcgctcccaccgccgaccttgtctccgccgttcatgccattcaggccgacacctctctcactgaccaggagaaggcaaagaaacgtcaagaactcctcgctggctcttccgactcctcaaaggacaaagccaaaaccaaagacatttttgacggaagcttaaattgctccatatgcatgcagttaccggagaggcccgtcacgacaccttgtgggcacaacttgtgtttgagatgtttcgagaagtgggtcggacaggggaagcgcacctgtgccaattgccgtgctcaaatcccggcgaagatggcgagtcagccgaggatcaactctcagctggcaatggccatccgattggcgaaggcggccaagtcgggagaagggtcctcgggcccacccaaggtgtaccactttgtccgcaaccaggaccgccccgataccgcattcaccacagagcgagccaagaagactgggaaagccaatgcttgcagtggtaagatttttgtgactgttcctcctgaccattttggtcccatcccgtctgaaaacgaccccatcaggaaccgcggtgttcttgttggtgacacgtgggaggacaggatggagtgtcgccagtggggtgctcatttgcctcatgttgccggcattgctggacagagtggctatggttcccagtctgttgccctttctggtggttacgaggatgacgaggatcacggtgagtggttcctttacactggcagtggtggcagagatctcagtggtaacaaacgaaccaacaagcttcaatcctttgaccagaagtttgaaaacatgaacgaggccttgagagtcagctgcaggaagggttatcccgttcgggttgtaaggtcgcacaaggaaaagcgttcttcttatgcaccggagtctggagtgcgttacgatggagtttatagaatagagaaatgctggcgcaaaaatggaacacaagcctgcaaatggatttttgctccaaactctttggttcatggagaagctctgtactgtgacagggttgcaagctcttttggtgtgtgtgcttatgtgttgttgacgtgcagtgatgaaattggagatcgcccacgcccactgcctaaaattgatgagttgaagggtgcggttgatataactgaaaggaagggtgatccatcgtgggattttgataagcctccaccagaaagcaagaaatcagtggacattaaagctgaagatggaacaacaatcagagttaaacggaaagcaaaaaatgtgtccgtgaaagaaaggctattgaaagagtttggttgccaaatatgtcgcaaggcgatggcttcccctcttactacaccttgtgctcacaacttctgcaaagcctgtttggagggtgccttttctggccaaagtttcatcagaaatagggcatgtggaggtggacgcactttacgagcgcagaagaattttatgaaatgcccatcatgttcaactgacattgctgactttctccagaatccacaggtactgcggaatgccgttattgggttttattcttgcaccaa

SEQ ID NO: 32115 - DNA, 1587 bp, Glycine max
  Peptide Sequence Number=SeqID_148893
atgggttgttgtatgagtaaaaaagggtcagagccagaagaacacattgtttacagacatgttgctggtgctgggggtgctggtgtgtacaataatcacaagagccatgaacccccttctcatcaaccttacccattacctgagaagcatgccccttggaggcctccaccaagcccaaaacatgttcacaagcatgacacaatcactgggaagccatttgaggatgttaaacagcactacacacttgggaaggaattggggagaggccaattcggggtgacttatctctgcactgagaattcaactggttttcagtatgcctgcaagtccatttcaaagaggaagcttgtgagcagagacgacaaggaggacatgaagagggagattcaaatcatgcagcatttgagtggacaatccaacattgtggagttcaaaggtgcttttgaggataagcaatcagttcatgtggttatggagctgtgtgctggtggtgaactttttgacaggattattgccaagggccactacagtgaaagggctgctgcttcaatatgtaggcaggttgttaaggttgttaacacctgccattttatgggtgtcattcatagggatctcaagccagagaatttcttgctatctagtaaggatgacaagggacttctcaaggccacggattttggcttgtcagtcttcattgaagaaggaaaggtgtatcgagatatagttggcagtgcttactatgttgctccagaagttctacgtcgtagctatgggaaggaagcagatatatggagtgcaggagttatattgtatatcttacttagtggtgtacctccattttgggcagagacggaaaagggaatatttgatgtcatattgcaaggtcatattgattttgaaagtagtccatggccaagcatatcaaacagtgctaaggaccttgttcgcaaaatgcttataaaggatccaaagaaacgcattactgctgctcaggttctagagcacccatggcttaaagaaggtggaaatgcttctgacaagccaatagacagtgcagtgctttccagaatgaagcaattcagagcaatgaataaactaaaaaaactagccctcaaggtcattgctgaaaatctttctgaagaagagatccaaggcttgaaggcaatgttcacaaatatcgacactgacaatagtggtacaatcacatatgaggaactgagggcaggattgcaaagacttggctcaaagcttactgaagctgaagtgcagcagcttatggatgctgctgatgtagatggaaatggcacaattgactacatagaattcatcactgctacaatgcatagacacaggttagaaagagatgagcaccttcacaaggccttccaatattttgacaaagatggcagcgggtatatcacaagagatgaactagaaacagccatgaaggagtatggtatgggcaacgaggccacaatcagggaaattatatctgaagttgacacagataatgatggtagaatcaactatgatgaattttgtacaatgatgaggagtggaacccaacaacaaggcaagctattctaa

SEQ ID NO: 32116 - DNA, 198 bp, Glycine max
  Peptide Sequence Number=SeqID_148894
atgtgtcgtggagcattatgtttgcttgacaatgacagacattggtggagaaggatattcaatgcagcgagtagcagtagtctttctgtgaaagattattttactctcaattgtgatgatgccttatatattaaaatcttcgtgtggaacagtgctgagaaaggagaatgtgaggaaggaggatttcctttcatgtaa

SEQ ID NO: 32117 - DNA, 351 bp, Glycine max
  Peptide Sequence Number=SeqID_148895
atggaagagtactgggagaccaatgactgtaagaatagacgttgtttggcgacgacacaagttgcagcgcaatgtccaacaacgatgcgaaagatcccccacaaagcccacaaaataccattatttgctcacccacaaagttcagatgggatcatagatcccattggcgatgtggatctagatctcacatctcgacttcaacacttcatcaagcaaatctccgttgagcattgttttttctacgttgatctaatgcttgctatcacacaaaatgaaatattggttgtgggcagtggtttatgccctgatggcagtatggatctcgatatgtctctccctcacactctctag

SEQ ID NO: 32118 - DNA, 501 bp, Glycine max
  Peptide Sequence Number=SeqID_148896
atggcgtcgtggtgcggtgctcggagcttccagattccggcgatggaagacagcgcactgcgcaaccgtgcttcattggccgccggagtagggtgtttgtcggtggccggcacctccttctggcgctcctcttcgtcaccgaagcgctctttgccattcacatgcttgagcatttcttccgatactcgtattaaggaaagtgttcaaactgaaggtgcacctgcggctttgggaccatattctcaagcaatcaaatccaacaaccttatttttgtgtctggtgttcttggccttgttcccgagacagggaagttcgtatctgatgatgttgaagaccaaactgaacagcttcttaaaaacatgggggaaattcttaaagccggtggtgctagctactcgtccgttgttaagacaacaattatgttggctgacttgaaggactttaagaaggtcaatgagatctatgctaaatgtgaagcttgcaataacttgtttaggtga

SEQ ID NO: 32119 - DNA, 735 bp, Glycine max
  Peptide Sequence Number=SeqID_148897
atggaaggtgttattctgagaagggtcattccttcggataacagttgcctcttcaatgcagttggatatgttatggatcatgacaaaaagaaagctgctgagttgagacagggcaaaatgatgccatgtaaacactccattgtggcctatggtgctgtcataggaggtggccatattaacaaattgcctacggtggttatagcagcaacagtagcaagtgatccacagaaatattgtgaagcatttcttgggaagccaaacgctgagtattgtaactggattcttgactcggagaagtggggagttgatgaatttgacttgggtttcaaagggtatttcaaagttcaaactcccagtgcaattgaactttcaatattagcagattattatggacgtgaaattgcagcatatgatatccaaacaactcgatgtgatttgtatggtcaggaaagtaactattctgaaagagtgatgctgatttatgatggtctccactacgatgcattagtggagtttgatcagaccatatttgctgtacagaaaaacagaagcattggacctgttgaggggcttgctctaacttttgtgaaggaccagcagaggaaacggagttacactgacacatccaacttcactctccgctgtggggtatgccaaattggagtaattggtgagaaggaggcagtggagcatgcacaagcaactggtcatgttaacttccaagagtacagataa

SEQ ID NO: 32120 - DNA, 480 bp, Glycine max
  Peptide Sequence Number=SeqID_148898
atggcaaaagcaaaggcaagtagaggcgccagtggaagtggaagcgtcggctccaatgtgatccctcaaagggacccacacttgccacctatgaaatcctacgtggcactacttaggtttttcattttcctatttatatcggtaatatcatatctcccacctagtttccatcttttctctctacgattcatcgcaattcacaaaatgggcaattgcttgaggcgccaatcgcggatcggatactccaccgacgacgatgaggactgggaggattttcgggcggcggcggcggcaagcggtggtgttaagaaatcgacgagagaggtgaaaattaagataacgaagaagcagttggtggagttggttggtaaagttgaggtaaaggagttgagaatggaacaggttttggcacacttgatgaatcactctcttcaacgtccatggaggcctgctcttcaaagcattccagaagatcattaa

SEQ ID NO: 32121 - DNA, 1470 bp, Glycine max
  Peptide Sequence Number=SeqID_148899
atggaaaacttcgaagtaccctcattttccctaggtctcgacgaaacgcccccccattcccccatccatccatctccttctcccgccgacctacacgtctctgactccgatcccgaatcccgaccctacccgccgcgccccctcctcaaacgcttccgccgcgacctcccgccgccgtgcctcgacgccgacgacgacatcgaggagttctcctcgcaagaagatcccgatcaagggcatgcgtttccgtcggcatggaatcggaatcattctgtgtgtagcagttcgaaagtttcgttgaatggtagcggagttttgacccctcattcgtgtagcaactcttcttctagggataggaaaagaaaggaactttccaatgatgttccggcttcttctaggttagagacacggaagagtggcttgatgtttcccaagttaaacactagtcctctccgaaggtttcaattgattgattccgactccgatgatgctgatgttgatgttggtgccgataaagttaaccctaacagtcatttggaacaagataagaaaactttggttgatttgaatggaaatgaggatctgtggaaggatttttcgccagtcaagaatgtttatgttaataggtttcaattgctttcggattctgatgatttggatgttgatgttggtgctgccaacaaagctaaccttgacagtaatttagaaaaaaataagaaaacattgcttgatgaggatctatggaaggatttttcgccagtgaagaatgtttctgtcccaactccggccttcaatgagatgtgtgaagagtactttcgttctgcctattgcaaggaagtgggtggtggtgatgtgtctaaaagttttaatgagaggaatcctggggttagctctagctgccagagggatcaacagcaacaggaatcaacggaccctgttcatcctgctcatagttattttttccatgaggatccgagaattcggcggttagtttgcagtcgcctgcagaattttaatccactaggtaccatcaacacagtgaatcagcaacctaatgtctcacacattgattacatgaggcaatttggcaatggaggagcttcaaacatgcagggagttcaaaatggtcgtgttagcaactcaacaaggggaaaaaataaatccagcaatttgaatgttgagggatattttgatgcttctggaggctggatggatcccaaatttgtttctccattcagccacgggaaatcttctagaaagaaagcaacaaagaggaatagcactaagaatagtgtctcaaaaagtaataataaaacaaacaaatcaaacccttcaaaccaatcatctgagggctgggtggaacccaggagctgcaccagtttgccaaaggatgcgggcaaaaggcgtgttcaagcaagtggtcaatctgctggtcattggtttacatcaccagaagggagaaaggcatga

SEQ ID NO: 32122 - DNA, 2076 bp, Glycine max
  Peptide Sequence Number=SeqID_148900
atgaagtattccggcaaggggagtttaccggcgggcattgcttcgaggagcgtgaacaacaacccttcgccggactcagatcttgaaccggcgaagccctttcagaggtggaaaccgagaactccggggacacggttgaggagacacggtggcaaacggagcagacccgaaacccctcttttgaagtggaagatccatgacgatccactcgaagacgaccggaagtcttccgtcgcggggtcccgtcggagaacgtgccggagcgccaagaagcaagccgaagtcgccgtgtcggcgaggagactcgccgccgggctgtggaggttgcatctgccggaaacagccgccaatgatgaccggaaggggttggaacataagcatggaattggtcacgcagggctccagttccttggtcatcctaatggcatgacccatggttctgatatgaagaagaatccatctcaaagtccccgttccatatttggaacaaagaatggtcacttctgtgagcctgaatgtttccagttttccaacaatgaaatggagggtgcaacaaaatgggatcctttatgttcaaaaactgcagatgaagctcagcatatttacagccacatgaaacatgttgaccaaaaggcgagtgctgtatctgttatatctgctctcggagctgaacttgagcaggctcgaacacgaattcaggaacttgagactgaacaccactcctccaaaaagaagcttgagcatttcctgaagaaagtcagtgaggaaagggcccaatggaaaagcaaagagcatgagaaaatccgtgcatacattgatgacattaaagcagagttaaatcaagaaaggaaaaatcgccagaggattgaaattgtcaattcgaggttggttaatgagttagcagatgtcaaactctctgcaaagcgctacatgctggattatgagaaggaaaggaaggccagagaattgatcgaggaagtgtgtgatgagcttgccaaggaaattggagaagacaaggctgaagttgaagcattgaagagggaatctatgaaattcagggaagaagtggaagaggagaggaagatgttacagatggcagaagtatggcgtgaagaacgagttcaaatgaaattgatagatgcaaaagttgctcttgaagagaagtattcacagatgaataaacttgttgcagagttggaaagttttatcaggtcaaaaagtgcagagccaaacacaatggagatgaaagaggcacagtcacttcaacaggctgctgctgcaatgaacattcaagacattaagggattttcatatgaaccccctaactctgatgacatttttgccatttttgaagatgcaaattttggggaagcaaatgagagggagattgaaccatgtgtttctcatagtcctgctagtcttgcctcaaatattcacatggtgagtcctgaagccaatgcaataagtaaaggtggcattcagaggcattctgatgtatttttggatgataatggggatatagaaggagatgaaagcggatgggaaactgtgagccatgtcgaggatcaaggctcgagttattcaccagaagggagtacccgatctttgaacaggaatcatcgagagagtaacgtttcagggagaagtgtacttgaatgggaagaaactgcaggtgaggagacaccaataactgaaataagtgaagtgtgctctataccaactaagcaagcaaagaaggtatcatccataaccaggctttggaggtcaacatacccaaacaatggggataattacaagataatctctgtggagggaatgaatgggagactttcaaatggaatgttatctaatggtggcatcatgtctcctgatcatggatcaggtaaaggtgggctgagtccccaagaccttctataccagttgagtcccgaatcaggaagtcctcatgcacatcgaggcatgaagggatgcattcctcgcactgtgcagaagaatagtttgaaagccagacttatggaggcgagaatggaaagccagaaggttcagttgcgccatgttcttaaacagaagatttag

SEQ ID NO: 32123 - DNA, 3194 bp, Glycine max
  Peptide Sequence Number=SeqID_148901
ttgtggagatagagatacagatcaagctaatgattttatctttattcaaaggaattgggaatgcccttatgcacattccagaagttgggccattgttgtcctcttttctggagcagtactatgatgagctcaataagtcttgtccaaaattgtcaaacactgaaactcagatagtgtgccttttgctggagagctgtgttatgtcatctccctctggtggaaatgatcttcaaaatcttttactgaaagctttgcggttgggtgccatgacttcggatgaccctgcctgtgtaaagccttgcatcactgtcttgaacaaacttaacagtcaattctatatggagttgaagaatgaagtaaaggagggtttattttgtgagctcgtgtttttgtggcataatgataatggtgatgtacaacgtgcaactaaagaggcattaatgcgcatcgatattagtttctcaactgttggccacatgcttgatcttatacttgcacagaagagttgtataagtagttcagcagaagaaaagatggtgaagaaacaaaaattcataggacatcaagaagcaggatatcctcctaatgacatatccagaagagataatccagtctacatccttagttcccttcttgatgttttgctactgaagaaggacataacaaacaggcatttacttttagggcccttatttaagcttcttagcaaggtgttttcaggtgaatgggtgaatggtgcctattccccgtgtgcccggaaatcccccgttgcagtcacccgcaaccatgtattttctgtactttctgctgttaccagagtctttccaggcgaagttttggagcatatgcttgatattctagaagttattggacaagcagctgtcacacaggatgtgctttttatagttgttaagatgaaatctaacacggtatcaaagcctactgccatttctgtcgtttccaagtttcctttgtgcatcacttggtcagccggcatccgtggagtgggagggggtgttgaaagtcctacatcaccaatagaaattgacagtcattcaaagcatgtttttgaggatcttatatctgcaattgttccgtgttggctggctaagacagatgatgtggagaaattactaatgattttcatggatatattgcctgaaatcgttgagcacagaaggctgtcatttgtgttatatctattaagaactttgggtgagggtaaaagcttagcctcattgcttatcctacttttgcgttcattaatttcaaggaaagctgcctgtttccttaatgtcaagacacgagatgatttaacattttatactggggaatgggaatataaatttgcagtgcaaatttgtgaacaatatacgagtatgatttggcttccttctttagtcatgctgcttgagcagaggggaaatagtgatgttgaccaggcactgtttctggaattgtttattgtaatgcaattttccttgcaaaagttgcaagatccagaatttgtgtttaagttggaatcaggagaagatactgcagtcattcaggctcttgggctgttatgtgaggttgcaagaaatcacaaaaatgtcagcttaaagcttaaaggcaataaaggttcaaggtcaactccaagttttcttttgcttcatatgaatgaaacttctcaagaatcacttaataaattgtgtttagaaattattcgagtacttgatgattcatcaaatacctccttgaaagtggcagcagtttcagcattagaagttctagctgaaagatttccttctaataattccatctttagtctgtgccttggatctgttacaagacatattgtgtctcataacttggctgtgacttctagctgcctcagaacaactgctgccctgatcaatgttctaggtccaaaatcactggcagaacttcccaagattatggacaatgtgatgaagtcatctcgtcgagtattggctagtttggataagaaacccgaaaccaccgatgttttatcagcctcaaatgaatcccatttttatgttctcatcactttggaggcagtcgtggacaagcttggtggatttttaaatccatatctcacaaatatcatggagcttctggtgctttatcctgaatatgtttcaggagtagatgcaaaagtggagtctagagctcatggagtacgaaagcttcttgctgaaaaaattcctgttcgacttgccctgccacctttgttaaaattatacccagctgccattgaggctggggataaaagcttaacaattgtatttgatatgttgggaaccataattggtacaatggacagatcatctattgtggcattccatggaaaggtatttgacctttgtttggttgctcttgatctgcgccgtcaaagtcctccttcagttcaaaacattgatgtagtggaaaaagctgtgcttaacacaatgactgttctgaccctaaaacttactgagagcatgttcaagcctcttctcataaagagtattgagtgggcagaatctgaagtggatgaaactgcctctagcggaagcattgatagggtcatatcgttctatggcatggtaaataagcttacagagagccatcggtcattgtttgttccttacttcaaacacttgcttggtagttgtgttcatcatcttagtgaaggtggagatgtgaaagtgtctagagtgaatcagaagaaaaaggccaggattctggatgatggcaatataaaagaaataggcagtgtgtctatcaatgcctggcatctcagggcactaatgttgttgagacctattgtttcacaacttgttgtagatccaccagcactgttggatgacagcattaatataccaagtgtgaaggaagttgatgacctactggttgtatgcattggtcaaatggcagtgactgctggatcagaccttttgtggaaacctttgaatcatgaggttttgatgcagacacggagtgaaaaattgcgagctaaaatattgggcctcagaattgttaaatattttgtggagaacttgaaagaagaatatctagtgttcatagctgaaacaatccccttcctcggtgaactgcttgaggatgtggagctttcagttaaatctcttgctcaggaaattctgcaggaaatggaatctctgagtggagaaagccttcgccaatacctatga

SEQ ID NO: 32124 - DNA, 2124 bp, Glycine max
  Peptide Sequence Number=SeqID_148902
atgtcgcttccgcctctccccaaaaactcccccgttggccgcctcgacgacgacgacacctactcgcgctacgccggcgcgtcgaggttcgagcaattcccgctttccaagaaaacaaaggacgccctgcgagaatccaagttcgtggtcatgaccgacatccagagagcgtctctcccccacgcgctctgtggccgcgacatcctcggcgccgccaaaactggctccggtaaaaccctcgctttcattatccctgtgttggagaagttgcatagagagagatggggacctgaagatggggttggcagcatcatcatatctcctacgagagaattggctgctcagctgtttgatgtgttgaaggttgttggcaaacaccataattttagtgctggccttctcattggtggtcgaaaagacgttgacatggagaaagaacgtgtaaatgagctcaacatattgatttgcacgccaggtagactgctgcaacacatggatgaaactcccaactttgattgttcacagatgcaggttttggtactagatgaagctgatcggattctagacagtgggttcaagaaggaactaaatgcaatcatttcccaactaccaaagcgtagacaaaccttgcttttctctgcaactcaaacaaagtcaattcaagatctcgcaagactaagtttgaaggatccagagtatctgagtgtgcacgaagaatctgtgacttccactcctactctgttgaagcaaatcgtgatgattgttcccctggaacagaagttagatatgttgtggagtttcataaagacacatctacagtccaaaacacttgtctttctttcaagctgtaaacaggtaaaatttgtctttgaagcatttaagaaattgcaccctggcataccattgaagtgccttcatgggaggatgaaacaggaaagaagaatggcaatatattctgagttttgtgagaagcgctcagttctcttttcaactgatgtggctgcaagaggccttgattttaataaggcagttgactgggttgttcaggtggattgtcctgaaaatgtagcttcttacatacatagagttggtcgcactgctcgatataaatctgatggaaagtcagttttatttctgttgccttcagaaattcaaatgcttgaaaagttaaaagccgcaaaggttccagtgcattttaataagccaaggaaagaactactgcaaccagtttctagcttgttggcatctttattggtcaaatacccagacatgcagcatcgggctcaaagggcattcatcacatatttgagatccatccatatccaaaaggataaagacatatttgatgttatgaaactacctattgacgagtattcagcatcattaggtttaccaatgacccccaaaatccgttttctaaatcagaaaattaaatctaaagatgtgtcaacaaaatcaattttagttgaaccagaggattcagacaaggaaactatctttgaggtttcaaggaagaagctagacacagttgctttcaaggatgaggaaaccgaaaatgatcttcttcagttagctgatactgcaaatgaaggcgaagtgaagtcatctgaaattgaagaaataataccagcaactcgtgtattgaagaaaaagaaactcaagattaatgtacacaggccacttgggactagggttgtatttgacgatgaaggccacacacttcctccactagccaggatagctgacacacaaagtggcaaagaaatgttgcttgatccagaacaaaaagctgaatactatagaaggatgcgagatgatttgaagaaggctgacaaggaagacaaacttatagaacgtcagcggcttagagaaaaaagaatcaagcagaagatgaaatggaaggctgggaatgcggaagaggacgaccaagatgatatatctgggtcagaaggagatgaaactgttgatagactgcataaaaagagtaaagtatactttgatagtgactctgacgagggtgaaagaaatgaagtcacaggaaatgcacgtacaagtactggcggggttactttggaggagcaagaagctctggctttgaaattgttaaattccatgcactcatag

SEQ ID NO: 32125 - DNA, 642 bp, Glycine max
  Peptide Sequence Number=SeqID_148903
attctgtttgtcgtcaatacaaaatacccttctgaattacgaggtgcagctcatcatttccttcaggataacaaagcacgttctaagaaagatgattcattgtataaggttttatgtaagatgttggatgggaattcggattcgtcacttgatatttcagactcaaatgctgatgttcgacgtgctacactgcttgatttaaataattccgttatcctgaaagccaaggcagttggtttagagcttgaggataaagatctaacagttgttcaagcagctttacgtgttgatggcttgccgaatgtaatagattcttctaagcttcttgatgcactacaaaaagtgctaagaagatgcactgacaaactgctgtcagctgataactatagtctaaatggtgaagttgctgtcacttgtctaaagaatgccatctcctacttcagtgatcatactgattacttgaagaatgttgctgctatgatttttccgttactccttgttctaccacaggctgagtgggaaacatcagtgacagctggtgatgcctcattggatgagttcaagcctgaagtgttagactgggattgcagtgcattctttaatgagcttttgtatgtcaagctgagacatctaaatgtgaag

SEQ ID NO: 32126 - DNA, 648 bp, Glycine max
  Peptide Sequence Number=SeqID_148904
atggatgaacggttcaggaactataaggacgatttgtttagccacagaagtatagaattggatagagagttaatgggaatagaacaggacaatcaacttaatgtctccattgcttcatacttgagactactttctggatactttcttcatacctctgctcttcaaacgctcgagtacttgatacgtagacacaagattcatgtatacaacaatgaggatttgattttgtgtactttgccgtaccacgacgagcccgaatttgttcgaatagtacagatactcgatacaaggaatactaaatggggatttcttgatggtgtgaaagcctctggtgcacggctacctagaatggtcatagtgcagcagtgcatccgtgataagggcatattagatgctctatgtaactatgcatctccatcaaaaaagtctcgaccttcaatgcctgcaattcgcttttgtactgctgttttcgttgaagttttgggtactgttgtgactgttgatgatgatctcgtaaagaggatacttccttttgtgagtcttcagcctggcattaagggggtttcagatcacaagaatatgctcggactagctcatgtcataatgtatgttttgttcaagcaattgattgctttattttgcatctga

SEQ ID NO: 32127 - DNA, 231 bp, Glycine max
  Peptide Sequence Number=SeqID_148905
atgaccgttagcatcaccgtcatcatcattgttgttgtcactatcatcatcactattatcacttgtttggccatgatggtggtgacaatcaatgactgtggtgatggtagtggctgcaatgatggtcatggtgatgacatcgatagtgatgaaggtcgtggcaacaaaggtggtgatggtggtgggtacaagatgatcatggtgatgacaacaacaatctgggttaattga

SEQ ID NO: 32128 - DNA, 603 bp, Glycine max
  Peptide Sequence Number=SeqID_148906
atggaagagaagttgggtgttagcaatgctcacagttggacatgcatggatctttatatttttgccaccccttatcgtgtaacatgggattattatttcctggcccgggagcatacgcttgagatcaaagagtgggaagggaaagctgagtacgagtatgtaaaaaaccatgggttatcaattttcctcttgcaagctgggatgttggggacccttcaagcactttgggaggtcttccctctatttacaaatactggatggggggagaactccaatattaagtttttggagaaacatatgggagcttcttttgaagtgcgccctcagccttgggttacaaatgtcagtgctgatgacattcattctggagatttccttgccgtttcgaaaattcgaggtcggtggggtgcttttgagactctagagaagtgggttagtggagcttatgctggccacactgctgtttgtctaagggactccagtgggaagctttgggttggagagtcaggacatgaaaatgaaaaggaccgttatcagtatcatacaattcacgatacgaagacatacaattcaattcgagcagttggtgactcaaatccttga

SEQ ID NO: 32129 - DNA, 628 bp, Glycine max
  Peptide Sequence Number=SeqID_148907
atgcagctgatgcggccacaattgcaatcacgattcagtcgtagtgactctaaaaaccttgatgttgtggccgaaatcatggtcacaagtcattttttaaaacctttcttgatgactattgcagcagatctatctcgtgcaccaaataatatatgccaacttgccagtgccagtgagaacgcagttacttcaccatttgagaatgaaaaaggttcaaatctaatgatgatgagaggaatgacagccaaggactttgaccctgtaagatattcaggaagatggttcgaagttgcttcacttaaacgtggatttgcaggacaaggccaagaagactgtcattgcactcagggtgtatatacatttgatagggaagcaccatctatccaagttgataccttttgtgttcatggaggccctaatggatttataactggaattagaggaagggttcaatgtctttcagaagaagatttggggaaaactgagacacagctagagaagcaggaaatgatcaaagaaaaatgctatctccgctttcctacactgccattcattcccaaggaaccttatgatgtgattgctacagattatgacaatttttctcttgtttcaggagctaaggatcaaa

SEQ ID NO: 32130 - DNA, 849 bp, Glycine max
  Peptide Sequence Number=SeqID_148908
atggcgaagaagatcattcacgacaccactaggaagatgtcgcagctgtgccagaaaatcgttaaggtcgacgtccggtggggtgtcctcaaaagggtatctttcgttggacactttttccgcttcatttggaacagacttcttgtttgctccgtcgccggaaggccatctcagtaccggaaactacccgtccgggacccctcttcttcgccgccgtcctacgctgacgacgtcttcttttccgctacaaccaccactggcggctatgactccgattccgatttggtgaacctcaagatcagcttgttgggtgattgccatattggaaaaactacttttgtgatcaagtatgtggggaatgagcaagaaaagaggagcttacagatggaaggattgaatctaatggacaaaactttgtctgttcaaggagctcgtatttcatttagaatatgggatgttgcaggtgataaaaggtccctggatcaaattcccatggcttgtaaagattcggttgcgattttgattatgttcgatctcaccagtcgttgtacactaaatagtgttgttggatggtatagtgaagcaagaaagtggaatcagactgcaattccaattctaatagggaccaagtttgatgattttgttagacttcccccagatgtgcaatggacaattgtaacacaggcaagggcatatgcaagggcgatgaaggcaacccttttcttttcaagtgcaacccacaacataaatgtcaacaaaattttcaagtttatcatggccaagctctttaacttaccatggacagtggaacgaaatttgagagttggagaacccataattgacttctaa

SEQ ID NO: 32131 - DNA, 732 bp, Glycine max
  Peptide Sequence Number=SeqID_148909
atgggtctaacaaagctcttcctggacaagtgcaattttgattttgattatttcagagtgaaagcaccaaatcttaaaattttcaagtattgcgggtggataaactttgccgtcgtagaaattgattcactcgcaatggaagaggtagatcttgacttctctctagaatcatcatttgaagaatttggtcatcctatctacaatctggtgaaagatgtttgtactgctagagtgctgacagtatgtagttttgtgcttcaggtaattcctactggtcctgaacagctacgtatggaagttgacatggatgcacgacatttgataatgaagacggccttggatgacgatgagtttattggaatctcattcttccttaacagttgtcccctcttagagcgtctcaccattgaaataggtccaaaaagtgagctgtctgattatgaaccagcgtttgaatttaccagcttacttttctggattgaatatttgaatgtttgcgaatgcttgatttcaagtcttgaagtggtggagattaatggctttagaggaactctgaatgaatatcgcttcctcgagtatttgatctttagtgggtatgtcttgaaaaagattatcataaacatgttgaaggatgattctggtaggactgtggagtattattgccgtcatatggcagaacttctgttgacatgtccatgcacttcaagaaacttagagatatcaatcttttga

SEQ ID NO: 32132 - DNA, 456 bp, Glycine max
  Peptide Sequence Number=SeqID_148910
atggcagtgagctctgactgcttctgtttgttaccaatcgaagtggttttaaccatcctttcactccttcccttcaaggaagttgtgagaacttgtgtactctccaaggactggttggacatatgcaagtccactccaaacatagagttcaatgaactctttttcgtgaaacccgatcaatcaaatgaaacaagagaagcccagagaagggcttttcttgagttcataaaatcttggattgaaaaccacaaaggagctactatagacaagttctctttaagtttatcaatgcctgcaaatgttggcgagatcattaatgaatccgttgcttttgctacacaacgtggggtgaaagagttggatcttgactttgttgataggagtaagaatgagaatggtgattgttcatacgatagtgacgaggcattgtttgaattaccatcacagggtttatga

SEQ ID NO: 32133 - DNA, 747 bp, Glycine max
  Peptide Sequence Number=SeqID_148911
atgatttgcaccgtgaaacaacccgccatatcgatcagagtttctgatattttcctacgtaagaagggtttaccttcaaccccagttcagtcatgttccattgtttcaccttcttccctcccgagggaaaaaaactctctgagatcattggtgtcagtgcaaaagccactgcacctttctcgagttggttttggagattttgttgggtctctggtaaggcgtgagcgtggtgatttcgtgacatgtgatgcttatgaggctgatagatcagaggttggaggggctccatcaaaggctgctaagaaggtgaagattgggatatactttgcaacatggtgggttctgaatgtggtgttcaatatttataacaagaaggttctgaatgcattcccatacccttggcttacctcaactctctcccttgcatgtggctctctcataatgttgttctgttgggccaccaagatagttgagcctcctaagactgatcttcagttctggaaggatttgttccctgttgctgttttacatacaataggacatgtagcggcaactgttagcatgtcaaaagttgccgtatcattcacccatattattaagagtgctgagcctgctttcagtgtaatggtttccagactactgggcgaggaattcccagcaccagtctacctgtctttgattccaattattggtggatgtggacttgcagctgtgactgagctcaatttcaacatgattgggatatga

SEQ ID NO: 32134 - DNA, 174 bp, Glycine max
  Peptide Sequence Number=SeqID_148912
atggagagcagaggctgcatatgttggggatggccaactgtcacaactggccagaaaatgctgagaaatactggctatgttcccagaaaagggtgggtgtttggcagtgccaaggctaccatggcgggtttattgccacctgtcataggcaacaatatctgctccactttgtga

SEQ ID NO: 32135 - DNA, 2790 bp, Glycine max
  Peptide Sequence Number=SeqID_148913
atgaacagatccttgaaggctcagaatctgtctggtagtctctcaccagatttttccaagcttcatcatctccaagaattagatcttagtcgtaacatcatcactggggctatacctccacaatggggtaccatgcgcttggttgagctctcttttatgggaaacaaattgtcagggccattccccaaagttctcaccaatatcacaaccctcagaaacttgagtattgaaggaaatcaattttcaggccacattccaacggagattgggaagctgaccaatttagaaaagctcattctgtcatccaatggattcacgggagcattgccacccacgctttccaagttaaccaagttgattgatttgaggataagtgacaataatttctttgggaagattcccgatttcattagtaattggacattgatcgaaaagctgcatatgcacggttgctctcttgagggtcccataccttctagcatttctgccttgacaagattaagtgatttgaggatagctgacctaaaaggtagtaaaagctcagctttcccaccactaaataacttgaaatccatgaagacactggtattgagaaaatgcatgattaaaggagaaatcccagcatatattgggagaatggaaaaactgaaaatcttagatttgagttacaatggcttgagtggagagatacctgaatcttttgcccaacttgacaaagtagacttcatgtatcttaccgggaacaaattatcggggattatacctggctgggtccttgcaaataacaaaaacattgatatctctgacaacaacttctcctgggacagctcaagtccaactgaatgtccacgcgggagcataaaccttgttgagagctactcttcatctgtaaatacacaaaataagattcattcatgcttaaaaaggaactttccatgcacatcttcagttaacaaatatcattactccatgaacattaattgtggtggtaacgaagcaaatattagtggtcaaatctatgaagctgacagagaacaaaagggtgctgcaatgttatattacaccggccaagattgggctcttagtagcactggaaacttcatggacaatgatattgactctgatccatatgttgtggccaatacttctagactgaatgtctctgcactcaattcacaactatatacaacagcgcgtgtttctccccttgctctcacatactatggcctctgcctaataaatggaaattacacagttaagcttcactttgctgagattattttcatcaatgataggtcactttacagtcttggaaggcgagtatttgacgtctatatccaggggaatttagtgctgaaagactttgatatccaaagagaagctggtggtactggcaagccaattgtgaagacattgaatgctagtgtcacccaacacaccttggagattcacttctactgggctggaaaaggaaccactggcatacccacaagaggagtttatggacctcttatatctgctatttcagttaaccctaattttaaacctccatcaggggatggcaaaagaacttatttcatgctggccatcggcatagtagctggtgttttagtggttgttcttctggtactggttctcatgaggaggatgggatggttaggaggcaaagatccagtgtataaagagctcaggggcatagatctgcagacgggattatttacactaagacaaatcaaagcagcaacgaaaaactttgatgcagagaataaaattggtgaaggtggctttggttgtgtttttaagggcctattatcagatggtacaataatagcagtaaagcagctttcttcaaaatctaaacagggaaatcgtgagtttgtgaatgagatgggactgatatctggacttcaacatcccaatcttgttaagctttatggatgttgtgtggagggcaaccagctaatactgatatatgagtacatggaaaataattgtctatctcgcattctttttgggagggatccaaacaaaacaaaactagactggccaacaaggaagaaaatttgtcttggtatagctaaagctttggcttatcttcatgaagagtccagaataaaaatcatacatagggatataaaggcaagtaatgtattgttggacaaggattttaatgctaaagtctcagattttggcttggcaaaactaattgaagatgacaaaacccatattagcactcgagttgcaggaacaattggttatatggctcctgagtatgcaatgcgtggctatctaactgacaaagcagatgtttatagctttggggtggttgcattggaaactgtcagtggaaagagcaatacaaatttcaggccaaacgaggattttttttaccttcttgattgggcatatgttttgcaagagagaggaagtcttctagagttggttgatccaaatttgggttcagagtattcaactgaggaggccatggtggtgctaaatgtggctctcttatgtactaatgcatctcctacacttagaccaacaatgtcccaagttgtgagcatgcttgaaggttggactgatattcaagatctactttctgatccgggatattcagctatcagttcaagttccaaacataagagtataagaagtcacttctggcagaatccaagcggaacacatagcatgtcaatacctagtattgatactgatttctctggctcacatgttgaaacagataagagctatcttcccgtaaccgttaattcagatggatcagacaagtga

SEQ ID NO: 32136 - DNA, 1302 bp, Glycine max
  Peptide Sequence Number=SeqID_148914
atgtcaagcaattcagatgcagcagcagcgacggtgcatgctcatggccgtttggccatgctcgccgctcacctcctcccctctcaactcactcatcacggcgccctccaccctctccatctctcctcccagttgccgccgccgcccaacctcgccggcactttgaccgtcgtcgacgaaaggaccggcaagaagtaccagcttcatgtctccaaagaaggcactgtcaaagcttctgaattcaagaagatattgacagggaagaatgacaagggactcaagctttatgatcctggctatttgaacacggctcctgttcgatcaacaattagttatattgatggagatgaggggattcttagatatagaggttaccctattgaggagttggcagataaaagcactttcacggaagtgtcctatctcataatgtatggaagtttgccttctgaaagtcagttagcagaatgggagtttgctatatctcagcattcggctgttccacaaggagttttggatatgatacaatctatgccccatgatgcacatcccatgggtgtgcttgttaatgccatgagtgctctttctgtttttcatcctgatgcaaatcccgctctcagaggtcttgatatttatgactcaaagcaaataagagacaaacagataacacggataacaacaattgctgctgcagtttatcttagaatggcaggaaggccacccgtgcttccatccaacctcctttcttacacagagaacttcctatacatgctagattctttgtatgtatgtggcaatcggtcatataaacccaatcctcagctaactcgtgcgctggacattatcttcatcctgcatgcagaacatgaaatgaattgttctacatctgctgttcgacaccttgcatcaagtggcgttgatgtatacactgctattgccggggctgttggagctctttatggaccacttcatggtggagctaatgaggctgtcctcaaaatgctgagtgaaattggaactgttcagaacattccagagttcattgaaggtgtcaaagccaggaaacgaaagctctctggttttggacaccgagtgtacaaaaactatgatcccagggcaaaggtcttaagaaaactggcagaggaagtgttttccattgttggccgggatcctcttattgaggtgtttatccattttgtatttccggtgtctcttgtctgttatatgtttcttaattttggtatgctggtcatgaggcctatgatcaggggtgtgaatacagagaaaaactactacatttaa

SEQ ID NO: 32137 - DNA, 372 bp, Glycine max
  Peptide Sequence Number=SeqID_148915
atggttagaatcataagtttggatcgggatttaggtaggattataggaagagtcttagggagagaacccacaacatctatacataggcaacaacaagttgcacttgttgctgaggatgttcagcacgtggatcatacagctgacgaggtccatcaacagcctgaagaagcagcagctgatgatgtagttcctgatgccgagggtttttcaggcgagtcccacaacacatcagttttgattggctatgttcatcatgttgcagtgactgtttggaatggagaagaacgtcctgagttatccttccatggaaggaaggttgagaaatttggcaggcctgctctaaagattgaaggcttagtcactgccacatga

SEQ ID NO: 32138 - DNA, 672 bp, Glycine max
  Peptide Sequence Number=SeqID_148916
atggctattttcaaggtccctgtggctgccatgcaaagaccagcagcgatagcgcaacccctgccacaaaatggatatgtagaatctgttattcatgaaaggttgaaaaatgtgaggatcacatggaatcatgcagccacgaatgttgctattgcaggatcatgggacaactgggagaccacggagcccttgctgagagtagatcaaaattttgtcattgttaaaacactccctataggtatctatcattaccgtttcattgtagatggctacttgacacatgctccagagttcccatcggcttctgatgattcaggttatggctacaatatattggatttgcaggattatatcccagaaatagttgcaagcttatccgattttgaagatcctccatcaccgccatcaagttatgataacacaaacttaaatgaagaggagttcagcaaacccccaccagaattaccacaacaactaccagtggcaataagaaatgaggcttcatccgcaagtggtagtcatcatgtccctaggcccacgcatttggaactgaatcatctatacatccacaaaactgatagggatcaatttgtggcactacgatcaacttataagtttcaacacaaatatattactgcggaactgtacaagaccctgcgcagggaaagatga

SEQ ID NO: 32139 - DNA, 513 bp, Glycine max
  Peptide Sequence Number=SeqID_148917
atggaagtgcatataattaggaagatatctcctctacttggggatctccgtgcctacttgaagcggaaaggtgcattaaaaccagtaacagctgtaaagtttgcacttgatattgctaggggtatgaactatttgcatgaacataaaccagaagccattatacaccgagatcttgagccttcaaatatactgcgggatgattctgggcatctgaaagttgcagactttggagttagcaagttgcttaaagttgctaaaacagtcaaagaggacaaacccgtgacaagcctggatacatcatggcgttatgttgctccagaggtatataaaaatgaggaatacgacacaaaggtggatgtattttcatttgctttgatattacaggagatgattgaaggttgtccaccgttttatgaaaagcctgaaaatgaagttcccaaagcatatgttgaaaatgagcgtccaccatttagagcttcaccaaagctttatgcttatggactaaaacagtga

SEQ ID NO: 32140 - DNA, 510 bp, Glycine max
  misc_feature (120)..(120): n is a, c, g, or t
  Peptide Sequence Number=SeqID_148918
atgggtcaaagcatgcgacaagatgcacaaaacattgcaaaagcagatcccggcttaaaggtgtttccagactacttcgctttagttagagggtctatagctctctcggttgaacatacnaaaaaaaacctttatgctaaagattttcttcaaactagacaaatgaaaggacattattactcaactaaatcaaataggcagggtcgtacatgtccttggcagcttgtatccatttacatcgtccagcattctgattcacaaggttgtctgttatcagaatcatttccagcagcaccattactgaggaagaaacttggaagcaaaatactgccccttagctatattgcaaagacagttttcgttgttttaattttacagcaaaaatcttcgtattcacaatttcttatatcgatggacgaaagcaaacaagatgagatatgtatcggtgttaaaagtaattctgttcaccggtccaaacaggtactcaattctattgaggcccacacatga

SEQ ID NO: 32141 - DNA, 144 bp, Glycine max
  Peptide Sequence Number=SeqID_148919
atgatgcaggaagtgactgaaaatatcatagatgcatgcggtcaaagaaaacgacaaattgaggatcagattcaagggcatcatattgttgaaatcatttcctgtttgctgatcctgggtgatgaagaagttggagttgattaa

SEQ ID NO: 32142 - DNA, 1551 bp, Glycine max
  Peptide Sequence Number=SeqID_148920
atggcggctacgtttgatggattctccataagggactacacatccaagatgaggtccatcgatgttttcaagtgctggcccttcgcatccacctcctcacgtgatacgtcacgtgaggaggttcagtcgtggcttccgcccatgaatccgtgccctagatccgacgatttcaacgacagccacgcccaaaatctggagaatccgccttctgctgcggaagtttcgagaaccgatggcgacggagattgcagcgaagaggaatctgcagaatctatggatttcgagaaatctgcgcctccttccgactccaacaacaacgaggatgaaaaattggagatggtttgtccggtgtgccgcgaattcaacgccgtgacgctcacggcggtgaacgcacacatcgacggatgtctcgcgcagacgatgagagaggagcgtcgccacatgaggattatgaatttgaaatcttcctcgtcgaagtcgaagccactgaagaagcgctctatcgctgagattttcaaggtggaggagcaacaacagcctccacggccacagctgcagccgccgccgttgccgcaaatcgagagcgtgttgaagttctggccgttccgcaagggcgaggcgaatgatgtttcgattacctcgattaccgttacgaagttcgagtggctctctcggcggcttgaggcgctgagatccaggcccacgcccagaggtggcgaggtgaaatcggaccaaggagaatcctccgaggagaagatggagatggtgtgtcctgtttgtcgggatttcaacgccgccacggtgacggcagtaaacgcgcacatagacggttgcctagcacaggctgtcagggaggaacggcggcagatgagaaggacgactgttaattgcaagcccatacctaaggcgcctcccaaacctaaggtgccaaagaagcgctcgatcgcggagattctcactgtggcaccaccgttcgaagccagcaaaaggaaagcgattcaggttgaggaagaagatgaggagaaatccgattatggctattcaggtggagattcaactagttccgccactcctgctccttatgctactgttgctagtcccgttgcttcggtaattaagaacaacaagagtacgatgaagaataggaacaagaaaaagttgaagaagaaaagcaaggtggagaagcacggtgatagtggtgtgtggttcgtgaaccatgagaagaagacagttgtgagcaagaagaagaggaagaaaaagaagaatgccttcaacaacgtaccaactgggaacaagcgaaatacgcggcaagtaaaagttgggaaaggggagtgttacgaaaaaggaaaactaagacaagtgccttcgtgcgcggaagggattcagaatacaagtaccctagctagaaggggccactcatgggttacgagtttttcggacgtagaggtttatacacagcttacagctggatgtatcttggctagtgggagatctgcaagtggaggtccagaatttgatagatcatttgttggatctgtcagaagtgtataa

SEQ ID NO: 32143 - DNA, 312 bp, Glycine max
  Peptide Sequence Number=SeqID_148921
atgaccctctttgagctttccactcatgagatccttgcttggtttcccatttggggatacctgaagcttatgttttgcatctggttggtaatgccaatgttcaatggagcggcttacataaatgagaattatgtgaggcaatatataaagaatattggaagaagttccaattattctgaggagtacaagaaggtccttcacatgatgaccttcgatgcaaggaaagcagttgaacgctatatcggtagatatggccctgatgcctttgagagagtagtgagagcggctgaaaaagaatcaaagaagagctga

SEQ ID NO: 32144 - DNA, 2760 bp, Glycine max
  Peptide Sequence Number=SeqID_148922
atgcttccacttcatgaggttgatccttctatcgatagaaagaaacaagttaaaaactgtgactcagttggaaagcaaccaaaagcagtatctcctgttcatggcattcttaagaaccacttcaaacatgtttctgaaaagacatcaagtggcagtagtattggagatggtactgaagaaagccatgataatgatcaagagccaacctcgaacagacatgtgaaattctctggcaaagatgatatacttggtccaaaaaagacaaattcatttgatgaaaccatgttcaagttatcttcagatgcgctggcttcttcaatagtaaaggagaagtcttctggaagtgatgaagaaactgcaagtttggagccaaacagaaattatgatcatattgccgttaatatagacagagacaagagagaggaggtttgccctatagttgaaagtaaacagttttctaacactctggaacaagataccgtacaaagcttcttgaagccttgtatcaatcaagagaagtcgaagcagttagaagagaagtcagaattgttgaccaaggtggcagtttgtgacaatattgattcacagtttttttatggaggcaacagaactaccctgcattgttctccatatgccgacatttctagacctctttctgcagtccaagaagagcagatgtctggtatcaatacacaagtgtgtgaatctggatctttcagctacagtgggaagttggaccatttggatgatccacaggttgatgctgttaactcaaatgaaaatacagagacatttctggagccttcttcatcttattctgcttcatataatgcaaatgaaaaaccggaatctccgttgcaaacttatggagataaagataatagtggcgaggccttgggtgacagacagttttctcgtatgctttctgcagatatgattgataactcattccccattacaggctgggagaaaggaagtgacaaaaatagctgtttggatccgaatttttttggtttgccactcaattctcatggtgagctaatcaatttcagttcaagtggagacttaaggatcaaccagtcagatacatcaagtacattacgtggctcttttagtggcttacccattaataatattctccatcaaaataaccaggaaaatttaagcattaatgaaaatcatgttgttcagaagacatttccaaaagattgtcttaatccatttccacatcatccaacccgattacctgtcaccgagttacaatctagagagagagaagatatccaccgacctaattcttcagatatgtgttccggtcactatgtcccgccacttaattcagagttgaaccgtaagaaaaactcattcattgaacagaatccatataaccgggtcaggaatcataatggaaatggggtggtttctctgaaagaagattcagatcatatctcaccaagttccaaccaaccaacaatgaggttgatgggtaaagatgttccaattggtagaagcagccaagagatgcaacaatttgcgggagatgtttggcctgatgaggaatccagaagaaggaattattctgaatatgctgctttagatcactctttattgggaagaagttctaagcagaattgggcatctggttcacctttacaaatatcagctgacaatgtattgcaatcagcaaaaattcaaagcaatcaagcagcacaaagcaccatattgatgagcagtacatactctggattctctcaacagtttattgatcggctaggtaatcatgtatctcaaaatggaagtcttggagtcaacagaaatgccagttcttatttcaatcccattactcaaaagtctagttcgtattcagtatttaatggtgcatccaatgacttttcagagcagtttatacctggagctaaacctctaggattgatctctcaatcagtggtactacctactcctggcaattttagtcactcgcctcatgtaaccaatggtgagctgaatgacaagaacacaaatccccatgttacaaaatcagcctttggatttcctttcttgcagccaactgtgaatgaacaggccaaaacatcttggtttcatagtccctacagaagttcaccatcgtggttgtcaagctcaacagatgaaatgctaccagggaccttttctcggcaattttctgcttcaattagtcaaaattttcctcaaaatctgtggggaaataatttcactactccatttgtgaatcattcagcagaagttcgctttccttctaatcatctgacttctctaggtcccatgcagacaactcctctttctccatcatcaattgttcatcctctacattttccagttacaccctctaccataaatagtggtaacagaaacataaataaggttgctgacagattgaagtttgatgagcatcatctgtgcgcaaataccaggaagaatcctgcagccgcagccaatcttgatgattccaggttaccgaatatacaagtgcaagaaaacttgagtcgtatgactaggttgcctgaagaaaagtcaagcgtggaattgcaacgaaacacaagagcactcgaactggatccgcacatgggcagtgctaggagtaggtgttgtcagcatgaagcacaaaatcaaaatcctggaagttatcctgctgtgaattcttttaaactggacagcatggtaacatcaggtcctgtccgacttggtcctaaaagagcgaagcacatcctaaattcctcttaa

SEQ ID NO: 32145 - DNA, 303 bp, Glycine max
  Peptide Sequence Number=SeqID_148923
atggagtttcccaacgaagcaataatatcagaagggtctaattctcagaagaaaacggggagagggaaaatagaaatcaaacggatcgagaacacaacgaataggcaagttaccttctgcaaacgccgtaacggattgctgaagaaggcttatgaattgtctgttctgtgtgatgctgaggttgctcttgttgtcttctcaagccgtggacgcctctatgagtatgccaacaacagtgacacaacacaagcacctcatccaattggagttagggtttcagacttttcactatttagtatttag

SEQ ID NO: 32146 - DNA, 1263 bp, Glycine max
  Peptide Sequence Number=SeqID_148924
atggagcgtgaggtgcaatcagctagaaagcaggagtcactttattggcatatagcttcacacggtgttcctcaaagtctgcattgtctttgtttgaagttggctgaagaatacgctgtaaatgccattgcacgatctcgtctacctcttcctgaacatgtctctcgcctcgttgaccccacttttcaccacattgttctcctaaccgacaacgtccttgcggcttctgttgttgtaacctccactgttgaaaattcagccaaccctgaaagattagtctttcacgttgttactgacaagaagactttcactccaatgcatacttggtttgccatcaactctattaactcagcagttgttgaagttagggggttacaccactatgattggtctaaagaagtgaacgctggtgttaaggatatgcaggaaactaataacttaatttggaagcactactacagcaactataaacaaaaggagcttgaccatagtgaagaccataacagatatttggaagctttgaggcctagcagcctttccttgttgaatcatctccgcatctatatccctgagctctttccagatctaaacaaggtagtattgctggatgatgatgtggtagtacaacatgacctatcttctttgtgggaactagatcttaatggcaaagtcagtggttcagtgttcaagtcatggtgtgagaacagttgctgccctggaaacaaatacgtcaacttcttgaacttttcacatcctatcatatcatccaactttgacggtgataagtgtgcatggctctttggcgtggatatatttgatcttgaagcttggagaaaatcagatattactaagacctatcatcaatggctgaaacttaacgtccagtctgggttgacattatggaatccaggaatgctcccagctgccttgattgcttttgagggtcaagtgcaccccatagatacatcatggctcgtcactgatttaggttatcgccatcgatcagaagaaataggcaacagcatagagagagtggaaactgctgctgttgttcatttcaatggcccagcaaagccgtggcttgaaattggtttacctgaggaggcagaggagccatcacaattgattggtagaatttcactcggacaacaagctggacatcaaggaacagaccctggtaacaaatgttgccgagttttgtcactatggcaagaaaccgaggattttttggaagcaaaactgcttaaagacttaggaccatag

SEQ ID NO: 32147 - DNA, 192 bp, Glycine max
  Peptide Sequence Number=SeqID_148925
atgtcagccaaaagagataagttagtatgtgatagcattcgcaggatagcagatacccagataacagagagtaacatagcagatagcaatatagcagatagcaacatagcagatagcaatatagcagatagcagtaacgataggccaaggagagtaattaggaaacccacatacctgcaggattatgtgtga

SEQ ID NO: 32148 - DNA, 1017 bp, Glycine max
  Peptide Sequence Number=SeqID_148926
atggcagagattcaattcaacacttcagaggtagtgtcgattttggagtttctccgcgtgatttcattatttcattatgatagtgatggtgctaatcccagtttagcttatgattatgagcttcctaaacaaaaatggaatagctctgactcgttggtgagtttgcatccgaaaaaagagttccggaatggaactgatttgatatggcaagtgcccgaatcacctaaaggtgttctctttctggctcatggatgcaatggcagggccattaacttctgggacaagtcccctgaatgccctgattgcattggtttgcctgaagagcggttgcttgtactccatggtcttgcccaaggttttgctgttattactatttcaagtgcacaaagatgttggacacttggtaaagaagtgatggttgttaaagacattatagagtggtggattggtagaaggaagcttgagaagcttcctcttgtggctttgggtgcttcttctggagggtatttcgtgtctgtgcttgccgccgccatgaagtttagtagtactgtgctcatgattgctgaggggatgtttgagcaaattgatgttaaaggggactatccgcctaccctttttgttcacatgccaaaagatctttataggcagcagaaaatagatgaatatgtgaaggttttaaaagataaagggattgatgttggtgttgttgaatgtatggagttcccgttgttgccgaatactttagctgacagaattccagggcttgatcaggctctttccaggaagttatttgagttctttcaggaaaagggctttattgataaaaatggttatatgaaaaaagatgggcgtcaaatcaaatggaaaaaggctcttgaggagaagaaagctcttctgctggataagaatctggtccctcacatccaagaggagctaaaccttgcatttgcttaccatgagatgactagtgtgcattctgaccaaatttttaaatggtttgaatctcacatgagctga

SEQ ID NO: 32149 - DNA, 1311 bp, Glycine max
  Peptide Sequence Number=SeqID_148927
atggggtttccattgataggggagaccatggaattcttcaatgcacaaaggagaaaccaattgtttgaagagtttgtccatcctcgcattctgaaacatgggaggatcttcagaacaaggataatggggtctccaactgtggttgtgaatggagctgaggccaacaaattcttgttgtctaatgaattcaagttggtgaaaagctcttggccttcttcctcagttgagctcatgggaagggactctatcatggagaaagatgggggaaggcaccgattcctccgcggtgttattggcacaagccttggttatgctggacttgagctattagttccaaaactgtgcaattctgttcagtttcatttagctacaaactggaaggggcaagaaaagattagtctttaccgttcaacaaaagtcctcagttttagcatagtgttcgagtgtttgttggggatcaaagtggagccaggtatgctagatacctttgaaagagtgttggaaggagttttctctccagcagttatgtttccaggttctaaattttggagagcaaagaaggccagggtggagatagaaaagatgttggtcaaagtggtgagagagaagagaagggaaatggaaggaagcttgggaagagaacaagatggaatgctgctgtccaaattggtatctgggatgatccaaggggagatcagtgaaaaagaggtcatagacaatgtggtgcttctagtttttgcagctcatgataccacttcttttgctgttgctatgacattcaagatgttggctcagcatcctgattgctttggaaaacttcttcaagaacatgttgctataatgagcaacaaaagccggggtgagaatctcacattggaggacataaagaagatgaagtatacctggcaagttgctagagaaagtatgagactgttccctccaatatttggttctttcaggaaggctatcactgatattgaatatgaaggattcattatacctagaggatggaaggtgctatggacaacatatgggacacattacaatgaagagtattttaaggatcctatgagtttcaaccctagtaggtttgaggagggagtaccccaatatgcatttgttccctttggaggggggccaagagtgtgcgcagggtaccaattagctaggttaaatatcctcatctttgtgcactatgttgtgacccaatatgagtggttcttactccatccagatgagccagttgccatggaccctttgcctttcccttcccttggaatgccaatcagaatttctcccaagtatacatga

SEQ ID NO: 32150 - DNA, 1083 bp, Glycine max
  Peptide Sequence Number=SeqID_148928
atggagaggaaaagaaacaatcctacttctttcactatgttcacattgctacttggagtgctttctcagaaccttgtcatccctgtaatatctaccactaccaccattgaggaccacaactctccagacccacatgcaggaacagatttatcaaattctctgtgttcatactgctctccagatcatggctctgggagtagtggacatggaagctcaccacatcactctcatcatggatcaccatctcatcatggatcaccatctcatcatggatctccgtcacatggaggtggtggaagttacaatccaaccccatcaactccccctggtggtggaagctatgatccaactccatcaccaccctcaggtggtggtggaagttacaatccaaccccatcaactccccctagtggtggaagctatgatccaactccatcaccaccctcagatggaggtgaaaattgcaatccaaccccatcaactcctcccggtggtggaagctatgatccaactccatcaccaccctcaagtggtggtggtggaagttacaatccaaccccattaactccccctggtggtggaagctatgatacaactccatcaccaccctcaggtggaggtggaagttacaatccaaccccatcaactcctccaggtggtggaagctatgatccaactccatcaccaccctcaggtgatggggtggtggaagttacaatccaactccatcaactcccccaggtggtggaagctatgatccaaccccatcaccacccacaaatggtggaagttacaatccaaccccatcaactcctcctggtggtggaagctatgatccaactccatcaccaccctcgggtggtggaagttacaatccaactccatcaactcccccaggtggtggaagctatgatccaaccccatcaccacccacagatggtggaagttataatccaactccatcaccaccctcaggtagcaactgtggacaccaccacaagacccctctactccaacaccctcagtcccaacaacaccatcaaccccatcaaaccctcccttgggaggaggtgggtactataa

SEQ ID NO: 32151 - DNA, 852 bp, Glycine max
  Peptide Sequence Number=SeqID_148929
atggcttcttcatatgttttattcatgctttctctctgcttagcctcaacaacaaaatttgctttgggtgggaatttttacactgattttaacattctctttggagataatcgagctaacatacaagatggagggtcaaacatgtcccttgcaatggacaaatcttctggctcgggcatagcaaccaagaatgagtacttgtttggacgatttgacatgcaaatgaagcttataccagacaattctgcaggcactgtcactacattttatctaagctctcaagggccaaaccatgatgagattgatttagagttcttgggcaacttatccggtgatccacatattctttcaaccaattattatgccaatggtactgggggtcgtgagatacagttctatctttggtttgatcctacacaagacttccacacctattccattgattggaaccctcaacgcataataatcttggtggataacatacccataagagtgatgcacaacagggagaacattggtgttccattccccacaagtcaacccatgaaggtttatgcaactttatgggatggagacttttgggcaacaagaggggggaaggttaagattgattggtctaaagctccattcatagcaggtttcagaaatttcaatgcgaatgcgtgcattgcaggaccagaggggtcatcttgcatgggtttcaacggtggaagaaacaaaggtcttgatgctcaaatcaggaagcacctcaaagagatccattcaagatgggttgtttacgattattgtcgtgatttcatacgctttgctcatggttttccatctgaatgccgcaagaataaacacacttga

SEQ ID NO: 32152 - DNA, 138 bp, Glycine max
  Peptide Sequence Number=SeqID_148930
atgtcatacgtccaagaagttggcaattggagaatgcataagagtttccgcaaaagcatgctggaatttgattgccagagtgtggtgttctgttggatctccaaaacagtgactgtagtgggagtgcctgtgctgtag

SEQ ID NO: 32153 - DNA, 2682 bp, Glycine max
  Peptide Sequence Number=SeqID_148931
atggcgtcaccagcggcggcgaggacgccggtctccaccggcgcatctccgatgcaacgcctctccaccttcaaaaacccctcctccaccaccgccaccgccacaaccaccacctcatccgccctagactccctggcctcggatcccatcttctccgccttcctctccccttccttctcctccacctccttctcctccgccgccctctcctccggctccccggcctccaccgccgagaagctccaccacgcgatccgcctcctcgagaaccagctccgttccgaagtcctctcgcggcatcacgatctcctctcgcagctctcgtccctccaccacgcggaccacgccctctccaccctccgatccgcgctctcctctctccagtcctccgtccgccgcctccgctccgagctctccgacccgcaccgctccgtcgccgccaaaaccgcccagctctccaacctccaccgcaccacggagctcctccagcactccatccgcgccctccgcctctcgaagaagctccgcgacctcatggccgcccctgaccccgaaaaactcgatctcgccaaggccgcccagctccacttcgagatcctcagcctctgcgacgagtacgacctctccggcatcgacgccgtcgacgaagagctcaattgggtcagggagaccggagatttgcttcgcagcgtggcgatgaaggttctggaacgcggaatggatgggttgaaccaggcagaggttgggaccgggttgcaggttttctacaatctcggggaattgaaggtcactgtggagcaggtggtgaataagtataagggcttgggtgctaagagtgttactgtggcgttggatatgaagaccatttcgggtggaagcgggtacggtcccggtgggattaggggctctggaacgccccacattggaggaggggctaaggctagagaggctctctggcataggttggggaattgcatggatcagttgcattccattgctgttgctgtgtggcatttgcagagggtgctctccaagaaacgtgatccctttacccatgttttgttgcttgatgaggccattcaggcttccagctttatgcaacattatacagtcacagcctttctctcttcaaaagagttgtataggatgcagagtagagaaattgtaaaaaatcatgcctgcccgttctcttctgatgcattaaacactactagatggattttggatgagatgagatcaatatgcaatcttttgaaaatctactcctctgaaggtgatcccatgctaacagatcgagtgtgggaggccattacaaaggcttttgcaagccaaatgaagtctgctttcaccgcatcaagttttgttaaagagatttttacaatgggatatccaaagctttactccatgatagagaatctacttgaaagaatttcacatgacacagatgtcaaaggagtgttaccagctatcaattcgtctggaaaagagcagataatttcagctgttgaaatattccagaatgcatttttggctcattgcttgagtcgcctttcagatcttgtgaattctgtatttccaatgtccagtcgtggtagtgttccctccaaggaacaaatatcaagaattatatcacgcattcaggaagagatagaagctgttcaggtggatgcacgcttaactcttcttgttttgcgtgaaattggcaaggtgttaattcttcttgcagaacgagctgaataccagatatccactggtcctgaatcacgtcaagtgggtggtcccgcaacaccagcacagctcaagaactttacattgtgtcagcatctgcaagatgttcatacacggatatcatctatacttaaaggaatgcccagtattgctgcagatgtgttgtctgcttcattaggtgctctatatggtgttgcctgtgattctgtaacagctttattccaggcaatgctggatcgtcttgagtcttgcatattacaaatacatgatcataactttggagtgctcggtatggatgctgctatggacaacaatgcatcaccttacatggaggagctccagaagtgtattcttcactttcgcagtgagtttctgtctaggttgttgccttccagaaattctacagctcctgggacagagaacatatgcaccaggcttgtccagagtatggcttcacgtgttctagtattcttcatccgacatgcatctcttgtgagaccactttcagaatcaggtaagttgaggatggctagggatatggctgaattggaactagctgtgggccaaaatttgttccctgttgaacaacttggtgcaccatatcgcgcacttagagcatttcgtccacttattttcttggaaacatcccagcttgcgtcatcacctcttcttcaagatctaccaccaaatgtcatacttcatcatctgtacacccgtgctcctgaagaattgcagtcaccactgcaaaggaacaaactaacaccattgcagtattcattgtggctagattctcaatgggaggatcaaatctggaagggcatcaaagcaacacttgatgattatgctgcaaatgtgaggagcagaggagataaagagtttagtcctgtttatcctcttatgcttcaattgggttcatctttgattgaaaaagatcagacttcctcaaagtcatga

SEQ ID NO: 32154 - DNA, 1620 bp, Glycine max
  Peptide Sequence Number=SeqID_148932
atggtgttcccaatggagctcctgaggcttgcagattggatcttgtaccagctgcttgctaactcatgttatagagcagcaaggaaaatgaagagttatggattccatttggggtatttgtcatctaaaccatcccttcagccttcctctttccccagtgttaccgaatgtgattgggagggtagaggctcacaaacacttgttgcttgtggcattcatagagtccttttgaggtctcactccttctttccatatttcatgcttgttgcctttgaaggtggcagcattttaagggcactcctcttgctcttgtcctgtcctgtgttgtggattttagacagtgagttaagtcttagggtcatgacctttataaccttttttgggctaagaacaagtgtcatggaaaatatgtcaagggcagttttgcccaagttttatttggagaatctcaatcttcatgcttatgaggttctggcctcagcagggtctaaagttgttttcacaagtgtgcctagagttatggtggaagggtttctaagggagtatttgagtgtcggtgctgttgtaggcacagagttgcacactgttggttgttacttcagtggtttggtatctggttctggcttacttgtgaagcacagagcactcaaggattatttcggagacacaaagcctgatattggagttggaagctctagttttcatgatcatcttttcctctccctttgcaaagaagcatatgtggtgaacaatgaagagggcaagggcaacccaagctcagtgttgccaagggacaaatatccaaagcccctaatattccatgatggaagactagcattcctgcctactccctcagcaactctatatatgtttatgtggtttccatttggaattcttttagccatttatagaatccttttgggcattctactcccttatggatgggcacaggcattaggggtttggagtggcataaatatgcaagtcaaaggcaatgtccctgaaaagttagaacaaaacaaaggggttctatttgtatgctcacacaggactctccttgatcctgttttcctaagcacatgtttggcaaagcctttgacagcagtcacatacagcctaagcaaagtgtctgagttaatagcccctattaggacagtgagactaacaagggacagaaaaaaagatggtgaaaccatgcaaaggcttctgaaagaaggtgatttggtggtgtgtcctgaaggaacaacttgtagggaaccatatttactaaggttcagctcactgtttgctgaattggctgatgagattgtgcctgtggccatcaatagtcatgtgagcatgttctatgggaccacagcaagcggtttgaaatgcttggatcctattttctttctcatgaatccaaggcctagctattatattgaggttctgggaaaggttcccaaggaactaacatgtgctggaggaaaatcaagttgtgaagtggcaaactatatacagcaacagttggcttgtgctttgggatttgagtgcaccacactcactaggaaggataagtacatgatgctggcagggaatgaagggatcgtcaaacaagacaagtggagcaaatgctattga

SEQ ID NO: 32155 - DNA, 1576 bp, Glycine max
  Peptide Sequence Number=SeqID_148933
atggagatggaatttttctccgattatggtgatgtcagcaggtacaaaattcaagaggtcattggaaaaggaagctatggtgttgtttgttcagctattgacagtcatactggcgaaaaagtagcaattaaaaagattcatgatatctttgagcatgtatccgatgctgcgcgtattctgcgtgagataaagttgcttagacttcttcgacatcctgatattgttgaaattaagcatgttatgctgcctccttctaggagggactttaaagatatttatgttgtttttgagctcatggagtctgatctgcatcaatatactccagcaattgacatttggagtataggttgcatatttgctgaagtattaataggaaagcctcttttccctggaaaaaatgttgtccatcagttggatctgatgacagatttgcttggcactccctcgctggatgctatatccaaggtacgcaatgataaggcacggagatacctgactagtatgaggaaaaaacaacctataccatttgcacaaaagtttcctaatgctgatcctttagcactacaactactggaaaggttgcttgcctttgatccaaaagaccggcctactgctgaagaggcattagctgatccttacttcaagggactttcaaagattgagagggaaccatcttgccagcctattacaaaaatggagtttgaatttgaaagaagaagagtcacaaaggaagaaattggagagttaattttccgtgagattctagagtatcatcctcaactattgaaagactacataaatggaacagagagaactaattttctttacccaagtgctgttgatcaattcaaacagcagtttgctcatctcgaggaagacagtggtaaatgttgtccaattatgccacttgaaagaaagcatgtatcactgcccaggtcaacaattgtacattcaaatatggtacccttgaaagagcaatcaaacattgcttcctgcataaaccggcaaacagctgaggaatataataagaattccagggatacagaaaatcctgcgccaagttacattcagggtctgcaaaaatttccacaagcaaaacctggaaaagttgttgggccagtgattccatacgaatatgcaagtgttgtcaagggtacatatgatccaaggacatttatgagaggttctgtgcttccttctcaacctatcccccctacgaatcactatcaaagatcaacctctggaaaacaagaaaggtcagcaacagaagctgacaagggtgtgtctttacaatcaaaacttgctaagcaatgtggtgtgaatgtcaaaatagcaccagagatagctataaatattgacaccaacccttttttcatgacacgagcaggaatcaacaagatagagcaggatgaccgaatagccatagagacaaagttgctgcagtcaaaggctcatcaatatggtgggattagtaccactgctcatagaaaggttggacctgttcagtatggtggagcgttccttgtggagaataagaaaaaggttcttcatagtggagaagtagtcgtctctggtg

SEQ ID NO: 32156 - DNA, 1206 bp, Glycine max
  Peptide Sequence Number=SeqID_148934
atggatgccgatgagcatataggaatccaaggcaagcaacaacataatttccttctgataacaactaaaacaataaccaatgagcctcacctgaatggcctcatcaagcaacaaaacatgggtaaagggatcacgtttcttggagagcaccctctgcaaatgccacacagcaacagcaatggaatgcaactgatccatgcaattccccaacctatgccagagagcctctctagccttagcccctcctccaatgtggggcgttccagagcccctaatcccaccgggaccgtacccgcttccacccgaaatggtcttcatatccaacgccacagtaacactcttagcacccaagcccttatacttattcaccacctgctccacagtgaccttcaattccccgagattgtagaaaacctgcaacccggtcccaacctctgcctggttcaacccatccattccgcgttccagaaccttcatcgccacgctgcgaagcaaatctccggtctccctgacccaattgagctcttcgtcgacggcgtcgatgccggagaggtcgtactcgtcgcagaggctgaggatctcgaagtggagctgggcggccttggcgagatcgagtttttcggggtcaggggcggccatgaggtcgcggagcttcttcgagaggcggagggcgcggatggagtgctggaggagctccgtggtgcggtggaggttggagagctgggcggttttggcggcgacggagcggtgcgggtcggagagctcggagcggaggcggcggacggaggactggagagaggagagcgcggatcggagggtggagagggcgtggtccgcgtggtggagggacgagagctgcgagaggagatcgtgatgccgcgagaggacttcggaacggagctggccggggagccggaggagagggcggcggaggagaaggaggtggaggagaaggaaggggagaggaaggcggagaagatgggatccgaggccagggagtctagggcggatgaggtggtggttgtggcggtggcggtggtggaggaggggtttttgaaggtggagaggcgttgcatcggagatgcgccggtggagaccggcgtcctcgccgccgctggtgacgccattgtgatttttgttttcgcgagcgagcggcgaagatcgtttagtctagtactagtacagacactgggattggatagttag

SEQ ID NO: 32157 - DNA, 2121 bp, Glycine max
  Peptide Sequence Number=SeqID_148935
atggcggtttcaagtgaaactcagcttgatggcaaaccatctggccctcccaacttgagaagcctcacttggagggaccttattaattctagttggaaggatacaaattataaacgagttgccatggctagccttgttcgtgcagtttacatgcttgaacttgatagacaggagaacagaacacaagaaaatgctcttgctccaagttggtggattcccttcaagtacaagctcacacaaatattgattgatgaaagagatgaatccatttttggtgcaatatttgaatgggatcgatctgcagcattggctgactttctaccaattagaccaaagggtgcccctaaagctgttttggcactcagaggaacattactcaggagcgctacaaggcaaagagatattgaagatgacatccgttttgctgcttgggaaagcttgaagggatctttcaggttcaaagtaactttggaggcattacaatcagtttctggtgcatatggaagcagaaatgtatgcattgcagggcattccttgggggctggatttggtcttcaagtgggaaaggaactagcaaaggaaggaattaatgtggaggcacatctatttaatccaccttctgtttcattagccatgaatattgaatatattgaagaaaaggctggatatgtctggaatggacttaaatctatgattacttcaggtagtgaagctcaagtcagcaatgatggagacaagactcatggtataagattgaagcaagtgatacaaggaatactggatgctggttttggtgtgggaaatagggttcctcatttgtatattaatagcagtgactatatcagttgcttttatttttatgctgatggaacaagagagatcactgaggaggaaaatatgggtcctgcatatgggaaaaactcagcaaagttgtttgttgtctctaaggaaaaccaggaatttcttgaggcacatagcctgaaacaatggtggtcaagtgatgcggaacttgatcaggatactcataatagcaaactcataagcaagcaacttaggtctttgaacattgctacaccttcactagtattttttttactttatccacacattgtttcatttgccatgagtcacagtaacattagagaaacgactggttttgtctggaatatactaaaatctatgcctctttcaattggaaaagctcaagtcagcaatgatggagacaatacttcaagtgttggtttgaagggttggatacctcagttatctggcttgaaggatgctggcttttgggtgaggaaatgtgtttcttatctgtatgattacaagaatgatggcatgggaaaaaggatggttgacaaagagaataaggttcctataaatgagcaaaacttgtttgttgtgtctaaggaaaaacagaaattctttgcagctcgtggcctggaacaatggtggccaagtgaagcagaacttgtgcaagtaatccataataggaaacacattagctggcagcttagatatttatacaccagtacacattgggaagcaacacatttattaagtccaccttttgtgtcacttgccatgagtctcagtaatattggagaaagggaagagtttgtctggaaatggaatagtcttaaatctatgcttccttcaagtagtgaaactcaagggaccgtaagcaatgatagacacaagacttcagatgcaggattaaagagttggatacctcaattatctggcttgaaggatgctagttttgttttgagaaaatgggttcctcatatgtatagtaacaataccgactatatcagcagtcaacttcaatctttgtactcttcaacaccttctcaagtatcacgcctatttagtaatctaccatctgttttaccagacatgagtctcagaaatactagagagaaggcagagtttgtctgtgaaagtcaagtcagcaatgataagacttcaggtactggtctgaagagttggatacctcaattatctagcttgaaggatgccggttttggagcgagcaaatggatttctcaagtgtatgctcacgagagtaacggcacaacagagaatataggtccttctctggaaaagaatgaagcctaa

SEQ ID NO: 32158 - DNA, 1332 bp, Glycine max
  Peptide Sequence Number=SeqID_148936
atgatcccacaacaagaacccgatttcaatctcaatcacctcaaattatattacggaaagctgtttccgtttgctgatttagttagatgggtgtcgtatggcaacgatggaaagcaccctggttgtgatcaatcctacattgggcgaagagagttttccttcactctggagaatgatatatatctgcgtttccaatctttccacaatgcacttgagctcgaaaactccatcaaagaaaagacccctgttaagatagatattggacctgtctacactgttgatcctgcaaaaaggaatgcctatgcacagagtggcgataataatgtctttgccccagttgagagggagttgatttttgatatagatatgtcagattatgatgatgttagatactgctgttcgggtgccgatgtttgtttggtttgctggccgttgatgactatagcgatcaaagtgattgatactgccttaagagatgactttggtttcaagcacattctctgggtatacagtggtcgcagaggtgttcattgttgggtctgtgatggaaaggcgagaaggttgacaaatgagcaaagaggagctattgctgactattttcgtgtctacaagggcaatgaaaacagtcacaagaaggtttctttgatgggtgctgctcttcatcctttcttggcgacgtcatacactaatgttctcaagaactattttgagaaaaatctgcttactggtcaaaatttacttgctaccgaggagagatatgaaaagatccttgacatgattcctgatgaatctattgcttctgaacttaggggaagatggcaagatagtaggcgctcttctagtgcaaaagaagacatcaatgttgttcgttgggaacagtgcaaacagttgctgcaatctggaaaacataagggaatgatgcaggatttgctgaaacaagcacaagggctgcgtcggtgcattgaagagattgtgttctgctttacctatcccaggctagatatggaggtttctaaacatatgaatcatttgcttaaagcaccattttgtgtacatcctaaaacaggtcgtgtttgtgtccctattgatccaaaacggtgcgaggagtttgatcctactacagtacccaccctttcacagctgatagaagagcttaattatgaaggctcaagagctgatgctgatggtgaatcgaatagaacttcgcttggaaatgcaattacgcttttcagatcatcattcttacagcctttactaaaagcctgcaaggaggagattgaaaattcctataacttaaaattgcagcagtcaaagaattcccttggttggtag

SEQ ID NO: 32159 - DNA, 282 bp, Glycine max
  Peptide Sequence Number=SeqID_148937
aagccaaagggtggtggtggtgattcagaagtggcagccacaacaaaggtagaagaagcagagggtggagacaagaactacagcctcagccgcgtagagtaccttgaaaacgacggtgtccatgatggtcgtttgaagatccagtcgtttccaccgaaacggccacgacaccttcttcaaccacaacttgctcctcttcttcttcttcttcttgttcttgtcctccatcatctctccctctttctctattatgtaatttggacacaaagaataagagtatga

SEQ ID NO: 32160 - DNA, 3375 bp, Glycine max
  Peptide Sequence Number=SeqID_148938
atgtcatccattaataggcaatcttcgaagaaatctggacgtaattcaggaggatcaacatctcaagggtcacaaagctctggcgggccaagtgttaagtttgcgagaagaacttcaagtgggagatatgtgagtctttcaagggatgaaattgatgtgtcttcagacttatcaggggattacatgaactacactgttcatattcctcctaccccagacaatcaacccatggactcatctgttgcaatgaaagctgaagaacaatatgtttctaattctttatttaccggtggattcaacagcgtgactagagcgcatctaatggataaggtcattgattctgaagtcactcatcctcaaatggcaggctccaaaggctctctatgttcaatttgtgatggcagggtcatgagggatgagaggggacgtgatgtcactccctgtgagtgtaggtacaagatttgtagagattgctttatagatgcacaaaaagaatctggtatgtgtcccggttgcaaggagccatataaagtgggggaatatgaggaagacctcacagatcagtattccaacaatggggcattgccattgccagccccaaatggttccaaacgcaatccaaacaacatgtcagttatgaagagaaatcaaaatggagaatttgatcataacaagtggttgtttgagactcaaggtacctacggagttggtaatgcatattggcctcaagatgacatgtatggtgatgatgccctaaaggcaggaatgctggatccagagaagccgtggaagcctttgagccgggtaacaccaattccatcaggcatcataagtccttacaggttacttatcttggtgagatttgtggtattgatcttttttttacattggagagtggtaaatccaaataaagatgcagtttggttgtggattatgtcaattacatgtgagatatggtttggcttctcatggattctagatcaagttccaaagctttgccctgtgaatcgttccactgaccttgcagtccttcacgaaaaatttgatagtccatccccatcaaatcccacagggcgatctgatctacccggtatggacctctttgtgtccactgctgatcctgagaaggagccacctctaaccactgccaataccattctttccatattagcagttgattaccctgttgaaaagcttgcgtgttacatttctgatgatggaggtgctctcttgactttcgaagccatggctgaggctgcaagttttgctgatttatgggttcccttttgccgaaagcacaacatcgagccgaggaatccagaatcgtattttagcttaaaagttgatcctaccaagaacaaaagcaggacagattttgtcaaggacagaaggagggttaagagggagtatgatgagttcaaggtacgcataaatggcctaccagattccataaggagaagatctgatgcatttaatgcgagagaggaaatgaagatgatgaagcatatgaaggagagtggggctgacccttctgagcctgtcaaagtgttaaagtccacatggatggctgatggcacccactggcctggtacttgggctactccttctagtgaacatgctaagggtgatcatgctggaatacttcaggtgatgttgaagccaccaagtcccgatccgttatttggaagtgccgatgatgacaagattctagacttcaccgaggttgatacacggttgccaatgtttgtatatgtttctcgggagaaacgaccaggttatgatcacaacaagaaagccggtgccatgaatgcattagttcgagcatctgcaattttgtcgaatggcccattcattctcaaccttgattgtgatcattacatctacaattgcaaggcagtacgagaaggcatgtgcttcatgatggacagaggtggcgaggacatatgctacatccaattcccacaaagattcgaaggcattgacccttcagatcgttatgccaatcacaacactgtgttctttgatggaaacatgcgagcccttgatggtcttcaaggtccaatgtacgtgggaactggatgcatgtttcgacgatttgctttatacggattcgaccctcccttcgcggacaaggacagtgacaataaagatggtaaaaagattgaagggtctgaaacaccggccatgaatgctagcgagtttgatccaaatcttgacgtgaacttactgcccaagcgctttggaaattcaaccatgttggctgagagcatacccgtcgctgagttccagggacgtcctttagcagatcaccccgccatcaagtttggacgcccacttggtgttcttagggctcctcgcgagccactcgatgctactaccgtagctgaagccgtatctgtcatttcttgttggtatgaagacaagactgaatggggagatagagtgggatggatttatgggtctgtgactgaagatgtggttacaggataccgcatgcataaccggggatggcgatcggtgtattgcataacgaagcgagatgcatttcgcggatcagcaccaatcaacctaactgatagactgcaccaggtgctgagatgggccacaggctcagtcgaaatattcttctcaaagaacaacgcattcctcgccagcaagcgcctcaagattctccaacgtctctcttacctcaacgttggaatctaccctttcacctccctcttcctagtcgtgtactgcttcctccctgcactctctctattctctggttccttcattgtcgaaaccctcagcatcgccttcttaatctacttgctcatcatcaccgtatgcctggtgatgctggccattctggaggtgaagtggtctggtgtggagttagagcaatggtggagaaacgaacaattttggctgatttctggaaccagtgctcacttggctgctgtggtgcaaggactcctgaaggtgatggctggcattgagatatctttcactctaacgtcgaaatcagcgggtgaagacgaggacgacatgtttgcagatttgtatatagtaaagtggagctcactcatggttccgccgattgttattgctatgaccaacatcattgccattgcggttgcgttttcaaggactatttacagtgccaacccacaatggagcaagtttattggaggtgcattcttcagtttttgggtgcttgctcatttgtacccgtttgccaaaggtttgatggggaggagaggcaagacaccaactattgtgtttgtgtggtcaggtctcattgcgattacactttctttgctttgggtttccattagcccaccacaaggtgctgacggacaaggtgtagggggagattttcaatttccatga

SEQ ID NO: 32161 - DNA, 1200 bp, Glycine max
  Peptide Sequence Number=SeqID_148939
atggaattgtcaaagaagacatcatttttgggtttgaaacgatgggttttgattgggataggtgtcggtgcatttattgtgctaattctgtgtatattatcgatatgggcgatgtttcggagaaagtgtaggagatctctggacaagtattctgtatcccaaataccaaatgtctcaaaagatatagatgttgacaaggttggggtgcagagttctcatgttcaaccagaaaatgtggttattcctgttcatgacaaggcaagtgataagaattcagataatgtatcagttcatttagggaagagcaaatctggtgatcctgataatatcagtcagtgcagctcaatttatcatcatgagagaggatttagttcaatgtcggccgaagaaggaagctctgggaatgttaagaagcaatctacattgtcacatggagggctggccactgcctctcctttagttggcttaccagaattttctcatcttgggtggggccactggtttacacttagagatctggaaatggcaaccaatcgtttctcaagcgaaaacatcattggtgaaggtggatatggcattgtttacaggggcagactgattaatgggactgaggtggcagtgaagaagcttcttaacaacttgggacaagctgagaaagaattcagggttgaagtggaggctatcggccatgttagacataagcatcttgtacgccttcttggatattgtgtagaaggagttcataggctgcttgtgtatgaatatgtgaacaatggtaacttagaacaatggttacatggaaacatgcaccaatatgggacgcttacctgggaggcccgcatgaaagttatacttggcactgccaaagcgcttgcttatttacatgaagcaatagaaccaaaagttattcaccgggatataaagtctagcaacatattgattgacgatgaattcaatgcaaaggaactcacttctgttgtggatttcagttacgtggcaccagaatatgctaacagtggtttgttaaatgagaagagtgacatttacagctttggtgtcctcttactggaagcagttactggaagggatcctgtagactatgcgcgccctgctaatgaggtgcctaattcttatgaactctgccagcttgccagttctaaccatactttccactggaagtcatcactgtgtttcaaatag

SEQ ID NO: 32162 - DNA, 1014 bp, Glycine max
  Peptide Sequence Number=SeqID_148940
atggcgaatgagaaggaccgtttttatgatccctttcattacaacaaccaccatgatcagcaactcaaccactcatcatcaagctttccattattctttagggacaacaacaacaattctgcaccaattagctcacaaaactttcaagggtttgatgatcataataataactcttcttctgatcatcatcacaccactttcactgactgcttacatggttccatggattacaacaccctctctagagtctttgacatgtcttgttcatcttctgaagtgatctcctccattgatgaaaaccccaagaagcctagtgcaggaggagactctgtgggggtcagggggaaccaatcaacacctaattcatctgtctcttcgccatccaatgaagctgaagcaattatagaagaagactcaaccaagagccagaaagataagcagccaaaagcgtgtgaagctgatggagatgaaaagcctaagaaagagaacaaacccaaaaagaaagagaaaaagccaagggagcctcgttttgccttcttgactaaaagtgagatcgatcatcttgaagatggatacagatggagaaaatatggacagaaagcggtcaagaatagtccatacccaaggagctattatagatgcacgagtcagaagtgcggtgtaaagaaaagggtggagaggtcattccaggacccaacaattgtgatcacaacatacgaagggcaacacaaccatcactgtccagcaactctgaggggcagtgctgcaagcatgttgtcatcaccttccttttttggttcctcttatatggcgtcaagcttaccccaagattttcttgctcagttggttccaagttatagccaaattaatgatcaccaaagtccaatgtttcaccaaaacctttcccataatctccatccacagcctcaacagcagcaccagttccaactctctcatgaccatggtttgttgcaagacctactaccatcattccctggcaaacacgagccatga

SEQ ID NO: 32163 - DNA, 531 bp, Glycine max
  Peptide Sequence Number=SeqID_148941
atgatattgaactgtgtcagagtgacagctatgcctatgatggctgttcctaggtggagatccacctgctgctgcgcttcttcttcgtcttcagtttcaaccatcaacacagaccaacttcgttctcaacttgatcaacttcatgcagaagctgatgccaccagaaccaaggcaactaatgctagattgaggcttctgcgactgtcagaggctgcagagaagcttaaaaaacaagcagctataagcattcaaaaggggcaggaaaattatgcaagggaaatgctttttcagaggaagaaagtgttgcaggctttagacaagtctaaaagacgcattgaattgctcgatgagctttccaccaagctaagtgagaggcatgctcaccttcagaaggaactgtgtatccctctcaagctattgctttcttctctctgcatatatcaatttgttctctatgctcatttgaggaggattcctgattctcatttgaaagatttgctgtcaaagaattgcaatcaacatcttttgtag

SEQ ID NO: 32164 - DNA, 478 bp, Glycine max
  Peptide Sequence Number=SeqID_148942
atggtgagacatggttggtcggagatgaactttgatacggagggtgatgatgatgatgaccgttcaaatctaagggatattaccactcccatcaccaccattccaaacttagttcccaccactcccaccatttcaacatctccattcctgaatcctaattccaaccctgacacggtctctccagcctccacaatcccatttagcactccaaccactgtgaattccccaatgttctcaggtgcaagttggtgtattgcaagtccaactgcctcacagactactctacaagttgcattggactatgcttgtggctttggtggtgctgattgctcagcaattcaacctggtggaagctgttacaacccaaattccatcaggaaccatgcttcttatgcctttaataagtattatcaaaagaatcctgttccaaatagctgcaattttggtggaactgctgtcatcattagcactaacccaa

SEQ ID NO: 32165 - DNA, 156 bp, Glycine max
  Peptide Sequence Number=SeqID_148943
atgtcgggaatgccaacaaaggactcagcagacacggaacaagacctcgagcagcaaggagagtttcaagatttgtcatccaacagaggccaggaagaacttgattgccttggaagacattcttctcggtcacccttcctctttgtcccctcatga

SEQ ID NO: 32166 - DNA, 1569 bp, Glycine max
  Peptide Sequence Number=SeqID_148944
atggttgtggaggctctagttcctcttcttgagagcaacatgcaagctatgaatgaagactattcagcttcatttaccagtaaaatgaagaaggaggggaatcacaaaacctattcttccaccagagatagtaacaataacatgcagcagggtggggaactttggactaatggacttatttgtgcttttgaattcatgaggggaaatggacctaccaagaagaaggattattgcttagggagaattggaaacagtttgaatgaatcagattcacatggagatgattttcatttgtattgcaaagaggatcttccaaggagatactggagaccaattggttgggatagaatttctgaacttgttcaggcagtgcatagtggtgatgcacagccgtttgatttcacggatgatgagagtgatgttcctgttgcagatgtagcgactccttactgggaacgcccggtggggcccacgtggtggtgtcatttggatgctgctgatccttttgttactgcctggtttggtagttctcgctggttgcatcctgccatcagcatcgctttgcaagaagaaagtagattaataagtgatagaatgaaacaccttctgtacgaggttccagttcgagttgctggaggattattatttgaacttctagggcagtctgctggtgatccatttgctgaggaagatgacattcccgttgtcttacgggcatggcaggcacaaaactttttggtgactgctttgcatgttaagggctctgcttcaaatatcaatgtgttaggtattttagaagttcaggaactgctggctgcaggaggtgctaaaaatccatgcagcattcatgaggttgtagcacacctagctagccgacttgcacgatgggatgataggaggagccatgaggatctgcatctgttcactataatactgaaccaagaaattagaagattatcaacccaggttataagagtgaaatggtcactccatgcaagagaggaaattgtttttgaacttcttaaacagttgagaggaaatgcagcaagagcattgctggaaggagtaatgaagagtacaaggcaaatgattggggagcaagaagcagttcgaggtcgcttattcataatccaggatgtgacgcaaagcacagtccgggcatggttgcaggacagaagcctcacagttacccataacttgggaatattcgggggttgtggccttgttctttccatcataactggactatttggcataaatgtggatggaatacctggatcttcaggaactccttatgcctttcttctattcaccatgatcctctttgtgctaggggtcgtgctaattggaattggattgctttaccttggcctgaaaaaacccatcattgaagaaaatgttgcactgagaaagcaagagcttcaagagctagtcaggatgtttcaacatgaagcagaaactcatgcacaagtacggaaaacggtgcctcacaaggctcaaactgcagcagttcggccaccaaatggtgcaaatcatcgtttcataatgtcaaagttgtgcagtcactag

SEQ ID NO: 32167 - DNA, 747 bp, Glycine max
  Peptide Sequence Number=SeqID_148945
atggatagaaaacaagaacaagacaagggaaactcaaacatgtctggcacggatgtagctctaatatctcccaaagtcccaaaagcagtttcaccagtttcttctgcagcagaaggggacaccttaaggcgaccacgtggccggccggccggctccaaaaacaaacctaagccaccaataattgtcaccagagatagtgctaatgcactgaaggctcatgccatggaagtgagctctggctgtgatgtgaatgaaagtttgtctaactttgcaaggagaaagcaacgtggcctttacatattcaatggaacaggctgtgtaacgaatgtaacgttgtgccagccaggctcatctggtgccattgtgacacttcacggtcgattcgagattctttcactgctggggtcaatccttcccccaccagcccctccagggatcacaggcctcacaatttacttggcaggtgctcaagggcaagttgtggggggtgctgtggttggtgctttgattgcttcaggccctcttgtaatcatggctgcatcattcatgcatgctacttttgatcgccttccattggaagatgatgaacttgctgctgcaatgcagaatcagcattaccaaaatggacgcacccaccatcttgatatttctgacttgtatgcaatgccacagaacctgctcatgaatggtacaatgcccccagagatatactcttgggcaccagggcagaacttgtcaaaaacctga

SEQ ID NO: 32168 - DNA, 453 bp, Glycine max
  Peptide Sequence Number=SeqID_148946
atggttgctatgaggcagtttcatcagtaccaggtggtgggaagggctcttcctaccgaatccgatgagcatcctaagatctaccgcatgaaactctgggcaactaacgagatttttgagaggaatcctaccaagattaagaattatggaatttggctgcggtatcagagtcgtactgggtatcacaatatgtacaaggaataccgagatactactctgaacggtgcagttgagcatatgtacaccgaaatggcgtctcgacatagggtgaggcatccatgcatccagataatcaagactgccaccatcccagctaagctgtgcaaaagggagagcaccaagcagttccacaattctaaaatcaagttcccattggtgttcaagaaggttaggcccccaactaggaagctgaagacaacatacaaggcatccaggccaaacctgtttatgtga

SEQ ID NO: 32169 - DNA, 135 bp, Glycine max
  Peptide Sequence Number=SeqID_148947
atgcgcctcccaaggaggtcattgttagtaggaagtgtgctgaggtgctcaggtgtaatggctttgagtgctcatgtagagaaaggagatacagttgctgtggagaagctgggtgctgatgggggattgctatga

SEQ ID NO: 32170 - DNA, 1299 bp, Glycine max
  Peptide Sequence Number=SeqID_148948
atgtattcattgagagggggagtgttcgttgctgatgcttacaaggtgtttgctgaaatgcgcgacaagaatgtgttcgcttggacagctgttgttgcagcacacgtggcgtgtcacgacatggtttccgcccggagactcttcgacctcgcgccgcagtgtgacgtggtgctgtggaacgtgatcgtttcggggtatatcgagttgggggacatggtggctgcgagggagctgtttgatagaatgccggactgcgacgtgatgtcgtggaacaccgtgttgagcggttacgcgaataatggcgaggttgaattgttcgtgaaggtgttcgaggaaatgcctgcgaggaatgtttattcttggaatgggttgattggagggtacgttcggaatggactatttaaggaggctttggagtgttttaaacggatgttggtgttggttgaaggtgaaggtaaagaaggtagtgatggtgtggttgttcctaatgattacaccgttgtggcggttttgtccgcgtgttcgagattgggggaccttgagataggtaagtgggtgcatgtttatgcggatagtattgggtataaggggaacttgtttgttggaaatgctttgattgacatgtatgcgaaatgtggggttatagagaaagctcttgatgtgtttgatggcttggatccttgccatgcatggcacgcggctgatgctttgagtttgtttgaagggatgaagagggcgggagagaggccggacggtgttacttttgttgggattttgtcggcctgcacacatatggggttggtgagaaacgggtttttgcatttccaatcaatggttgatgattacttgattgtgcctcagattgagcattatggatgcatggtggatttgttgggaagagctggtcttataaaccaggctgtggatatcgtgaggaagatgcctatggagccagatgtgatgtacaagaatgtggaaatggcagagctggcacttcagcggctcattgaacttgaacccaataaccccggaaactttgtcatgctctcgaacatttacaaggatcttggaagatcacaagatgttgcccggttgaaggtcgcgatgagagataccgggttcaggaaagtgccgggatgtagtgttattgggtgcaatgatagtgtggtggagttctactccttggatgagagacatcctgagacagatagtatatatagggcattgcagggattgactattttgttaagatcgcatggatacgttccaaatcttgtggatgttgctcatgcaaactga

SEQ ID NO: 32171 - DNA, 1821 bp, Glycine max
  Peptide Sequence Number=SeqID_148949
atgcacatcagatacctcttaggccaaatcaagtacactgtatgtagtcctaactcagaaggtgcaaatagtttgaaattatgctacagtgctacacggattttcattgggtccaagaaggaggatatcattgctatgattttgaaggtttctctcattgtggttctcctagtgatatgctcctgtgttgtggaagccatttctaggaatcacaatcaaaatcccaaccacaacaatatcaacaaaaatggatcttctctggctgcaataaagtttcctgattatccaagtttcaatgatgtctcttcttcaggggacgattgcagcttctcaaattctgagcaactcggacattctggacctaccatgacatcgggtgaagaaactgatgaagagagtgaagcttttccagcacaaaaaccacaccagaatttggtgaaattccacttgaaacacaggtcagggagcaaagatgctgagccgaaacaatctgtggttgatttcacactaagtgatttgaccagaattcagaaccttcacagaagggtcatagagaagaagaatcaaaacaccatttcaaggctgcagaagtcacagaaggagcaaccaaagcagtcctacaagccggtggttgctgctccggcagcttcacggacaacaagtccagtttccgggcagcttgtggcaaccttggaatccggggtgagtcttggctctggagagtacttcatggatgtgtttgtggggacacccccaaagcatttttctctgatacttgatactggtagtgaccttaattggattcaatgtgttccatgcattgcatgttttgagcaaagtgggccatattatgaccccaaagattctagctcttttaggaatataagctgtcatgatccccggtgccaattggtttcagcccccgatccacctaagccttgcaaggctgagaatcagagttgtccatacttttattggtatggtgatggttccaacacaactggggattttgcattggaaactttcactgttaatctcaccactcctaatgggacttccgagttgaagcatgtggagaatgtgatgtttggatgtggtcattggaatagaggcctatttcatggtgctgctggtttgttaggattagggaaaggaccattgtcatttgcttctcagatgcaatctctctatggtcaatccttttcctattgtcttgtggataggaatagcaatgcaagtgttagcagcaaattgatttttggtgaggacaaggagctgctcagccaccccaatttgaatttcacttcttttggtggtgggaaagatggttcagttgacacattttactatgtccagataaagtctgttatggttgatgatgaggtgctgaagatacctgaggagacttggcatttgtcttcagaaggtgctggtggtaccataattgattctggcaccacattaacatattttgcagagcctgcttatgagattatcaaggaggcttttgtgaggaaaattaagggctatcagcttgttgaaggccttcctcctctaaagccatgttacaatgtgtctggaattgaaaagatggagctacctgactttggaatcttgtttgctgatgaagcagtgtggaattttccagtggagaattattttatctggattgatcctgaggttgtttgtttggctattttggggaatcctcgatctgccctttcaataattggaaactatcagcagcagaatttccacatactgtatgatatgaagaaatccagacttggctatgcaccaatgaagtgtgctgatgtttaa

SEQ ID NO: 32172 - DNA, 804 bp, Glycine max
  Peptide Sequence Number=SeqID_148950
atgccaggctaccatctggtcggttcatgtaatgggttgcactgtggggttagcgaaataccagaaggataccgtgtttgtttctggaacaaggcgacaagggtgatatccagagaatcaccaacgctgtctttttccccgggcattggtcgtagaacaatgtttgtgtttggctatgatccgtcaagtgacaaatacaaggttgtagcaattgcattgactatgctctcacttgacgtatctgaaaagactgagatgaaagttcatggcgcgggtgacagtagttggagaaaccttaaaggttttcctgttcttgggactttacctaaagttggtggagtgtatctgagtggaacccttaattgggttgttattaaaggaaaagaaatcattcattctgaaatcgtaattatttctgttcacctggagaaggagacttgcatatcactgtttcttcccgacgatttttgctttgttgatacaaatattggagtttttagagactcgctgtgcgtttggcaagatagcaacacccatcttggtttgtggcagatgaggaagtttggagatgacaataaatccatgattttaccattgtgcatgtctgacaatggagacttcttcatgctgaaattcactagaaatgctgatgatgaataccaaacaattctgtataaccagggggatggtaagtctcaagtttctgtcgttccctcaggtagtttcataactttgttgtggcgcaacctcaatgattttcaccaagaagtttggtcataccttattgaaattctacagatgtga

SEQ ID NO: 32173 - DNA, 1167 bp, Glycine max
  Peptide Sequence Number=SeqID_148951
atgcacccttctggtacgccttcccttcctcatcctccaccatgcacccaatcctctgaagcagagtgccctgatcatctctgtggtcaacacatcaccggcacgcttgtgaaggttggcgtaataggtgggagtaggcgaaggcgtgaactcaaatccaccaaggaaacttcgcttcctcatctctctcagagtggtgaaaatgtcgtgagtaacaagcgcaagatgctgcacaccagcaccttcgttgtgttccaaataagtctcaatctggctcttccgtttcgttccgtaaacaggctcgttcagcgccagcaacaccgtctccgagttgttcgccagaaacaccgagttcaacccgctctcgctcgttcccacgtcctccgcggtgaactccgcgaactcgtggaatccgctgaagcctttcaggtacctgaccgccggcgccagttcgggcacgttcccgacggcgtggtccagccgccgaatcccgtagtccagctccggaaacgaccacgacgcggcctcgaatcccggcaggaaccaccgcgacggatccgcccgcggcgcggcgtccttgtggcttacgtagcggagcacgacgtcgccgtagaggcgtacctccgcgaagccggtgcggccgtcgaggagagccggtggagacgccggctcggcgccgttggcgacgctggcgttgaaggcggcttccgcgtcggctacctccaaagcgatggcacggacgccgaagccgtgcttggcggcgaaggcgaggcaggtggcggcgtcgaaggttggaagggaggcggtggaggcgcctccggtggcagcggagaagaggaaggagaggtcaccggagcggaggaggtaggaggcgtggatttggtttccggtggagagatcggattttgccacaataggcattccaagtccccaagagaatcggcgggaagagttggtagcatcggtgcaccagaagccgatgtggtggaagcggttaacttgaaagcggtccgatttagggttggttcggacgaagtttgtgaaaccaacgagcttaaacccggtttggacattgctggactctcttctctcacgctcctcttcctgcattatctttttccaaaattactaccacgtatcaacaaatttatctttataatcctatga

SEQ ID NO: 32174 - DNA, 401 bp, Glycine max
  Peptide Sequence Number=SeqID_148952
taactttcaaaggacccaggaaggctagagggaagagatctgaggccccttccatagcaccattagaggcaccaacaccttcttcttctacacttccttcttcttcctccacagatatcccaatgattcctcctacacccacacagataccactaccagctcctctttctacaggagaccagccttcttcctctggagggggtggggcctccacatcccaggagcctgtgactaaggaggccacagcaccagcaccatcaccagcagcagtagaggaggagaccactccagctcagacccctcaaccatctccaccatctgcacctgctccagaggagactcagctatcatcagcactggatcttaatgaagaccagccacaagaggagcaggacgtttaa

SEQ ID NO: 32175 - DNA, 1566 bp, Glycine max
  Peptide Sequence Number=SeqID_148953
atgacacagcgagctgcagaaaacacagagaatagcttggagaagatcaagcgccagctcgcttccgcttccggtagaaacctgttgcagggaccgcttctcaagagatctgaaaccctgagaaaatggaacgagcgttgggtgatcttggacccgacaacggggagaatggaatacaagataagaagaaacgaaccttctgttaaaggaacgattatatttgacgccaatagcacgatcaccatatctcctgtgaatttccacgggcttccaaagtatgatgggtgctgcttctgtatcctttttgtcatttttatcacatttaatattgggacaccacagaaaaaggattacttcctctgtgccgagactcctggtgcagctagagcgtgggtgtcaacgttacatgcaactcagttggttctaaaagcccataaagaagctgtgaattccttaagtgggaatggctctacaaaattaggaactgttgcaacagttgttgctgcagccaattcaacagccttggaatgttcaaaagaaattgaagcagcaatgcagatttctttgcgaaatgctctgggaatgatgaataataggactactgatggtcctatggatgatttaacaataatgaaggaaacactaagagtgaaggatgaggagctacagaatttgtctcgagaccttcgggcacgtgattcaactataaaagatatagcagataaactctctgagactgctgaagctgctgaggctgcagcatctgctgcttatactatggatgagcatcggagaattgcttgtgcagaaattgagcgtttgaataaagattctgagaagcagcaagagctgtttacacagaagctgaaggagtctgaagaaaagattgggggcttaagcaaagaaagagagcaattaatcaggcagagagatgctgctattcaggaagcaaatatgtggcgttctgaactggcaaaagctagagagcatgatgtgatcttagaagcagctgtagtaagagcagaagaaaaggttagggttgcagaagcaaatgctgaaactaggataagggaggctgttcagagagaatccgcagcattaaaagagaaggaagagcttcttgcatatgtgaattttattgagtttgaatatgtatatcagctacgaaatgtggagcttcataaaaccaaagttgacatagcagatatttttcttttcaacaggcaacacattgatacaactcaagtttttgagaagacagagtcatgctcagatacaaagcatgttgaccccactgaagaaaatgttgataaagcatgcttgagtgtttctagagccatccccgtccctgcagagaatgtagtccacatggcaacggatcaggtgaacattcagccagttggagacaacgaatggagtgatattcaggctacggaggcacggatagctgatgtaagggaagtagcacctgaaactgatggaagcagcttggatattccagtggttaaccagccgggaaccaatcatcaccatgaacaaggagctaactctttccatcaaccctga

SEQ ID NO: 32176 - DNA, 1251 bp, Glycine max
  Peptide Sequence Number=SeqID_148954
atgggtgggatattgaagcagccaggcgcgtttgcaatcacgccgcacaaagtatcactctgcatacttcttaagatctacgctccgccggctcagatatcggtccccttccctttctcttccgttgcacagcacaatcgccttggcttgttcttgttagccctcaccaagcttcccgccttgtctgttgtctcttactgggttctcagtaaatacttgttggagaagaaattaagaaactcaccgctgtctcgcataaatgcgctggtgcatgcaacttgctttgctgatgcatcaagctcatcagatgcagcattagcatatgtaaagctcattcaacatttagcagtatttaaaggatacaaagaggccttttttgcccttaaaatagcagaagagaagtttctatctgtctcaaaatcacaaatcttactgctaaagttgctgctgcttcatgagcatgctttacatcgtggacaattaaagctagcccagaaactgtgtgatgaacttggtgttttggcatcaagagtaactcgtgtagatatggaactaaagacagaagcaagccttcgccatgctcgtacattgcttgctgcaaatcaattccgagaggcagctgctgtggcacactccctcttctgtatgtgctacaaatacaatcttcaagttgagaatgcttcggttcttcttttacttgctgagattcacaagaaatcaggcaatgcccatcttggtcttccatatgctttagcaagcctctcattttgcctctcatttaacttggaccttctaaaagcttcagctacacttactctagctgagttgtggctctctcttggatcaagccatgcaacaagggctctaaaccttatccatggagttttcccaatgattcttggtcatggtggtttggaactccgctcacgtgcctatattgttgaagcaaaatgctatctgtgtgattcaaacttcaatgtctttgaaaattatgagatcgtggtagattcattgagtcaagcatctgaagaactccaacttttggagaattacaagcttccaagcggtttcattggtcctttttcattttttcatgaactggcatctgaagctttctatctgatggccatggtatatgacaaactagggcaattagaagaaagggaagaagccgcagcttcatttcagaaacatattttggctctccgcaatcctcaagatgaggatgatcctcttgttagtgtattttga

SEQ ID NO: 32177 - DNA, 2229 bp, Glycine max
  Peptide Sequence Number=SeqID_148955
atggcagtagtggctgatggcaggagtttctgggctgtgggcacaatgaagatatctagagcatcattagtgccaacatcaagctacatagccaaaccagctgcctcatggcttgatgattttcttgtatggatatcacctgaagcttttagttgctgtcgaaaattcacaaatgactcttattgtccacctgatgatcagccaccttgctgtttaccagatgaagggccatgtgggttgggtggagtgtgcaaagactgtacaacatgtttccgccactcggatttggttaatgatcgtccatctacagcacagttcagagagaagcttccctggtttcttgatgcactgccatcagctgattgtgcaaagggtggccatggagcttacaccaacagtgtagatctgaatggttatgaggggggtgtcatccaagcttctgagttccgtacttatcacacaccacttaatagacaaggtgactatgttaatgcaatacgagctgcaagggacttttcggcaataatttcttcgtctttaaaggggtcgatgatgtcaggaaactcgagagataacttgatcctcggaggattgaaactacatgcgaatcttccaaagcatggaaaggaatggaaggcgacagagagagtcaacaaggatgatcagcataagaaggagtcggtcaaggagaagccaattgagaaagacgaagataaaggcaaggtagcaagatatggtgaaaagatggatattgaggaggagctttgggtggcagcactctcaaatcaatccattatgaggcaaaaggcaataactaaatggattgaggaaggggattgtaactctcggtattttcatttgattgtaaattggaaatgccaatacaacatgcttagaggagtgtttgctggtaaatgctggttagaagaaccaagcagggtcaaagatgaaactagacaattcttcaaaaggagatttaaggaggtggagcgggagaggcctaggttgaatcgggtcagatttaagactatctgtcagcaagataatgatcttttggtggcgcgctttgaaaagaaagaagtgagggctacaatgtgggatcgtgggaatgcgaagagccccggaccggatggactaaatttcaagttcatcaaggaattttgggatattctcaaaacagatctgcttcgctttctggatgaattttatgctaatggagtattcctgaaaagaagcaatgcattcttcctagctctaatccctaaggtgctgccaaccataatagatgaacgtcaaactgttttcatggagggtaggcatacgctgcacaacgtggttatagccaatgaaatcatggaagaagcaagaagcaaatgggttagatggattgaaggatgcttgaaattaacctcaatatctatactggttaatgggagccccacagatgagtccacccctcaaagagagaactcaagtttcttggtaggaagaaacaatgtggacatcagtctattacaatatgttgatgatacgattttctttgggaaaacatcgatggcaaatgtaaaaacaatcaagggtgactttgttaaagtcaatcctgaactcaattcctatcttttttcagctgctacccaccacattttccatcttttgttagaagcctttgtaaagaaggtggtggataggctggagaaaggtggcttgggcgtccgggacttggtaaaattcaactatgttctacttggaaaatggcactggaacttatttcatcaccatggagaattgtgggtgcaagttttggactccaaatttggaaggggggctagtttaaaagtgggacaaatggaaaattggatgtggatcaaaggtgaagtttttggaaaatggggtttcattgttggagaagtacccaagaatgtaccgcatttctcaacagcaacaacaatatatccagtagctaggagtggcaacaaacggagattgggaatggcagttccagtggaggagattatttttggaggggcgagccctggtgcagcggtaaagttgtgccttggtgacttgttggtcatgggttcgaatccggaaacagcctctttgcatatgcaaggagggtctaacagtacaagttcagcaacaagacatttggatttgggagggggacccaagtgggagctacacagtggggaatgcttacatgttgctcaatcgatatatgatagatga

SEQ ID NO: 32178 - DNA, 216 bp, Glycine max
  Peptide Sequence Number=SeqID_148956
atgtctgaggaaaaacaacttctctatagtctcttagccccaaagatttaccagtgtgtcaaggaagggtcataccatcttcatgagcaaaactaccttcagaacacagctagaaaacaaagcaaaacacttgcaatttgggtgcggcgatcacacatgcagaaaacaggaatactagattgtaaaccatttgatacccatatgaccaaaatatga

SEQ ID NO: 32179 - DNA, 2133 bp, Glycine max
  Peptide Sequence Number=SeqID_148957
atggagtatggtgcgtttgggagcttgtcggagtgtgaagaagatttgatcgaggagttgctggaaaaaggttgctgggtggaaacgaatgggagcagcgaggcacagtacgacatagagcaagaattagccatgcccatggggaagaccacatggtggattggacccaaggggcctgtgtctgggtcatcttcatccgtgaaagagagattggtggttgcggtgggctacttgagagaatacacaaagaacaacaacgccgccaacgtgctcattcagatatgggttcccatacggaggatgacaggccttcttgccattggccttgggcccgatgagtcggtttcggttgcttttccttttccgaccaacatgaacatgaacatgaagtcgaacgtaaacattcggttctttagaagccatgagtacccgcgaattccttatgaatatggatccttggcacttcctgtcttcgaaagaggcagtggcacatgcctgggtgtcctccagattgtaatgccagcagctcgctgggacacaatcaactatctccctcaacttgacaacaataataataataatgctttccagggcatgattccaggtggtgttgtaaaggtatttgacgaggatgaggtgtacgaagcatcagtgaacgagatgatggaggtggtgaggtgtgtgtgcaagacgcagaatgtgcctttggctctgacatgggctccttgcgtccaacaactatgtgtggattgtgggcattcaagggatgagaacaactatgtgtcgattgtggacagagcgtgttttgtgggggatggtcagccccagctattggggttccaggaggcctgctctcagcaccaccttttccgcggacaaggaattgtcggtacggccttcacaactgccaagccctgttttgctatggacataaccgccttcaccaaggccgaatatcctctctctcaccacgccaacatctttgacttgcattctgccgtcgctattcctctaaggacttcttcttatccccattttgattttgtcttggagttcttccttcccaaacactgccctgaccacaacctcttcctcaactccttatctattctccttcaacaagcttgccccaccttccatctttctgctcccatccatgatgatgtatttacctccttgccctctgaatcccagtcccagcaggcttcctggatcgcacatatgattgatgcccaatcccaacacaaggacaatgggaaaggtgtgtgcttgtccttggatttcctggaagaagaacccaaagaggagttcaaagtcacaacaactcactgtaactgggacaccactgccactagtacttatcattcacacgaccatgtcgtgttttcagattttggagaagaatctcaatctcaatctcaatctcaaactcacacatttggtgtgaagcgtggcagaaaaccaggagagaagagacgaaccaaggccgagaagactatcagcttgccagttctaaggcaatactttgcaggaagcctaaaagatgcggctaagagcattggcgtgtgtcccacaactctgaaaaggatatgcagacaacatggcataacgcgatggccttcaaggaaaataaagaaggtggggcactctttgaagaaactacaacttgtaattgattcggtacagggtgccgagggtgccatacagatcggatccttctataacagttttccggagttgagctctagagcttctcaatcatcctctcctgcagcacaaagccctcctcatgttcctcaacaacccttgagagtgaaggctacttttgcggatgaaaaaatccgttttagcttgcaaccactttgggggttcacagaattgcagttggaaatttcaaggcgcttcaacctaagcgatgttagcaacgccaacaacgtggttctaaagtatttggatgatgacggagagtgggttgttttagcctgcgatggcgatcttgaggagtgtaaagacttgcatacaacgtctcagagccgcacaattagactcgccctatttcaagcttctcctcttaataatcaaccaaattcatatactttcgccaacaccaccagcactccttcttcttcttaa

SEQ ID NO: 32180 - DNA, 2046 bp, Glycine max
  Peptide Sequence Number=SeqID_148958
atggcaatgcaaggttgttattgtcacgtctatacgaagttggcaactcaaagaagaacactggacaatcttagtttttcaggctcaatttcggttaaaaaattgtcaaagaatgaaaggaccacagggaacaatcaatttcataggttactcgtgaaaatgcgacagacagaaatgcctgccgcctcagagtatggaacaaatgagttagtgaaaagaaagacaatgttagagaagacagtgaataatggttcagcaacttcaaaggtagtgagaaaaaatggtatcccagccttgagcaagacaatgaaatctagaagctcattggaagagctaaaggttttagccacagatgaaggtttcagttgggccaatgaaaattacagttcctggcagagatctattgatgtttggtcttttgtggcttctttgcgtattcggattctgttggacaatgcaaaatgggcatatttgagaggtttcacagaggcaaagcagaaaagcagaaggcggaaaactgcctcatggttaagagagcgtgtattgcagcttggtccaactttcattaaacttggccagttatcatcaacaaggtcagatctatttccacgtgaatttgtggatgagctcgcaaaattgcaggacatggttcctgccttctctcctaagaaagcaagaaaattcattgagagtgaattgggagctcccattaacatattatttgaggagtttgaagatcggccaattgctgctgctagtctcggtcaggttcatcgtgctattctgcataatggagaaaaagtagtcatcaaagttcaaaggcctggtctgaagaagctgttcgacattgatttgaaaaacttaaagttgattgctgagtattttcagagaagtgaaacttttggtggtccacttagagattggattggaatatatgaagaatgtaaaactattttgtatcaagaaattgattatataaatgaaggaaagaatgctgacaggttccgccgagattttagaaacataaagtgggttcggatacctctggtatattgggattatactgcattaaaggtgttgaccatggagtatgtaccaggtatcaaaatagactatgtggataccttaacttcgcgtggttatgatcgattacgtatctcatcacgtgctactgaggcatacctgattcagatattgaaaacaggtttctttcatgccgatcctcatcctggaaatcttgctattgatgtggacgaagcgattatttattatgactttggcatgatgggagagatcaaatcttttacccgggagagactgcttgaacttttctatgctatgtatgaaaaagatgccaaaaaggttatgcaacgccttatagagctcggagccctccaacctactggggacctgtcatcagtgaggagatctgtgcagtttttcctggaccacttgctaagccaggcaccagatcaggagcagaccctttctgcaatcggggaggatttatttgcaatagcacaagaccaaccattccgttttccatccacctttgcctttgttctaagggcgttttcaacacttgaaggcataggttacacactcaatccaaatttctcctttgctaagattgctacaccctacgcacaggagcttttagagataaggcaaaagcagcgcactgcgccacagcttgtggaggagataagaaagcaagcagatgatgctacaacctataccatgtctatgccatacagagttcaaagaatagaagagtttacaaagcaacttgaggcaggggatctgaaacttcgggtacgagtgcttgagtctgaaagagctgctcggaaagcaacggctttacaaatggcaactatgtataccgtattaggagcaactctgctaaatcttggtatcactctgagcagccaaggcaacataactattgcgaatggatctttcattggtgcaggtatttttatgacactatttgtcagatccatgcaaagggtaaaaatgcttgataagtttgagaaaatgatataa

SEQ ID NO: 32181 - DNA, 1875 bp, Glycine max
  Peptide Sequence Number=SeqID_148959
atgccccaaaccgagattccagaatggtttgacttggttgataatattaatggaggaaatcctcgtttctgggcccgtggcaagtttcctatcattgcactagcattggccttccaagatgtgagtgaaagggcgagacaatctcgccgtcaacttgttgagctacacctacttatcaacggtcgatgtgttcctcgcaaagggtattacaacttcaaaattgcagcagatcacgtcttaatttgtgacctacgacttctattcagtgataaggaatggcttggccttgatgcgtttctcgagcacgagtggaacctggtgcgggtttcatacgaagccccgtccaccttgacgctaagtggttggggagtctttgtgtacgaagaaggagccaacatggaagatgtccaattcatgtgtcccgatcccaagtattcggacatgtctccgacaaaattagttccaacgacgaaagatcctaggcaggaacgaaaaaagatgatagacaatttatgcctagacgaaatgtttgatgggatgttgatggaaaccatggactacgaagaaagagacgattttgctgataaagattttgcaatagagcaaatgcatattctaatgggaggattaaaggacttatccacgcaagctaaggatgaattggaatccaatggctcagctttacaagataataataaaaactccaccctaacttggttgctagatacaatcaagaaaatagataatggagaagctgagcctcaaagcttttaccataaggatctcgcattgattgaactaaaggataaagtgaagccacctatggatgcagcagaagaagcttcaacctctggtcatcagttgcaagaaatgatgagagaaatattctatgatggaataactgatggacttcttgaagcacagaatatatttccttctctagatattgttaaaatcagaagtgctgccatgaacaagggcaatagggttgcatggtcagccgaagggaatgtgatactacccacggttgaaatgaggacatacacgagtggagttctcggtggactcgttgaagcaaaggaggtatgctttcctgatttggacatatgggcaacactaaatactgtggtaagtaggagaggcattcaagcatctttcgcagcaccacctacggttccacaattggattggaccacaatcgtacctccttcgtcacgctctcaggatcctttgttggaagcattcctgatgatgaagcctgaaagctcagagtctgaggccaagagtaaactcttctggaagttcaatgaggaacaccaagctctacggaacaaatatgtacaacttgaaaatgaaaatgctgctccggataaagatataagtgacacagccagcagcccttggaaaaatcaatatgaagaattgattcagaaattcaacactcaatccgatgatgagtttattgcaaagaagcatgacattattgcctgcaaatgtgacacagagtatgagaaggtgtgtgctgttttgaaaggaagagctgaagaattagggaagctatacaatgctgggattgaaggcttccagaactcacaggagtttcaggatctgataagtgcaatatacttgagtggacttagggatggactccttgaagcacaagccgtcttacttgctctcaacatggacagaaaaactccagtgtttaaggagaaagaggaggaacatgttattgatcatgatgttgccgttaatgaaagcgccattgtagcggatattccaatccctataggtccagatgttgacaatcccattcgtgacactgataacccttccagctcaaaggattttttcaattggcaggaatttatttaa

SEQ ID NO: 32182 - DNA, 915 bp, Glycine max
  Peptide Sequence Number=SeqID_148960
atggatgtggccaagttacataactctgatgatgatgatgacaagaaagaagatgaagatgtgcttcctgggtttagattccatccaacagatgaagagcttgtggggttttatctgagacgaaaggtggagaataagcctctgagaattgaactcatcaaacagattgacatctacaaatatgatccatgggatcttccaaggagaaaatacaggaacagcataaggcctaatagagtgacaggttctggattttggaaagccacagggattgataaacctatatactgtgttaaagaaccccacgaatgcattggtctaaagaaatcattggtctactatcgtggaagtgctggtaaaggcaccaaaactgattggatgatgcacgagtttcgcctcccacccaatggaaaaactagcaataatccacaagctaatgatgctcaagaagctgaagtgtggacgctatgccgaatattgaaacgattcccctcttacaagaagtacacaccaaatttgaaagactcagcagcagcaccaataatgacgaagccaaattaccccacaaactcttcaagtacttccaaaacatgcagcttagaatctgacaacggcaagccatacttgactttcacaaactcattatcaccattactcattcaacaaaatgaaaggaaaccggctattaatggacatgttgacgttgaacgtaaccacttatttctaggtcaattaggcattaatgtagctcaggctccaacatccttgtcttactcaagtttttggaatcgtcatcatcagaataatgtggaatttgctaatgagaattgggatgatctcacgtctgtggttcagtttgctaatattgatccatcccgggtttctgatcattgtaaagaatttaatagattttaa

SEQ ID NO: 32183 - DNA, 4536 bp, Glycine max
  Peptide Sequence Number=SeqID_148961
atggctgattccggtactgatcgagttgaggccgccttagaccgcctcacttcccgcattgaggacctcttgcagcatgtgactccatccgcttctcccccttttcctcctcgcagtctgattcctgcacacacacatcgaatgaaattagacgttccgagattcgatggaactgatcctatgggctggatttttaaaattacacaattctttgagtatcacggcacacccgattctgatcgtattaccattgctgcgttttatatggagggaagggcccttgcttggttccaatggatgtcaagcaacgaccaattcacctcttggcccgtatttctacaggccttacagaccaggtttgctccgtccaattacgaggatccttcaggatccctattcaagctcattcagaagaccacagttgcagaatacttatctgagttcgaggagctcgcgaacagggtcgtcggcctccctgctccgttccttttaagctgcttcgtttctggccttgcgccggagattcgtcgcgaggtgatgatcaaccaaccgcttacggtggcccaagcggcgggtcttgcgcgtctccacgaggagaagttgcgcgacctccgcttcgatttccgccagcccaacagacctcgccctcttcagctaccccctgtaaccccaccgccgacttcgccgctcccaacctacacacctccgcgcgcatccacccttccccctttgcttcctctgccgtcacgtcctaacccgccaccgccaccgatgtttcgtcgcctgacctcggaggaactggcgtcgcgccgtgagcgcggcctgtgtttctcatgtgatgagaaatttcacaagggccatagatgcgcccctagggttcatctcctgatagccgatgatgaagacccccttgaccccgcgggttctaatttaaatcccccagaccctcccgacccgctacccggcccattggatagacccgactcaccggcccacctcagcatcaactccttggcgggtcatcttgcacccgagaccttgagactcctcggaaccatctccggcgttcccgtcctggtgctcattgacggtgggagcacccacaacttcatccaggagccactcgttcaccaattgggccttccttgtcaatcaaccagcccattaaaggtcatggtaggaaatgggcaacatctgcaatgccatacgatttgcagttccaccaccctcgtccttcaacatcattcgttcaccatggacttatatgtcctacccattgccggcgctaacattatattgggtgtccagtggttacagtccttgggcccagttttaactgattatacaaagctcaccatgcaattctttcatgatgacaggttcgtggagctccgcggcgaccccgacgcccacagggaactcttatcatccccacaattccggcgtgtctgccgccatcaaccgcagagcctctacttccacatcacagtgcttccggaggattccgcccaaacattgaccaagcccgttgaccctcaggttcaacatcttcttcatcaattcgccattctctttcaagaccccaccactcttccgccggcaagagacacggaccatcaaattcaccttcttccacatgcgaccccagtgaatgtccgaccatacaagtacccatattaccagaaacgcgaaatcgaagctcaggtggaaactatgcttcaacggggcttaattcaacccagcaagagccctttctcgtcgccggtattattggtaaagaagtctgataacacatggcgcttctgcgtggactatcgcgcattgaatgccctgaccgtcaaagatcgttttccgattccgacgatcgatgagcttctggatgaactcggcggtgcgtcttgcttttccaaattggatttgttgcaggggtatcaccagatacgcatgcaaccggaagacattctgaaaactgccttcaggacgcatcacggccactttgaattcaaagtgatgcccttcggtttatgtaatgcgccttcttcattccaggcaaccatgaacactcttttccggccgtatctccggcgattcatcatcgtgttctttgatgacattctcatctatagtggttccctcagcgatcacttacgtcatcttcaggccacatttcagatactctatgagaatcattttgtgcttaagctctccaaatgcctctttgcacagtcagaagtcgaatatttgggtcatctggtttcacacaggggtgttcaacctgtcacttcgaagcttgatgccattgctcagtggccaataccacgtttagtccgtgctctacggagctttcttggcctcgccggattctaccgcaggttcattcggggttatgccacccttgtcgccccgcttgtaaaggccaccacggttgaacctctccagtggaactcatccactcaggcagcttttgacactttgaaacaagctctgacctccgctccggtcctttctctccctgattttcaattgccttttacaattgaaactgatgcgtctgcaatcggaatgggggctgtattgtcccaacggggccatcccatagcttactttagcaagccttttagtccaaagttgcttcgagcctcaacttatgttagggaactgtttgccatcacggccgccgtgaagaagtggcggcaatacctccttggccatagcttcattattttaacagaccatcggagcttaaaagaattgatgagtcaggttgttcaaacacctgaacagcatacttaccttgcaaggttaatgggctacgactaccagatccaatgccgctccggcagtcacaatcaggccgcagacgcactatcccgtttgccggaaaacccctctcaggccctcctcatcctctctgttccatgtctcacctttctggaggagcttcatacccagcttgctgcgaattcttctttccaacatctcttccaagaggtacgggatacccccgacaaacaccccgatttctccattgccaacaagcttttgctatataagggtcgcatctggttgccgtcggacataccaatcattaagaccttgctcacagagtaccacgccacccctacggggggccatgccggcgtcgcgaaaacggtagctcgtctcaccaccaatttctattggactggtctacgagatgacgtcatgagcttcattgcaacctgcgttgactgccaggtcaccaaatatgagactaagaaaacagctggacttctctgccctctccctgtccctactcaaccttggtcggacctatccttggatttcatatgtgggttaccaccgtatcggggcaacacgacgatcctcgttgtcgtggatcgcttctcgaaaggcatccacttgggcatgcttcctcaaagccacaccgctcttgctgtcgctcggctctttttggacttagtggtgaagatacacggctttcctcggagcctcgtttcggaccgtgaccctctcttcattagtcagctatggcaagaattatttaaatccagtggtacccagcttcggatgagttcggcatatcatccacaaagcgatgggcagacggaggtcttaaatagagtagtagagcagtatctgcgtgcgtttgtccacaggaaaccgtcaagctggggaaaattattaccatgggttgagtggtcgcacaatacctcctggatggccagcacaggcaccaccccttatgagattactttcggccggaggcccttcaattttcccgattatcttgcgggttcttctaaaattgaggcagtggaggacatcttaactgatagagacaataccttccagttggttcgcaaaaagttgctgaaagctcagagcaagatgaaactttatgcggatcaacatcgtcgggatgtacagttcgccgttggtgattgggtcttggtccgccttcgtccttaccgacaattttctgcaaaagatacgcaccacacgaatgagaaactagcccgtcgctactatggtccctttcaagttgttgctaagctcggacccgtggcatatcgtctagcgctaccagagggggtccggctccaccccgtgtttcattgctcgaagcttaagccctttcgcggggatccagactcctcatcccctctgcctttaccagccactttccatgaaaatcaaccactcgtctctcccctctctatcctggattttcgtcgggaaacctctgatccccagagtccgtggcaagtcttggtccagtggcagggtcttccaccggaggaaacgtcatgggaagattggcatcagctttgccaggattatcaccttgaggacaaggtgatcctgcaagggccgagggatgatacgagtacagaggacacagagcttgggaaggaagacacggaggaagaagatgatctgagtaagagggtagaagaggatagaggggtgcaaagagaaggaaagcccaaaaggaaggttaccaagcccaattatctaaaagattatgtttaa

SEQ ID NO: 32184 - DNA, 5175 bp, Glycine max
  Peptide Sequence Number=SeqID_148962
atggcaaaacaacatgaggaagagaccttcggtttcacctacgatgttttcatcagttttagaggagaggatacaaggaacaattttataggacatcttcgtaaagagttgtcccggaaagggatgaaaattttctttgatgatagggacctgccggtggggaatgttatttcaccttctctatccaaggccattgaagaatctaagattttaatcattgtgttttctaagaactacgcatcctccacatggtgccttgatgaacttgttaagatcctggagcagtccaagatcagtgagatgaaacaacttgttttcccagttttttaccatgtagatccctcagatgtacggaagcaaacagagagttatggtgagcacatgaccaaacacgaagaaaactttggcaaagcctcccagaaactgcaagcttggaggacagctttgtttgaagcaagtaacttccctggccaccatattaccactcgctccgggtatgagatcgattttattgagaagattgttgagaaggtccagaaaaatatagctcctaaaccattatatactggtcaaaaccctgttggacttggaccccgcgtagaagaggtaatgtcactcctagacatgaagccttatgatgaaactgtacgcatgttgggtgtatggggacttggtggagtcggaaaaacagaacttgccaaagctttgtatgacaacattgtgcaaagctttgatgccgcaagttttcttgccgatgttagagagaagttaaacaaaatcaatggcctggaagatctacagaagacacttctatcagagatgcgagaggagctagatactgaattgggcagtgcaattaaaggaatgtttgaaataaaacgcaagcttaaaggaaagaaagttcttttggttcttgatgatgttgatgacaaagacaagttagaaaagttggcaggaggacgtgattggtttggttcaggtagtaggatcattataacaacaagagacaaagatgtgctaattgctcatcaagttgataacatttatcaaatggaagagctcgataaacaccattctcttgagctcttttgttggaatgccttcaaacaaagccatcctaaaacaggctttgaagacgtgtctttgcgtgctatatatgttgccaagggtcttccactggctttaaaagtaataggctctgatttggctacacttgatgaagaaagtttagaagattggaaatgtgcattggaagaatacgagaggactcctcctgaaagaattctagacgtgctcaaaaaaagctacgatagattgggtagcaaaccaaaacaggttttcctggacatagcttgcttcttcaaaggggagaaaaaagaatatgttgaaaatatacttgatgacattggtgcaattacttacaacattaatgtacttgttaaaaaatctctcctaactattgaggatgggtgcttgaagatgcatgatctaatacaagatatgggtagagtgattgttaggcaggaagaaccagataatcctggcgaacgtagcagactatggtactatgaagatgttattgaaatactaactgatgatttgggaagtaataagattcaaggaataatgcttgatccaccccaacgagaagaagtagattggagtggtacagcctttgagaaaatgaaacgactcagaattcttattgttcgaaacacatctttttcatctgagcctgaacatctgccaaatcatttgagggtgcttgactggattgagtatccttcaaagtctttcccatcaaaattctatccaaagaaaattgttgtctttaattttcctagaagccatttaacattggaagagccatttaagaaatttccatgcctgactaacatggatttctcgtataaccaatctatcactgaagtgcctgatgtgtccggagttgaaaatctaagacaactgagacttgatcaatgtaaaaacctaactactgttcatgaatccgttggatttctcaaaaagcttgcccatttaagcgcatcaggatgcaccaatctcagaaatttcctgctaaagatgtttctaccatctctgaaagttcttgaccttaatctatgcataatgctggaacacttcccagatataatgaaagaaatgaaagagccattgaagatttatatgataaatactgctattaaggagatgccagaatccataggcaatcttactgggcttgtttgcctagacatatcaaatagcaaggaacttaaatatctgccaagtagcgtattcatgttgccaaatgttgttgcctttaaaattggaggatgttctcaacttaaaaaatccttcaaaagtttgcagagcccttcaacggccaatgttcgtccaacattacgaacattacatatcgagaatggtggtttgttagatgaagatcttctcgcaattctcaactgttttccgaaattagaggtgttaattgcttcaaagaacaattttgtctctctccctgcatgcattaaggaatgtgttcacttaacaagtcttgatgtaagcgcttgctggaagctccaaaagattcctgagtgcactaacttgagaattcttaatgttaatggttgtaagggtcttgagcaaatttcagagttgccatctgctattcaaaaagtagatgcaagatattgcttcagcttaactagagagacatcagacatgttatgctttcaggcaaagaaaggtatttgtggattagaagtggtgatgcctatgccaaaaaaacaagtggtgattccagaatggtttgacttggttggacatggagggaatcctcatttctgggctcgtggcaagttccctatcttatctctagcgttgctcttccaggatgtgagaacagggccaataaaacgctatgatgaccttattgagctgcaactagttatcaactgtcaatgtgttcctcgcaaaggctattacaacttcagagttcctccagatcacatcttaatttgtgatctacgacttttattcagtgacaaggagtggattggccttgatgcatttctcgaccgtgactggaatgaagtacaggttgcttatgttgctgcatccaccatgacactaagttgttggggtgtttatgtgtacgaaggaggagcaaacaagaaagatgtccaattcgagtgtcccgatgccaagtattcagacatgtcacgggcagtagttcctacaaaagatactaagctggaacgaagaaagatgatagagaggtatggcgcaggccaagcgtttgatgcaatatcgactactttgttggaggtctacgaaaatgtaaaggatttgccagaatattctcaccttccgttgaaagagaagttgagtactatactaggattttataaggaggtatcgaggcaggctgaggctgaattagaatccggacgctcagatttacaagataaacactctttcctcacggcttacctagaatatgaaatgaatgtcaaagcattggaagaagaagaagcttcaacctctgtccatcagggcagtaaggaggagctactacactccatgcaacatgaattctatgatggagtgacggatggacttgttgaagcacggaaaaggtttccttctctggatattattaaaatcagaggagctaccttaaagaagaggccggagggtacttgtgttgaatggttattcgaagtactattccatgaaagaaaggcatacactgaaggaatagtgaatggactccttgaagcaaagttgagctttccagagctggacatgtgggcaacaatacatatcgtattatgtgcaagaggcatagaaggctttcgtgagggaattcgcccatcgatacaagtaattgatgaagtggaggcagcacccgtggatgtaggagaagcttcaacctctggccatcagggaagtcagaaggaacaaggctacgatcctcagcagcaaaaaaaaatatgggaaatattctattatggaattgtggatggactttttcaggcacaaaatagctttccctatttagatgtttttaaaactgcaaatgctgccttcgacaagaggtttgcatggtcacctgaagggaatctccaagtacacacgttggaaatgaggacgtacacgaatggaatcatcaatggactccatgaagcaaagctgagctttcctgatttagacatttgggcaacactaaatgttgtgttaaataggataggcatatatgaaacaccggcacttgaatttgcttcaaggatcctggatgcaatcaatataatggaagtaggagaagctccaacctctggccttcaggaaagtgatcaggaggagaagcaagaaataatgaggaaaatagaatgtgatggaatgaaggatggacttgtcgaagcaaagaaaatgtttccttctctagatgttattaaaaccagagctgctgccttcaacaatgggactagggttgcatggttattcgtactacctcaggttgaaatgaagttacacattgaaggaattatgaatggacttcttgaagcaaagttgagatttcctgatttggacatatggacaacactaaatattgtgttatgtaggagaggcatggaaggcctccatgagagaattcgcccattgatacgagtaatggatgtaggagaagcttcaacctctggccatcaaggaagtgaggatgaagaacaaggctacaatgctaagctacaaaaactaatggagacaatattgtatcaaggaatgatggatgcactttatgcagctcacaataactgtccttctctgaatatttttacaaccaaaagtgcagccttacgtgcctcaaaaaaccttaagtacttgattggagttataaccgatgataatccagcattacccatggttatggagatcatgtacataaatggaattatgaatggactccgtgaagcaaagctgagctttcctgatttggacatgtgggcaacactaacaaccgtgttaagtaagataggcgtctgtgaaacatcaatacttcaatatgcttcatgtttcctggatacaaacaatacaaaagaagtaggagaagcttcaacctcaagccatcagggaagtgaggaggaacaatgctgcgattactcaatcaaggaatga

SEQ ID NO: 32185 - DNA, 309 bp, Glycine max
  Peptide Sequence Number=SeqID_148963
atggcaaaacatgaggaagagtcccttggtttcacctatgatgttttcctctgttttagaggcgaagatgtaaggtacttatttataggacatcttcgtaaagagttgtgcagcaagaatataaacactttctgtgatgatgaggacctgaggatgggagaaggtattgcaccttctctatccaaggccattgaagaatctaagattttaatcattgtgttttctgagaactacgcatcgcccccatggtgccttgatgaacttgttaagatcctagaaagtgcaggcttggaggtcagctttgtctga

SEQ ID NO: 32186 - DNA, 210 bp, Glycine max
  Peptide Sequence Number=SeqID_148964
atggttaaggtggctacagccggcgggaaagtgatagggtgcaaacagaacaatcagcagaggtccaagcagagcatacaagggtgcagatcaaggaaaagcccaataggagagtcacaagaccagcttaccttcgagactatgcttgagggcagctcggggatttcatcttcagcatatgcagcaccaccaatatcgtatatagcttga

SEQ ID NO: 32187 - DNA, 2823 bp, Glycine max
  Peptide Sequence Number=SeqID_148965
atggcaaaccataaggatgagtcccttggtttcactttcacctatgatgttttcctgagttttagaggcgaagatacaaggcacaaatttataggacatctccgtaaagagttgtgccaaaaggggataaaggttttctctgatgataaggacctgaggataggagaaggtatttcacctgctctatccagtgccattgaaaaatctaagattttaatcgttgtgttttctgagaactacgcagagtccacatggtgccttgatgaactcgttaagatcctagaatgtaccaagatcatcatcagggacaagaaacaacttgttttcccaatattttaccatgtagacccctcagatatacggcatcagaaaaaaagttacggtgagcacatgctggaacaccaaaaaaggtttggcaaagactcccagagagtgcaggcatggaggtcagctttgtctgaagcaagtaacttccctggccaccatattagcacagggtacgaaaccgaatttattgaaaagatagctgacaaggtctataaacacatagctcctaatcctttacatactggtcagaaccctattggactttggccccgcatggaagaggtaatgtcactcctagacatgaagccttatgatgaaactgtacgcatgttgggtgtatggggactccctggagtcggaaaaacagaacttgccacagctttgtataacaacattgtgaaccactttgatgccgcaagttttctttccaatgttagagaaaaatcaaacaaaaatcaatggcctggaagatctacagaaagacacttctatcagagatgcgagaggagcctagatactgacttgggctgcgcaaataaaggaatgtctgaaataaaacgcaagcttgaaggaaagaaggttcttttggttcttgatgatgttgatgacaaagacaagttagaaaagttggcaggaggacgtgattggtttggttctggtagtaggatcattataacaacaagggacaaagatgtgctaattgctcatcaagttgataacatttatcaaatggaagagctcgataaacaccattctcttgagctcttttgttggaatgccttcaaacaaagccatcctaaaacaggctttgaagacgtgtctttgcgtgctatagatgttgccaagggtcttccactggctttaaaagtaataggctctgatttggctacacttgatgaagaaagtttagaagattggaaatgtgcattggaagaatacgagaggactcctcctgaaagaattctagaggtgctcaaaaaaagctacgatagattgggtagcaaaccaaaacaggttttcctggacatagcttgcttcttcaaaggggagaaaaaagaatatgttgaaaatgtacttgatgaggactttggtgcaaaatccaacatcaaagtacttgtcaataaatctctcctaacaattgaggatgggtgcttgaagatgcatgatctaatacaagatatgggtagagatattgtcaggcaggaggcaccaaatccaggggaatgcagcagagtatggtatcatgaggatgttattgacatactaactgatgatttgggaagtgataaaattcaagggataatgcttgatcccccccaacgagaagaagtcgattggaatggtactgcctttgacaaaatgaaacgactcagaattctcattgttcgaaacacatcttttttgtctgagcctcaacatttgccaaatcatttgagggtgctcgactgggaagagtatccttcaaaatctttcccatcaaaatttcatccgaagaaaatcattgtcatcaatttacgtagaagccatttaacattggaagagccatttaagaaatttgcatgcttgactaacatggatttctcatataaccaatctatcactgaaatgcctgatgcgtcagaagttcaaaatcttagagaactgagacttgatcattgtagaaatctaatagcaattcaccaaaccgttggatttctcaaaaggcttgctcatttaagcgcttcaaattgcaccaaactcagaaatttcctgcaaacaatgtttctaccatctctagaagtccttgaccttaacttatgtgtaaggcttgaacacttcccagagataatgaaggaaatgaataagccattgaagatttatatgataaatactgctattaaggagctgccagaatccattggtaatcttactgggcttgtttgtatagagataccaagtagcaggaaacttaaatatctaccaagtagcttattcatgttgccaaatgttgttgccttcaaaattggaggatgttctcaacttcgggaatccttcagaggtttcgttcagagcccttcagcagccaatgttcgtccaacattacgaacattgtattttggaaatggtggtttgtcagatgaagatcttctcgcaattctctattgtttcccaaaattagaagagttaattgcatcagagaacaattttgtatctctccctgaatgcattaaagaatgtgatcacttaacaagtctcgatgtgagcctttgcggggagcttcaaaagattcctaaatgtacaaaattgagaattcttaatgttcatcattgtgtgaaacttgagcaaatctcggacttgccatctactgtccagaaagtagatgcaagatattgcttctctttaactagagagacgtccgacatgttatggcttcagttagtggctgatccaaaatcctgggttagtggggacaaagaagctgacttgcagctagtgttattcgagagtgagaaataa

SEQ ID NO: 32188 - DNA, 1002 bp, Glycine max
  Peptide Sequence Number=SeqID_148966
atgtcgataaaagccattgccgtagacccgcagaaccccgccggtttcatcgaaatctcaccggagatgccggttcccggccagtacgatctgctggtggcagtgaaagcggcgtcggtcaacccggtggacaccaaagtgcacgccggtctgcaaaagagcggcctgcagcagccgcgcatactcggctgggacgccagcggcgtggtagtagacgtgggcagcggcgtcagcggcttcaagcccggcgatgaagtgtggtacgccggcgacatcacccgccccggcagcaacagcagccaccagctgatcgactcacgcatcgccgcgcacaagccgcgcagcctgaactgggccgagtccgccgccctgccgctcaccgccctcaccgcctgggaagcgctgttcgaacacctgaacattcaggacgcgccggagcacaagacgctgctgatcatcggcggcgccggcggcgtcggctcgctggccattccgctggccgcgctgcgcagcaaggtgaaagtgatcgccaccgcctcaaggccggaatccgccgcctggtgccgtgagcgcggcgccgatctggtggtggactaccgcgatctgaagggcgagctggcgcagcacggcatcgagcaggtggattacatcctgtgcctgaacgataccgacggccactggccggcgatggccgagctggtcgcgccgctgggccatatctgcaccatcgtcgagaacgcgcagccgttggatcaaaacgcgctgaagctgaaaagcgccgcgctgcactgggaattcatgttcacccgcagcatgttcaccaccccggacattgcgcagcaggggcgcatcctgcagcaggtggcgcagctgctggacgagggcaagctgagcaccacgctgagcgaaactctgcacgggctgtcggtagaaacgctgaccgccgtgcatcaacggctgctcggcggccatatgcaaggcaagctggttatcgcttactaa

SEQ ID NO: 32189 - DNA, 1254 bp, Glycine max
  Peptide Sequence Number=SeqID_148967
atgtccgccgcggaacgcgccgatctggcgttgcagcggctgcgcgataacccgagcggccgcctgcgcatttcaacgcccgccgggctgggggcgaccctggtggcgcggctggcggcggattttcagcgccaatacccggacgtttcgctggaggtgtcggtgtccgacgccatggtggatctggtgcaggaaggcttcgacgccgcgctgcgcaccggcaagccgcaggattcttcgctgatcggtcgccgtctcgggtatgcgccgcgctatctgttggccgcgccgtcctatctggcgcagcatccgccgatcgaacacccgcaacaactgcaacagcatcgctgcattgcccaccgcgcctggacggcctggaacctgcgctgcggcgacgactactaccgttggcagctgccgctggcgcacaccaccgacaacctgctgtatgcgcgtgaatgcgctatcgccggcgcggggatcacgctgttgccggcgtttctcagccgcgaggtggtggcgcagaagctgttggtggaagtcttgccggcgtggcgcgcggagggcaacgagctgtatctggtttacccgagccgcaagctgaactccccggcgctggcctgcttcatcgatgtggcgccgcatgcggcgccttgggtattacttggcgatcttcttgtacttgatgcggtgcggctcgagcgcatcggcgcccagcgtacgcttcttgtactcttcgtactcggtgaagttgccttcgaagaattccactttgccttcatcctggtagtccaggatgtgggtggcgatacggtcgaggaaccaacggtcgtgcgagatcaccatggcgcagccagggaattccagcagggcgttttccagcgcgcgcagggtttcgatatccaggtcgttggtcggttcatcgagcagcagcacgttgccgccaacctgcagcagcttggccaggtgcagacggccacgctcaccgccggacagctcgcccacgcgtttgccctgatcgacgcccttgaagttgaagcggccgacataggcgcggctcggcatctcggtgttgccgatgcgcatgatgtcctgcccgccggagacttcttcccacacggttttcgaaccgtccatgctgtcgcggaactgatcgacggacgccagcttgacggtgtcgcccagcacgatgctgccggaatcaggctgttcctggccggacatcatgcggaacagcgtggatttacccgcgcc

SEQ ID NO: 32190 - DNA, 954 bp, Glycine max
  Peptide Sequence Number=SeqID_148968
atggcgaaatactcgaccttcgccttcgtctatttcgcggcgctgtcgacgctgttcgtaccgcagatccgccgctgctatcgccagccgcagttctatctggcggtggcgatctggttggcgctggtgctgccgaacctgttctggctgtggaaccacgacttcgccgccttcaagtgggtggattcgcagatcaagatgcagctcaacctcgatatgctgcagtcgctgctgctggtgttctatccgtcgctcgcgctgtgggtgatcctgcggcgcagcggggcggtgctggcctggccagcggcgttgccgatgcgggtgttgctgtgggtctacctgttgccgctcggcatcattaccttctggttctctttcaacgtcggcggccggctgaccgagtggctgcagccgttcttcatgttggcgcccgcgctgctggttggctgcgtgcgccagccgccggtgcgttcgctgcgcgcggcgaccatcgggctgatgtgcgcggcgctggcggtctatctggggtatgccgcggtgatgctgggcaacgtgcgcaacgccggccagaaaatggtgggtatcaaggcgttcagcgtcggagtggagcggctgtggcaggagcggtatggcgtcagcctgcgctacgtcggcggtgaatacctgtcgcagtggatgacggtgtatgccggctcccggccgcagaccattacgcgctggtccaatcatacgcggccgaatatctacaacgtgaatatcagctatccgcagattgcgcagcacggcgtcgctctgttcgggcggttgggtgaagactgcgcgcacagcgacttcggcggcgagctggcccactggccgaagatgcgcctcgattggcagcagacgctgacgttccgcgccgatccgcatgccgacgagcaagcgctgtgcgtcggctttgttcgtccgcagtaa

SEQ ID NO: 32191 - DNA, 1416 bp, Glycine max
  Peptide Sequence Number=SeqID_148969
atgagttttaaggttggagaaggagaattcattgtgagtgtgagcaaggaggaggtggtggtaccagagattccaatgcatgagcactggctgccactatctaaccttgatctactcattcccccaatggatgttagtgtattcttctgctacaaaaaacctttgcctgaaaaatattattgcttcggaaccatggtggggtcactgaaaaatgccctagcacaggcactggtttactattacccttttgcaggtgaaatggtggccaacaccatgggtgagcctgagctcttttgcagtaatcgtggggcggattttgttgaagctgtggcagaggttgaactccagtgcctcaacttgtacaaccctgatgacactgttcaagggaagtttgtaccaaggaagaagcatggtttgcttgctgttcaggcaactgagcttaagtgtgggagtttagtagtggcatgcactttcgaccatcgcatagcagatgcctactctgcaaacatgttcctggtgtcatgggccgagatagcccagtccaacaagcccataatctcaatccagccctcttttgctcggtcccttttcatcccacgaaatccaccttccttccattcttcacttcacgacttgtacgtctccatctcggcgttacctcgaccgtcagatccaaaacccgggttccaatctgagccactcattaaccgcatatactacgtcacaggtgaaaacctcaaccttatgcaggaactggcaagctcaaacggtgtgaagcgcacaaagctcgagtctttctctgctttcttgtggaagatggttgctgaagctgcagcggctaaggttaagggtaagaaaaacctcgttgcgaagatgggtgttgtggttgatggaaggaagaggttaagtaacggtgacaagaacaaagaagcaatcatgggttcgtattttggtaacgtagtttctattccctatggtgggaaaccggtggaggagcttatggaaaagccattgagttgggtggcggagaaagttcatgagtttttggagattggtctgacagaagagcattttttgggacttgttgattgggttgaggtacatcgaccagctcctggtttgtctaggatttattgtgggcatggcaaggaagaaggaccaagttttgtggtttcttctggtcaaaggtttccggagtcaaaggttgattttgggtgggggaagcccgtgtttgcatcgtaccattttccttggggtggagattctggctatgtcatgccaatgccttcttctactgggaatggtgattggttggtctacatgcaccttctcgaggctcatttgaatttcatggaggttagggctcctcaaattttttggccattctctcgggattatcatttcaatcgtcattga

SEQ ID NO: 32192 - DNA, 1947 bp, Glycine max
  Peptide Sequence Number=SeqID_148970
atgggtctacaagctcaaaagctcaaatataaacttgatggaacaatggacatatacaacactcagttagtagctaaaggctacacacaacaagttggaatagatttttcagacattttttcacttgttgccaagcttacctcagtgagagtacttctagccatagtagtagtagctaggaattggtgtttacaacaactggatgttaacaatgctttcctcaatggagatctttttgaggaagtttatatggacttgcctcaaggatacaaaaccactacttctgtgcttcttgtagatgttgatgacattatactcgtttgcccaagttcttcatgtattgttgagatccaaatcaagttacaatccatgttcaagttgaagattttaggctctttgaaatatttcttaggcattgaaattgccaaatctagtaaaggaatttcagattctcagagaaagtacacactatcattgctagatgatataagataccttggtagtaagccaacacaactacctatggatccaaatctgaaatcgaccttgactgatggtgatctaatccctgatccttctctgtgtaggagattcattgtacacaagctaagtcaatacatgaagacccctttgacaactcacttggctgttgtttaccacttgcttcaatacctcaaatatgctctaggacagggccttttctttcctgctcagaattccatacacttgctagcatatgctgatgcagactatggtagctgtctaaatactcgcaagtctacaactagattctatgtatttcttggtgatgcactgatttcatggaagtctgtgaagcaagctagctgcaccaacagcagtggaaattgccttgttcttgagatgtctggtgttcttctttgggtgagttctggacccaaagagaacatcaactccttggtgagtttttcatgcaggagtggtggtggtggtgaaagaacacaaaagaggttttctggaatcagttttgcaagtggtgcctctgctttttcaagtgcagtggcagctgagactttaagatcctcagaggagagggtctatgaagtggtgctgaagcaagcagctctggtaaaagaaaacaaaaggggtacaaagatagctctagatttggacaaagacgttgaaggtgatttcaccaatgtggatctgttgaatgcagcttatgatcggtgtggtgaagtctgtgctgagtatgccaagacattttacttagtgtggtgcagaagaactgatgagctagtggatggcccaaatgcttcgcacatcacccccggggccttggacaggtgggagcaacgactgagtgatgtttttgaaggtcgaccctatgatatgtatgatgctgccctctcacatactgtctcaaagtacccagttgatattcagccattcaaggacatgatcgaagggatgaggatggacctgagaaagtcaagatacgataactttgatgagctctacctttattgctactatgttgctgggacagtaggccttatgagtgtcccagtaatggggatagcaccagaagcaaatgcttcaacagagagcatttataatgctgcattggctctaggcattgcaaatcaacttactaacatactcagagatgttggagaggatgctagaagaggaagagtatatctcccacaagatgaattggcactagctggcctttcagatgaagacattttcagcggaagagttacagacaaatggcggaaattcatgaagggacaaataaagagggcgaggatgttttttgatgaagcagagaggggagttgcagacctcaactcagctagcagggcatatgtaggaaaagtaaagaagctattatcactacctactgcctatggtttttcacttctaggccctcagaagtttgccaaaatggttaggagataa

SEQ ID NO: 32193 - DNA, 267 bp, Glycine max
  Peptide Sequence Number=SeqID_148971
atggagaaggaagggttagggggtgggaggaggaagaggaactatggagaagaaggagatgaagggttggggaagaagaagaagaaaagagaaatgaagtgggagccaggagcaaattgggaaagggccaatagtatctccctcaagttaatgtgcgtggtgagcttaagaggacatcctttttttggggggctttctaccacttacttttgcttagacatggcaatggggcggaacgaggacgggtattgtctccccaatccctga

SEQ ID NO: 32194 - DNA, 1563 bp, Glycine max
  Peptide Sequence Number=SeqID_148972
atgggctgcttcttcgcgtgcttcaggatcagagagaatcgccgcacaaacacatcgcatttgattacctcctccactcgatccaccggtgttgtggtgtctcgaaatcgcttgtcttctttattatctgaagaagagagagatgattctgcgaggattgatggtgttgggtttcagggagatttccaggggcttaaggatgaggctaagtttcttaaagcttgtgggaccttaacaggaacacccgttgaaattcgtaaagcatctgagaaattgaaagcatcacccgctcctgataaagattcagaacattcaagatttcattgttggcttcctaacacgtctgtggagaaactgcagctggatgtacaaccatttgatccaccaactcccataaatctttgccaaaaattgggaaatagtatggattcatttgagcacacgccaatcagctttatctccaaagcgcaagatactgaagaagactctgttgactatatggaaaaaagttggtcagggaaccttcatacggcagataggtctgaaaggaatgcagctttggtttcagctttgctagccacaaatactcagagaaagaacaagtctgttcgttttgaaagtgaaactgacttggcaacctatggaagctcatcagataatcggcatatgaaggaaaacaagtcaccaaataaccaaagtgcatataaaccgtctccttatcctaccccgttgaagttatttgatgagatgcaaacaccaggaactgtgtatcctgcatcattagaagagttacatacaggtagggctcaagttcggtcccagtttgtctatccaactaacaaaccaggtgataatgtcctccggtgcaaaatactcaaggagagagattttaaccctgaagaagattcaagtgagctgagtgatttggttgagaaagctcaaaatggaactcctaccccagaaaaagggtccaagagattttcaaatgaaaatgatgagatcaaatcaaatttgtcttctagaataagtcctgtatcaaccatcgaggagcattcgcctatgtcatttaagtggtggtatgacaatggcatcccgaattcaacaactaagtacaaagaggaccagaaagtaaaatggcatgcaaccccatttgaagagaggctggataaggcactgtctgaggagaattttatatctcaaaggatttttcaagagaaacaaaccatggtagtgaaggtgtacggtcccagctgtgcttccacaaaacgggtgctagtttgtctggttgagaaggaaatcgaatttgaggatatccctgttgatatcttcaaggtggaacagaaaaatcctgagttcctcaaattacaggtgatagaggagagtgaagcaaagctggtgcgggtgttgaacatttatgaggagaggctatcaaagactaagtatttggctggagatttcttcagccttgctgacatgagccaccttccttttcttgagtataatgtgaacaaacttgagaaagcgtatttgataaaggagaggaagcatgtgactgcatggtga

SEQ ID NO: 32195 - DNA, 456 bp, Glycine max
  Peptide Sequence Number=SeqID_148973
atgtcgtgctcttgtgcatcgtcatcacgttggaccaacgtgaatgaggaactcgaacaccttgttgtcaatatgcccaaattaacaattgaagagcatggggaatggaaggaattggcaaagatgatgcaggatgtcatggctccaccagaggctttattccatactgctaacgctagggaccaggtttatctcactgagcagaaagtttcctatagcagtctagacgtttcaagtatcatgtattattttttaaaagacaaaggttgtactcatttgtacttggaggacgttgcagaatgccggctcgtgttcaatcattggaggaagacactaaaaattgaagtcagatggaaacatttatgcgagaccttgtcgctcacccgtgacatggaaatggttttcgaatttattaatcccgatgttaaccgcgttctttattggccgtgtttgtga

SEQ ID NO: 32196 - DNA, 159 bp, Glycine max
  Peptide Sequence Number=SeqID_148974
atggcgatacacttcttcttctacagtattgaatggatgggcgattgcgctgtctatggtagatatctgcgtccgggccgtgcgcccggctttattttgtcccgctgcgccgtggcgcggcggtcaccggggagctgggcggctcctgcggtccaacca

SEQ ID NO: 32197 - DNA, 1134 bp, Glycine max
  Peptide Sequence Number=SeqID_148975
atgcagctcggcgatcggcgccgacgtcacccgcaggccgaagatgcgatcgcggcgcaccgcgtgcgccacgttggcgatgtcgtccagcgaactgacgatgccgaccagcatacggcgcgacaacaccagagcgcacagggtgttgagcaccatgcaggcgatcatgccgaccaggccgcgcaacaggaaacgcatcaggctgccgccgttgccgctcaaccagacctggccgacctgtttgcccccgtgagaaataggcaggatgaccggttcgggcagcgcccagtgcgcaaccatctgctccagaccgtgcagcgggctgtcggagggatggcgccagctggccagcatcttgcctttattatccagaatgcgcgcctccaggatctcttcgttggaggcgatcagcatcagcgcctcacgcgcggcggcgccgtcttcaaacaccacggcggcctcgacggtatagctgatggagcgcgcgatcaggtgcaggttgtggtcggcataggcgcgcagcgcaaacagcgccaccagcgtcaaaaagatgccggcggtgccgacggcgatcagcgccagcccaagatgcacccgctgcagcactcggcccagcgtcgggcgcgcattgccggcgcggtttctgtgcaacagcctcatagcggcggcgcctatgacatcgcagccggtactcagcgttgggctgtcgaacggcacacgctcggctttaatcggacgcggggcgctcagcaggatcggatcgaacagcccttcggcatactgggtgggtgcggtcacgcacaagcggatcggattgggttcacgcgaccagcgggcgtagctgatgatgcctaccaccacggtcgtcacggcgtgcgtgcgtttttgatagggatcatcggcggcgcgcgcaggcccggacaacgtcagcagcaccaacaacacgatcagcagcaggcgaccgatattcagacgtgcgtcaaggaagcccggcacggggctttttgcgcaacgcatcgctatcgcggtcttattcgccatcttcacccgccattccggcctgatccaccgcccgcaggccgtggcctgacaaggaaaagttcggcccgcttgaagggacaatcgttttgctga

SEQ ID NO: 32198 - DNA, 579 bp, Glycine max
  Peptide Sequence Number=SeqID_148976
atggcaaaattagagtcagcagtgataatagcgatgaagggacacccaggcagcgggaaaagcacgttggcaaagtccatagcctcatctctccgaatccctctgttagacaaagacgatgtcaaagattgcacccaacccttgctgctaacctcacccgccacactcctcaacgacctctcatacgacgccatctggcacatcgcctccacgcagctccgcctcggcctcagcgtcctcctcgactccccgctctcccgccgcgcccacctcgatcgcctccttcacctcgccgcctccgcctccgcccgcctcctcgtcatcgagtgcaggcccggcaaccaccgcgagtggcgtcggaggctggaggcgcgcggtggaggtggaggtggacacaagcctggcacgtgggaggaactggagacccttctggaagggtacggagggtgcacggagtacgacgtgggtgacgtgcccaagctcgtggtggatacaaccgccaatcttcctttggaagagatgtgttccgctgcgctggacttcatcttcgctcacgctgctaagccaactctgatttag

SEQ ID NO: 32199 - DNA, 159 bp, Glycine max
  Peptide Sequence Number=SeqID_148977
atggggcttgatcatgtgaaagcatcttttgtcttcgctacccatgtgcttatcaatttcaagagagcaaagtgggaatccagaatagaggctggcaagaactttaatgttgtttgcaagcatcttctgtggcatgctaaagcatgtgcaggggactaa

SEQ ID NO: 32200 - DNA, 1347 bp, Glycine max
  Peptide Sequence Number=SeqID_148978
gtaaagttgcttgatccaagttgcaaagtagaagaatttctacgcaagacattagatcctccagtttttgagtccataagcaatgctattttagttcttcaagatattggggctttttcaaatgatgaaaaactcacccatctaggggagaagcttggttctcttcctgttcacccattaatatgcaggatgcttttttttgctatattgatgaactgccttgatccagctttaactcttgcatgcgcatctgattatagagatccatttacacttccaatgttacctgaagaaaagaagagagcttcagctgccaaatctgagcttgcttctttatatgggggttgtagtgatcagtttgccgtattggctgcatttgaatgctggaataatgcaaagaaaatgggtctagaagcacggttttgttctcagtattttgtgtcttcaagcgccatgaatatgttatcaggcatgcgcaggcaactccaagcagaattaattcgaattgggtttattcatgaagacgtgtcaggttacagtgtgaatacacatgaccctggtgtgctccatgcggttttggtagcaggtttgtatccaagggttgggagatttctaacaaataaaggtggaaaaagggttatagttgaaacaacaagtggagataaagttcgcctgcacaatcattccacaaattttaagttgtcattcaagaaaaatttagataacactttaattgtgtacgatgagattactcgcggtgacgggggtatgaacataaggaactgcacagttgttggaccacttccacttttgctgctttcaactgagattgccgttgctccagcagaagaaaatgacgagggggatgtggatgatgcagtaggtagtgaagatgaagctggaagtgaagatgggatggagtttgatgccgagtccagtggaggccgtgaggataagttgatgtcttctcctgataatatggttaaagtaatcatggaccgttggctttattttcgttcaacagcaattgatgttgctcagctatactgcttgagagagcgattatcagcagcaattttatacaaagtcacacatccaaggaatacacttcctcccatcatggcggcatctgtgcatgctatagcttgtattctgtcatgtgatgggtgcattggtgtgtcagcaatgttagaaggtgtggacacactaaccactatggtaaacgcaacgtctttgggcaagccagcaacaggtactaggcgttttggtaagagaccaaaaggatcccttgcagagcttttaaattacgacgggcgccaaaactctgggcctcatttcaaagcatag

SEQ ID NO: 32201 - DNA, 1032 bp, Glycine max
  Peptide Sequence Number=SeqID_148979
atggtgaaattcaaatcttaccagaaccaggctaatttgttcttgaaggaatatttgttagcagaccctttgattccatatacttctataattggtggtatttttgcttgcaagatggtctatgatcttactcagctttttagcactgttcactttaagagctattccagcctcactagaatccaacgcgttgagtggaataaccgttctatgtcaacaattcatgctattttcataacaactatatcgttgtacttggtgttttgctcaaatctatattctgacaaccagttgtccgaacttattacatttcgaagctcttcatcatctacctttgctctggggatgttgtacgttgagtctgaatccctagatataccggaagttaaatttggaggacacccgtgccttgttatgaaagcaagacagacagacctagaggaaaacataggctgccaggatttgctgaagaaagaaaaacaagataatcccatgttttacattgtccacctttttaactttaaagcatgctgcaattgctcttcagatctgtatacttccttgagtaatgtgtctgtcggttacttcatcgctgaccttgggatgatattttggttttttccttctcttggtggatatgagtatgtgattcatcatttgctttctttagtagcagtatcattttcaatgttgactggggagggtcagctatacacatacatggtcctgatctctgagacaactactcctgggatcaacttgagatggtatcttgatgcagctggaatgaagaagtcaaatgcttatctcatcaatggggttgtaatattcattgcttggctggttgccagaatacttttgttcgtttacatgttttaccatgtctacctgcactttgaccagattgaacagatgcacgtgtttggacaaatgctagtcattgttgtgccactggcgctatcagttatgaacttgatttggttttccaaaatcatcaaagggttgaggaagacgttggcgaagagacagtga

SEQ ID NO: 32202 - DNA, 888 bp, Glycine max
  Peptide Sequence Number=SeqID_148980
atggaaacgacgacgaagaacaaaagagagaagaagaaaggagagccacttttccgtcaaaaccccaacgttgatgaagtcaccaggattcgcatttcccagattctagaacacttccgagcttccaatgatgaagtctacaagtttgatgctgatttgtccaaccaagagcgtgctttggtgcatcaaatggccctcaaaatggggtttagatctaaaagttacgggctagggaaggaaaggagagtgtgtgttcaaaaaatgaaaaagaaggttgacacggataacgggtttggaagtcttcctcaattcacattttctggagaggcaaagtgggtgctgggtgatttgtttgctcattatccgcctggcgatggaaactcatgggagatggtcggagaaaatagtgacactgctactgacagaacaaaacagaggccggatgatattttcagcaggccctctatgaccaaagctgaaattgctaggagattggaagctcttacttctagaatgaacaatgtctctaacttgaaacagatcattgaagggagatctaagcttccaattgtgtcttacaaggattcaattacatcaactgttgaatctcaccaggttgttctaatatctggtgagactggttgtggaaagaccacgcaggtcccacaatttattttggatcatatgtggggtaagggagagtttccgagagaattgctagtgagagaggagagactattggagaaaatgtgggatataagtaatgatacggttagaaagcagaggtggaaggcaatcatcaattgtgctatgtactactggagtgctattaagggtgctggtttccaaaggttctcattcgtcaaagattgggcgtgtgaaggatga

SEQ ID NO: 32203 - DNA, 732 bp, Glycine max
  Peptide Sequence Number=SeqID_148981
atgtctgagaaaatcacagctgaaaaccttttaaacacccttgtggaaacacttactgagaagcaaaaatctggatcattttttgaagaagacaagtcaagctcagtgagctaccaattcaacagactgtttggacgccagaaacctgtgcaccatattttagggggtggaaaatctgctgatgtcttgttatggaggaacaagaagatctctgctagcgttttatcggcagcaacagctatatggcttaaacctgctttgttttctgtgggtgacaggaagccatctaaagttccccgttttgtcctcccagatgatatcttcgtgaatattgcaactgtagttggtgctgaggttaaccgtggtttgaggtttctccaagatgtttcttgtggaggaagcctaaaacaatttcttattgagttggcacccaggaagggtgtgggtaggttggtggggggtggggtgggggagactgacatccagcaggaggttgtagtaagcttatgggctggtgctgtgattgggagctggtgcaattttttgactgtcatgtatattggttttgttgctgcacatacactcccagttctctatgaaaggtatgaggatcaagttgacaactttgtgtacaaggtctttgatcagatgcaaaatcactatcagaagctggatactggtttgctcagcaaaatccccaagggaaagctcaaaggaaagaagtatgaatag

SEQ ID NO: 32204 - DNA, 1947 bp, Glycine max
  Peptide Sequence Number=SeqID_148982
atggaaagagaactgggaagggaaacgcgtgatgatttaagaaacaagcaagcacaagtagaaaaggagaaggtttgggacttagagcgtgtgtggttttggttggtaactgaagagtgtgtggaagcagaagaagaaggaagaaggaatcggcggtgttcgactgacgatcgcatctcaaaattgggttcggatcattcctttgcttgttcgggcacacttttcatgggaggtgtggaagatgaagaaccatccatgaagcgaatgaaattatcctctaaaggattagttggcttgtctaacggttcttctaaagaacctgttagaggcttgtccagtgacttgatggctcagcccctactatccaaagaggacgaacatgttgttggttccaaaggggttataaagaaagaggaatttgtaaggataattgcaaaggcattatactctcttggttatggaaagagtggagcacatctagaggaggagtctggaatacctttacaatcacctggggtaaatctgtttaggcaacaaatacttgatggaaattgggatgacagtgtagccacattgtataaaattggtctggcagatgaaagtatggtcaggtcagcctcattcttaatattggagcagaaattctttgaacttctaaatggtgaaaaggtcatggaagcattgaagaccttgaggacagagattgctccactttgcattaataatagtagaattcgggaactttcttcctgcttagtttcaccatctcctaggctagatattctaagggtgaggtctcgatcaaagcttctggaggaattgcagaaacttcttccccctacagtaatgatacctgaaaagaggttggagcatctagttgaacaagcccttatcttgcaacatgaggcatgcccatttcataattcattggataaggagatgtcattatattcagatcatcattgtggaaaagatcagataccttccagtacattacagatattagaagcacatgatgatgaagtctggtttgtacaattctcgcataatgggaaatatttagcttcagcatcaaatgatcgaactgcaataatttgggtggttggcataaatggtagactgactgttaagcatagattatctggtcaccagaagcctgtttcttccgtttcatggagtcctaatgaccaagagatcctcacatgtggagtggatgaggctattaggcgttgggatgtctctactggcaaatgcctccaaatttatgaaaaagctggggccggtctagtctcctgttcatggtttccatgtgggaaatatatactctgtggcttaagtgacaagagcatttgcatgtgggaattagatgggaaagaagtggagtcttggaaaggacaaaaaacccttaagatatctgatttggaaataacagatgacggggaagagattctaagtatttgtaaagccaatgtggtactgttgttcaatagagaaacaaaggatgagagatttattgaagagtatgaaacaataacctccttttctttatcaaaggataacaaattcttgttggttaatcttttgaaccaagaaattcatctatggaacattgaaggtgatcctaagcttgttggcaagtacaaaggtcataaacgcgcccgttttattatcaggtcttgctttggtggccttaagcaagcttttattgctagtggaagtgaggattcacaggtttacatatggcacagaagctcaggggagctaatagaagcattgactggtcattcaggatctgttaattgtgtgagctggaatccagcaaacccccacatgttagcctcggccagtgatgaccggacaattagggtatggggcctaaattgtatgcacaacaagtaccaaaatgttcacagcaatggcatccattactgcaatggaggaacttag

SEQ ID NO: 32205 - DNA, 1785 bp, Glycine max
  Peptide Sequence Number=SeqID_148983
atgacctccttggactcatatgaggaaatctcttatggggaaagcgagattgggccaaatgctgcctctgtttgctcgcaatttgaaggtgaaaaatcatggtggatgatggcggaggcagatcggagagtggtggcggaagctgatcagaaaccagcaacaatgggagcaggtgatgttggcacgaacaacagagagggtggtgacagaggtctttcgaccattggtggtggccaaaccaacacattgacctcaatcaaccaagctaccatggtccaggactcgttcttggaagggcccactaaaacacatggacttgcacatgaggaaagttggataaatgttagtggttctttcagcatgggaaaggagtgttcagctacaataagcaaaaggagggctgataatgacaatagtatacagaaagagaggggagaagatgcattacctttttctgaggggggtgtccagttaccttattctggaaaagacattacttcaaaacatgccccattagtagaagacgtggctgtccaagataacatggaagaattgaacttgggcccaaagtgtaatgggcctcagtctacatggaaagtttgcatgaggacaagaaaacacaaaaggggaaatgggtctggtgtagtagaaggaaaagaaacttatgaagacaccagccttcacaaagacatgggaagggctgatgctggactaacaaacgtgttaaggcctgcttcccctaatcttgagggaggaagtggccttaaagaagttgccacgtgggatgccaatatgaaaagggcatataatgaagggtcaacttcaagctctatatacaagagtctaagaagctgtgatgctatgatggatgctgcctatacatgggaattggctaaaaacatgggagttagttgcgggaaggacgaaaatggagtgttgactagaatggttggtttagatggaagagacaagtatgaatttgagaagttgggaaaaaggaaggttgagatgctatgtctacaggaaactaagaaagaaatgctggacagaactatgtgtcaggctttgtgggggaattcagaggtgaaatgggcagccaatccagcagtgaacagtgctggaggcatattgtgtatatggagtgaatcatcttttgaactagagaaggaggagacagtcaaaacgagtgggggttggccaaagagaacaaggtgggggatcatgacagaatttaatgattggatgccggatctagaagttgaggatgagccaagtgtagggcataaattcacttggaattactcagaccactatccaattctgctgaaatcaatcattgctgatcggggcccgaagccattcaagactctagattgctggtttcaagataaatcctttaagaagacggttcgggattgctggagagaatgcttagtacaagggtggggaggtcataagctaaagagggcagagcaaaaactcaatgagttgaaaaagaaaggggaggaaagagacctaactgaggaggaaattagattgaggaaggagctgcaggaagaagtttgggtgactacgcactcaaaagaatcctttgaggcaaaaagcaagaataaagtggagccaaacaaagtaagggaggaagaaacaattctttatgaaaaggatgaggtaagggcaacagtgtgggaatgtggaagtttcaagagtccaagacatgatggattaaattttaaattcattaaggaattctgggatgtaatgaaaatggatgtcttgcgcttctag

SEQ ID NO: 32206 - DNA, 903 bp, Glycine max
  Peptide Sequence Number=SeqID_148984
atggtgcggcgaacctggtggagcagcggcagagagacagaaggaaaaattagagatgcttcaaatattacgtccttctacttcacgtgtttccctaaagacactcaagaaaaagatttatggttggtttttaagaaatggggtaatgttagggaggtcttcatagctacaggaacagcagcagtcgaaagtatggttttgtcagattcaaagtcggataatctgattgtagcgggccttaaactacatgtgaacctaccaaaacatggaagggaagacaagaagcatctatggaaaagggagtctgatagggctacatctggtggacgcgataagtgtaaggtggcccaagtgcaaccccatagccagcctaacaagggacaacaaaagacgctggatatggaggatgttggcacctcaacaaagcaagttgttggcagtgaggccgatcaagatagacgagattgcacaggcaaagcgccgttcgcaacagtggtagccaacggaggaaaacacgcatcttggagagggcaaccaagaacatttacgtttgacaaacttgaggaagagctcatgtggggtggcggggaggagaccaaaccaaagtacttgggtggtgatatagtgctgttattgggtttggatcatgtgaaagcagaagatctatgcaaggaaggagtgcaaagtggattatctatgttccactccctgcagaaatggagtccaaaaatgtgcaccggctttagactggtctggatcatgtgttggggcatcccaatacatgcttgggatatggaaagcattaagaaaattgcaaaaagtgtagatgtggtcaagatagatgaagaggtggaagatttgcaaaggcttgatcgggctagagtccttgtcaagacaccttga

SEQ ID NO: 32207 - DNA, 1140 bp, Glycine max
  Peptide Sequence Number=SeqID_148985
atgccttattttcagttgtcaagtccattagctcgtggatcagctaatgttcagcctcgggatattggaaggaatggcaccaacaacaatacaagttctcgttctatgggtgttcttccttcacctttggccactgataaaaatgatggcacggttgctctagttaaaactggctctgaaatagttaagactacccctgctggtgaatatcttactgctgccctgaatgactttgatccagatcaatatgaagggcatgctgccatatctgatggtgcaaacaagcttttgatgctggttctggctgctgtcattaaagctggtgcctctagagaacatgagatactcgctgaaattaaggattctgttttctcttttattagaaagatggaaccaaaacgagtaatggacaccatgcttgtttcccgtgttagaattctgtatataagatctttgcttgctagatccccagagttgcaatcaattaaggttttgccagttgagtgctttcttgagaagactaatactgggcgcagtagaagttccagccgagggagtagtcctggtaggtctcctgtgttatatgttgatgagcagatccagggatttaaagtaaatctaaaaccagaaaagaaatccaaattttcatctgttgtgttgaagatacgtggtattgatgagcaagtaactggtggaaagctcagggaaattactgaggaggccaaaagttttgcaattgggaacagggctcttgctgcactctttgtacatacaccagcgggtgagctgcagcgtcaaattagatcctggcttgcagagaattttgagtttctatctttaacgggagaagatgcatcgggggggtctactggtcagttggaacttctttccactgcaattatggatggttggatggccggacttggtgctgctctgcctccccacactgatgcccttggccagcttttctttgaatattcaaaacgtgtctatacttctcaactacaacacttaaaggatattgctggtaccttggcgacagaggaggctgaagatgcagcacaagtagcgaagctacgctcagctctagaatcagttgatcataaaagaagaaagttttgtcattgcattggttactag

SEQ ID NO: 32208 - DNA, 501 bp, Glycine max
  Peptide Sequence Number=SeqID_148986
atggtgtgggaaccaaaagcaatatacatccaagaagatagaaatctgataactcttgcatgggatgaactgttgggtatcctaagagttcttgaagttcatcttcagaaaagagatcatctaccaaagaaagattctactgcccttaagtttggagagactagctacaaaataaaagaaaataagagctcctttaaagctcttagagtgaagatggttgagtttgatggctcagacaataattttggaggatccacaaatgatgaaatggatttgatgtccgaaaagttcaaacaaatgttggaaatgaaaggaaagtttcaacacttctccaaaacaaaagacactagatttataaagaaatacaaagaggagaccaacaaaatcatatgctttgaatatagtgagaaaagtagtagctcaaacgatgaacaagttaacatctatctgatggccaacacaaatgaaaatgttgagatatccttggaaggaaaagactag

SEQ ID NO: 32209 - DNA, 779 bp, Glycine max
  Peptide Sequence Number=SeqID_148987
gtgggagttcaaaagctctgatgattgtgaatgtgtgtccaagtatttcaaatttatctgagacattgtcgtctctcaatttctctgctagagctcgaaattctactttaagccttggaaaccgagacacaattaaaaagtggagagatgttgcaaatgatgcgcgaaaggagctgaatgagaaagaaaaagaaattcatgatctaaagcaagagggtctgaaactcaagcaagcacttaaagatgcaaatgatcagtgcattctactcttcaatgaagtgcagaaagcatggaaagtttcttctgtattgcagaccgatttaaagtcggaacatgttttgctgtcagataaacacaagatagagaaagaacaaaataatcagcttagaaatcaagtcgctcaacttttacggttagagcaagatcaaaaattgcagatacaagagcaagattcaaccatccaaagtttgcaggctaaaattagaactcttgaaactcaattcaatgaagctattaaatctagtgaatctaggtcaacatttgtctatgagacagagtctgctgatcaatccaattccggaccaactggtgatggcatagactcttctgcagtaaccaaaaaactagatgaggaactcaagaaacgtgatgcactgattgagcaatttttttcatataaagcattactggccatatcactgtacatcttgaagatgcaaaatggtatacatgcaggaacatggtatgagtggaccatcgtttttgatagcaacaattaa

SEQ ID NO: 32210 - DNA, 219 bp, Glycine max
  Peptide Sequence Number=SeqID_148988
atggaaggaagagaaggcttcaattctggggttacagtgataggggcagaagctccatcagcctatcatatggcaccaaggagtgaagctccaagtcaggttcctcctcctgttcctgaagcaacagctggagctattggtgtctcacctgtgagtgtggaattggatggaacaacagctaagaagaaatctgattctattttagcaagggagtgttga

SEQ ID NO: 32211 - DNA, 612 bp, Glycine max
  Peptide Sequence Number=SeqID_148989
atgtttttgagctggctttgtggcctacaacatgatttgaacctccgacagacgtcgtacgtgacgaggatcgagtggatcaaagccgacgcgcgcaacaccaacatgaagattgacgtccggtggtactaccggtcggaggagtcaataggcggccaccgccagtttcacggctccaaggaggttttcctctcctatcacttcgatgttcagagcgccgacacagttgaagccaggtgtacggtccacagctccaagagctacacgaagctcaatgctatcgaaaacgacgatttcttctatcgttttgagtacaattccttcaccggcgccttcaatcctgatagagttgctatttggaaaatgatttactatggtgatgattggggtggtctttttgaggccatcactggttatggtcttggtgggtcttctatggctttgtttggaagagtagttgatggaggtatctatactaaggttgctgatgttggtgttgatcttgtccgaaaggttgaaagaaacatccccgaagatgatccaagaaatctagctataagaaatataatcctgaaactaggcccccttatttggtttttaaacattctctag

SEQ ID NO: 32212 - DNA, 150 bp, Glycine max
  Peptide Sequence Number=SeqID_148990
atggaggaagagaatgagagagagagaggcatggaaattgaaggagaatatgcagagaagttgaactttgaagtaactaacacatccggaacttccttgagaagcaaggaaggtagcttccttgggaagcaaggaagaaagcttccttga

SEQ ID NO: 32213 - DNA, 926 bp, Glycine max
  Peptide Sequence Number=SeqID_148991
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgtcgagcgggtggaccatcgcagccaccagcggcagggaatcgagcaggaggcgactgtgcatatggggccgagcgcgacggcgatggagcgccgcgccgagcatcaggcgatgcgggaggggcgggcctatgagccggtgacgatggtggggcagcacaacgctggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 32214 - DNA, 396 bp, Glycine max
  Peptide Sequence Number=SeqID_148992
atgtcaaataactccactcctatacccattgagagccaacaaccccaaactgatcaggcacatatctctcaaaccatgggggagacacaagaaattccccaccacaatctagctgacttcgagccttggctcggatatgccactgaagggcaagcagttggtggtataccctttgaaaacactttggagggccctcagtttctcccacaaccacaaccattgcattttgcggtgggaagagcccctcctgctatggccgaaaagggaaaggcggatcatctaaaggaaaggctcagggccattaaaggaggtgaagattatgcctttgctaacctagaaaagttgttcctaatacccaaacatggtcattcccaagttcaaggtgctggactttga

SEQ ID NO: 32215 - DNA, 213 bp, Glycine max
  Peptide Sequence Number=SeqID_148993
atgggtccaaaatctaccctaaggctcatgagaaccctagggtcttctcttgcatccctggctcaatcttcttgtagtcttctatccaatacccttggggggcttgtgtttcttgagtccaacttaggctctatcctatttacgtccagctcggcccgaaccagttggccaacgggccatcccgataggccaggtccgttttaccaactctaa

SEQ ID NO: 32216 - DNA, 405 bp, Glycine max
  Peptide Sequence Number=SeqID_148994
atgaaagataagagggatgaggaagaaaaactaaaaaaacaaaagaaaaagaaggatagtaaggccttgtcttcaaaggccaaggggaaggaaaaagagggaaaggattcctccaagaagattgttaagaaggaaaaccattttgcaacaaaaggtgatattaaaatagcactccttcttaaacaatccttctaccttctcctatcaagggaaacatcccttagcactgccatacctcttgagcttgaggttattcctcgagtaaaggagttgttggatgagggtttggttcgagataaggctatatggtatgttctaagtcaagaggaaaagaacaaaagtgcatataactgcatgagctccttgtccttgaagaaagagacccttgaggaatattctatgtag

SEQ ID NO: 32217 - DNA, 1173 bp, Glycine max
  Peptide Sequence Number=SeqID_148995
atgcctgtggcggtaacaatacccagttatcagcaccgcatctacgcttcactcatctacatcgccaaggctaagaaaaccaccatggccagcaccagcagcagcaatcctggtggggccttcaccaccctccaagagagggtcactttcgagaaggagataaaaaagagcaagttcatcgccattgctggccccatccccgatgaaaaatccgccatgtctttcctttcccaggtacgggatccacgtgccacccacaattgctgggcttataaggtgggggatcaatatcggtccaatgatgatggtgagccttcaggaacagctgggaaaccaatacaaactgctattgattcttcaggaatagatagagtaatggtggttgtgatcaggtattttgggggtatcaaattaggcactggaggattggtcagggcttatggaggagttgcatcagaatgcttgagaaatgccccaacttgccttgtaaaaactaaggtgccaatgggtgtagaggttccctttgagctagttggagttctcaaccatcagtcttttcacgtggaagacatcaagcaggattatgatactggtaaagatggcatatctatggttacttttaaagttgattttgatcaagctgagaaattggaggatgcaatcaaagccaattgtagcagagaattgcatctggagaatggtgggaacgggattagaaaattctggtttaaggaagcggtggagaaacaagttggacttggtaatgacacattgttttggaagaaccagtgggtagagggagggtctgactgcgatacttggagatggatgattgatccaagtggtggctacacggtcaattctgcattcaaaaatctcatggaaaccaattgcacaagtattgaagggggatggaagctactatggaatactctggagttttacaacctttataatgtgtttgcatcggctgcaaggagatggaggaatctgtcaatcatttgttttctgagtgccgatacttcagttgtggattgtggtaagcctgttttcagtggttgggagtgcagtatgtcatacacaatcaggccaagtaatatggtttgccatgatgtgggaaatctggaaatgcagaaatgcaatggtctttacaggaaaacagaccagcattga

SEQ ID NO: 32218 - DNA, 834 bp, Glycine max
  Peptide Sequence Number=SeqID_148996
atggatggaggaacaaggactcaaatttctgctaaactccaaggcttagaatgtgatgttgtgtgctctttcagaagaagaatacaccaaggtgcacaacttcataagtgccaaacaaatgtggggcactctggctataacatactaaagaacatcataggtaaagaggaacaagcccagtctcctcactcgaaatggagaatgtatgtaacaacgctgagagtattaaagaatcttgactcgatgtcctttgaggaacttgttaataccctcaaggttcatgaacaagaacttcagcaggacaatggatccaaaagagaaaagtctctggctctcagtagtcagaagaataagaaggcatcatcaaccagagaacaagtcttgagaagttcgtccaaagttcataaagttgatgattcatctgataatgaatatgaggaagactcagatgaagatgagctcacctttatttctcgaaatatccacaagacatggagaaacaaaggaggctctaagtggaaaaactcctcaagaagaatgtccaaagaaaggaaagataaagacaaaaacttcataatttgctatgagtacaaaaagcttggacatttcaagtttgaatgctcaaaactagaaaagagtcaagataagaagaaattcttcaagattagagaaaagaagggccttggatcttcttcctcaatggagtcctttgcttctttaatatcaatggtagcagaatggagaaggaagaaagatgattggagacaccacttcaaggagaagatgagtcaagaagaagctcaccaccataggaaaccatggataagagcttga

SEQ ID NO: 32219 - DNA, 783 bp, Glycine max
  Peptide Sequence Number=SeqID_148997
atgaaacaagacacagacaacaacggaaccctcggcgggtccgaagattccctcctccgttcatgtctctctcttctcacgcgccgcagcttcaccgcttgccgcgagtccgcaaaccaaatctcaagatccgacccgaccgtctccctccatctggaccaaatcctcgcggtggcggacgtcctcaccgcggcggagagccgccgaggaccctcccacccgcacgactggtactccgtcctccgcctccaccccggcggcgccgacaaccgcgacctagcacgacagcacttcaagaccctcgtgcggctcctcgacccgaacaagaacaagctccccttcgccgacgaggccctcatgcgcgtgcgcgaggcctggtgcgttatctccgacccaacgcgcaaggcccgcttcgacaaagagatcgaagagtcagccagaacggcgtcgttttggacaatgtgcccttactgctggtacctgcacgagtacgagcgcaagtacgaggactgcacgttgaggtgttcgaattgccagaggacgttccacggcgcggcggtgccgccgccaccgctggaggcggtggtggcgggaaaggaggagtattactgctaccacatgagcttgccggtgaggtatccggttggcgaacggtgtcgtttcgggggtgaggggaatggggcgaggaagaggatgagggttaagacggtggctaatagaatgaaaatgaaaaggtttgttgatgctaataatggtgaatctgataatgatggggtgaggtag

SEQ ID NO: 32220 - DNA, 523 bp, Glycine max
  Peptide Sequence Number=SeqID_148998
atgggtggagcaggtttaggcaacgaaccactgaacgacggtggtggaggttttgaaggtctttgtgtgccatggcaatatgctcttgctgtcaagttacttggcaaatggattggctataaatgttttgacatgattgatattgacaatgattatttcatggtgaaatttgacctggagggagatagggtgaatgtcatggagggtgttccttggatgaactttgatcattatcccacatatactcttggctttggcaactgcattggtaggcctattagggtggactcaaacaccctagatgcttgtaagggtagatatgcgatgtggatgctttgggcatttgttaaggggtgcaaagtttcagttcaatcaccaatggaagagtcttcaaagcttgatcaaaattcgacggttgtccaaatttcacctaaccagacggctctggcgaattcatcaatgtcaatgaatgcaaatgattccaatattggcgtaatggatacaatcattaccattaattcag

SEQ ID NO: 32221 - DNA, 523 bp, Glycine max
  Peptide Sequence Number=SeqID_148999
aacaggccattcgacagggagactcggaagttgcggagtcttggtttaatcaagccgctgaatattggaaacaagctatagccctaacccctggtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtggtttggccaatagtgggccaagaaatattgaatggtgatgtagggggagg

SEQ ID NO: 32222 - DNA, 519 bp, Glycine max
  Peptide Sequence Number=SeqID_149000
atgtcttttgaaagtccacaccaagagatgaacattccctccatggagattacccccatacacattgagcacttctttgacatcaatgagttggacaaagttggtcttaagctttacgagaccttgcttctatgcagtgcaagaaacttaggaggcatggacgatatctactaccctgctttcatgaacaagatgttatgggatcaaggggtttatcgtgtttttgacaaattggacgatgacttaaagcacaacttaaagatcaaaggttcaatggtggccaaacaacaaagcttcagcaaaacgaacctaaaagctatgaaggtggtaatggaggaacaaaaactaattcctcaagtggatgtggaagcaatcaaacaaagaaaacaaaagaggcttaccaaagccattgcaaacaaagataaaggtctgaatagctttggaataaccaagaaaattcaaaatattatgaaagagaaacaacaaagaaagaaaaccaaaagacaatcccgtcattaa

SEQ ID NO: 32223 - DNA, 731 bp, Glycine max
  Peptide Sequence Number=SeqID_149001
atgaaagagtctacagacaaggacttttctactcatacgccaatgatgcagcaatacctgcgcctgaaggccgatcatcctgacatcctgctgttttatcgcatgggcgatttctatgagctgttctacgacgatgccagacgcgcatcgcagctgctggagatctcgctgactaagcgcggtgcgtccgccggtgaaccgatcccgatggccggcgtgccctatcatgccgttgagggctatctggcgaagctggtccagctgggcgaatcggtggcgatctgtgaacagattggcgatccggcactcagcaaagggccggttgagcgtaaagtggtgcgcattgtaacgcccggcaccatcagtgatgaagcgttactgcaggagcgccaggataacctgctggcagccatcttccagagccagcgcggttttggctacgccacgctggatatcagctccgggcgcttccgcctcagcgagccgggcgatgtcgagaccatggcggctgaactgcagcgcaccaatccggcagagttgctctatccggaggatttgcaggccatgacgctgatcgatcagcgccgcgggctgcggcggcgtccgctgtgggaattcgaaatcgacaccgcgcgtcagcagttgaacctgcagtttggcacgcgcgatctcagcggctttggcgtcgagcaggcgcatctggcgctgcgcgcggcgggctgtctgctgca

SEQ ID NO: 32224 - DNA, 447 bp, Glycine max
  Peptide Sequence Number=SeqID_149002
atgggtcaacttcaacggcaagccttccgcaaagcctatggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggctcgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 32225 - DNA, 189 bp, Glycine max
  Peptide Sequence Number=SeqID_149003
atggcgaaggagaaccctgccttcaggcataaattccgtgccatagcgtaccagaccaatttccttcagttccgcgtcgatggcataacgcagttcgcccggctgtgtctgttcgagcatctccacacggaggctgttcagccgcggttcgtatttgagcagtaccgcggacagcgtggtcatttactg

SEQ ID NO: 32226 - DNA, 611 bp, Glycine max
  Peptide Sequence Number=SeqID_149004
atgacaacttatcctaagcgtcacctgactaccggcggcgacccgcgcacgctggcagactacgcaaagctgcgtgaagaaatgcacaaactcagccacccggcgcgccccgacgttgactggctatacgcagaacggctttgcctgtcattgtttgaccgtaacggcgtagagctgcagaccgcggcctggtatacgcttgcccgtacgcagttaaccggattatgcgggctgaatgaaggcctggctatcctggaaacgctgattacccgtcagtgggggagcctttggccacagccggtacacgcgcggatggaaatccttagcggtttgggtaaacggctacagcaagcgctgcgtactctgacgctgacctatgccgatcttagtttgatttatgaggcggaagcgcatctgaaagcgctggatgctgcgctacagcgtctggaattaaagcatgccagtcagtttgatgcgttgctcaatttgatgcataacgcggcagtacggctggagaatagcgatggtgtaactagcgttgataccctaccgcacgtagtcgcgatggagaatgcttccacctatttggatgagcgggttgagcgaacaaa

SEQ ID NO: 32227 - DNA, 1066 bp, Glycine max
  Peptide Sequence Number=SeqID_149005
atggataggttgacgaccatgatgaatgcactcctgtcagcccagaactctcaagctgccgccgctgctgtagagcagcctttggtgagcacaaccccgctatctacagtgacttctccacccctctttctgcctccaggttgtacatggggaatgccacctccggtctgtggaagcccccaacccgccgtatctgaagttccacttcctttcgctcagcagtcagcaccggttccgcaacccggtacctctttccctcaagctgcaatgacctattcagcaccactgatccacactattcaacaagaggttgagccaattttccaagctgaaaatgttgtagccttcgacaagatggaagaactccaagaaagatttgatggtatgcaaagagaagtcgaagccctccgaggaagagatctgttcgggaaggacgcctgtgaattatgcttggtcccaaatgttactatccctcacaagttcaaggtgccagacttcgagaagtataaagggaactcctgtccccgcagccacttggtgatgtacgcgcggaaaatgtccatgtatactgacaatcataagctgcttattcatttctttcaggacagcctgactggggccgctctaaagtggtatatgaatttggacagtgcgagcattcgtactttcaatgacctgggtgaagcgttcatccggcagtataagtacaatctggacatggccccagatcgtgatcaactccgtgcgatgacacaaaaagagaaggaaacgttcaaggagtatgcccagcgttggagggaagtggctgcccagattatcccgccgttggaagaaagggaaatgaccaaaatatttctgaagaccctgagccagttttattacgagaaaatggttgcaagtgcaccaacagacttcaccgaaatggtcaacatgggggtacgattagaggaaggtgtccgagaaggacgtttgactggggaaagtacccctgccgcaagtaatgccaagaagtttggaggccactttgcgaagaagaaagatcaagaggtgggaatggtagctcatg

SEQ ID NO: 32228 - DNA, 363 bp, Glycine max
  misc_feature (359)..(359): n is a, c, g, or t
  Peptide Sequence Number=SeqID_149006
atgtgtgatgcaagtgattatgcagtaggtgctgtgctgggacagcgaaagagcagaatttttcataccatttactatgccagtaaagtgttgaatgatgctaagatcaattatgccacccttgagaaagaattgctggcaatcgtttatgcacttgagaaatttcgatcttatttggtggggtcaaagataggatctgaaaatgtggtagcagaccaactatccagattagtcaatgaagaggttactttaaaggaggctggaataaaagatgaatttcctgatgaatctttgtttttgattgcagagacaccatggtttgctgacctggccaatttcaaggcagctggtatcatccnctaa

SEQ ID NO: 32229 - DNA, 227 bp, Glycine max
  Peptide Sequence Number=SeqID_149007
atgacatggaaatacgatttgttgattgatgttggaaatgcattggcatatgcatgttgtgtatgttcgtggggggcactgtgcactgacctttcagggtctttggcactagcttttggccacgttcatacgttggatgttgtgtatgatcgtgggggggcactatgcactgaccttccagggtctttggcactagcttttggccacgatcatatgtcgtatgaagt

SEQ ID NO: 32230 - DNA, 354 bp, Glycine max
  Peptide Sequence Number=SeqID_149008
ggattgcgcctgcaagacacccagtggacccgaagaagtccaacagggtcttggagttgtcaagctctaattacgggtctctgtcagttctacggagtgtctgtcgcccccagcaaagtcatcagacccccctaccaatcgagctttcatcaagaagtactgcgcccccaggcaggcgcagggcgaaacaccacagcagcattgggatggccggtagtgggcaatagacacaccgccaccacctcatccgcaaaaaggttagagcgttgcctacgacacatggccgaccagcaggctaccaagtccaaagccaaaggtaagcaaagtactaggtcagtgactgacaagtcataa

SEQ ID NO: 32231 - DNA, 310 bp, Glycine max
  Peptide Sequence Number=SeqID_149009
atgtggacacgttgccctctaaaggcgagggcgtgcagccctctgaagtttaggacgtgtcgccctttgaaggcgagggcgtgcagccctctaaaggtgaggatgcgcagtcctctagaggtgaggtcatttaaccttctgatggtgaaggcgtatagccctttgaaggcgaggaaatgtatgcctctcaaggggaggatgtatagccctctgaaggtgagggcgtgtagcccttggaaggtgaggacttctaatcctttgaaggcgagggcttgtagccctcttaagcgaggacgtgtagtctctgaag

SEQ ID NO: 32232 - DNA, 261 bp, Glycine max
  Peptide Sequence Number=SeqID_149010
atggctcaaggattgtgctgttatttgtccttaaaagagatgaaacaagcgaccaacaattttgatgagccaaatgtgataggggtaggagggtttggaaaggtttacaagggtgttattgataatgggttcaaagtggctatcaaaagatcaaatccgcaatcaaggaggcatcaattgaccaagaaatcagatgtgtactcatttggggttgttttatctgaggcactttatttgaggaaggtagctttggatacttga

SEQ ID NO: 32233 - DNA, 258 bp, Glycine max
  Peptide Sequence Number=SeqID_149011
atgtcagggtttggccagcggtttggggataaaggggacgtcccacattatttccatgatacacaagcaacaatgatgattaagaaattttatgcaaaactggtcatgcatgcacctatgtggacactcaagcatcaagggaggagcttgccacccagctcgcccaggcgagctcagctcgcccaagcgagcaaggttgctttatccagaagcaacaaccttctggaggaagaatcaggaaggcccaagtgggcctga

SEQ ID NO: 32234 - DNA, 588 bp, Glycine max
  Peptide Sequence Number=SeqID_149012
ggtggacgttcttgccttaagaaggctgcacgtcctcgccttaagagggctgcacatcctcgccttcagaggactacacgtcctcgactttagagggctacacgtcatcaccttaagagggctgcacgccctcgcctttagaggattgcacgtcctcggcttcagaggactacacgtcctcgcctttagagggctacacgccctcactgtaagcgggctgcatatcctcgcctttagagggttgcatgtcctcaccgtaaaagggctacacacccccgccttcagaggactgcacgtcctcgccttcagaaggcttcacgtgctcgcctttagagggctagtcgcccttgtcgtcctcgacttcatagggctacacatcctcgcctttagagggctacacgtccttgccttaagagggctacacgtcctcgccttcagaggattgtacgtcctcacctttagagggctacacgtcttcgccttcagagaactcaagttcctgggccacccccttgatcttggaggagggccaactatgcgagcacagccagagaaggaggctatcgcccagctactatgcataccagg

SEQ ID NO: 32235 - DNA, 393 bp, Glycine max
  Peptide Sequence Number=SeqID_149013
atggcgatgctcggcgggcgtttcagtgatgtcgctctcatccagatggatacgtccgctgtcggcgttttccagcccggcgatcaggcgcagaatcgtggtcttaccgcagccggaggggccaagcagggtgataaattcgccatgaccgatggtcagcatagccgccggcgacagcttgccgtgatgaagggcgcgataatacctgaaaaatgcgccattgccatgttcagacacggaataaccttgaaaagtctgcaaattgctggagtatgctcatcgggccagccggacgggtggctggcagggcgaatttcagcgcacgattgggctgagagggctaacctgaaggataatgatttgacgcaacatggcgataatcaggccccatga

SEQ ID NO: 32236 - DNA, 444 bp, Glycine max
  Peptide Sequence Number=SeqID_149014
agcctgcaggttgtggctccaccacgaaccatcttgatagttgagcagttcatggagaaggtagcctggccaggaactcagccttctcttgtgagggaaggtgggggtcccagtgctcaggtacctcagcaggtacataatgcatcatcagaggccaccatccctgtgccatttgtttttaaggtaggagggacacaggtaaggaaggaggctgctactccagagaggtcaccacagatttcaccagatctacccttgccaatggtggatcaatcttctcctcaacagctagcagaccctcctacaccagtgcatgagatgccagtagacccttctactccattactgaagattccaaaggaccctgccacaccagtcctgggactgactaccactcctccagccactcttgtgctacattttacagatgaggagggcacttag

SEQ ID NO: 32237 - DNA, 189 bp, Glycine max
  Peptide Sequence Number=SeqID_149015
atggtttccaggacttccgtggctaccgtaaaatttccgaaaaccttggataggggtgtaaatagcaatttgagtctaggcccttctggaacattttggaagttgggttgcttaaggaggaagcaactgggcggcaagctcctccacatttttgaaaaatggtttccggggcttccgtggcttccgtaa

SEQ ID NO: 32238 - DNA, 675 bp, Glycine max
  Peptide Sequence Number=SeqID_149016
cgccacgcgggtggtgaaatcgcccgccgccaggcggtgggtgcccgccaccagacgcttgaccggggccagcatgccgcgcgacagcagccaggtcaccgccgccgccagcagggtggagagcgcgacgataatccaactggtgcgccgctgctggcgatcgaagttgatgtcggtattgcgcgtcaggcgctcgaccggggtggtgagcacccagccgacgatctggttgttgtagcggatcgggtggcgcggcccctctttcggcagggggccagaatgcccgaccaaacgattgaactggctgtccaccacccaaaactgggtgcgccagcccttgggcggcagattgtggctgctgtcgctgttctgctcgaacgagcgcatgatctgcgcttcgctcagcatgttgatgcgttgctcgttgctgctcttgatgtaatcgataaagccgcgctcaaagctgacgcgcaccccccaatgcatggtgatcaacaccagcatgcaggtagcgaaaatggccaggaacagtttcccggtaatgcctatcctcattgcaacctcgttgagccggtacccggctctttggtcagcgtgcggttgggcgcgctatcggccggcacgcgcgcgaaggccagcgcgggcagagcgataatcaacgccatacagcagtag

SEQ ID NO: 32239 - DNA, 752 bp, Glycine max
  Peptide Sequence Number=SeqID_149017
aagttgaggtcgatttagaaacaccgcgtggctcggtgaatgtggatgttctcgcgacagatgttaggagtgtggacaaaatcagatacatcgtggaatgtaaaaactggggtagttctataccacagactgtggtccattcgttcacaacggtaatgcatgaaaccggggcaaatattggatttattatttcaaagcatgggcttcagcaaggtgctaaaaaatacactcaaaataccaatattattgggatgacatatctagagttccaacaaaggtattttgaggcttggtggaataggtacttttgcccacgtatcggcgatgctgcagacgaaccgcttcaatatgttgaacctgtcaactataagcgcgatcgcgaatatgccaaacttaaccttcgagaacaagagaagttcgatcggttaaggcaagagaaaggtgtatcagtaatggctctctctatgcttaattacaggtttatgtcgaaagctttaaacactggcaacttgctgaacgtcccaaagagtctggatgattttaagaccagagttctcacccaaatttgtcctcacatggaatggcattgtgatacgtacagagagctgctagaaattatcttagaatatttatcagacaccaaagcagagtttgatgcgatatttggtgggactatctttgaaccgctagggactatcacgggggttactgccgctggcccctctctggatgatggtatttatcataattaa

SEQ ID NO: 32240 - DNA, 669 bp, Glycine max
  Peptide Sequence Number=SeqID_149018
gagaaatggagcggcgatggcgcaggcatcaaggcgataaccggcggcgatgcggtggcaatcgacccgaaatatcgcgatgcctattccacacacatcccggcggtgattctggcagctaataacaacccaatgcgcttcagcgatcgcagcggcggcgtgtcgcgccgtcgggtaatcctgacgttcccggaagtgataccggcaaaagagcgtgacccgcatttgctggacaaaatcagcaccgagttggccgtcatcgttcgtcacctgatgcaacgctttgcctcacctgacgaagcccgcgagttgttgcaagcgcagcaatcatccggcgaagcgctggagattaagcgacaggccgatccgctggtcgatttttgtggctacctgatgccgctcagcacgccgaatggactgtttatcggtaacgccaatatccgcccgatgaacccgaaacgttatctctatcatgcgtatctgtcattcatggagtcacgcggccatcagcatccgctgagcctgaccgcattcggccaggcggtgccgcagacgcttaaagagtatgagcccacccttctgaagcgcaggactaataacggcatccagaccaatctcatgctacatgaagacagcgaggcggattggttgcccacatgcagcgactga

SEQ ID NO: 32241 - DNA, 2184 bp, Glycine max
  Peptide Sequence Number=SeqID_149019
atgaacaaacactttaactgcattgggatcgtcggccatccgcgccatcccactgcgttaaccacccatgaaatgctctggcgctggctgactgacaaaggctatgacgtgatcgtggaacagcaaatcgcccgcgagctgaacctgcaggatgtgcgtaccggcagcctggcggatatcggccagtatgccgatctggcggtggtggtcggcggcgatggcaacatgctgggcgccgcgcgcgtgctggctcgttacgacatcaaggtgattggcatcaaccgcggcaatctcggcttcctcacggacctcgatccggataacgcgcagcagcagctggatgacgtgctgcagggcgattatttcgtggaaagccgctttttgctggaagcgcaggtatgcaaagaagagtgttcgccgcgcatcggcagcgccatcaatgaagtggtgctgcatccgggcaaagtggcgcacatgattgaatttgaagtctatatcgacgaagtgttcgccttttcccagcgctcggacgggctgattatttccacgccaaccggttcaaccgcctattcgctttcggcgggcgggccgattttaacgccgtcgctcgatgcgattgcgctggtgccgatgttcccgcacacgctgtcggcgcgtccgctggtgatcaacagtgattgtatgctggcacaactgaccatcagtaattttgcaatcgttcgtgaactggagatcgactttcatcgtggcatgacagcgatcaccggcgaaaccggcgcagggaaatccatcgcgattgatgcgctgggcctgtgccttggcggccgtgctgaagcagacatggtgcgtcagggggccagccgcgcggatatctgcgcacgcttccagctgaaagcgtcaccctctgcccagcgctggctggtggagaaccagctcgacgacggcaacgaatgtctgttgcgccgcgtgatcagtgccgatggccgctcacgtggctttatcaacggcacgtccgtaccgctgtcgcagctgcgcgaactcggtcagttactgattcaaatccacggtcagcatgcgcatcagctgctgcttaaaaccgatcaccagaaacacctgctggatgcctacgccgcgcacgacgatcggctggcggagatgcgtcagcactatcagcgctggcaccacagctgccgcgcgctggcacagcatcagcagctgtcgcaggagcgtgaagcccgccgcgaactgctgcagtatcagctgaaagaactcaacgagtttgcgccgcagccaggcgagtttgagcagattgatgaagagtacaagcgcctggcgaacagcggtcagctgctgtccactagccagcaggcgctgcaaattcttgccgacagcgatgacaccaacctgcaaagcctgctttacagcgcgcgtaatatgctgagtgagctggtctcgctggatgataaagtcagcggcgtatttaacctgctggaagaagccgcgattcagctgagtgaagccagcgatgagctgcgccactactgtgaacggctcgacctcgatcctaatcgcctgtatgagctggagcagcgtctgtcgcggcagattgcgctggcgcgtaagcatcatgtttcaccggaagcgctgccggtgctgtatcagcagctgctggatgaagcggaacagctgtcgcagcaggagagcgatcaggaaagcctgcagagcgacgtcgtggctcatcatcaggccgcgctggcctgtgccgaagccctgcatcagcaacgcgtcacctcggcgcaggagttgagccagctgattacgcaaagcatgcgcacgctcgccatgccgcacggtgagtttgccatcgtgctggaattcaatgccgatcagctgacggccgaaggtgccagccgtattgatttccgtgtcaccactaacccgggccagccgctgcagccgctgggtaaagtggcctcagggggggaactgtcacgtattgcgctggcgattcagcggtccgacggccgctgttgttggccagatgctgcgccagttgggcgaatcgactcaggtaatgtgcgtaactcacctgccgcaggtggcgggctgtggtcatcagcacttcttcgtcagcaaagagaccgacggtgcgatgaccgaaacccacatgcagccgctggataa

SEQ ID NO: 32242 - DNA, 525 bp, Glycine max
  Peptide Sequence Number=SeqID_149020
atggaggtcatgttgagcatgaagaaaataatggaaagcaatacagctgcagttgccactacaagtgccgccactgaggtagacccgactcacccatcgagcctcaatcaagtaaatcctccaatctcggatatggtaggtcagggagaagaagcattgggaagtacaggcagtccccatgttatgcagagcaagaattctttcccaccatatggcttgcctcccaactatacaccacccaatgttgcacatgctctcgatgagaatgtcaataactccactcccatgctcattgagagccaacaaccccaatctgtgccccgagaccacactctagccgactctgagccttgcctcggatatgctactaaggggcaagcagtccctcctgctatggtggaaagggagagatttgatcatataaagaagaggttgagggttcttgaagaaggtgaaaattatgcctttgctgacatgacagaattgtgcctaatgcttgacgtcgttatctctctgaagttcaag

SEQ ID NO: 32243 - DNA, 759 bp, Glycine max
  Peptide Sequence Number=SeqID_149021
atggccaaacgtttcaaattgaagttcaatatcccttcgtttcaaatgtgtcgctcaaaagacctttcctctttccctggaaaccccgttcctgccatataccgtctttcacccgttaaccacaacgcacgtgacacaaagcatccaagccttcttccttctccttctccgtcaccgtcaaagataacgtccatcgcgcagagatgcaaaatgtgctgcgacaaggacagtttgaagaaactgaaatccagcgttccgtcgaggcgaagcgattttctgatcgacaacgtcgaggaagacgaaagcgagactctgatttcttgcatgacaagtttctccgacgagttttgtctcggcgaggagaaggatttgagtagtagtagcagcctgagaaggaagaagatgggcagcgtaaagaaggttcggagggtgaggtttcagagttcggagaaacggagaggaacggaggtgaagaagacgacggtgacgaggagaagtgtggaggggaaggtgaaggagagcttcgcggtggtgaagaagtcgaaggatccttatgaagacttcaggaaatcgatgatggagatgataacggagatggagatgtctgaggccgaagatttggagcagcttttgcagtgtttcttggctttgaactcgcggagttatcatgcagttattgtgcgggctttcatggagatttggcaacaaatgttcgtaatgaaaaatctccaaacgaacgttaaaactcaggaaaagtaa

SEQ ID NO: 32244 - DNA, 360 bp, Glycine max
  Peptide Sequence Number=SeqID_149022
atgggggagacacatgaagtaccccaagaccacgctctagccgactttgagcctcacctcggatatgccactgaggggcaaacatttgaagaaaggttgagggccattgaaggaggcaaagactatccttttgttgacatggcagagctgtgcctagtgcctgacgtcgttatacctccgaagttcaaggtgccaaatttcgacaagtacaatgggactacttgctccaagaataacctgaagatgtactgccggaaaatgggagcgtacgcaaaggatgaaaaactcttgatgcatttttttcaaaagagtttggttggggtggctatcacttggtacaccaatctggattcttcctag

SEQ ID NO: 32245 - DNA, 465 bp, Glycine max
  Peptide Sequence Number=SeqID_149023
cgcctcgggtcggtagccgggctccgggacattactaccacggctactatcgacccgagcccaaagaaggaaaagaacggactaaagcgaggagttcattggccatacatagtgaagggggatgggggtcaacctctttcatgacccatggccccattgagacacgtttttcggatatggattttttcgagatggttaaccacttttttaaccgtgagagggaggtcattcagaacccgctggctccagtccagaaccggtggaagttccccacgccgatcccccaacggcggctttccgttcactttccggaaattgaagaaatctattccagtgtcgcagagaacattatgtctcgcgatctggaaatatctgcggagatttctattgaaactctccgcggatgggtggaggagataaaggagaaccctaaatcccctaaaatcctctcattagggaacacct

SEQ ID NO: 32246 - DNA, 163 bp, Glycine max
  Peptide Sequence Number=SeqID_149024
cagtgtgcgtatctgggctgtatcaacttgtgctggatgagatctatcattctcccgaaaaatctgcacttaaagaactaaaagatgaagatgtcctggacattgtatccgacatcgtggatcctgcacaatctgttaaagatataacagatttatgtgtcca

SEQ ID NO: 32247 - DNA, 411 bp, Glycine max
  Peptide Sequence Number=SeqID_149025
atgtcgcggaacttcacggattgcctaacgatgggtgtcaagttcctcgaagtggtcatgcgaaggtcgcatcccaccaaacagatgatatccagctgtgcaacatcatcaaagttatggttttggcacctctacaacaaagctttcaatctctcccacgtcttacacagaggttcgtcagatccttggtgtcgcaacctacctttcggcgggaaggcgacgcgagggctcaccggtgcgtcttccaaaggaggaaaatgcgcggagtcgccaccaacgtttatttgtggaaaacgtcagaaaaaccgaaggaaaccggtcatgaagaatattccagattcaggagttgtatttacgtttgaggaaggtattagcacctctcacgtttgtcctaaaggacaacagccttaa

SEQ ID NO: 32248 - DNA, 366 bp, Glycine max
  Peptide Sequence Number=SeqID_149026
atgaatgtgttgaaaacgaagccccaagagtcgatgttgaaaagcatgttctctctgtcaaactcccattcggaacctcctctctcagtgtcacgaaataggctacgagcctgttctgcttcgggtttgggaattgaggttcggggaggagaatggtttggagtggggaatagttttttgggagaaaaggatcacgtgaccggaggaagggaatggataagcgagcacgtgagttattgccatggacatgtttggactttgggtctcagggtctgtgatgatgcttcattgagtgaaattggaggaatgcatatggtgcttaagaaggtttttgacttttgcgtcactattgacaacttcacatag

SEQ ID NO: 32249 - DNA, 372 bp, Glycine max
  Peptide Sequence Number=SeqID_149027
atgcttcctaaagaaaacacattgccgaaaaatcactacaaggtgaagaagattttatgtccggtgggaaaggagtacaagaaaatccatgcatgccctaatgattgcatattgtatagaaatcggtttgtagaaatgtgtaagtgccccacatgtggggtatcattgtacaaagtcaaggatgatgaattcagtgatgatgcaagcaaaaacaatagtcgtctagcaaagatgacagaaaaagtgatggattgctctgacatccgactgattctccataatggaagacaattgattgtatccatattttgtagacgagctaggaaacctaaggcttggtcttgcttcggacggaatgaatccttttggtaa

SEQ ID NO: 32250 - DNA, 408 bp, Glycine max
  Peptide Sequence Number=SeqID_149028
atgcttctaactcacattcacgttttctctcccttcacacgtttcacttatgcacttcatgcctcgcccgtccgtgcctcttccgctccaacacggcgtcgtttggtcaaaaccgccgctcctcaggaaccgaagaatctccggcacctcacttcgcgcattgttcaactcactcgccgaaaacagctccgccagattttggatgaggttgaggttgcgaagaagcatttcgggaagctgaactcgattgtgatgaacgcggtggtggaggcttgtgttcgatgcggcgacatcgattcggcaattagaatattcgatgagatgaaaaagcgcgatggttgtggtgtggatactgtcacgtatgccacgcttttgaaggatctgctatttttagttgtagaaaactag

SEQ ID NO: 32251 - DNA, 198 bp, Glycine max
  Peptide Sequence Number=SeqID_149029
atgactaatgcaaattgtccgcaagagtcattgcattcagtctcaaatgggaatctaagttgggtatatgtgtattatggaaatctatccactattgctttaagtctgaaggaccctgttagtgtgaaggagaggagggaaggttttctgcagggtttgggcttagctgattctacaaaccaactatcttgtgcctaa

SEQ ID NO: 32252 - DNA, 390 bp, Glycine max
  Peptide Sequence Number=SeqID_149030
atggaagtgctacgattgtgtgaagatggattaatgaaaaggtttgtgtggatgatttttgtgatggtgaccgggtgttgtggattcaaggagctttggtacttcctcgtatttgattttgttgcaggcgatgctgaccatgaggttcttggcttcatggatgatttcaaacatattgatgccgactatgaggctcttggcttcatggatggtcttacacatgtggatgtcgaccataagactcttgactttatggacggtttttctcatgtggatgcggaccatgaggctcgggcttcatggacgatttcacacatgtggatgccgaccatgacgctcttggcttcatggacgatcttactcatgtggatgccgaccatgacgctctag

SEQ ID NO: 32253 - DNA, 567 bp, Glycine max
  Peptide Sequence Number=SeqID_149031
atgtgcaccaatccctacaacaattttagggataagagaatcatgaaaaggtcagtcaatcaagtggagttagccgaatctcattttgaactagggcaacaaattatggctctctctaggaaaatagagagattcatgaaggcaaaatctcaggccattattacctcactccatatccttcttatgatagatgtaggtatgtacatgctccaggctcttactaaagagaaaaaggatgagaatgaggtactgacacctgctcagaaattgcctcctaagctcatagatccagagaatttttcaatcccttttactattagcagcttgcaaattgatagattgttatgtgatctagccaccaacaagatgaaaacaattgtggccaagcctcgcccaagtgtgaggaaggaagaccgtctaaaaaggaatatcattctaaagaatcaccatgaagggggtacaagagatgagaatatgagagatgacagcaccattcaagttcttggatatggagtggatgatcatattgaaggatcattttacgaaaagatcatcaacccattctag

SEQ ID NO: 32254 - DNA, 150 bp, Glycine max
  Peptide Sequence Number=SeqID_149032
atgtctcctccacctctaatcactcacagactcatctcatgctctcaagatggcttcctcttcactctcagttctctgccagtcttcgcacagcttaaattggtggccttgttggtgcttgcacgcttagtgcaactctggctcgcttag

SEQ ID NO: 32255 - DNA, 207 bp, Glycine max
  Peptide Sequence Number=SeqID_149033
atgtgtttggtgtttgtgtgcgacgaggaagaaagggtgttggggagacagacagcaccgggggcatgcccttattgtggagggatggttcaggccattgatgtagagagccaatggagattctgttttctacccttatgctttaagaccaaacgcaaatactattgtaccatgtgcacaagaagactagagacaaacaccatgtaa

SEQ ID NO: 32256 - DNA, 705 bp, Glycine max
  Peptide Sequence Number=SeqID_149034
atgacaaaggtatggagaaaaaggttctccttaatgaaggccacgagtaagggagaaattctctatcttagcaccattccaaacaatattcaaggaagaggatctaacacaccacatgatgagggaaacaatgataggagggaaattaaaatcatgcaagacctactacaaatagtcccatataaccctgtcataatccttcaacaagtcaatcttaaaggaaattacacccttcttggctttggaatgatgggtgtagtggacaacttcctagggcataagggcattcttagaagtgcctctcccaatgacaaaatttccctaaaaagggttgataatatcatcctgatacgacctaagacgctgcacaagaactttagtgatgattttatatgccacattacacaagctaatgggcctgaagtccttgaattgcttgtatttgctttctccctctactctctcacactctctgtattctcactctccctcttactcttcgattcccatctagggttcagaagccgcaactacacttgttggtgctcccacctccctaccaaaccctctgtctgccttcccaacaacaaaaacaactcctccaccatcactcacccaaccctatcagaatgcacagtgcaacacgctccaaagcagagcatcttctcaagatcgcaaagaagctcttctagaaccgcaatctaa

SEQ ID NO: 32257 - DNA, 165 bp, Glycine max
  Peptide Sequence Number=SeqID_149035
atggtggtgatggttgcttctgatgacgcagaaatttttcacacggttgccacagcagctgccattagtgatcaaccgtgttgtttccgataccagaagggaaatggagttggtgttgaaataccaccagggaataaaggcattcctcttgaggaaaaagaatag

SEQ ID NO: 32258 - DNA, 129 bp, Glycine max
  Peptide Sequence Number=SeqID_149036
atgccgagtacaccgatgcgtttatgggatctatgtagctcgcaaagagagcggacatgtcgtctagaagatggaggagtaccaggaactattgaggcagttggaaccgatgtctcaggaggagagtga

SEQ ID NO: 32259 - DNA, 222 bp, Glycine max
  Peptide Sequence Number=SeqID_149037
atgacttctggcttagcgccagtcatgttcactcagcttggaggttcaagcgccttcctccaagatcagtgggtgccccagaaactggctgatgacatctccttcaaaaggaatccactggcccctcacccaagagcgtatgtctcaggtcccctcttccgtaggccaggcattagcataaaactccatgactatttcaagaccgaacttagccatgggtga

SEQ ID NO: 32260 - DNA, 402 bp, Glycine max
  Peptide Sequence Number=SeqID_149038
atgatgagctcggcgtcgcatcccccattttacattaatgctattgagattaagtgggaacataatgacacactccatgtggatcacttctttgggttcctaagttgccaccgaatgccagatgtaccaggagccaggattcgcatcatcgacttttgtttttcatggacccaacctaaaccatcctataattgcttcgtgacgcccatgcctaaggttgtcattccatccgagtcacattcgttatttttcgatgttatgatgtcttctactggatctaactcctcatccaaggatactaatgccatctctcctttgatgtctcctcgttcgctgttgcctaagtcttgggtaccacttggggtggatgtggtggatctcgtgtcagtagatgaggggtag

SEQ ID NO: 32261 - DNA, 462 bp, Glycine max
  Peptide Sequence Number=SeqID_149039
atggagacaatgaaatttcgaaagggaaaatggatcaccaccattgtcaacaaagcagatacggtggtggaaggtgttgaggatgaagagcttgaggtcgacgaaggtgaggatttggaagattgcaacgaaggcatgggtgtggtggaagtggggctaacagttggcccaatcaaagaacttgatgcaagggaggatgtcgcggtgggcggtgctaaggcaaaggatgagggaagctactatctcaccttcgtgaaccacgtcttgatggaggacgcaatgacattttgggagataagaaaggaacttgaggttgaggatgttgattgggagggtgatgatgcaaggaaagtgtatgtagcatggtcggagcacaagttgagaatggaggacatgaaggatttggatttgagatgggttgagaatggaggagacaaaggagagagaatctgggaaaaataa

SEQ ID NO: 32262 - DNA, 687 bp, Glycine max
  Peptide Sequence Number=SeqID_149040
atggtgttctatgatgagagtttcttgttatacttagcctctgttgttgggaagcctatcaaaatggatacgaatatgttgcatgcatatcgcggtaggtttcctagggtttgcgtccaagttgaccttagtaaacctgctatggggcgagtcaatatttggtatcatattgagtatgagagcttgcatcttctatgtgtgttgtatggtcattatggccatcaaaaaaaggactgttcaaagaatgtggtgcgcaaaaagaaaggcaattggaacaagaatctatctttaacatatgattggattaaatcaggtaacaattattcccaaaatattttgtttgatttaaaatccaatattgtctcaccttccaaagatcaagatgagagggcccacaatgtttatgctcaagatctagagaggaaaaggtcatgtaaagaacaaatacttcctttccatacaggtggcatcgtgggcaattcctccactcaaaagaatctgaagcaaaagtcagttgcttcctcctccaatgaagaggctaagacccatccgtccaagagttcgaataccacaattcctcttgtttccatgaagacgtctgctaccattgcggataaagctcccattaatgaggatagggatattcagatgttggatgccattgaggtggacataagaccaaaataa

SEQ ID NO: 32263 - DNA, 561 bp, Glycine max
  Peptide Sequence Number=SeqID_149041
atgagaggtacattctctgaatctacttgcaagaaaatctatcctattcccttgagaagaatcaagatgaatgatttccttatctggaaatttactaatgatgcaatctacacagttaaatctggttattatcaggctctaggagataaccatacatctaatttgtcctctagttccttctcgggggatatttggggtaatatttggaaaatcaaaactgtccataagggcgaggaaccaatagacctctcaaaagaggagaatccctatccgttttgtgatagacaagttcaactccttaagggtggaggatcgagagctgaatcgggggaccatgatggagaggttctggctgcagcttctctttttgtggaaactttgtatgatcctcatgtggcagagactttggctcttcattgggcgatggaaactgcaagatttcttctacaaaaactggttcaatatgaaactgattgtaaaagattagttgatgcttggactgatggccgtgtgctgcagaaagattacttcacaagggttttgcttgatcgtaaaaactaa

SEQ ID NO: 32264 - DNA, 588 bp, Glycine max
  Peptide Sequence Number=SeqID_149042
atgtctctgtttggtgcttactctatctgtgaagttggcaaggatgcggctggagttgctgggaacatctttgcttttggtttgtttgtgtcccccataccgacatttaggagaatcatccgaaatgggtcaacagaaatgttctccgggttgccatatatttattctctcttgaactgcatgatctgcttgtggtatggcacaccccttatatcacctgataatctcttggtgacaactgttaattctattggagcagcctttcagcttgtgtacataatcctcttcttgatgtatgctgagaaagcaagaaaggtgagaatggttggattactgctagcagttttgggcatatttgtgatcatactagttgggagcttgcaaattgatgacagtgcaatgcgccggatgtttgtcggattcttgagttgtgcttctctcatttcaatgtttgcctctccattgtttataattgtaccaaatgggataggaactgttttaggaataatacaattggtattatatttctattataaaggttcatccagtgaagagtgcagagaacccttgatagtgtcgtacgaatga

SEQ ID NO: 32265 - DNA, 375 bp, Glycine max
  Peptide Sequence Number=SeqID_149043
atggtaataaaatttcacgacgatccaacggtgaacaagtccgagatcatcgtttttctgagacaggtttggtgggctgcgggaaaaagaaagaattttgagaggagaaggagaaaaacgaaaatgagggaaagaagatgcaccgtcaatgtgaaaactgacctaacgctatttatagcttgttgcaaaaggttgttaatgatccatgaggatgatgttactcgaaaatgtgatcctgaccttcaagctgagccaaagaactccataacggcaagcacatcctggtacctccttcaagccaatttttttggtgccgacaatgctcaaccagggcaagatgttagggacgaaaagagacaacatcataatgactag

SEQ ID NO: 32266 - DNA, 204 bp, Glycine max
  Peptide Sequence Number=SeqID_149044
atggaaagcaacccctccaaagctcagaagaaaggcaagtcttccaagaggaagcatgtttgtgcgcttaatgagtgtgtcccgctaagcgaggcaccagcgttctcagcaagactcaagaatctggaagagaatctgccttgcaagcacacgctcagtgcgttgtcactcgctaagcgagtcatccgtcatcttccaggctaa

SEQ ID NO: 32267 - DNA, 378 bp, Glycine max
  Peptide Sequence Number=SeqID_149045
atgtgggcttttcttaccggtcgtcagatcgactgggcccatttggttcggtaccgaatgcataaggcattacgggctaatgcacctctcccttatccacatttgattactctgtttttgcgtcattttcaaattccgcttgatgatgaatcctttgttcaagtcaagcattcctttgcaattggtgctggtgcagtgacctcctttgggtaccataaagatcggaatggtcaatggttgaagaaggatgcacttcctcctcaagatgaacgtactccttcacctcctcttttccggtattgtattgtcatcatcaaaaagggggagattgtagatgcaattgcttttgatgttttgatgatgatcatgatgatatga

SEQ ID NO: 32268 - DNA, 342 bp, Glycine max
  Peptide Sequence Number=SeqID_149046
atgtcgacttggcgactcccacaaaaagaatctctctccatgtcatcaattgttgtacatctgctcccacaaacgaaggttagcgatcatcacaggaaaactaggcagcaagtgtctaggtcaccctatcgtgcacaagaaactcgccccatggtgattagcctgagtcacaagggagttccaaaccgagtgacatgcctccaagtacaagtattttccctcatgaaaaacagtgatccaacggttaacgagtctgggatcactgttttaccggaacgggtatgggtaaaacttgaaatctcacaatttcaacataggtcaatcaaactccacataacctaa

SEQ ID NO: 32269 - DNA, 798 bp, Glycine max
  Peptide Sequence Number=SeqID_149047
atggatactgatgcagtgggaagcgaagggtactctccgctgaaggaattaagactggaaattgaagtaaaggagggaactttctctctctgcttttggctttatttgacgagttccactacattccctgttaccattatccaacaggttttctctgatatctccgaaagtgctccttttcttgttattgatgataataagagaatccatatgttaccagttcttctcttacatgaagaagctcctgaaactggcaatataaattcctggacagaagttccacatgcaactgttgattttgagtttcttttggaaaaatgggttcatgttggatgtgagtgccctcctctgaagttatcaattgatgaatcgtctgtctctgagattgaagaagaaagtgatggtgtttggggcattgttggaggcaaggcatcttgtcgtaggaacttctctttggatgttgttctatccgatgcttttggacagcctgtagataaggagaatgaggtttttgcttcacttttgtatgccgacacgggggcaccagtggagaatacagccgatgatgaagcaccccttttagctagttatgatggaatagaattttcctcttgtgaaagaccaagtaagcttttgctgggacgtgcttcatttaagctcaaaatatctcagaatggtgtggcggattttgaacacaaagccgttagaggagcatggcatggtggcatatggcagctgcaatgtgtgtggaaaaggaataagcctataatagaaagagtgtgctgggaaaaggattag

SEQ ID NO: 32270 - DNA, 1431 bp, Glycine max
  Peptide Sequence Number=SeqID_149048
atggaggacgaagatggaggatggggagaaatgttttattcattacagaaatgggatccacagctaaggcctgcttatagactgacatggatgcattgttggggaataccgctgatagcatgggacatacatcacatcaagcagatagtgtcttctatcggcgatatgatggacgctgatgaagatgtagaggaactaaggaagctggatatggcgagggtcttaatcaaaacaccatggaagccactcatacaacacactgtgaatgtacagattcaaggagaagtatatgcggtacacatagtggaggatagcgagaaatcatgtgtcaattgccgacgccagcgatggaacgattatagctctttggaggatatttgctcagaggaaagcgaagctgaaatttcacggggagatagcttgccgacatggtggaactgcatgcgcccgcaaaatagaatggtggcctcaggggaaccgagcggaggtgtcactgtgtcgggggaagagaacgatggagaacacccggccgtagcgagggaagcacggacgacggaggtaaaaaacaagctagcttgcggcgagggaatggaggcacaaaccagcctgcacgacgcagagcaaccactgtcggagagaccttcagaggacggcgtgacagtgaatattggtgcccatcagcagcaacgggagaccactccggcacaacggtcaccggaaaagcttgctgacagcttaaacctggcctcggaggaagcggtttcagggaagaggaccattgggtcgggtgacggaccggaactggaggacatggctattacccgttgggcacgcacacaaactgacagtgaccagtccgctgaggatgttgcacagttgtaccgtagggatgaggtagtgctagtacaaacagacttgcacaaaaagggggagaaagagcacaacgggaagggtgccaatgaggacagcagagagaaatttcatggaaatggaaagatgggggcagatgtgaacgttgaagacataggcagatttaaacctgttagggaggagccacgtgatggacaggtggagagaggagtggaaaaggcaattcgaaggatggtcattgaacaacatatagacatgttgtgtcttcaagaaacaaaaaaggagatggtggagaagtccatgtgtgcagcattatgggggggatctgagattgggtgggaatcatacccctcatctaattcagctggtggtattctctgcatatggaatgtgaattcgttcagagtagaaaacaaaatctcaggaacaggttgtcaaggtcaacaggtggaagtgttggtggatagctctaacatgtctttctactttggacttggcttcgtaactttgagaaggactttgggacaagctataaccactggtcaagcaatcttcgattag

SEQ ID NO: 32271 - DNA, 1074 bp, Glycine max
  Peptide Sequence Number=SeqID_149049
atggcaatcaacaaggaggtgcatccctgttttactcaatggagaaatggagcccaaccttacgcactggatccagctatgggggaaatggtggatatggacgatgacgcggaagataaaaggaggttagacagggttagggtgcttgtaaagaccccgaggactccaacgatcaagcacaccgttgaggtttacatcggagacgaacgctttaatgtgtttatcgtggaggaatgcggcggcgacagtcatgactgccggagaagtcgatgtagcttttgtgaatcgtcggaggagattgactccaatgaaagctacaatgggagcatttccccgaggtcgataaacactctcgggattcgacgatcaagcacaccgttgagtcgatgtagcttttgtgaatcgtcggaggagattgacttcgatgaaagctacaatgggagcattaccccgaggtcgataaacactcttgggatggaggacgaagggcacgtcgcagtggtgctggtgaccgcacaaccccgctcgttggcagactcacccaacgacgatgctgaggaccgaggaacaaaactattacccagcagtattcgtgaccaccattccacaccgggtaaagcaagcatcccgcgagtgcaaggtagcagatgccaggtcacatcatgcaaacagacgatgcctgcagtgccacaaccaatggtcacctgccaccgtgatatgctaaccaaatgcggaaaacagcagggtattggaagcgccacccttgaagaaatgctggagccgaatcatgaaaaaggaaaaaagtgttttgggagaaagctacagaggtggttcaaaaagaaaaaatacatgggccagaattctcctaaaacaatgacagaaacaggaacgagtagtttgcaaggccagcaccttcaggatgaaatacagcaggggaatgcttccaatattaactgtgactctacgacaaggtcagcaatacaagttgaagacccagaagaaattatggaaacacaatgcattcaacaggcaactaacatttggagtatggctaagcaccttggggctacatga

SEQ ID NO: 32272 - DNA, 327 bp, Glycine max
  Peptide Sequence Number=SeqID_149050
atgaaactctacgaatttcgtaacgatacttattttccttccgcaaggttacgaatccatacggattatgtatttactcattctctagcttttgaagaagttacggaacctcacagattgcgcaaaaacacctcttttcgacttcccccacattacgaaatttcacggatcgcgcaagcatacttccttttgatttctgagacgtctccggacttcatttattccatgtcatcaaagtattttttgaagttggattgcttcttgacgccaccaacccagctcgcctgggcgagctgggcagcaacctcctcccccttttttctataa

SEQ ID NO: 32273 - DNA, 726 bp, Glycine max
  misc_feature (9)..(9): n is a, c, g, or t
  Peptide Sequence Number=SeqID_149051
atggggtgnttggagtaccaaggaaatgtttggaagcaaaagcaagagtcttggcaggtagcgattgacgcttttctcgcctttcatgaccacaaggaaagctcagttgtcgctatcttagccgatctatatgacaccttcgaccgaagatgtgaaaagaacagtgcaaggatcatttgttgtactccggccctctatgtatggttggtttcgcaccttttccgccaagaggtgagacatgcttgcccgctagaaggccatcgctcatgcacagagaaaaaaaaggcaagttgggaccgactcttagcaagcaaagaaagagcgtctgtcaactggttcccccaatggaaagaaggaagaaccgggattcttatttcgtgcagaggatttccaaattttctcttgatggggacaaggggttgcattaattacaatcccatcctcgccataagacaacttggctaccctatgagaggggcaccattagaggaaggcctcacacctattattgcacgaggtttcaatagcaccaacgcgggggcgcttcagaaggttcgcaaggcatgggagatgatgcaaaaaaagggcaaggaacttagaggcagtagcaacgggcccatcggcggctaccatgggtggttgaaagcctacacacaagatctagattggttcccgaatttgagacccactaagaggttggagtttgaaactccggaagaaagatga

SEQ ID NO: 32274 - DNA, 904 bp, Glycine max
  Peptide Sequence Number=SeqID_149052
ctggccgccagcgacaaaaaactggcagcgctcagcgcggagaagcagcagcaggagaaaaacatcgccacgctgcagcaggcgctgaaagaggcacagcagcagcaaagcgccggcagcgcccaactgacgaaacagctcagcgacgcgcgcgcggccgccacccagagcgccgacgcgctgaagacactgaaagcggaaaacgacaaggcgctggcggcgctgcaggctgagagcaaaaagcagctcagcgcccagcaggccgggaacgataaaaaactggcagcgctcagcgcggagaagcagcagcaggagaaaaacattgccacgctgcagcaggcgctgaaagaggcacagcagcagcaaagtgccggcagcgcccagttgacgaagcagctcagcgacgcgcgcgcggcggccacccagagcgccgatgcgcttaaagcgctgaaagcggaaaacgacaaggcactggcggcgctgcaggcagagagcaaaaagcagctcagcgcccagcaggcggagagcgacaaaaagctggcggcattacaggctgaaagcaagcagcagctcagcgcacaacaggctgagagcgcccaaaaactggccgcgctgcagacgcagcaggccgagcgtgaaaaacaactcgccgcgctggacagtgacaaacagcagcaggcacacaacctggcgcagctgacgcgggaactggaggcggcgaagcagcaaccggccgccgcgccgaaactttctgccccgaaaagcgatgccgaacgcgatggctacacgctgggtcagttcattgccagcaatgcggtggtgcagctgcagatggtcaaagacatcggcctcagcattagtatggatcagctgattgccggcttaaccacccagctgcaaagcg

SEQ ID NO: 32275 - DNA, 204 bp, Glycine max
  Peptide Sequence Number=SeqID_149053
atgaatgaaatggccccaaggaagcttgcctcaaagagatccaggaaggataaagcggctgaaggaaccagttccactcccgaatatgatagtcatcgttttaggagcgctgagcaccagcagcgctttgaggccatcaagggatggtcatttctccgggagcgacgtgtccagctcagggatgacaagtataccaatttctag

SEQ ID NO: 32276 - DNA, 657 bp, Glycine max
  Peptide Sequence Number=SeqID_149054
atgtctccaaacaatcaccacattccttgggagaatgcagtgtatgagattgaagagcaattcatgaagattgcttcttgttgttcaagatctctctcacctcaggacctaaatctcctgagaaggattgctggatgtcaagagtacctaacacaagagaactttgagaagttgtggtgttggttgtaccctgtggcatttataatatcaagggactggataaatcctatctggaattccacatcacctaagtggatagaaggattcataactaaggaggaagcagaatcttcacttcaaggtcccacaggatttcaagaacctggtacctttatactccgatttcctacctcaagaagctggccacaccccgatgctggtaatctagttgtatcctatgtcggcaatgactacaaacttcaccacaggctactttctatgcatcatgtttatggctctggtgataatagagttgacgtgaaaccactgcaagatatgttattggcagaacctgagctttctcgattgggaagtgtatttgattcatgggcgactgttcaggataataagaagccattaggcacactagaattgttgcagaaggtacctcaacatccagttaaagttgctttcaaggttggcttcggtggcagttga

SEQ ID NO: 32277 - DNA, 132 bp, Glycine max
  Peptide Sequence Number=SeqID_149055
atggcacagaggccacctatttgtgggagccaaggaattctagagctaggcacagtgattgtgggacttgagacaagaggtaaagaggcatttgttgtcatgcgagaggtggagtttgatggaaaaatgtaa

SEQ ID NO: 32278 - DNA, 627 bp, Glycine max
  Peptide Sequence Number=SeqID_149056
atgattcgcagacattgccttcagcattttattcagaacctagagattttggtgcaatttgcgactattgttgatcatgatgttggttgcgatactgaagcttatcatacctgggagcaacaagatcagttgttgctctcgtggcttcaatccaccatttctaatccaatgcctcgcaaattaatcggttgcacgagtttgtggttgctgtgggataaaatccacaattattttcatgctcatatgaatgtgaaggcgagacagcttcgtattgatctttgtttactagaacattatgactcttccattgcattcataagtaacaaacttgaacttcattctattgatgaaattgaaaagtttctcaagaaaaatgttgcttctctattaatgttgcatcaacttcctctgctccttcgatccctaattcagacattgttcaagctaatcttgtgcaacaatcctctaatcaaaatcaaattcctaatcagagtcagtattcgaattattcctaaactgattagaattagtatctgtagtccaacttcagtggtggttgttgaggggaagggggttgtggtggtcgcagctccattcaatgttctatctgcttcaatttggacatga

SEQ ID NO: 32279 - DNA, 348 bp, Glycine max
  Peptide Sequence Number=SeqID_149057
atgcaagaggttcgacgccttccgcaatcgacaaccacactttccttcggagagttcttcttattcagttcagaggcttggggagggcgacaatgtgtgaggttagggtttgggagaggattggagaagaacatagcattgtttgtcattggccgtgatggtctaagaaagcggggaatacaaagtagggttgggttagggtttatcgatttcggtggaaggttagggtttgggagaggattggaggtgagtgagaagaacatagcatcgccatcgccattgtttgggagaggattagggagcgtcttgaggttgttagtgaggaatgagaagacaagagttggctag

SEQ ID NO: 32280 - DNA, 378 bp, Glycine max
  Peptide Sequence Number=SeqID_149058
atggggacgaaagaaaagttgaagggagtagttatcagggtaaggaaagaatgcaatagactaagggatatcagcatgtcaacaattgatgcattggagcgagaaatgagaagggctaaaggggaagagacgaatagaaaaaggtaccaaggagcttcgtcagacaatagtaatgaactcaagctgagaaggacaaagagagaccaagccaaaacggaaaggcgagatctggctactatacatgggcatgctttgagaaatgaacaggcagaagtgctagccttacagggtgaaagagaaacaagggaggaagtgatgactgatatatactttgctcacaacgaagttcatagtctcttcgattactaccagcacatg

SEQ ID NO: 32281 - DNA, 1020 bp, Glycine max
  Peptide Sequence Number=SeqID_149059
atggacacgttaccagttgtctattatgaaaagatagtgggatatatgcttgtgagctttgtggatttggtgtttgcaggggaaaggattgaagttggtttgaaacaggggaagtttgattatgttgcttcaacaaattctggtaataggaggcctgtgatgaatggagtgaagaagagagaggtagaagcccatgtcatggctacggaaagatctgttaacctcgatttccccgatggtataaatcccaacattaaatgcgccactaatctgctaccatacttgctcgataaccaaatggaagtacttacgtttcaagatgatagtcccaacatgagaactaatcccctcgcgaatcatggaagctcatatgtgaatgctattaaagaaggggaggttggtatggttgaatatgatggtaatgaggagaatcagtggccgctacatccaagggagtttcatgatgtagatatatggttagtgtccaagaagttgttgcagaggttgataaatgagggtcgaattgaaattggccacgtgagaaaggaggaagatgttaccactcacatgcctcaaggtttccagccagctatggtgaggacgccatcaccattcccttacgagagtaacaagacagtgtcatggaggtacggtgtacatgtgtctgatggagggcaggacgtatctgtcatgcgtgttgggtctagcatgccaactgttaaagtcacaaatatttttggcatgagtggcatgacttgtagtggacatgtttgtactcctctcgagctactagcggggtcgaaaaacaaaggaaaaacaaacgagaatgtgattgaaagggaaaaaatggaccctataatgaacaacgagactcctatcgaaaagcctacaaagaaagaggagaattctagcaagaagaaaatgatgcaatcctaccccgtaagggcattggatagaagactccaagtagattgggtcagagatgcaagagaaggtcttagggttctcatgagtcttagg

SEQ ID NO: 32282 - DNA, 444 bp, Glycine max
  Peptide Sequence Number=SeqID_149060
atgttttctctttctttgaatctcaataacgtcaattggtatgttttgaacccctattatcaactttgggactttatgatgcaaaacccagggcccaaaatcactaatgtttatgtgagatggcccaagaaaggaaccgcagttgatgagagttttaatgggaatgatgcaccagatcctaagagtgagagtcaaaactgctgcatagcagaatatggctcaccagagaagaacagtttgctcgccagaaaaaggtggccagcggcaaacagctgtgaacggcttttcagaatacaaaaaaatgcccgctatagcgcccgctatcacgccggagcggagcagcccctacggcgaagacccctgtcactgggtggaatgaaggagaggtcatcgtgcttacaattgcggcaaagcgggacagcgcaatcatgggttttgttgtga

SEQ ID NO: 32283 - DNA, 390 bp, Glycine max
  Peptide Sequence Number=SeqID_149061
atgcctttttccattactatctcgaaagaagagtacaaattagggtcgaaaaactggaagaataatctgcatggccacttcatcctggccaaaggagatcagccttttcattatcaagacttgcatgcaaagttaacgaaactttggaagcctctgggtgattggtgcatgacacctcaggacaaggattctatgaattcagtttcgcctcaacagatgatttgcatagcatttggactgttggagcttggaacgtttagcccaggctcctccacttatataaatggactcttgattttaatcccaacaagcagaaactcacccattctcaatgttgggctcacttatgtgacctaccccaagaatattggtggcccaagaccctcctag

SEQ ID NO: 32284 - DNA, 307 bp, Glycine max
  Peptide Sequence Number=SeqID_149062
gctgccgtctcttgtgacggacgtgtggggtgctaataccttccccgcgcgtaaatgcaactcccgagcctttcacttaaaagttcgtagatcgcgtcttttccggtttttccgacgttttcctcaaataaacgtgggtggcgactccgcgcgtattccattcatggaacacgcatcccgcgagtcacgcttcgcctcccgccgaaggaagaaaaaagaaggagtagagacgagagtcgtcatcacagaaagggcacggacggacgaaatcagtgtcctatctttgctttcctcttatctccgatga

SEQ ID NO: 32285 - DNA, 281 bp, Glycine max
  Peptide Sequence Number=SeqID_149063
atggtaggcaaagatttgggaagtatgggcggcccccattatgtgcaaattccaaacaagcatgccttcccgccatatggcttgcctcccaactatacaccacccaatgtggcatacactcctgctgaggatacacatgaaatgccccaccacaatctagcggacattgagccttgcctcggatatgccactgaagggcaagcagttggtggtatacccctgcaaaacactttggagggccttcaatttcgcccccaaccacctcttgcattccacagtgg

SEQ ID NO: 32286 - DNA, 234 bp, Glycine max
  Peptide Sequence Number=SeqID_149064
atggccattggagttcccatctctatcaatgatgttactctgaagtacacttttggtcactttgctcgtctattgattgtcattaacctctccaagaacctccaccagcaaatacttgtgcaaagggaggggactcgtcatgttcccaaagatttaagtgcagaaccaactcttaattgtccccctcacaatttaccccaagcaatgcttaggaaccctcttatgaagccttag

SEQ ID NO: 32287 - DNA, 239 bp, Glycine max
  Peptide Sequence Number=SeqID_149065
cagctagacaggcacagggtggcaacccacaggccccagacgcaccgccgccacctactcaggctgatccagctgcgtcattcgacacggagtgggcagaggtcgcatggcccggagattggccagaggcccaggcaggggaggcacccgcagaggctcccgacgatgcagatgaggcccgcgtggacgaggagataactgatttgcttgatttcttgggagggagcggagccacatga

SEQ ID NO: 32288 - DNA, 279 bp, Glycine max
  Peptide Sequence Number=SeqID_149066
atggcgcagcctaaaccaagtgctggccttaaggggaaacctcaccagcatgctctcactttcatgccttcttgcatttcaaaaaaacaaaggcttgggccccctaggccaaagtcatgttttggcatttatcctaactttcgcaagctgtccgcatcccaaaaatggatactaggctgcctcccagcagcgcttcccgcttgtccggagttggacatgggacgacgatccgtcgatcatgggcctagcctctactcgcgttcgtccctaagtacttga

SEQ ID NO: 32289 - DNA, 340 bp, Glycine max
  Peptide Sequence Number=SeqID_149067
atggcctcttcaaatcctttgtttcctgaagcaaattccattcgtagaccacccattttcaatggtgagggttaccattattggaaaacccatatgcagattttcattgaagccatatatttaaacatttgggcagcaatagaaataggaccatacatacccactgtagtagatgtaagcacaagcactgtagaagcaaggcttcatgatgaatgtgatgaacaaaaagctcaaagatcaaagaacaactcaagagaatcaagaacaattcaagagttcaagaatcaagaagaattcaagactcaagaagaaagcctagaatcaagaatcaagattcaag

SEQ ID NO: 32290 - DNA, 1158 bp, Glycine max
  Peptide Sequence Number=SeqID_149068
atgtatccatctacccttcactatcaaacattgttgacaacttatgaaaggtgtcccagcctcgccaaagttttcacaactttcaaaagggtcttgcaagagaaggacttcacatgttggcatggtaacaacaaacaacaacaacaccgttttctagcctgcggcaggttttgtgtaggagggaaagcagcaatggaagatgaggctttgattgattataagagtgaaggtgttgaaggaagcatagaatgtgaaagtggttgcaatgatgagagttttgctgatttgattaaagaaaagggtggagagagaagttccaactctgaaattcttttatctgagatgacagaacttgatggtcagagtcaaggtagtgcagaagatacatcttcatcaacttcaatggggtttcaggaaatgtctgcatctaatagtacaagtccacgtggaagtgaagatgcagagaaaaaggacttgtgtaatgagaattttgaggagcaagtatctgggttatcaatgtcagtgctagagcatgaattgatgaaggaaaggttcgcaaaattgttacttggagaagatatgtcaggtagtggaaatggagtccctgcagccttgactatatccaatgccatcactaatctatgtgccaccctctttgggcaactttggagattggagccactggcaccagaaaagaaagcaatgtggcgacgagagatggagtgtcttcttagtgtcagtgattatattgttgaattgaagcctacatggcaaacatttcccgatggaagcaaacttgagtgtacattagtccagtttcaagaaatagcacatactaaacattctctcttctttccaaaggaaattctggatagttttgttgatccggagtttaggtatgttgaccaaggggttcttgccccagatgcagatggttcatcttcgttccgccaagctcttcagcggctagaagagaaatggtggctccctgtacctcaagtccctccttctggtctccatgaagattccagaaagcagttgatgcacaaaagggatagtacaaagcagatattaaaagctgcaatggcaattaacagcattactttagctgacatggagatccctgatacatacttggaatctcttccaaaggtataa

SEQ ID NO: 32291 - DNA, 165 bp, Glycine max
  Peptide Sequence Number=SeqID_149069
atgggtgaacaagatagtggtgaaggagatgttgaaaaacaagcagagtggaaccaagccttcactggaaatcagtgcgatgtgttggatttatgtctcaagatggatagcatattctctgaaagctttaacaactattctatcaccatagaacttcctcattga

SEQ ID NO: 32292 - DNA, 180 bp, Glycine max
  Peptide Sequence Number=SeqID_149070
atgttaagcccattatatgagagtattattggtgttgaagatagaaaagaaagagaaagagcgatgccaggatcattgaggcctcggtttgttatctttggttcttccatcgttcaatttggtttttatgatgaaggttgggtggctattctttctcatttgtatgcccgcaagggatga

SEQ ID NO: 32293 - DNA, 255 bp, Glycine max
  Peptide Sequence Number=SeqID_149071
atgatgcaaggaatccccgatggctcactccagaaagtgcttttccaggctacgccatacctcatttatgcgaagtttacaggtcctcatcttaaattcgccaaggataacgataaaggaaacaacctggataggcagtataaggcagagcaagagaggcagaagaaatcccgattgactcacttgtacaaatatttaattcctcgaagagactccaaagtgtggccaaatatttcctgggctgcagttgcttga

SEQ ID NO: 32294 - DNA, 781 bp, Glycine max
  Peptide Sequence Number=SeqID_149072
atgggactgttaaaacttcgtcttctctgcgtgaacttttcgctgcaggccgccgttcgtgacaggtgcgtcgctgccggagctcgtcgccgccgttcgtgccggtgcgtcgctgccggaggtcgtcgcggctgcgtgcgcgtgtggggtgcgggagggacgcggctggtgcaggggaggctcgcggttgggttctctcttagatggaagtgttcagcattctctgctagtccttcatcagagaaaacatggaccatgcgtactacctttccagaatatgttgttgcacttgctactattgttggatctgtgctttttgctatatttggtggtgttggtattgcctgtcttccattaggacttatattttcatttattcggcgtccaaaggctgttatcactcgctcgcagtatatcaaggaagccactgaactgggtaaaaaagcaagagaactaaaaaaagcagctgaggcactacatcaggaagaaagaagtggttcaaagggtagaaagtttcgtaaaaatgtgaaggaagttgagaaggagttgtttcaattagaagaagatgtaaagcttcttgaagagatgtatccacaaggggaaaaggctgagacaacatgggctctaacagttcttggttacctggcaaaatttgttttgggaattttagggttgattgtttcagtggcgtgggtcactcatataattatctacctattaattgatcctccactttctcctttcttgaatgaagttttcattaagctagatgatgtctggg

SEQ ID NO: 32295 - DNA, 1895 bp, Glycine max
  Peptide Sequence Number=SeqID_149073
atggaagggacaaaagaggttcaggagaatagagtgaagggggaaccgcaggcagttttggagagtattctagagatatttgccgaggttttcaaggaacccactggtttgcctcccccacgagctcgtgagcacaatatcactctccaaccaggagtggctccaattaatgtaagaccctatcggtatccacacctccacaagaatgaaatagagagacaggtgaaagagttgttggcgaatggtcatatccgatatagccagaatgcttattccagtccagtcatcttggttaagaagaggaacaataagtggcgtatgtgtgtggattttagggcactgaatagggttacaatacctgacaaattcccaattcctgttatcgaagaattactggacgagttacagggagctaagtatttttgtaaactggatttgagctcaggatatcaccaggtgtgtatgaggaccaaaggcatacctaaaacagcgtttagaacccatgagagccattacgagtaccttgtaatgccttttgggctgatgaatgctccatctaccttccaagctttgatgaatgatgtcttcagagattatttaagaaaaggggtgttggtttttttttatgacatccttgtgtacagcaaaggatggcaagagcacttgcaactgcttcagcaggttctggaagttttgaggcacaacaagttgtttgcgagacatgagaaatgcactattggccaagaacaagttgaatacttgggtcatatcatctttgtgcagggagtggcggttgatcctgccaaagtgaaaagtgttcttgagtggcctagaccaaagaatgtgaaggggaagcgtatgacgaaggcaccagtgttgagattgccaaattttgaagaacagtttgagttagaatgcgatgtttcgggaacaggaattggagcaatcctgatgcaaaacagccaaccaattgcatatttcagtaaggcattgggtgggaagaatttatctaaatctgcctatgagaaagagttgatggcagtcgtccttgctatccaacattggcggacacacctgttaggaaggaaatttgctgtgttttcagatcagaggagtttaaaacagttgctaagtcaaagggttttaacaggagctgatgccctgtcaaggagtttggaggatgccgaattgactaatatgatctattatcctaagtggttagattggcagcagttgactcatgagggagtgctgctttataaaggaaggttggtgatgcatgagaaatctccttggattcagaagttactagaggaatttcattctactcctcaagctggtcattcgggtttttataggacatatcggaggttggcttccaatttattttggaaaggtatgaaagaagatgtcaaacagtttgtgcaagcttgtgacatttgtcagcgtcagaagtatagtcctacctcacctggaggattgctgcaacctcttcctattccagaacaggtctgggaggatgtatcagttgattttatcacagggttgcctcgctcgagaggctatgaagctattctggttgttgtggacaggctgaccaaatatagcaattttgttccattgaaacacccttatactgccaagggaattgctgagattttcgtaagggaagtaggaacaatgctcaagatgagtacagcttaccatccgcaaacggatggacagaccgaagcagaattctggatcaataccacgcaccaagagtctatagggactactccttttgcagtggtgtacggtcgtgaacatcccaagattataccgtgcattccaggggaagtgagagtagaatcagctcagagggagttaattgatcgtgacgaggcattgagaca

SEQ ID NO: 32296 - DNA, 499 bp, Glycine max
  Peptide Sequence Number=SeqID_149074
ggatcacgcccacgagacacctagtggacccggagaagtccaacagggccctggggtttccagctctggttacgggcctctgtccgtcctacagggtgcccgcccccccccagcaaggtcatgccatcgtgacacagctaagtatgcacgggtagcgcccacaagacacccagtggacctggaggagcccaataggtccctggggtttccagctctagttacgggcctctgtcggtcctacagggcgcccgtccccccagcaagttcatgccatcgtgacatagggatcacgcctgcaagacactcagtggacctggagaagtccaacagggtcctggggtttccagctctgattatgggcctctatcagttctacggagtgcctgtcaccccctataaggtcatcaagccccctactaaccgagctttcatcaagaagtactgcgcccccaggcaggcgctgggcgagacaccacagcagcctggggatagccggtag

SEQ ID NO: 32297 - DNA, 279 bp, Glycine max
  Peptide Sequence Number=SeqID_149075
atggcccggcgcgaaggctggatcagccgcaggcgtaaaggcgtgcagggaaaagcgttggagtaccatatcgacagcctgccttcagacgtgcgtaacctgctggtgctgaaggaagacggggcggcatatgacgtagagcgtcaggatccgttggcggtctggatcgagtattactaccatttgacggaaagcgaacgcgagaaaatggtggctttcctgatgcgggaagggatcggcggcctgttggcgcgtatcgacgaagagagcaatacctag

SEQ ID NO: 32298 - DNA, 351 bp, Glycine max
  Peptide Sequence Number=SeqID_149076
atgcacacacgaagtttcacaaatccacaattccttaaaataggcctaactcacataaatagtccccagtggagtcgccaactgtcgcaacgtgcccttctgcgggcgagcgaggcgaggctcacgggtgcgctttccaaaggaggaaagatgcgcggagtcgtcaccaacgtttatttgtcggaaacgtcgaaaaaactggaggaaaccggaaaaaccaaggttacgaatccttatggattatgtatttactcttttttagctttcgaagaagttacgaaaactcacggattgcgaaaaacacctcctttcgatttccgtcacattacggaattttcacggatcgcgtaa

SEQ ID NO: 32299 - DNA, 231 bp, Glycine max
  misc_feature (14)..(14): n is a, c, g, or t
  Peptide Sequence Number=SeqID_149077
atgacggaagggtntggtgaagggttttgcattgcaaacgttcccggtgatgcttttagtctatgggggaacttctttgaggcaaagaaacaaatgatggctgatgccaaggtcggcggtgctgggttatggccccgtgctaagtttcggattggttggccccctcctcccccccgtgatcagttttgttgccaggattttgccaactttggcttgcgccccgttggctaa

SEQ ID NO: 32300 - DNA, 381 bp, Glycine max
  Peptide Sequence Number=SeqID_149078
atgcctaggaaggtgcagggtgatgcaccgcaggccacaaacgcgccaccaccacctcatcaggctgatcccgttgggtcattaggcatagagcggtatctacagcacttggttcgccagcaggcggccaaccaccgggggcaggtgcagatacatgattgtctctaccagctcagccttagtcaacagggccagggtttcactccttttgcatgccctactctagatcagtttagggctgaggtcgcatggcccggagatttgcccgaggcccaggcaggggaggcacctgtaggagctcccggcgatgcagaggaggcccgcatggatgaggagatgacggacttgctcggtttcttgggaggaagcggagctatgtga

SEQ ID NO: 32301 - DNA, 988 bp, Glycine max
  Peptide Sequence Number=SeqID_149079
caagattgcagctgtggttggagattcggcgagagagttggatcgtatgaagcaaactcgaaatggcgtagtgggcctatcatggaaatacttggaaggcaaggcaagggatatggtgaatcaagaggagtgggtcccgtttgcggatatactagctttgctaatctttggggttgtcctctttccaaatgtggacggtttggtggacctagccgtgattgatgctttccttgcatatcaccatagcaaggagagcctggtggtagctttcttggcggacttatttgatacatttgaccgaagagtagattgggaccaatacttggctgggataggaggcagaacaatcaactggtttcctcgatggaaggaaggaaaagagggagttctcttctcatgtggggactaccctaacattccgttgatagggacgagggatttcggcgcacaaagtttcaagattgtacaaagagtccacaaggtgtgggaaagcccattaaggaaagataaagaacttaggggcatccgtaatggcatcatcggtggttatcatgaatggctgaaagttcatacacgagggttagattggctctccaagttgaaaattatcaacgaggagaacttcgaagcttcggaagaagatgaagatgtccgagctctaaaaatagagttgggaaaggcaagactcgccaaagaaaaattcaagttagtcgctacagacgaggagttagctacttgctcaagatccaagaagagtttggcccgacacttagaagccacggagcaaagcatgctagctataatagggcagtacaaagaagagttaaaccagtctttgacccatgagcaaaagctagtagaggacttcgcacaagcatacgccgagaaggaagaaagagggagggtgattgatgcattgcatcaagaagcgaccatgtggatggataggttcgccttgaccttaaatggaagtcaagacatcccgtga

SEQ ID NO: 32302 - DNA, 1191 bp, Glycine max
  Peptide Sequence Number=SeqID_149080
atgcctatttccgcgtcccccacagaggagagagccacactctcgtggcgcaaaattccccacttcaaatacgacgccgttcagccccgcctccgtcgcaacaccaccaccaccctcactttcgccaccgccaccggcggctctaaattcgcctccgtctccgtggcggagcccaaactgcaccacgatttcatgcccacgccgtcccagctcttcaagaaccccctcgccgccttcgccatcgtgccccgtgacgccgctctcttctccgccggagccatcgccggcgccgccgccaagaccgtcaccgcgccgctcgaccgcatcaagctcctcatgcagactcatggtgtgcgtcttgggcaagatagtgctaagaaggcaataagtttcattgaggccatagcagttatagggaaagaagaaggtattcaaggttactggaagggcaacctccctcaggtgattcgagttgtaccttacagtgctgtccagctttttgcttatgaaatttataagaaaatattcaagggagagaatggcgagctctctgttgcaggaagacttgcagcaggtgcttttgctggaatgacatccacttttataacttacccattagacgttctaagattgcgattagctgttgaacctggttatcggaccatgtcagaggttgccttaagcatgctaagggaggaaggatttgcatctttctatcgtggccttgggccttctctaattgcaatagctccttatattgcagtgaacttttgtgtttttgacttattgaagaagtcattgcctgagaaatatcaaaagcgaactgaaacatctatactcacagctgtcctttcggcatctcttgctacacttacatgctatcctctggacactgtgcgaagacagatgcaattgaagggcacaccttataagacagtattagatgctctttcagttttattgtactttaagaaatgctggaagggtgcacttgatggtattgtggcacgagatggggttgctggtttgtatcggggatttgtgcccaatgctctaaaatcccttcctaacagcagcatcaagcttaccacatatgacattgttaagcgcctaatttctgctagcgagaaagaatttcaaacaattgcagaggaaaatcgcatcaaacacaagaacactaacaatcaatga

SEQ ID NO: 32303 - DNA, 597 bp, Glycine max
  Peptide Sequence Number=SeqID_149081
cggacggccgccgccggcgttgtccaacggggccgacgcataaacgccaacgctcttggtatccgacgcaattgcacggaagaagaacgaggtgttgtcggtcagctggtagttgccgttcagcagcaacgagtcaagcgacatcaatgcttccttggccgaggtcgcgccgtggtcgaagccgcagcgggtcgggctgatgcggacgctgttctcgaaggtgtcgcagttggcgacgctggcgctgccggtgcgggcgccggagaaggtcgcgctcgaattgtacgggctgatgccccaggtcagccctgcatctttgacctatttcttgatgtcacggttgtacatcaactcgcgttcctgatggtcgatcacgaacgtcttgttgccacggtcggatctgatgccaccggacaggctgccggtgcgaccggccgggccgatttcaggattttcatagccgacgctgaagcccaggccttcataatccttacacaggatcacgttgaccactccgcccatggcatcccaaccgtacactgtatctgcgccttcacgcaggatttcaatgcgctcgacggcggccgtcggaatcag

SEQ ID NO: 32304 - DNA, 204 bp, Glycine max
  Peptide Sequence Number=SeqID_149082
atggagcgagagcaaggtttaagctacatggagaaagagcgagatcgagagagagggagacactactcagggagagagagcaagttcgcatacgggccaggtgatgcaatcctcccaaggaagggatcagtcactagaaccatgagcaagaggcttcaagaggattggactagagctgctgaagaaagccctaggttctcatga

SEQ ID NO: 32305 - DNA, 1960 bp, Glycine max
  Peptide Sequence Number=SeqID_149083
atggcgaaagttcaggggcagtgcagcctccaagacttggtgagtgtcactgctgaagagagaaccacgcagaactggtacatttcactcaacttgaaagtgaaagtgatgcttcaagtttcagttcctaacgcaatgggaagcacaagtttgcttcatctattacttggtgttgttttggctctgctgagtgtgtctcttgtggaaggagaagatgcatacaaatactacacgtggactgtgacatatggcattctttctccactaggtagtcctcagcaggtggttcttatcgatggtcagtttcctgggcctcaactagacttggtaactaatgaaaatgttgttctcaaccttgtaaacaagttagatgagccatttcttcttacttggaatggcatcaaacaaaggaaaaactcatggcaagatggggtattgggaaccaattgccccattcctccaaactcaaattacacatacaagtttcaggtcaaggatcagattggaacctacacatactttccatcgacttcactgcataaagcagctggagggtttggaggactcaatgtctaccatagatctgtcatcccagttccttatccgtaccctgatggagatttcactttactcattggtgattggtacaagactaaccacaaggtattaagagaatctttggattctggaaaatctcttgcctttcctgatggtctccttatcaatggccaagctcatacaaccataaatggggaccagggaaagacctatatgttcagaatctcaaatgtgggcatgtcaacatcaattaacttcagaatccagggtcatcctctgaagctagttgagattgaaggatcacacattgtccagaacacgtacgacacgcttgatgtgcatgttgggcaatcagctgctgtgttggtaaccttaaatcagcctccaaaggactactacattgttgcctcaacaagattttcaagaaaagttctcacagcaactgcagtgttacattattcaaactctaactctcctgcttctggacccttgcctagtcccccaatttaccaatatcattggtctgtgaagcaagctagaacctacagatggaatctgacagcaaatgctgctaggcctaatccacaagggtcataccattatggaaaaataactcctacaaagacaattgtgttgtccaattcagcacctttgattaatggaaaacttcgttatgctgtcaacaaggtttcttatgttaactctgatacaccgctcaagcttgctgattacttcaacattcctggaatctacagtgttgactcaatccaaacccttccttctgaaagtactcctgcatccatagccacctccgtagtgccaacttctctccatgatttcattgaggttgtttttcagaacaacgaaaatgccatgcaatcttggcatcttgacggttatgacttttgggtcgtgggttatggttttggtcagtggacaccagccaaaagaagaacctataatctagttgatgctctgaccaggcacactacacaggtatacccaaatgcttggactacaatattggtgtccttggacaatcaagctcaccgacgctggaatggaagcattcgcaaagaactagaagggattgaagaaggtctcctgcagatcgtgcacgttcgggtcaagcctagtggtactgttcctccacggcttcccggagatttgcgggccatcacccctgacctctgtggctacggcgacactgccgccctacctgacgctttcttgtactctgccttccacatcattgtcgacctcgtcgggcaaagatctatgttaacactacattttactgccatgtactctactgtgatgttccttggaaccaaggacactttgggagtgcaaccagttgttgacatagaaagaactgtattgtatcatgaaaaagcaatag

SEQ ID NO: 32306 - DNA, 606 bp, Glycine max
  Peptide Sequence Number=SeqID_149084
atgctaccgctattgctcaagaggtcgcagctcaaaatttggctctacttgtttgactttttcaaaacaaggataaatatttcaaggaaggtgcacaaattgatgttccaattgatatgtgatccctcgggagtggtggttgaaactactctcaaggaattggttcttgcagttataatgtggggaaataaattagaccacgttattacaaaactcctatacctacttaatcagggagagacatttacaaaggttaaagccacaaaatttttctttcctgtgactaagctttttcagtctaaagatatgggattaaggagaatggttatcatcgtcacaagctctatcatgaaggacatgaacaacaagattgatatgtatcgagcaaattccattctcgtgttgtgtcgtatcactgacggaaccctcctttcacaaattgagcggtatttaaaacaagccattgtagataaaaatccagttgttgcaagtgctgctctagttagtggcattcatctgctccaagtgaaagagatgctggaatatagatgttgtattcagaatgctggtggaattgcttcctttagtgcaccacaaagaaattga

SEQ ID NO: 32307 - DNA, 302 bp, Glycine max
  Peptide Sequence Number=SeqID_149085
gatgtgcgaaaaaaggcataggccatccagaggcgtcacaaggttcctttgtcccccatggacgtcaagatgtcctgactgctaccattgggcgaccagaacaccctggtcgtagtcatgctgctggagtcggtgtgatgatcaagcaatactttggaccggctccaaggacctcccacacatcttcctctatggctcccgaagacctggagcagctgtcgcaacaaattagggaccagttggtggagtcgatcacagaaaatgtgactcgacaaccaatgttgtccttcagccagatgtag

SEQ ID NO: 32308 - DNA, 138 bp, Glycine max
  Peptide Sequence Number=SeqID_149086
atggcgaagactgcgagggtcgttcaaggaaaccaacaaaacttaccaaaacatgagggtggggtgagcgtcacggcgaccacgatgcctgagcgtgactatgcaagactcaacgtcgaggatcagggacaatgctag

SEQ ID NO: 32309 - DNA, 318 bp, Glycine max
  Peptide Sequence Number=SeqID_149087
atggagctacgagacattgatgccaagatggaaaacaaaaatttgacaatgattctattagcctttctccctacctcctatgagaattttctccgactaaaggcatctaggaatgacgatgaagcctttgcgtctggattattggtgactaagagatggtacatctcttgtggatcagttctagtggaaggtacatccactaggttgctcaaagagaacaagggaggatacatcccttgtggatctttgcttgtaaaggattttacaaggttgaagagaaatctcaagaaccgtaggtcgcttggggactggatgtag

SEQ ID NO: 32310 - DNA, 501 bp, Glycine max
  Peptide Sequence Number=SeqID_149088
atggcgaaaacgaggccaggcagaaaggacgtggactcatacaccataagaggaaccaacaagatcgtccgaggcgagagctatcgtttaagaaaatgtttgggttttgcagctggagactgtgttctgatgcggccctcggacacgtcgaagcccccttacgtggcgcgcgtggagatgatcgagcaggataataggaacaacgtgaaggtgcgtgtgaggtggtactacaggccggaagagtcgattggtggtcggagacagttccatggtgcgaaagaactgttcctctccgaccactacgatgtgcagagcgcgcacaccattgagggcaagtgcgtggtgcactctttcaagaactacactaagcttgagaatgtgggtgctgaggattactattgtagattcgagtacaaggccgcttctggggcttttacccctgaccgtgttgctggggtggttattgattgtggggatgggtattttgggcttcaggactga

SEQ ID NO: 32311 - DNA, 633 bp, Glycine max
  Peptide Sequence Number=SeqID_149089
atgtctctcaatctgatcaagcattcatgtcaacaccaacaactgttatgcatcctctctggtatccagacaacggagcaagccatcacatcaccaatgatgagagcaacttttctgttaagactgattagacagggaatggtcgagaacataccaaggagactcatcttcaaggcaagtttagcaagggtctttatgtttttcccaaccttcagcatcaaaaccacatttatgctttccattctacaacagattcttcattcacagtcttggagctttggcattcaagacttgctcatgcctctcttaaagttgttagatcagtacttagtcattgtagtataccattgtgatactactgattcttctgccgtagctgtttcttctcccattgcaagttatgttcctcaaaatactcatcccatgacaaccagagccaaagctggtgtttttaaaccgaaaacttatgcttcttacaaggaaggaagctatgatcacattgttgagccacatactataaaggaagcaatggccaagccagaatggctcaaagctatgaaagaggaacatgacggtttaaaagcaagtttaatgctgatggacgttttcaaaggcacaaggacaagctggtag

SEQ ID NO: 32312 - DNA, 204 bp, Glycine max
  Peptide Sequence Number=SeqID_149090
atgtttggggtgtataatgataacttccccttgtacataaagcatgaagatctttctaaaatagcacatggtggtcaatgtttgagcatctctgttatcaaattgtggattatgcatatgattaaggcaagtatgcaagcgggaaatgccaatgtgtatggattccttgagccacagtccatacagagatctgggcaatcgtaa

SEQ ID NO: 32313 - DNA, 454 bp, Glycine max
  Peptide Sequence Number=SeqID_149091
atcaaacaacgagtcctatgaaagtagtgataacaaggacccgaaggttgattttgagcaactaataaatcaagccaagaagggagaacctagatttgaagagaatggtggaacaagaagaaaggcaagtgaagccacactgagaggaaacagaagttgtgaacttaggcgttggtggagagagaaaagaggtcaaggatatgcccggtttgagctcgaacatcgtgcaatacaactacctctgaatcccaagtgttccctggtaaagcaaaaactgaggagaatgaagcccgagatgtccctgaaaataaaggaggaagtgaagaagcaattcgatgctggtttcttggtcgtggcttggtacccagaatgggtcgccaatatcgtgccagaatgggtcaccaacatggatgatgaagagttgccttcgcctgtgaattccgacatcatctag

SEQ ID NO: 32314 - DNA, 429 bp, Glycine max
  Peptide Sequence Number=SeqID_149092
atgcagatttggaaggacaaaaaaaaaaaaaaactcagatccgtgaaggatttcattgccgccagtatcaacacgcaaggtgacgctctcgaagccggaatcacaatcgaagtaggtggcgatgggactgaaggttcccaaatctcgtcactaccccaagaggcctcttcgtcttcaggccccccatggccatgccggacgactactgttcatcgaattcgtccacgccatctcctcaaacccctttcatcttctttgttttcccagtcaaaagccgaagggtccggaggcagtgctgaaagtggctccagtgactcagtgcaagttccggctgctgaagttggagatggagaatcaggagcgactcaagccgaaggtcgacaacgggttcaaggtcgggaagagacaaaatatgttggagaagattaa

SEQ ID NO: 32315 - DNA, 285 bp, Glycine max
  Peptide Sequence Number=SeqID_149093
atgggtgacctagaggaagttcaagaacaggtgaaggccgacatgtcggctgtgaaagatcaaatggcttccatgatggaagccatgctaggtatgaaaagattaatagagagtaatgtagccatagctgccgccgccaacaccgcagttgaagcagacccggtacaaagggacgactttccccaagaatcatttgaagatgtatttctagaaaataggggcatcacacacccgtttggtacaccaacttggaagcatcatgcatccgctcatggaaggacttga

SEQ ID NO: 32316 - DNA, 324 bp, Glycine max
  Peptide Sequence Number=SeqID_149094
atgaagaagattcatggtcgtgttgttcaggaggcacctccggcaccacagcctaccgccattccttcactcctgttcctcctccttagacctccaccctggatgctccaggccatggagcatccatcagggccaacttcttcttctttagagccatggagcttgttgttgctgctactatcgagcccacagatgtcaccactgagacagcttgctattgctactgagccagatactatagagcaaggacttgacgaggactacattgctaatgtctcaacgactcaaactgcagcttggaatccattgtttacacaggactag

SEQ ID NO: 32317 - DNA, 1248 bp, Glycine max
  Peptide Sequence Number=SeqID_149095
atgacgtcacgatcggggcaggggagcagcggcggagggagcagcaggacccgtgtggggaagtacgagctgggtcggacgctgggcgagggcaatttcgccaaggtgaaattcgcgaggcacgtggaaactagagagaacgtcgccatcaagattctcgacaaggagaaactactcaaacacaaaatgattgcgcagataaaacgagaaatatcaacaatgaaactgattagacacccaaatgtcatacgcatgtatgaggtaatggctagcaaaacaaagatatacattgtattggaatttgtgactggtggggagctgtttgataaaattgcacgcagtgggaggttgaaagaagatgaagcaagaaaatactttcaacagcttatatgtgctgtggattactgtcatagtagaggtgttttccatagagacttaaagcctgagaatttattgctggatgctaatggagtgcttaaagtatcagattttggattgagtgcattgcctcaacaagttcgggaagatggactacttcacacaacatgcggtacgccgaattatgttgctccagaggtgattaacaacaaaggttatgacggtgcaaaggcagatttatggtcatgtggtgttattctctttgttttaatggctggctatttgccctttgaagaaaccaatctatcagctttatataaaaagattttcaaggccgagttcacatgtcctccgtggttctcttcaagtgcaaagaagctaatcaacaaaatccttgatcccaatcctgccactcggattacatttgctgaggtcattgagaatgactggttcaagaagggatataagcctcccgtatttgaacaggctaatgttagtcttgatgatttagattctattttcagtgattctacggattcacaaaatcttgttgtagagaggcgtgaagagggacctatggcacctgtggcacctgtgactatgaatgcctttgagcttatctctaaatctcagggcctcaatcttagtagtctttttgagaagcaaatgttaaagattcaaggtgaaaagacaggacggaaaggtcatctatctgtagccactgaggtggccccttcactatacatggttgagctgcgaaagtctgaaggagatactctcgaatttcacaagttctacaaaaatcttgctactgggctgaaggatattgtttggaaagccgagcctatcgatgaagaaaaagatggttag

SEQ ID NO: 32318 - DNA, 261 bp, Glycine max
  Peptide Sequence Number=SeqID_149096
atggaggtggttgagcttttggtgcagcgaaggatcacattcaaggaggttggtggagaggttgagggattgaaggttggagtgggaggcgagaaacaacatagatctagggaggttaatgtgaaggcaaacttggagtgggagagaggaggcatggtggcgggactggagaggtttgtggattttagggtgaataaatactactgctatagaaagagagagttaaaaacatgtgtgttaagtttttgtgcccttcaatga

SEQ ID NO: 32319 - DNA, 588 bp, Glycine max
  Peptide Sequence Number=SeqID_149097
atggtgtctctatggcatgatcgatggccatctaaaggaattgtttgtcatcttttcaatgatatcaacattgtgaatgtcaatggccatacacctgatggcatctacactgccttgtttgcttacagatggctttctagagctcatgaattcactctggttaatgagaagggagaggttgttgggtttggccactccaaattccagaaaatatcaaacactttgtttggcttgttgatcatcgaagcatcccaacaaatctgtttcgaactaatcgccatgttgcctttgactctctttatttcaggtgtagcagccaggaagaatcctcttagttttcgcctatatcggcggctcatcttagttcttgcctatatcggcggcatctatggaggggggatattaggaagtcccacatcgcctgcctcagttcttgggcctatagcccgtcttagttttctccgccatgtcggcggctctctccgccatatcggcggcatctgtggaggggggatgttaggaagttccacatcgcctgcctcagtccttggggtgcagcttatatatctgttggataacttcacttag

SEQ ID NO: 32320 - DNA, 375 bp, Glycine max
  Peptide Sequence Number=SeqID_149098
atgacactgaagatgacgaagaacgagaaagaagatagagggggagtgcaggttgtcattggtcttcttcgtgtcgatctagacgtcgacagtggcagtgcggggtttgaaatggaagcgaagaacaaattgaagattgaggattctacaacggagtctccaacttcggtccttgaagacaagttattttacggaaccatgtgtgcctcgaaagaggaagttaagttggaggaagaagtgactgcaaacgtcaaagatgatgggacctctcttatatcgaaaacaatggtggaggaggaagagaatttaattgaagttgggatgaaggaagaggaggcgcagtgtgaggaggcacttgaccttaatggcacatag

SEQ ID NO: 32321 - DNA, 735 bp, Glycine max
  Peptide Sequence Number=SeqID_149099
atgataaaaaaacgaaaaacaaaacaagaagaacaaaatgtgcaactcaacgcaaaagaaccacactttcaattgcatttctctctctttcttacaatttccacttttcgggttttcaattcgagattcgttgttccaatgagcgatcacttggtggtgttcgttgactgtcttgcacgccctgtccctgttgatccagtggcgcagacgacccaggtgcctttcgaaccatctccacctccggccgtcgtggatgctgacgccgctgggagctccgacacctcaccgtcggaggattgcgacgacgagggcgacgacgaggaggagcagctgatccagatggcagagtgtcatatctgccaggaggaggatggcgtttccaacttggagacaccctgcgcctgtagcggcagtcttaagtttactaaaccggcaaatgcttttgcttggatagaaggttttgagttttgtgactttgttgtgtgttatgctcacagaaagtgtgtccaacattggtgtgatgagaaaggagacataacttgtgagatatgtcatcatagtcttggatgcccgggtatagctagggtgtacctagatggggactgggaaggcagtggctccccaaaatggttgtttgtttttttcccttctatattaacactcccacatttaatgattatcgttctgcccctgggtatagggacagattgtagacctatccgtgttcttgattaa

SEQ ID NO: 32322 - DNA, 294 bp, Glycine max
  Peptide Sequence Number=SeqID_149100
atggctaactccaataacaacatctcaaccccgaacaacacattccaaaccattctaactaaattcaaccttcaagggcttgatctagttgctctatcagaggagccagagcctaacttagaaaagaaagctagatgtaactattgtgaaggtttgatcaaattcgagaatagagcaattgctatgtggaatcatttagacagatgcaacaaaaaagcaggaaatgtgagtaagaagcaaaaaatcaacttcatccatgacaaatgctttttctccttcattggcaaaggttag

SEQ ID NO: 32323 - DNA, 240 bp, Glycine max
  Peptide Sequence Number=SeqID_149101
atggtgatgagagagaaagaaaatgaagatgcatccattaaattagccaagaacaaaccggtcccgaggatgagaaacaacagagcacatgacttgagtgagaagctaaagctcgagcttaagttcctctttctcggtgctgagaaagtgaagaatgtaaggggtgactcgaataacaacaacccatgccccgaacatggccacgtgagatttcagctgctttgtctggcttgcgcatga

SEQ ID NO: 32324 - DNA, 204 bp, Glycine max
  Peptide Sequence Number=SeqID_149102
atggaggttgatgaaccttggttggggttatggctaccatcacattatcgagtagataggggacaggtaggctttgtggctgatttagggatggcctttgtggatgatttagtgttctttgttgatagggtggtggttaatgagaaaggtcgatattggctgagtaatgacattgttgggctggtgggaaatttggccatgtag

SEQ ID NO: 32325 - DNA, 459 bp, Glycine max
  Peptide Sequence Number=SeqID_149103
atgtacaaaaagatggatagtgaaagctttgttagggtttcaagcaatggtactagggtttcaagcggtggtgatagggtttttgaggaaccgtccaagaagaggatgatcttttacgtcaaagcaataggaaggctaagatcaactattaggataatgctaaaaattgacaaagtcacgaccattcaagtaggggggattcggttcaaatttgtgtcgagcttgatcttgatcaaccgcttcaactacgaagggttgcactttattagtttcaagtgtagtagatatgggcataaggaaagcatgcacgttgagactgtgatgactcaagggactagttttgataatgtcaatatagtggagaagcaaggaaaatggagtaactcagaggcagcaccactagttaatgttatggaaggggccatattgaatcaaccgctaaaaggtgggaaaccctag

SEQ ID NO: 32326 - DNA, 225 bp, Glycine max
  Peptide Sequence Number=SeqID_149104
atgtcgaaggagtcacgcccctgcgagcttgacgtagtaggtagacaaaaagagtgtggccatatagaccagatgccacacacatcactattgatcaccgtcagtactgctacatcccctaaggatttacatttccccgactactggagtggtttgaagacatcaactttatctgggtatggaagtgctttacgatgctcaagaattcgaagtggccctcagtga

SEQ ID NO: 32327 - DNA, 372 bp, Glycine max
  Peptide Sequence Number=SeqID_149105
atgccgatctccccctgcggaaggtgcctgtcccccccagcaaggtcatgccgtcatgaaataggtaaggatcacgcccgtaagacacccagtggacccggagaagtccaacagggtcctggggtttccagctctgattacgggcctttgtcagttctatggagtgcccgtcgcctccagcaaggcgcagggcgagacaccacagcagcaaggggatggccaacagcgggcaacaaacgcaccaccgccacctcccaagcccctcagctcatctacaaaggcttgagcgttgcctatgacccgtggccgaccagcaggcgaccaagtccaaagccaaaggtagcgagagaccttggatatgcgtgtatatag

SEQ ID NO: 32328 - DNA, 222 bp, Glycine max
  Peptide Sequence Number=SeqID_149106
atgccatctgtgaatggtaaggttgcattaggaaagttgatgatggatagagatacattagggtgtagtgggcaaagaggttcttgggacctaggggaattagcaattggggactacccgacatttggtgcactcattttgcgtgggaagttcacaggcctcactttgttattcctaactggctctgagactatgctttttgagttaggagcaggggattga

SEQ ID NO: 32329 - DNA, 390 bp, Glycine max
  Peptide Sequence Number=SeqID_149107
atggtcctagactgtctagtttttgagagttggaatggggcaatagcccaaagccaaagccttctgttgaggaacctcctgaattggagtttagttccttccttccagcctcaagtttcaatgaaactattgtcagttctcaaggacaacaatgaagtctttgggtggatcacccatgacataaagggtttggaccctacacttagcacccacaaattcaacattgaagaggggtttccacccaaatggttattccaaaagagacttaatccaaacataatggaggttgtcaaaagagaggatgttaagcccactttcaagacgaatgcacataaagtcaaggtgtattatgagggattccaacaactgcaaaacattgtgcaccactga

SEQ ID NO: 32330 - DNA, 1590 bp, Glycine max
  Peptide Sequence Number=SeqID_149108
atggcccgcacgaagaagacaggggagatgacgactgaggccgcaaaggaaatcgctgagaagattgtaagtcattttcaactaaccattacaattatgtttgaatattttgagaatgccatgtaccactgtgtgttttctgtgcaagattcgtttgaggagcaggccacacagggatcgttcgtcccccatggacgtcaggatgttctgaccgctgctattggacgtccagagcaccctggacgtgtctgtgctgttggagccggtgtcaccatcaagcaatactttggatcggctccacggacgtcccgcaacgcttcctccctgcctcctgacgaattacagcagctgactcagcagatcagggaccagctagaggagcccatcacagagaaagtgacgaggcaggtcatggcatccttcagccagcttcagtcacagatgcaatctcagggacctcctgagcctctggttggtcctggtcccttcgttcctcgggtgagcacaaaggggagttgtgttgatccctcaggaaacgatcctgagacgggtgactctgacaggtgcggcttgtacatagaagcagatcctgcccgcctggttgtcgtggggagagtttatgagggatccactcttgttcataacactcctttgttgcctagccaagtaaaggtgagtgtggacgaggttaaagatgcacatgctgcagttcctgtacccactgctgaggtttccttagtggggcaggcacttcacaccttccttgcttggtcgacacatctgatcaagtctttatcaaaccaggtagctgtgtctccgccaaaaccacctccgaagcccaatctggaggtcgatgatccactttatctgatgacattgaccatcccagagcttttcttgaggccttatcaggttagatgggatgccaccgtgttaggggtcgttaatccagatttccccctgtacataaagcacgaagacctctccgaaatcgaacacggtggtcaatgtctcagcatatcagtgttacagttgtggattctgcatctcactgaaacatgtatgcgagcggggaattctgatatctatggattcctcgagcctcagtccattcagaggtctgggcaatcacagtttgaatctgaaagttacataaagagttggatgcagagttcacaatgcgatgtgtatcttggagcctacctaaatgggttccactgcagcggacattggcagatggtggtcatcctgcccaaggaacacttagttgtctggttttgttcattgcataacaagccaaacaactaccttaaggggattattaatagtgctatcaagggtcttgatgatgctccacagcctaaatcaaaggctcctgctaggtggattgtcgtcaagtgtaatagacaaaaaggaactactgagtgcggctactatgtcatgcactggatgtccaccatcattttaggaagttttagaaataattggaaagcgtattttaacgaccctagaccattggagcctgagagattaaaagcattgcggatccagtgggcacagttttatctccgagttagagatcaggcctag

SEQ ID NO: 32331 - DNA, 354 bp, Glycine max
  Peptide Sequence Number=SeqID_149109
atgctttggaagggtgaggctctggagagttttaagcctaacagagttgatagtgacctgtggaaacccattcaggtggggagaaatggtccaaagttgtctcatttggcttttgcaaacgaccttattctctttgcagaagcatctttggatcaggtggaggtaatcacagcttgtctagagttcttctacaacagttctggtgaaaagctgaatgatgataagacgaggatattcttttctcataatgtgaatgggagggttaaggtggatattagccaggccataggtttccaacgtacaaatgatttgggaagtacttgggaatcaaacttcatcacaggagagttttga

SEQ ID NO: 32332 - DNA, 210 bp, Glycine max
  Peptide Sequence Number=SeqID_149110
atgaactccacaaacgctaactcgacaatgtggttgcagtcatggaagtgcaacccagacgtacctcaatggataagtggcaaagacgatctccacaaacatgatctccacaatgtggttgcagtcacggaagcgcaggcgactttgacacaaggagaaagaagaagaacgatagggttcaagcgcaaggagaaagaagaagaacgatag

SEQ ID NO: 32333 - DNA, 330 bp, Glycine max
  Peptide Sequence Number=SeqID_149111
atggagatgcagcggaagataaaggagaagaggaatatttcaaggatatgccaaaggcatcttagaatattccaagaatatgtcaaaggcatcttagaatattccaagaatatgtcaaagcacatgggaaaggaatggacccaaccttggctcatgggctcagaaatctaccctgaggttcatgagaaccctagggccttcttcagcaactctagcccaatcttcttggagcctcttactcatggctctagtgactggtcccttcctagggaggattgcatcacgacttatcgtagtaattttaaacacaagaatggttttagaatgtag

SEQ ID NO: 32334 - DNA, 309 bp, Glycine max
  Peptide Sequence Number=SeqID_149112
atggatagagatatcgtagggtatagtgggtggagaggttcaaagaaactagtggaattagcgagtggtgactacttggcatttggtgcacttatttggcatgagaaactcacagacctcactttgcttcgttactatggaaacctttgcctatactttggacttgaggagcctcatcacaacttggagttcaagttgactctggtggggtatgatgaacgagacaacgttattagctactacatggatccaatgagcatagctgaagttatcaaggataaaggagaccattatgatatgacgttctag

SEQ ID NO: 32335 - DNA, 195 bp, Glycine max
  Peptide Sequence Number=SeqID_149113
atggtggacatccacattaaatcgttcacaacagaagaggacatggttgctgatggtgtgacacgagaagttcttgatatcctcaacgatgagggtgatcccacatacaataatatgatttttgatagagccactgcggagaaggtttttcatacatctcatattctaaaagcttatgaagaggtgtctggataa

SEQ ID NO: 32336 - DNA, 951 bp, Glycine max
  Peptide Sequence Number=SeqID_149114
atgggggtggacaaggggcataacctggaggacacagtcaacgcaagagagaaagaggtcaacgcctccaatctgtctacagggaaggatgatgtcagccctaatgagatcagtgggaaaaaagatcttcagctgagtaacgatggaatggaggattgttttgggtcatggatgatggatcacgtggagggggctgttattgagcacgaaattgaaggagatatgattgaagagaaatcaaaggagaatatttccattaattctagtaacgtggggccacgtgatgaagagttaatttccaagtttgatgatccaaaagcttttaaatggcacatgagcagtggttcgttcgaaggagaagccagtggagttaaggtgggtcccacaagcgagtatgaaaaggcagaaacaggaatcaaggaggaggaaaaaagttctgataaggagaaggaagacatggagattgagaggattgatggtgaacaaatacaaacggaggatgttgttgactactgcatgccagtgcaacaagagatggtggaaaggtctgtccaggggcacatggtgtttatggaaatccaatgtttggaaggtggaagtcttgcagttggaggcttaatccattcatatgaagacgtggggtttgaagagccaaaactcacatggaagagaggtgatcttcaagtaagattggacagggttcttattaatcagtgttggagattaaggttccctagagccaaggtgagtcatctgtttcattataagtctgaccatcctctcctccatgtttttcttgatgtggggatccctatgaatcaaaggagaaggcccttccgatttcgggctgcttggctctctcatgatggcttagcttcgcttgttagagataattggtgtaacaatatggagtggaatgctcatttggtggaatttaccaaaaccattaag

SEQ ID NO: 32337 - DNA, 1551 bp, Glycine max
  Peptide Sequence Number=SeqID_149115
atgaagaagggcgaaaataagggtcggactcggaccttcccggtggatccgaatgttccccgatgggtttgccagaactgccgcaaccctctctgcatcgtaggcgccgattcttacgccgacaagttcttcaacgatccttctcgctacgggatgcaagggtcgtccattcacgttgccagcagtgtgctgagtacgactaaaatggacaattcctatgttgtgttgcccaagcagaaacctcaggctcagggaaatcctcctcggccacgcggcgatgctgctgcacagccagggaaggccatggaggagtcatttgtggttgtgtacaagtccgaatcggggaccgatggaaacgcggtgcattcgtcgggcacaggggctgattctggtggccatttgccacctcataactctgggtttaattctactattactgtcctgactcgagcatttgagattgccacgacgcagatgcaggttgaacagccttcatgccttgactgcatgaggattttgtcagataagcttgataaagaggttgaagatgtgaacagggacattgaagcttatgaagcctgtcttaaatgcttggagggggaggctagagatgtcctgagtgaggctgattttcttaaagagaaattgaagattgaggaagaagaacgaagacttgaagcagcaattgaagcaaccgagagacagaatgctgaagtaaatgctgaactgagggaactagagttaaaatcaagtcgctttaaagaattggaggagcgtctcaacttggtaccaaagcgggttgatcctgctctgccagttgtccgctgctatctgtcgtttccaatggccactgccgtcggctgccatcatattttccagcgatcactggatctggtgtgcctcgccacgtgtgacccagcccagaaggcctcttccggtcctgattcagtcattagttcgtcgttttcaagtcctcttgttgctgtttggatacgcttggtaacacgcccgtcctcttctgtcctggttcagtcatcatctcgtcctcctagctgctgtttgtacacaatgagtagaggagaccatactgaatgcacattttgcaagagaatagggcatacttggataacatgcttccatttatttggtttccctaacaagacagcatccaaattcaagagagttgaggctaaattctttgatgaagagtatcaggaatatctaaggttaaaagctagcagacaagctcaacctcctttaacctctagtatttcaacagcttgcgtttctcaatctatggacattcaaggtccatgggtgattgactcaggttcttctaatcatatttctggtaatgcatctttatttacctccatctcttccccaaagtttcctcatcttataaccatggcaaatgaatccaaggctcttaaacacagtgttacttgggagttggtttctcttcgtcctaaaaagaaggtggttggttttagatgggtatatgccattaaagttggccctaatggtgaagttgatcgtcttaaggcctga

SEQ ID NO: 32338 - DNA, 1332 bp, Glycine max
  Peptide Sequence Number=SeqID_149116
atggtgactgcaaatgaggttgttaaagaaggcaaacgatgccaaaatccatgcattttattcaaggttgattatgagaaggcatatgattttgtgtcttgggagtttctcacttatatgatgagtaggatgggcttttgcagcaaatggattcaatggattgaggggtgtctaaaatcagcatctgtttcaattttggtgaatggtagtccctcatctgagttcctacctcaaaaaggactatggcaaggtgagcctctatcacctcttctctataacattgtggcagaggcacttaatggcctcatgtcacaagctttggagaagaggctatataagggatttttagttggcataaataaggtggaagttagtatccttcagtatgcggatgacatgatcttctttggggaggaaactatggaaaatgttagagcaattaaagcaatgttgagggcttttgagcttgtatcgggcctcaaaattaattttgctaaaagtaattttggtgctttcggggtgccggatcagtggaaaatcgttgcatccaattacctcaattgtagcttgatgtccttccctttcacatacctcggcattcctattggagcaaatccaagaagaagtcagacatgggaccctattattagcaagtgtgagagaaaactagcgaaatggaagcaaaaacacttatctttcggggggagagtgactctcataaaggtccctaaaaaggtagtggataagctggtgaggttacagaggaattttctatggggaggtggccatgaacaaaacaaaatagcacaaatcaaatgggaatcggtctgcatgcgaaaagaagatggtggcttgggagtcaaagatattaattctttcaatttatcattgctgtggaaatggaaatggaatttatttcagcatcaaggggagttgtgggccagggtacttgaatcaaagtacgggggatggaggaatttgaatgatgcacctagaatcaatagtgaatcaatatggtggaaggacctaaagatggtggctcaacatccgcaatatggtcagatactaaagaattcaacattatggaaggttggttgtagggacaagtttaaattttgggaggacaactggatgggtggagtgggcacactaatagagaaatatcctaggttgtatactatttcctcccagcaaaatcaattcatacaacacatgggagctttcaaagacttagggtgggaatgggagttcagatggaggagaccattgtttgataatgaattagacatggcaatctcatttctaaaagatgtagagagccatagaatttag

SEQ ID NO: 32339 - DNA, 1222 bp, Glycine max
  Peptide Sequence Number=SeqID_149117
gcatgagaaaggaaagtgggaggcagaaaagactgttagggtgatggggaagggtgctttaagttcagaaaagccacgtgaccaagaggcaagagatacacttgggcctatttctgctattcacacccccgacaaaaagcaatatgctaccttcccaaaagatgctatgggccaacaagtaacaccaacaccacccaatatgcaggggagtgaacacatgccagaaagggaccgtgaacaaaaggatcattacctctcatcacaacaaccaacacttgaggaagtacttctggtcaacaacaagattcaagaggcagagaaattatgggagatgacaaaagaattaagggttacaggagggcacgttcagaggaataactttggccaacagttagaagctctatggggagattctgatgttaggtgggaagctctgccttctgttaattcctcaagtggcattctgtgtatttggggtgaaaaatcattcaagttggaaaggaagattactggagctggctatattatgttggtggggaagtggcagcatgaggcacaaacacttaacattatcaacatttattcactgacctccgaagagagagtcggagcttgtaacaaggggatgaaggtaagcaattctagggagtttaaagaatggattgcagatttggaggtggaagaagcgccatgggttgggagaaagttcacatggatcaggccaaatggaacagccaggagtaaattggatagatttatgcacagaggatggggaggctttgtgctaaaagaaaaaattaaatcccttaaagacaggatcaaggtgtggaacaaagatcagtttggagataccctcaggaagtataagaggattgaggaagacttaaacaagatggaagaggaatcagatgacagacaactaactgatcaacagttgctagccaaaaagaaattgcagcaggacttatgggaagcagctcaggcacatgagtcactgttgagacagaaggcgagatctaggtggattaaagaaggggattgtaattctagatattttcaactcatgatcaatgcaagtcgtagaaataattgcctaaaagaagtgatgattgatgggtcatggatcgaagacctgacatcagttaaggaggaagtcaggagccatcataaggacatgttggtggagcgttttcaggaggaggaggttaaaaaggctatgtag

SEQ ID NO: 32340 - DNA, 303 bp, Glycine max
  Peptide Sequence Number=SeqID_149118
atgagtgagaattccagtgaggagaagaatgaagggtctatctattctcaagaagaggaccttttgattaggagtaagaagaaggttaaagagggaaaatcacttatcaatgagggagtaaggggggtagatggtggttcgtgtccatataaagatatctttctgaagcacattgagggagacgtagttggtgatgttgtggagatagagaaaagtgatattgtcatggaggaagaaagctctgtagagaccgaaaaagagtcagtatatgtgagagatggagtggagattatagttacataa

SEQ ID NO: 32341 - DNA, 2307 bp, Glycine max
  Peptide Sequence Number=SeqID_149119
atggcaagggtgaaaagtccctctcacattctcaagaagatttataaccgcgtctctgtgtctccctttgtggttaaactgtttcctgccatgctggttatgcaagaacccaagaggatgatagctttgaacctgcagactggaagttggggtgatgcaatgaggcagtcttttgatccttcatctttgggtccttccaagattccatctataaaaatacctggaaaagcagggaatggtgcatgggaggctttgtctggatctgattcctaccatgcttcgtcggatgctagcctcttttctagctcattacctgttcttccgcatgaaaaattgaacttgaatgaaactgcaaatgcttatcaatctattgacgacatctcatccggctttaagaagctccatcaagatgctgagggcaatggttcacttgaagacggtgatactcatgcaattggacctgcccttcctgatgatgaggaggagcttttagctggcataatggatgattttgacttaagtggtttgcctggttctcttgaggacttagaagagtatgatctttttggttgtggtggaggtatggaactagaaactgatccacaggaaagtctcactgtgggtatatctaagctaagctttgcagatagtaccgttggcagtgttttgcccccttattcttttcccaatggtgtgggagctgttgcgggagaacatccatatggagagcatccttctcgaacattatttgttcggaatattaacagtaatgtggaggattcagagctgagagccctttttgaggacaatccatcagacaaggatatcaaccagggaacattggtagttttcaatttggatccatctgtttcaaatgaagacctgcgtcaaatatttggggcttatggagaggtcaaagagataagggaaactcctcacaagaggcatcacaagtttattgaattctatgatgtcagagcagccgaagcagcacttaaatcattaaacaggagtgacatagctggtaaacgcataaagcttgaacctagtcgacctggaggagctcgtagaaatttgatgctccaattaaatcaagagcttgaccaagaagaatctcggagtttccgataccaagtgagttcacctgtagctaactctcccccaggtaactggttacagttcaacagccctgttgagcagaattcaatgcaaactatcaatcattctcctggttctaggatcataagcccaacaacaggcaatcatttacctggattagcttcaattttgcaaccacaagtatctaacgctgtaaaggctgctgctattggcaatgacttgggaaggagcagtcaaggagagcacatattttccggtatgaattcatcacacggagctacttttcagtcgcattcacttccagagcctaaattcagccaatatcgtggagcattgtcctcaattggtccatcaacatcaaatggatcctcagtggaaactttgtctgggccacagtttctatggggaagcccaactctctactcagagcataccaaaccttcagtttggccaagatcatctgtggggcatccgtttgctgcatccaatggaaagagccatgccttcccatattcaactcagaatagttcttttgttggttcatcccagcatcatcaccaccatcatgtcggctctgccccatcaggcattggtcttgggcataatgatggaaattacatggttaatgcgggtggatctgttaatcctaacactactatcccaagaaatatatctgataatggttcatcaaacttaagaatgagatcttctccaaggcttagccctgtctttttgggaaatggtccttatccaggactgccacctaccactttggagagtttggctgaccgtgctcggagtagatggatagagaacaatgggagccaagttgatagcaagaagcaatttcagctcgatttggataagattagaagtggtgaagatacaaggactacattaatgataaagaatatcccaaacaaatacacctcaaaaatgttattagctgccattgatgaaaatcataggggtgcttatgattttctctatctgccaattgactttaagacattcaatgggaagaaatgggagaaatttaatagtgaaaaagttgcatctttggcatatgctcgaattcaaggaaaatctgcccttgtgagccacttccaaaattcaagtttgatgaatgaagataaacgatgtcgccctattctcttccactcagagggttctgaagttggtgatctg

SEQ ID NO: 32342 - DNA, 1124 bp, Glycine max
  Peptide Sequence Number=SeqID_149120
atggcaatgttggtgggtagcgctaacatggaccatttggaagcatcgaaatggggtgcttcaatccaacacgacaacttggcttccaagataagtgaaattgggatgttatatgatggccaaaggatccatagtccacctaatgtggcacttgttcttcaaaatattaaacaagaggttaagagtcttgatgttgattacttggaagagaagacaccatattccacaagaaggaaattgtttgctgatattcatggagtccctaggaatagaagggagaggagagagagaaccaaagcgagacagagagagggtacatgtctgagtatcgccggaaataggaaaggatatcaacaaagctacatgcgagagaattggagagaccataaggatgtaacgtctttctacttcacttggttccctgatgatgcaactgaagaagatttatggggtggaggacaaacgccaattagagaggaagttggactcgtcttcggtgggctaaagatgtatgctaaccttccaaaatttggaagagttagggatcgaaaatcacatcaagatgtagaggggcgatcatatattaagcaaggggagaaggaaaatagagatgcatacctgcaaatgaagcaaggagtatcattggatatgaagcgaggctcgtacgctgatgttattctaggaataaactacgagcagaacaggggaattcagcaaacaaggaaggcaacaggtcacaatcatcgcgtagaagacgacatcctctgggatttcgatgataacaaatcaccgaaatacatcgaagatgacatgatcttgctcctgggcctcactgacgacaaagcaaggcaactgatggatgatgaaaatgaagatgggactacgatgttccacaccttggaaaaatggaatccagggatgcgaccagcaaatgaagaagatggtgctggtatcggggacttggtggaagtcgacgatgacatggaggaaccacgaaagctagatatcggggacatgaagcaaatgaagaagatggtggcttgtatcggggacttggtggaagtcgacgatgacgtggaggaactacaaaagctagatatggcaaggatcttattaaagacatc

SEQ ID NO: 32343 - DNA, 693 bp, Glycine max
  Peptide Sequence Number=SeqID_149121
atgagcgttttgcaagggaagcgcaagcgccaagtcttgttggcatcgacgcagtcatcgtcaatgaacaacgaggagcgcgccgtgtacacgatcattcgcgagaggaaggagatggggatatggcaaggagacatcaaacgagagaaaaacattcacattcccgatagtctgctgaagaaaaccctaaagatgctcatcaccaagaacctcatcaaggaggtcgtcaacgtccacaacaagtccaagaagcttttgatggcgaccgacttcgaaccctccaaggagatcagcggcggagagtggtacaccgacggcaaattcgacaccgaattcatcggtgctctgtctgatgcttgcttgagcaacatccgccgacggaaagtcgcgacgtgcgacgggatcgtcgggtggattaggaaggtggggagtgatgtgttccctggtggagttagtaaagggcaggtggagcagattttgaagaatttggttatggagaataaggttcaggaggtgactagtactggatttggggattttgagtctgttcctgttggtgaagtttgttatagattggtgaagaagggtgctggtggtgttggtgccatggcttctattccttgtggggtttgtcctaggattcattcttgtacacctgatgaggagattggcaagcttccatatgctgcctga

SEQ ID NO: 32344 - DNA, 120 bp, Glycine max
  Peptide Sequence Number=SeqID_149122
atgagtggaaagggattgcagcatgttcggaaatcactttctcaatatcagcgtcttagagcatgtttggaaatcaaatgggataccaattgggaaagagggtttgtagtttatgtaaag

SEQ ID NO: 32345 - DNA, 156 bp, Glycine max
  Peptide Sequence Number=SeqID_149123
atggatgttcgtcgcagagcgaaagcgaaagcgaggtcccagattaaagtttgctctaataccattttgtacaatttaggcaccaacaacctgttgcctgtttgtgaagtgccttcccaacctagccaccactgtaactctgtgagcaatttgtga

SEQ ID NO: 32346 - DNA, 1866 bp, Glycine max
  Peptide Sequence Number=SeqID_149124
atggtgtccgacgccagcaagaagaaggccgcacagaagaaggccgccgccgccgccaagagaggtggaaaggccgccgccgccgccgttatggaggcgtcttccaaagccgccaacaaggtcgccaacggaatcgccgatattcagatttcggatcggacctgcaccggcgtcctctgttcgcatcctctctccagagatattcgaatagagtctctatctgttacgttccatgggcatgatctcattgttgattctgaattggagctaaattatggaaggcgttatggtttacttggattaaatggttgtggaaaatctacactgctgacagccattggttgtcgggaacttccaattcccgatcacatggatatatatcacctaaccagggagattgatgcctctgacatgtctgcattggaagctgtcataagctgtgacgaagaaaggttgaaattggagaaagaagctgaagttttggctgcacaggatgacggaggtggtgaatcccttgaacgcatttatgaacgattggatgccctagatgctgccactgcagaaaagcgtgctgctgaaatcttgcatggtcttggctttgacaagcaaatgcaggcaaagaagacgcgtgatttttccggtggctggagaatgaggattgcgttagcacgggctttatttatgaatccaaccattcttctacttgatgaaccaaccaatcaccttggtatactctctgccctggaaagagtccctcttgtttgtccaaataatttttatctgtcttatgcagtaattggttgggatgatttggaagcttgtgtgtggctggaggagagtttgaagaagtttgaacgtattctggttgtgatttcacactctcaggactttcttaatggtgtctgcacaaatattatccatatgcaaagcaaaaaactgaagatctacactggtaattatgatcaatatgttcagacacgttctgagctagaagagaaccagatgaaacagtacaagtgggagcaggagcagattgcctcaatgaaggaatacattgcccggtttggccatggttctgcaaaactagctcgccaggcacagagtaaggagaaaacgctggcaaaaatggaacgtggtggacttgcagagaaggtggtcagagacaaagttttggtattccgttttaccgatgttgggaaacttccccctccagttctccagtttgttgaggtgtcatttggttatactcctgataatctcatctacaagaacattgactttggggttgatttagactctagggttgcactggttggacccaatggtgctgggaagagtacactactgaagctaatgacaggtgacttgatgcctagtgacggcatggtaaggcgtcataatcatcttcgaattgcacaatatcaccagcatttggcagaaaagctagacatggaaatgtctgctctacagtttatgattaaagaataccccggtaatgaggaagagaagatgaggggggcaattgggaagtttgggctgtcaggaaaagcacaggtgatgccaatgaagaacttgtcagatggacagaggagccgagtgatatttgcttggttagcttggagacagcctcagatgcttcttttggatgagccaactaatcatttggatattgagacaattgactcgttggccgaggcattgaatgaatgggatggtggcttggtgcttgtaagccatgattttaggctcataaatcaagtggctcatgagatatgggtatgtgctaatcaatctgtgaccagatgggagggtgacatcatggaattcaaggcgcatctaaagtcaaaggcgggtttatctgactga

SEQ ID NO: 32347 - DNA, 387 bp, Glycine max
  Peptide Sequence Number=SeqID_149125
atggcaaggcttaatgtaagaagcagcagcaaaaggagggttttagatggtgttttgaagttgaagagtgtgtttgaaaagcttcagaagagtcttttattgcgcagaaataaatcaagttcttcctattatggagattatgacacaacagcgtgtgtgctagaaggacattttgcagtgattgctgagcatgaaaaggagacaataaagagattcttggtgccattgagctacttaagaaactcaacattcttgggtctattggaacaagcagcagaagagtatgggtttgatcaacatggtgcactaacgattccttgcaggcctagtgaacttgagaggttattattggctcagcaacggaaaggaagagagagattcttctga

SEQ ID NO: 32348 - DNA, 1770 bp, Glycine max
  Peptide Sequence Number=SeqID_149126
atgtctcaccaagtcgaatcttccgactcgaaatcttggaagaaagactcttccacttcgattcttgaacggaagaaatcgccgaaccggttagtcgttgacgaagcagttaacgatgacaattcggtggtcgccatgcaccctcaaaccttgaaaaaactccaacttttccgcggagacactatcctcgtcaaggggaagaaacggaaggacacggtttgcattgctcttcgggacgagaattgtgaagaatcgaagataagattgaacaaagttttgaggtcgaatttgagggttcgtctcggagatgctgtgtctgtgcattcgtgccctgatgttaagtatgggaaacgcgttcacattcttcccattgatgataccattgaaggtgtcactggcaatctctttgatgcttacttgaaacttgttgttatgagaagctattattgtctactatgggtgtggttgggtaaaaagcgtgatttagtgcttgtcatcatatttcttgtccaaggagggatgagaagtgtagagttcaaggtcattgaaattgatcctggggagtattgtgtggttgctcgagacactgaaatattctgtgagagggaacctgtgaaaagagaggatgaagaaaggctggatgaggttggctatgatgatgtgggctgtgtcaggaagcaaatggcacagattcgtgagttggtagagcttccactaagacacccacaactttttaaatcaattggtgtgaaaccacccaaaggaattttgctgtatggacccccaggctctggtaagacattgaaagctagagctgtttctaatgaaactggagcgttcttcttttgtattaatggcccagagattatgtccaaactggctggagagagtaaaattgattctattgcacccaagcgggagaagacacatggtgaagtcgaaaggagaattgttttacaacttttgactcttatggacggatttaaatctcgtgctcatgttattgttattggagctacaaataggccaaatagtagccccgctttgagaaggtttggtagatttgatagggaaattgatattggtgttcctgatgaagttggaagacttgaagtccttcgtatacataccaaaaacatgaagttttcagatgatgttgatatagagagaattgcaaaagatactcatggatatgttggtgctgaccttgctgccatttgcactgaagctgctctgcaatgcatcagggagaaaatggatgttattgatttggaagatgagaacattgatgctgaagtgctgaattctatgacagtttcaaatgagcatttccataccgctctaggaacaagcaatccatctgctttacgagaaactgttgttgaggtgcctaatgtcagctgggaggatattggaggcctcgagaatgtcaagcgcgagctgcaagagactgttcaatatcctgtggagcacccagaaaaatttgggaagtttggtatgtcaccatcaaaaggagttctcttctatggtcctccaggatgtgggaaaacgttgttagcaaaagcaatcgctaatgaatgtcaagctaacttcatcagtgtgaagggcccagaattgctcactatgtggtttggtgaaagtgaagccaatgttcgagaaatttttgacaaggccagacaatcagctccatgtgtcctcttctttgatgagcttgattccattgctactcagagaggaagtagtgttggagatgctgggggttgctgctga

SEQ ID NO: 32349 - DNA, 1143 bp, Glycine max
  Peptide Sequence Number=SeqID_149127
aggacagcatgtcctcgcctttagaggactacatgtgctcccctttagaggactacacgtcctcaccgccagagggctgcacgccctacccttcagagggctgcacgccttcacctttagagaactgcttgtcctcgccttcagagggctacaccccctcgcctttagaggactatacgtcctcatcttaagaggactacacgtcctcatgttcagaggactaccgtcctcgctatcagaggactgcacgtcctcgccatcagagggctatacgcctttgccttcagaggactccacgtcctcgccttcagaaggctcgacgcccacgccttcagatgacaaaatgtcctcccctttagaggactacacgtcctcgccatcaaaggactacacagggctacacgccctcgctcttagaggactccacgtccttggctttagaggactgcatgtcctcgcctttagaggactacatctcctcccctttagaggactacacgtcctcgccatcagagtgctgcacgccctcccctttagagggctgcacgccctcgcctttgaggactacacggttgcacgtcctcgccttcatagggctacacgcctttaccttcagaggactatacgtcttcgccttcaaagggctacacgccctcatcttcagagggctacatgtcttcgccttcagagggctacacgccctcgctttcagaggactataagtcctcatcttcagaggactacatgtcctcaccttcagaggactacacgtcctcgccatcagaggactacacatcctcgccatcagagggctatacgccttcgcgttcagaggactccacgtcctcgccttcagaggactgcatgtccacgccttcagagggctacacgccttcgccttcagaggacaacacgtccaccccttttgaggactacacgtcctcggctacatgccctcgccttgaaagatcttcacgccatcgccttcagagggctacacgccttcgccttcagaggactctacatccttgcctttagaggactgcatgtcctcgcctttagaggactacatgtccacccctttagaggactacatgtcctcgccgttagagggctgcacgccctcgccttagaggactacac

SEQ ID NO: 32350 - DNA, 523 bp, Glycine max
  Peptide Sequence Number=SeqID_149128
atgcccctccactaccattgacatgagaactcctaaagaagtttggtcaggtcaccctccaaacttgaatagactaaaagtgtttggttgtgttgcctatgctcacattaggcaagataaattggaacctagagtagtaaaatgcttgttcctaggctatctaaaaggagttaaggggatacgtgttgtggtgcttaaaacctgtactgaccggactcaaaaggatgaatctaaaggattagcgcttgaggtggagcctaaggacaaggttgatgaagttcaagatagaatcaaaagggagacgaaaccacctgacaggtataggtatgcaaacttgattgctttttcactgatagctagaaatgaggttctggaagatgaacctactagtcttaaagctgttttggctagtgaagagaaagacaaatggaaaactactatggaagaggagatgaagtccatatatgacaaaaatacatgggagtttatcaaaaagcccattggttcaagggtagtcaattga

SEQ ID NO: 32351 - DNA, 2286 bp, Glycine max
  Peptide Sequence Number=SeqID_149129
atggctgggattgatgataatgttggccttactggtgattggggtcttgctagcccaagtccaaggacctttttttccagaatgttcgaagaagatagtgtgacaagatcaatctcagaacattctggaagtggtagaactggggatctcttttcgggacatcgtgagcctagtgagacagggaaagaaaacatgaatgatagggcacaagatggtgattctggagcccaattgaccgatgtgagttttcagaccgagcagaagtcgagctcccggggtggtcttgttgaaagaatggctgctagagccgggtttaatgctccaaggttgaatacagaaagcattagatctactgacctttcgcttaatcccgacattcagtctccgtacttgacaatcccgcctggtctcagtcctactacacttttagattctccagtgttccttgcaaattcactggcacagccttctccaactaccggaaagttcttgttcatggcaaatggcatcatgaggaactcagaattatcatctgatgctccagaaaaatgtaaagataatggctttgatgatatctacacatcatcctttgctttcaagcgtgcaacagattcaggctctttttatcatggtgctggaagaaaaatgataaatcctactacacttcctcaacagtcccttcctggtattgaggtttcggctcagtctgaaaattcttttcaatctcaaagtgttgatgctgtcaaagctcaaactgagaacaaaagtggttttcgtcttcaggccgactttgctgaatcacctcctcaaaaagataatggaattaagatgttctcagctgatcaaagggcttttgatgttgttggcggtggcaatgaacattctacaccaattgaagagcaagtagatgaaggagatcaaagaggcaatggagactcaatggctagtggtgttggtggtgcaccatctgaagatggatataactggagaaaatatggccaaaagcaagtgaagggcagcgagtaccctcgaagttactacaagtgtacgcatccaaactgtcaagtgaagaagaaagtagaaagatctcatgagggccacataactgagatcatctacaagggaacacacaaccatccaaaacctcctccaaatcgtcggtcaggtataggtttggttaaccttcatactgacatgcaagtggaccaccctgaacatgttgaaccacacaacggtggtgatggcgacttgggatgggctaatgtacaaaagggaaacatagctggagctgctagttggaagcatgacaaccttgaagccgcttcatcagcatccgttggccctgaatactgcaaccagcagccccccaatttgcagactcaaaatggtactcactttgattcaggagaggcagtggatgcctcatctactttttctaacgaagaagatgaagacgatcaaggcactcatggtagtgtatcattaggttatgatggggaaggagatgaatctgagtctaagagaaggaaactggaatcatatgcagagttgagtggagctactagagccattcgtgagcctagagttgttgtacagactaccagcgaagtagatatcctcgatgatggttatcggtggcggaaatatggacaaaaagttgtcaaaggaaatcccaacccaaggagttactacaagtgcacaaatgcagggtgcacagtaaggaagcatgtggagagagcatcacatgaccttaaatctgtgatcactacgtatgagggaaagcacaaccatgatgttccagctgctcgtgccagcagtcacgtcaatgctaatgcttccaatgcagttcctggccaagcttctcttcagacccatgttcacagacctgaaccatctgaagttcacaacggcattggaaggcttgagaggccttccctgggctcattcaacctacccgggaggcagcaactaggaccttcccatggcttctccttcggtatgaaccaatccatgctatcaaatctggtgatgtcagggttgggccatgcgcaagcaaagcttcctgtcatgcctgttcattcattcttggcagcgcatcaacaacaacagcaacatcaacaacaacaaaaccaacaacaacgtgcggcaaatgatttgggtttcatgttgccaaagggagagccaaatgtggaggctattcctgaacgtggtggccttaacctgtcaaatggctcatcagtgtaccaagaaattatgagccgcatgcctcttggacctcatatgtaa

SEQ ID NO: 32352 - DNA, 393 bp, Glycine max
  Peptide Sequence Number=SeqID_149130
atggcctccatgttgggccttcatctgctcttgcacctcctctacttcacccattactctacttctagcacgggttcggatatggggttgaatcaatttagattttcaacatggtccatgacatcttcgtcaagacgaagcaatgatgtaacacaatcaatcttttgccccaacttttgcaaggtggttacttccatacttcaacttgactcgatgaatcttttcgtaaaagcacgagcttggttcaaccccataacccagggaatggcaattttgatcgccaatacttcaacaacatttcatagggatgaaagattcgggaatacgcatgctatgtatggaaaatgtaattatgagattgagatgcccaaagagacatcctttcttaattaa

SEQ ID NO: 32353 - DNA, 330 bp, Glycine max
  Peptide Sequence Number=SeqID_149131
atgaatgtcacaactgagagagatagcaaaagggttagagaggagtggccacaggttcttatgggtcgtgaaaaggccaacacaagacgagggaacaaagcatattcacgacataacagcaggggaatgttccgacttgagttcaagggcaggggcctggtggtgaggtcgtgggccccacaagtggaggtgctgagtcgcggctcggtcggcgcgttcgcacgtgatggtgtggagatgaatgtggctgttgcggtggagcaaagggaagaagatgagtttgtgagtgaggaggaggtggagaagaggctgagggaggtgatagtgtga

SEQ ID NO: 32354 - DNA, 297 bp, Glycine max
  Peptide Sequence Number=SeqID_149132
atggccattttttggatgtttctaggcataagctcacccagaccaacatctggctcacctgggccatggaatccctttatccttaagcaactagctcgcttaggcaagctaataccttcagcttcatgcaagagaagagtttcaggggctgattcttggaggaatagagggaaaacacaggaagaggaagataagaagaaaaaagcaaagctgaggtatcgtcgaatcgaaccatggatcgtttcctacatcatttctcttgctagcctttttattaccctcatgggacctctgtga

SEQ ID NO: 32355 - DNA, 270 bp, Glycine max
  Peptide Sequence Number=SeqID_149133
atggaacctctgatgtcaacggaggcggcaacggcagcgactgacgagagcgccgccgcggcgagaactgggatttccactttcgtaacgagaagagaagggaattgtatgagccacggtgggggcgacagccttcagcggctctcgcagcaacaatggggggcagcgccggcaacaacagtggagggcggtttgagaggtgagaggcgacagcgacagagtgaagtgatggacttaatgacgtggtgctctattaaaaagccatgctaa

SEQ ID NO: 32356 - DNA, 219 bp, Glycine max
  Peptide Sequence Number=SeqID_149134
atggccttttcctttaaaaagccatgtaggggaagggtttctggggttgattcttggaggatcagagtgaaaacgcaggaagaggaagataagaagaaaaaagcaaagccgaggcgccgttcaatcgaaccgtggatcgtttcctacatcatttctcttgctagccttgtaccttgtgcaacagtcgtgagactagaaggtaatagaaaacgaaaatga

SEQ ID NO: 32357 - DNA, 705 bp, Glycine max
  Peptide Sequence Number=SeqID_149135
atgtaccaatatcttccccaacaatatcaatactcagcaaatatcagtcattcctattactcaccaccctaccaaccaagagtgcccaatcatctgcaaaggccacccctaaatctgccacaaaatccacctgttgcacatccaagaccaaacaccacccctaataccaatcaaaacaccaaccagggaaggaactttctagaaaagaagcttgtagaattcaccccaattccaatcccatatgctgacttactcccttatctgctcaacaatgcaatggtagccataaacccaacaaagattcctcaacctccatttcctagaggatacaactctaatgtgacatgcgctcatcatgggggagttctggggcatttcattgagcattgtatgaccctgaaacataaggtgcaaagtttgatcgatgtaggctggctgagatttgaggaggagaatcgcttgtggattctgacatggtcgtggcaaacgaccacaacatatacctccgaaccctacattggggcaatgataggcaccatgcatgagcttcaagcgaacctaggggcagacaagaagtcctctcatgataggttgaaaacccaaaagggtggcctaggcaaaagttatggaaataaaaagggaaaaacaatcaggggcgtgttatcaaaggttttgtcccaaaatccaaactgtaaaagtctctag

SEQ ID NO: 32358 - DNA, 444 bp, Glycine max
  Peptide Sequence Number=SeqID_149136
atgttgagtcctatgaaagataaaggcgaggactttgagtcctatgaaaacataaaggtgaggacgttgagtcctatgaaagataaaggcgacgactttgattcctgtgaaaacataaaggcgaggactttgagtcctatgaaagataaaggcgaggactttgagtcctatgaaaacataaagataaaggcgaggactttgagtcctatgaaagataaaagcgatgactttgagtcctatgaaaacataaaggcgaggacgttaagtcctatgaaacataaagcaaaggacgttgagtcctatgaaagcataaagcaaaggacgttgagtcctgcgaaactaaaagcaaagaacgttgagtcctatgaaaacataaagcaaaagacattgagtcctgcgaaactaaaagcaaagaatgttgagtcctatgaagcatgccaataa

SEQ ID NO: 32359 - DNA, 234 bp, Glycine max
  Peptide Sequence Number=SeqID_149137
atggcttacactcacattccggtggaagattcaacaagcaattctcctcaaatttcagccagcccgtatcaattagacttcacactttatgcttcggggtcatacaatgctcaatggaatgccccggggctcctccatgataagcacacgttgcgttcgagtcgtatcctcagaaaaatggaggttgaggtggtcttcgtcattggaagtgcggtagacaggcttagtggttga

SEQ ID NO: 32360 - DNA, 255 bp, Glycine max
  Peptide Sequence Number=SeqID_149138
atgtccttaaatgacacattcatttgttcacagagttttgggaagtacgaggcgattgctagaacagcgacacccgaaagcgaagaagtagaagtagaagaggttggttacaaaggcttttatggtggtggatttggagattttggtgagggtggtgtctacgttgggggtgtttcttttgatgaagtcgaaggcttttgcggcgaagcttgcgatggtggtggtggtggtggggcggaggcgatgcactactaa

SEQ ID NO: 32361 - DNA, 288 bp, Glycine max
  Peptide Sequence Number=SeqID_149139
atggtggagaaaaggcaaatttgcatatacttgaagtcaaataacgttattcctaatctcgtagctttagtgagtcccctcactcactattacctctcgccaccaaccatagtccacgatgacaaaaaattgttaaactgcaaaattgtctttcatggatttgctgcgcccacaaccctatcttccttcaccatttgccgcaatgaaacaccagcgcccaaaccccaaccatggcaccctcatcgctttctatctgctccgcaacatcatggagaatgtggtagatga

SEQ ID NO: 32362 - DNA, 630 bp, Glycine max
  Peptide Sequence Number=SeqID_149140
atgaagcaaagagataaactgggtcagatacaacaacattgggaccaagctctcagtagacagaagtttcctatgagtgctatgtatcatgggctgacagaggaacaccaaagagtgccgtggaggtctgtgatgtgtgggaacaaggctagactgcgagctgtcatttgcttgtggcttgcttgtcacaaaaagctctctactaaagatagattaagaagatttggaatgatccaaagtagtgattgcagtatttgtaactgtgctgatgagtctataaatcatcttttcttcaactgcagtggcactagagaaatttgggggaacattttggattggctgggtagaagacatgatccgagggagtgggatatggagcttgcttggattattgagaacaccaaaggaggtgcttctttcgagtccgcaaagcacgtgccatcagctaaggccttaaccgccataggctcaagctccggaaacgtgttcaccactatcccatcgcttcaccaaggcttgtgcccagatacagcatgtcccaaaacacagaagaaggtagggaacagagttgaagccctagagactctcgctcagcgcgtcacactcgctcagcgggcaatccttgcttag

SEQ ID NO: 32363 - DNA, 828 bp, Glycine max
  Peptide Sequence Number=SeqID_149141
gaatgggatgaacaagtcattcataggaacataacctcttcagcagtgactcttgaacctgacatgaccccaagactagtggggcttaagagtctaagtggagttaaggttgtggattttaggcaacctgaggtgctattggtaaacgaggttcatcaatttgaggggagaaaaaggccacttgaggcattagcagatatgggactaaatggagagtacaatttgaaggagttaatgacattggtaagcttaggagctacacgcacccattctgacccaaaattaagaccaaccactagacacatagtaagcattctagggtacatctacttgggtttgactgagaacaagagaggatacatctcttgtggatcagttctagtggagggtacatccactaggttcaaagagaacaagggaggggggagaagcatttcaactgaaaagtttctatcaaaagaggagagcaggatccaagcaccaacaaagccctctaaggaacaagataagattcaaacgcctacaaagaaggctaatgctaatggaactgtggaggaaccagaaaagtatagtaagctaagaacttccattggaaagaaatcagctgaagtttctaacagtggactccctggaaacttggtcaaagttactctaagtaatacaaaagtaacagatgcaagtgttcaatgggcttcactcccatcatctatttcaaagattggaagggaagtaatgaaacacagagatgcggcacagatagcagcaactgaggctatgcaagagcctattgctgctgagagtttactgcaatgtctaaggtatgaataa

SEQ ID NO: 32364 - DNA, 567 bp, Glycine max
  Peptide Sequence Number=SeqID_149142
atgcaaaaggaattggaagagctcaaacagcgatgtaaaaaactgaaggaagagcatgcttcatttcatgatcttgcggatagaatgattgaggagaaagactatgaaatatccagacttttagatgaaaataagaatcttcgtcagtctcttcaatcaagaccatcaattttggctagacaacaagcccaaagagaggaagagctagcactgtcacagcgccatattttagctcttcaagaagaaattgaggagcttgaacgtgagaatcgtctccacagccaacaggaggcaatgttaaaggatgagcttcgcagtatggaaagatcaaagaaaagggaaggtgttgatatgacatatttgaaaaatgttatcttaaagctgcttgagactggtgaagttgaggtattgctaccagttattggaatgctgcttcagtttagtccagaagagatacagaagtgtcaacaggcatatcacaactccacagatgttccaccaccaaatcctgcaagcgatacttcaggatctggcctatcgcttttctcaagattcacattttcttaa

SEQ ID NO: 32365 - DNA, 1032 bp, Glycine max
  Peptide Sequence Number=SeqID_149143
atggccaaggttctagttgcagaaaaagaatccagaattgcagagatggaagcggcatcaacaggagaagctgcacgactcagagcagctgtggaaagtgtgaaaggggagctttctcacctaaaagaggagcatgaaaaagaaagggaaagctgggagactgcttctcaggcacttaaagcaaaacttgaaattgcagagagcaactgcatacgtgcagaagttgaagtagcaaaaataagaagtcagctggaatcagaggtatccacccaaacaagaatcctcaatatgagagatgccgaattgttggctgccaaagaagagcttaaagagtgtcaaacagttcttgtggagcatcagcatattttcttattttcattagaaagtatggtgtgtgataatgtaatgtcatacagaatccctgttgtaggagagaaccctgtttctgagatcagctctcttgagaaggaattttcttcatacaaagttcgtgcacatgcacttcttcaaaagaaggatgctgagctggctgctgctaaagattctgaacaactcaaagctctagaggaaactctgagagaggtggaaaatgaagtattatcaataacagaagaaagggatagagttcttcaagatcttcaatctgctatggctaatcatgagaaagagattgcagaaagagacacagcccttgaaaatgtcaagcaacagataaggagctttgaaataaagcttgactcagctaatgttaaacacctaaaagagaaagaggaatggggactaagtcttcaaaatgtagaagaaacatggagaatcagatgcgaggcaatgaaggctgaaaatgaagctactgctacaaaagatatgcaaaaggaattggaagagttcaaacagcgatgtaaaaaactgaaggaagaacatgcttcatttcatgatcttgctgatagaatgattgaggagaaagactatgaaatatccagacttatagatgaaaataagaatcttcgtcagtctcttcaatcaagaccacca

SEQ ID NO: 32366 - DNA, 1358 bp, Glycine max
  Peptide Sequence Number=SeqID_149144
gactctttttgacgtttaatgatgatgtgctgcgtccacagggttatcatgctctgcaagtacatcgggtagctcatgcattgtggcaccagggacgcaaagtcttggccctggctttgcaaagccgtgttagtgaggtttttggagtggacattcatccagctgcgaaaattggggaggggattttattagatcatgggacaggtgtggttattggtgaaactgctattgttggaaacagagtttcactgatgcatggcgtaacattaggaggcacggggaaggaaataggtgatcgtcatcccaaagtaggtgaaggggcactaattgaagctagtgcaactatacttgggaatataaagattggtgaaggtgccatgatagctgcgggttccctggtgttaaaagatgtccctccccactgcattgcagcaggaataccagctaaagttattagtgctctacaggagcatgacccatctttaaccatgaagcatgatgctagtaaagatcttttcacacatgtagctactaatttcatagatgaaaagcccaatgactgtctgggacattcggaaacggcagcgttttctactctccttaccgtgcacgccggcgtgagatccattccgccaccgatcccacctccaccggcacttcccgcgttcaaatcgattaagctcgtttatttgctgatttctcttccactttcgttctgcagcacagtttccccacactcagacttgtgctgcaagaggttgattgcatctggtgaaggggatactggtggaatgatggatactcacgcagaagattctgctagatctgaggagaattttcctgatgtgactcatcataatgaagatggaagcaacggaaatcttatattggaaaatggtttgtctgatggcaatcaaggtcctgctgatactcatgatcagcttctacaaatggttatggacctcaggtttcagaatgacttcttgaagtcccagtttgagggatttaaaaatgtagacagtgtacatagtgactctaatatacagaaaggagttggtggcttggaagatggggaatctgacattgtgaaagaactaaaggataagatacaattgttaaataaagaatttctggaagaaaaacaaacaagaattgcatcagaagaggctttgaagcatcttcaaacggcttactcagaggcagaagcaaaggcccaagagctctctgaaaagcttgcagaagctcaaacgaagttagaccaagaagtaaaagagcgtgaagagaagtaccttgaacttgattccaagtttaataggcttcacaaacgagcaaaacagcgcattcaagaagttcaaaag

SEQ ID NO: 32367 - DNA, 309 bp, Glycine max
  Peptide Sequence Number=SeqID_149145
atggcggagcgtggccatggaatgtattacacaccacaaacatttgctgagtatccgacacagatgtatcagtatccttttcagggtcatgacactgatacttctgcaatccagcaatcgttcggtggttttgcggaaacacaagctcatttttcatggcccataatgaccccttcacagcaatatcatgggccaattccaacacctaatgccctgttaggaacacaatggaatgtaccgggacaaatatctaatacgggtgacttattcggtgttgatttgcgtcacgcattttttgtcttaaattaa

SEQ ID NO: 32368 - DNA, 201 bp, Glycine max
  Peptide Sequence Number=SeqID_149146
atgacgatgaggatgtcaaagcatagcaatggtgattccaacgaatacaacaaggaaacatatttgccgataacaatcaatgtcatgtgcatgccatttgatgaccgcatcccgtttgaggaatatggtgctccaacgagtttccagttgcacgagatcgccaaaaatcgttcacatggaacaatctttgatcaacaataa

SEQ ID NO: 32369 - DNA, 1462 bp, Glycine max
  Peptide Sequence Number=SeqID_149147
atgacggtagctacacttgttggcaagctaagagagtatgagttagagcttgggagactcaaggatgaagaagaaattgacaagaaaaaaaagggattgaccttaaagacaagcacttcatatcatgaagcttgtcacataaaagcggattgtccaacttacctcaagaaacaacaaggaggtgataagaagcaaaataaaccatttaagaagaaaagagcatacatatcatgggatgataatgatgatagttcttcaagtgacttaagtaaggaagaagaagcaaacttatgtctcatggccaacattgatgaggatgagaccaaaagtaatgtaagtgactcttcttccaaatctaacacaaactatgaaaatctacttgatgcattcaaagagttacatgaaaaagttcaaagactcacctttgtaaacaagactttaaaaggccaagttagatggcatattgagaaatttagcactttacaaaaggaagtccatgatttgagaaaagagaaagtggatttagaaaaatctattgaggactccatctgtacatgtaaatataacaatattgcttctagctcatattatgaaaattgcaagcatcttcaatgcaaaattgattatcttgaaaagccacttgcaaagttcacaagtggaagagcaaacttagatgccttgttgagttctcaaaagtatgtcatgggtaggactagacttaggcatatgactagagacaaatccaaacatgtctctctaacgacaaaacaagaaggatttgctacatatggtgatagaaacaaaggaaagattctaggttatggtaatgtaggaaattttgaaagttctagctaccttgaggagactagaccattaatattggagaaacaaattgttgatacaagtaaaaaatctacaaaggagttgcctaaagaatggagcacctctaggaacttatcacttgacaacataataggtgatataaacaaagggaagtttggtatggaaaagtccaaagagtcaccaacacctatgccacctcatgctaccttgatttggatgaaaaaggaatctcatttagtggttgtaaagagggtccttaagtacattaagggtacattaaaagtaggattgtggcatcctaagggtgcatctattaacttagttgagtattctgattcagattatgcaggttgcaaagttgataggaagagtactagtgatacatgtcattttcttaggagcgctttggtttcttggcactataagaaacaagcttgtgtggctctatccatatctgaagcagagtatatcgctgctggtggccagtcagggtcacgatgttttgcgagaatgctccaaccatatgggatcagcataggcttaaaggagcactcaaacccggtgacccccaaggcctacactccgaagagtccgtcagggcctctcccttctgattcag

SEQ ID NO: 32370 - DNA, 198 bp, Glycine max
  Peptide Sequence Number=SeqID_149148
atggcaacaggaagaagagcaggcgcggaggaagaaggaaacaagaaaggaagtgagaggttgatggaggacttctggagcatattccctaattctacaccattgaaaaattctattatactccaagctcatatgatctctaactcatttctcggcttgtatcagaacatacaaaaaggctacataaatcagcaatga

SEQ ID NO: 32371 - DNA, 1185 bp, Glycine max
  Peptide Sequence Number=SeqID_149149
atgttgcttcagtcgtataaggagcacacaaccaggcgtgtatggatcgatgagcccaaagcagttttgaagctagtcagtcatggtggtaatgttatgcctcaccctacccaaccaacaatgaagggagatggcacaaggagacctcctccttccaccttcttgttggagagaataaccctcaatgatatgtcatgtcctttacatatgcctattacaggtcatatcgttgatcacacagacacgagctacaccaagaaagagatcacaggtcagagcttgctcaacgaaataaggccagaaaaaaggaagagaacatgggaagtcatccaggttgaattcgctgagcaaaatgtttggattctaactgggaagtattatccaaatgtggatctaaatcaagtcaccaaatggggttttgagttgatgatcaaagaattggttgttgatcttgaaatccttagaattttcatgtaccttagtgatctaggtcgctgcaacgagtatgcttgcaaagaatttgcacttgcatttctttatgatcagtttgcatatgcgagtaaacagatgagagattatatgacgcttctcatactaaaaatatattttatgttttataggcataggtgttcgagcatcatccaagcattccttgttgagaaaagagaacttggaccttttgaggaccaggcatactcctttggccacataagagttgggacaaacatgtggttatatctaccaaagagggttttgaggaaatttgggtatgatgagtgggagcaacatgcgttgtcattaggcgaggttgctccacatagggctctatgggcttgctctacaaattacatgccttggtattacgagcatttacatccatacctgattctgccacaagagggaaaggcactgcataatcatgatcggttcccgataatgcaaacaacaacaactactaacatagacttatcatctaaattagagcctgttgttgccattgatccacgcatcagaacaatgatctctttggcaaatgttgtttttcttggtttaaatagaagggcaaggatttctttaggagagcacccaaccattgcatacaactcaattgatcctttagaactaaactccaaaaagaagaaacacatcttccccatttcattgtcatctttaagctccatatag

SEQ ID NO: 32372 - DNA, 177 bp, Glycine max
  Peptide Sequence Number=SeqID_149150
atggcaaccacttctcactttgagtgcgttgttccaatacttgtgaccactctcgttttggcagagtttccaaaagtagaatgggtatggaaacaatgctgggatatttggattcatgatcccgaattcaaaaccaaatggataaacgaggccttgacttttccctcaatacattga

SEQ ID NO: 32373 - DNA, 375 bp, Glycine max
  Peptide Sequence Number=SeqID_149151
gatggtgatcttgatttgaatgcttcccctcaagcacttgacaaattgttgggtcatgtgttttcttttaaggtcaggattcaatcaaatttcaaaaatgcagttgtacttagatactctaaagacctggatttgatcaatgctgttctcgagatgctgcctgatagtgaggcatgttccaaaatagatccttccaatgttgattgcaatgatgctacgcatgctgaatctaaccatgatccggttgcgggattgcctttaacacccaaaaagcggatgtcatctgatgaaaccgatgatgagttaaggagctctcaaatttcgccagcccaactatcgtctaacaaattaacaagacattctcataagagctaa

SEQ ID NO: 32374 - DNA, 537 bp, Glycine max
  Peptide Sequence Number=SeqID_149152
atggagaggaaggttttaacagcacggtgtacgtcaggttctagcaatggcgaagactacgactcctctccctccatcaccattaacgtagtcatgaccctcaacaccaactacctccgcggcaccatgcttcaccatagcatattattgttgccaagactgcaccgacggctggggctagtccaaggcctgtcaaatggacttggatatcttgccacggaccctattggagtcaaaccgatcaatcttcatcttgaggtaagggaaggtggacttgatgctagagaagagtttaggagcatcgtcatgggcggagaggaagtggaaggtcaggtcctcagggcacgtcgaatgttgaagcatggagaacaccgtggtcatggtgtcgcgaaggtagttggtgttgagggtcatggctacattaatggtggcgaagggagaggagtcgcactcctcgccattgtgaaaggcgggggcctcccggaagagagggagctccggggaagaacggcgggcaacaataatttacgatgttaa

SEQ ID NO: 32375 - DNA, 750 bp, Glycine max
  Peptide Sequence Number=SeqID_149153
atgaaacaaccaacattatttccactctcccgaccctatttccatgtttccgaacagggcatacaagatcatgctatgccactttggaagtttttggcaattgagtcatctttaatatacgcgaccttgttacttctaaagtcttcaggtgtaagcacaggtttacatgctggaaggtatcgaagttgctcaatccaaggatggtctagttatctcccaaaggaagtatgtcttcacatcctggaagaggctggcctactgaatgctaaaccagtggacactcctatggatcctagtgtcaaattgctacccgatcaaggggagcccatatcggatcaagggagatataggaggttggttggaaagttgaactacctcacagtcactggtccagacattgcatttgcagtaagtgtggtaagccaattcatgaactctccctgccaggatcattgggatgcaattatgcggatcctgaaatacatcaagtgtgctccaggaaaaggcctcacttatgaagataagggacatacacaagtggtaggttacgtagatgctgactgggctggctcacccagtgataggcgatccacatctggaagattgagtcagggaacattattacaagttttatcgactcttgtgagttgtgaccaattggctgatatcttcacgaagtctcttaggggaccaagaattagctttacttgtagcaagctgggcacatatgacttatatgctccagcttga

SEQ ID NO: 32376 - DNA, 180 bp, Glycine max
  Peptide Sequence Number=SeqID_149154
atggatcttgacggagggtgttcgtcaacagttagcacaggagcacaggcaattccaggacgttcaacacgacatggtgctagaagagcttttgggagattttctactggaaatatagagctttttccagttgagaaactctcaatagctcttctagctttatatccaaacaatctctag

SEQ ID NO: 32377 - DNA, 567 bp, Glycine max
  Peptide Sequence Number=SeqID_149155
atggttccgaaatggttgagtaacttgtatgtcttgtacagcaagatcagccatacagttgtggggccttttgaagttcagcatctgattgaacatagtaccagtaactggatgccagatgactttgaggtccaatacaggtatgtcaaaagtagaagtgacctgcaactcttacatggacttggatacaatgacaccagttcttgtaaacctttagagtcctcacacaatcttccaattgtaccttgtgggttgatggcgtggagtctgttcaatgatacatatacattcagtcgtgggccatcagaattgaaggtcaataggaagaatattgcgtggaagagtgatcgtgatcacaaatttggaaaccatgtttacccatttaattttcagaatgggactttaattgggggtggaaagctggatccaagtattcctatggtatcagagtctatcccagatccattaataggccacccaccatattatccacacactaagcccaaaagtactgggtgtaagggggtgtattgggaaaaactaagtccttcattggctagagaataa

SEQ ID NO: 32378 - DNA, 444 bp, Glycine max
  Peptide Sequence Number=SeqID_149156
atggcaagagcggtagaggttttgaaggataaggttccaagtttcgaacgaaggagtgatccagaggcatacttaaagtgggagatgaaaacaaagctagtatttgcatgctgccaatatagtgaagtggaaaaggttaagaatatcaaaggacacatggaagaagagagaaaaataagagctaatgagagagataaaaggttaggttggaggagcaaacaaaagagggagggtatctctactagtgctaaactcactacatctattcatccaactagaagcagggaacttgaatgtgtcatgtattctggaaaatggcatatgacctcccaacgcctagggtggaaggcattgacaaatgagttaaaagaaaaagagattaaagaaaatgagttgagagaaaatgagatgagagaaaaacaagttgagggaaaaagaaaatga

SEQ ID NO: 32379 - DNA, 579 bp, Glycine max
  Peptide Sequence Number=SeqID_149157
atggcgaatgagttagagacaaatacagctaaggctcaaaaaacaccagaagaaggatggactatgcaagatggtacactttggccaggaaataactcacgcgatcaccctggcatgattcaagtatatccattatttctattgactagtttggttctagcaatcaataattggtacaagttccaggtgagagtgtctgcagttctcacaaatgctcccttcattcttaatcttgattgtcatcattatgttaacaacagccaggccgttcgggaagcaatgtgttttcttatggatccagaagttggtagagatgttaacatgaaaggacttgatggcattcaaggactaacaatctttatggctatagccctctttctatgcccaacttaccaagatcttcatgttgctgcttcccctcaaagaagtccaccaatgatgtctcggactttcaaagaaatgcaaaaagggaagaacttgaggccgccatttttaatctcaaggaacttgacagccaataaggcacaaactgctcacagaggaatgaacccctcaaggactaagggtgcaaaaggttaa

SEQ ID NO: 32380 - DNA, 534 bp, Glycine max
  Peptide Sequence Number=SeqID_149158
atgggttttaaatcagggaatgagagaacaatcggaggagagaaaggagaaaaagagtcattacagcgaagatatactccgaccttagggcgcaagggaattacaattttcccaaaacactgcaacaacaatgaggtgttgaaggctctctacaccgaagctggttggaccatcaaagaagacagaatcatttatcgcaagcatacaaagatgaatctgttaaagatattcttaattagttatgtgtatctttatccgattttctccataattgtcgacaaatcattgaaagatgaagatgggaatctcaagaagatcaagagagttagtattgaagattttgagattttgaagattgtggggcagggtgcatttgcaaaagtgtatcaggttatgtggaaggacaggattatggagaagaaccatgctgagtacatgaaagctgagagggatatttggacaaagatagaacacccatttgttgttcaacttagatactcttttcagctttatcaccaaggcctttttaggtga

SEQ ID NO: 32381 - DNA, 597 bp, Glycine max
  Peptide Sequence Number=SeqID_149159
atggattcttttaaacaaatctggggtagtgcagaaggatgtagcagtagtgaatctggttggactatgtatattgcctctcccatgcaggaagatgctgctggatgcagcaatgaaaatgatggatatcatgacaacatctatgctgagaacaggagaaagaagcaaggggccaaagtggatgaagaagaaagcgatgattcaatggcttcggacgcttcctccggtccgattcattatcaccatgcctatgctcacagccaaggtagtcacggcaccgcagcctctaagaaagataaacaagatcatggaagcaagtgttcttctaagaagaatgcaaacaaacaggagaagaaacgtgttgacagcagaaaggatgtagaagtaaaacaagagaaggtaaaacactgctgcaagaatgttgagttcgcagttgaaatttctcttgttgattacgtatgcaaaagttgtattgagctggttgacagaagaaacaagaaaagtggacaagggggagttagagatgtggccaaaagattgaggataatattagcacaaagggaggaagtattttgtatgggaaaaaccttccaataa

SEQ ID NO: 32382 - DNA, 156 bp, Glycine max
  Peptide Sequence Number=SeqID_149160
atgataggcaaggagggcacattagcccccactaccacttcaccatttcatagcacacccaacataacattgacaacacctgttaactctggtctctacataggtcagtctcattgtgtgaaactccacaaagcaggcttagtcaacacaatctag

SEQ ID NO: 32383 - DNA, 117 bp, Glycine max
  Peptide Sequence Number=SeqID_149161
atgaagaaatgcatgatgcaattaaggaataggcgagaactctcaacgacaacgcatcaccaaaagaagaaagctctagatgaggctttactgtcatcaagcgagtcggagacctaa

SEQ ID NO: 32384 - DNA, 1848 bp, Glycine max
  Peptide Sequence Number=SeqID_149162
atggacacccaaagtggtgaagacactgttgatattgatcttggaggtgtttcatccagtggagaagcgattggggatctgggtgatgacattgtcacagtgctcactgggctggaattgaatgttgcatgtttctctgagaaagttgcaaactttagcaattttgtgatgcacttggaaactcttgggtttgaattggagggcttggatctggagaaagaagacaatgatgtggacaacatggattgtgttgggaagtttctggagtttgatctgttgtgtggggtgttgggttctgagattgtggaattggataggttcctggacacccttcatgctgaaattgctgattctggggagagggtggcctcttgcaagacttggcaagacaagttggttgattctgagcaatgtttgaggcagtctgagatgcagttttcagagattaagaaacagtctgctagttttgagaggactctgtcttcttataagaggggaggaaatgataatgttgaagagggtgagatcatcttagaggatgatgaatctttaaatgtaagcacagtgataaacatgcaaacacctgagcaacaaagacatgttctgaggatgctagagaaatctttagcaaatgaaatagatcttgagaagaatttcatcgactcaaggcaaattgaagaaaagctaaaacaaaagatggtttctttagaacaagagctaattctcatggaggaagaagcaactgatgcttgtgagagatggcttgaggcagataatgcaagtgagatactgacgggaatttcaaaacaactgttgggtagacttcagatttcccagttcaatttgaatggtttaagtcagcgtgaatctgaactcagaactaagcttgaaacttgtatagaacaattgaaagagaaggatgttgtttcggacaagattgaacaattgaatgataaactaattcttgccaattctcaggttgttgctttaagcgtcgaggtgtgttcacttgagaagcagctaaaagaatctgaatgccaggtactgaatgtgaaggcttctgctgatgaatatcagaaacagtataatattctgtgttctgaagtgagagacatggaagaagttattgttgaattgaaagaaaatgtatctaatgcggaaagtcgggctaatactgcagaatctctgtgtaagttattgacagagactaacgatgaactcaacaagcagttggctcttttgaaagatggtggtggcaaatctgagagggtagagtcacttgagaggcagctaagggaatccgatttacagctgcagcaagcagtagcatctgctgaagctagtcaagagaagcaaagtatgttgtattccacaattaaagatatggagcatgtgataaaggatcttaagtcaaaggtttctaaagctgagagtcgggctgacagtgcagaggagaaatgcatcatattatctgaatctaatagtgatttaaacgaggaattaaacttctcgaggagtagattggaatgcttggagggatcactacaccaagtggaggaagccaaagtggcatctgcaaaagatatcggaaagcagaccaaagtattcaaaaatttggtgatgcagctggctgttgagagagagcgtcttaataagcagctgtcctccttagcaagtgagaacaaaatattggtagtgaagctaaagcagacaaataagcatccttctcaagaagttactgtgacttttgctactgaccatgaggttggtacttcagactttattatctttgatttttattgttacatgtggctgatgtgcaagaatctcctgattaagttaacttaa

SEQ ID NO: 32385 - DNA, 2628 bp, Glycine max
  Peptide Sequence Number=SeqID_149163
atgaaccccaccaagaaattaacattttcccacattctccaaaaatgttccaaccttaaagctctgaatcctggcaaacaagtccatacccagatgattgtgactggttttgtgcccaccatctatgttgccaactgcttacttcaattttattgcaaaagttccaaaatgaactatgcattcaaggtgtttgacagaatgccacaaagggatgtaatctcatggaatactttgatatttgggtatgctgggattgggaacatggggtttgcacagtctttgtttgactcaatgcctgagagagacgttgtttcctggaattctttgctctcttgttacttacataacggtgtcaatcgaaagtcaattgaaatttttgtcaggatgagatcactgaaaatcccacatgactatgctacatttgccgttattctgaaagcttgttcgggtattgaagactatggtttagggcttcaggtgcactgccttgcaattcagatgggttttgagaatgatgtggtgacaggcagtgctctagtagatatgtactcaaaatgtaagaaactagatgatgcctttagggttttccgggaaatgcctgagagaaatttggtatgctggagtgctgtaattgcaggctatgttcagaatgaccggtttattgagggattaaaattgtttaaggatatgctgaaagtgggtatgggggtgagtcaatctacctatgctagtgtattcaggtcttgtgctggattatctgcatttaaattgggcacacagttgcatggtcacgctctaaagtctgattttgcatatgacagtataattggaactgccacattggacatgtatgcaaaatgtgagagaatgtttgatgcctggaaggtatttaacacattgcctaatccccctcggcaatcttataatgccattattgttggatatgctcgccaagatcaaggtcttaaagctttagatatttttcagtctttacagaggaataatcttggctttgacgaaattagtttgtctggtgctttgactgcttgttcagtgatcaaacgccatttggaggggatccagctacatggactagctgtcaaatgcggtttagggtttaatatttgtgttgcaaatacaattttagacatgtatggaaaatgtggagctctgatggaagcttgtttaatatttgaggagatggaaagaagggatgctgtgtcttggaatgcgatcatagcagctcatgagcaaaatgaagaaatagtgaaaacactttcactctttgtttcaatgttgcgatcaacaatggaacctgatgattttacttatggcagtgttgtaaaggcatgtgctggtcaacaagccttaaactatggtacggagatccacggaagaattattaagtctgggatggggctagactggtttgttggcagtgcccttgtagatatgtatggcaagtgtgggatgctaatggaggcagaaaagatccatgccagactggaagagaaaacaactgtttcctggaattcaatcatttcgggattctcatcacaaaagcaaagtgaaaatgctcagaggtatttttcgcagatgctggaaatgggcataatacctgacaactacacatatgctacagttcttgatgtttgtgcaaatatggctaccatagaacttggaaagcagattcatgctcaaattttaaagctacagctgcattcagatgtgtatattgccagcacacttgtagatatgtattcaaagtgtggaaatatgcaggattccaggctaatgtttgagaaggcaccaaagcgggattatgtgacttggagtgccatgatttgtgcatatgcataccatggtcttggagaaaaagccattaatttatttgaggagatgcagcttttaaatgtgaaaccaaatcatacaatttttatttcagtcctcagagcttgtgcacatatgggttatgtggacaaagggctccattacttccagaaaatgctaagtcactatggtttagatccccaaatggagcattattcgtgtatggtagatctattagggaggtcaggccaagtaaatgaagctttgaagcttattgaaagcatgccttttgaagctgatgatgtaatatggagaactttgctcagtaattgcaagatgcaagggaatgtagaagttgcagaaaaggcattcaattctttattgcagttggaccctcaagattcttctgcttacgttcttttagcaaacgtatatgctatcgtagggatgtggggtgaggtcgcaaaaatgagaagtataatgaagaactgtaagttaaagaaggagccaggttgtagctggattgaggtcagagatgaggtacacacatttcttgttggagacaaggcacatccaagatctgaagagatatatgagcaaactcatttgcttgtggatgagatgaagtgggctggatatgttccagatattgatttcatgcttgatgaggagatggaagaacaagatccatatgaggggctcaaaactaccgtttgtagtgagagaccctcaacatggctctggctggcaatagtggacctcaccgagagttttgggggaggttatcgagcaatctga

SEQ ID NO: 32386 - DNA, 1095 bp, Glycine max
  Peptide Sequence Number=SeqID_149164
atgatgaacacgtatattccaagagagttaaccgaaaaaattctaattaagttgcctgtgaagtctcttgtaagcttcaagtgtgtgagaaaagagtggaataatctgatttctgaccctgaattcgcagagagacatttcaagtatgggcaacgggcagagacattgatgatcacaacacctgatgttaaccacttcaaaagcattaaccccatcaaatccttacatgatgaatcttcctaccaatcattgtcccttagttttttgggccatcgtcatcctaaaccttgtgttcaaatcaaaggttcctgcagagattttcttcttctggaatcctgtcgttctctttatctgtggaatccatccacaggtcaaaacaaaatgatacaatggtcttccaatgtctccttcattacccctggcgattccttcttgttctgtcatggtcttggatatgatccaagaacaaaagattacatggtggttgtaatctcctttgccgaatatgactctccaagccacatggagtgtttctcagttaaagagaatgcatggatacatattccacttgctgcagatttgcattacaaatcatgcaatctctggaatggccgcaacttaactgggacattttttaacaatgccctccattggcttgtttataagtatgaggcatacatgcatgttgttcttgcctttgatttggtaggaagaactttttcagagatacatgtgccgaatgagtttgaattttattgcctacctcatgctttgaatgtatttggagaatcactgtgtctatgtgttatgagggagatggagcaggttgaaacttcaattcaaatatgggaattgaaacaatacacagaccacacatcttggacaaagacgaatactttgattatcaatgacatttggtctggttcagccttaccagtatgcaatgctgaaaatggttgtattgttggaagtgatcctgctggcgtattggtcaaatggaatcaagatggagaggtggaagaacaaagatcatttgattatattcgtgatggataccaagtgactgcgtatagagagactctttttacaatttag

SEQ ID NO: 32387 - DNA, 2628 bp, Glycine max
  Peptide Sequence Number=SeqID_149165
atggcgtcaaccccaactccccgaccccacttttcctccgtcccccctagaccctcctccaacaacaaccagcgccgctaccatagccaaaacaggagccatcaccgccgcaacaacaaccagaatcggtggtcttcttcttccaccaggtactattcctcacctgcatcaagtgcaggtgcaggtattccctctgcagctgccactgcctcagctgcatttttatcttccctgagtccgtggcttggtgcccagaaaaccaggctcgctcccgagttttccggccggccgtccaaccggaacccggggaagatgaactccggcggcccgagggctgtccccaacaatcagcagcactcgaaggcggccgaggaggttttgcatagcctcaccaatgctggtaatgatgttgctgccatagataatgtgttgcttaattataggctttatgttgctgaggattatgtttatttgcttaaggagtttgccaatactggtgacctattgctagctactaggacctataattttgccatgagtagggcaaccgataatactttcatggggaagttgaccagcaacatgattaggacccttggcaggctaaagaagattgagcttgccttgaatttgtttgaagagtctaggaatagagggtatggaaacactgtttattccttttctgctatgattagtgcacttggtaggaacgattgcttttcggaggcagtgagtttgttgaggagcatgggaaattttggcttggaacccaatttggttacctacaatgccattattgatgcaggggctaaaggggaacttccctttgaaatagttgttaagtttttggaggagatgatagctgctggctgtttgccagatcggcttacttacaattcacttctcaaaacttgtgtcgcgaagggtaggtggcaactgtgtagggatttgttagctgaaatggaatggaaggggattggtcgtgatgtgtatacttataatacatatgtggatgcgttgtgtaaaggtggacggatggatcttgccaggcatgctattgatgtggagatgcctgctaagaacattttgcccaatgtggtgacttatagtactttgatggctggatattctaaggctgagcgctttgaagatgccctaaatatatatgatgaaatgaagcacctgctgattaggctggacagggtgtcttacaatacactggttggactatatgcaaatcttggttggtttgaggaggcagttggtaaattcaaagagatggagtgttgtgggataaaaaatgacgtagtaacttataatgcactgatcgagggatatggaagacataacaagtatgttgaggtccgaaaattatttgatgagatgaaagcaagacgcatttatcctaatgatctaacttactcaacattgattaaaatatacactaaaggtagaatgtatgctgaggcgatggatgtttatagagagctcaagcaggaaggcatgaagacagacgttgtattttacagtgctctaattgatgctttatgcaaaaatggtttgattgaatcttctctgaggctgctggatgtgatgacggagaaaggaagtaggccaaatgttgtgacttacaactccattattgatgcattcagaataggacagcagctgccagctctggaatgtgctgttgatacttcttttcaagccaatgaacatcaaattaaaccttcatcttctaggcttagtgctggtaactttcaagatcagaagactgggaacaatgatgaaatcatgaagatgttggagcaacttgctgctgaaaaagcaggtcttatgaagaaggataagaggagcaggcaagacagtttctacttagtgcagatctttcaaaaaatgcaagaaatggaaatcaaaccaaatgttgtcacattttcagccatcttgaatgcttgcagttgttgtgagacatttcaagatgcttcaaagctgttagacgcactctgcatgtttgatagtcatgtctatggtgtagctcatgggctacttatgggtcacgggcaaggcttatggaatcaggctcagacactatttgatgaactcgagcacttggattcttcaacagcatctgcattttataatgctctgactgatatgttgtggcattttggtcagaaactaggggctcaaacggttgtgattgaagggagaaaccgaaatgtgtggaaagggggctggtctactgaatgcttggatctacatctaacgtcctgtggagcagcctgtgcaatggtgcatacatggttgctcgaattgcgtaccactgtttttggaggccagaagccacctccaatattgagtatattaactggatggggcaagcatagcaaagtagttggcaatggcactttaagaaaggcagtagaggcactcctaaatggcattggtgcaccctttcagatttctgagtgtaatttggggaggtttaaatcagaaggacctgaagtgactgcttggttgagacaacctagcacattgaatgtgctgcttctccatgattgcattgtttattctcaaccagttgagagaaaccaaacatttaatataccatctcttggagcacagtag

SEQ ID NO: 32388 - DNA, 1677 bp, Glycine max
  Peptide Sequence Number=SeqID_149166
atgtcttattttagacccaccacgccaaatgcctccaaaaccaactttgatgagtttcggtgggtgattcaaatacgtgaaactcttaatgaagggcatgaagatgatgatcaattcccagtgtccatcttcaatgtgcctaagccccttatggctactgatccagattcttatatccctcaacaagttgctataggtccttatcattattggagtcaagaactctatgagatggagagatataaaattgcatcagcaaaaagattccaagaacaactacaaagcctcaagttagaacacatggttgaccaattgataaggttagaacataggataagagcatgctaccacaggtacttaaattttaatggcgaaacattgatgtggatgatggcaattgatgcctcatttttgcttgaattccttcaagtttataccattcatgatggagcaatgataccaggagtttcatcaagaatgtctcacttgatggattatgcagggagaagaattgctcacaatgaaatcttgaaggacatagtaatgcttgaaaaccaacttccactatttgtgttgagaaagatgttagagttcaaattctcatcactagaattagcagatgacatgctactttcaatgttactaggattgcttaaagaattttctcctttcaaggtgatagagaaggactgtccagaggtcattgtctcagagtgtgcacatttgctagattttttgtatgccatgattgtgcctaaattggaagaacaaacagatctagtacaattggaggatcaacacagagataaggaggacagtgaaaaatcaattgtgaaccatgtcaagcaatttctcggtgaggtttggagggtactttcaaaattggctacagcattaataagcttaattaacaaagtcctacaatgtagagccatgaaaattatcactctgttgccttggacagtcatttctaaccttcctggagtaggacttataaaacaacctgttgaatacttatttttctctcaggataaagaagcaaccgaagaagaaaatgggaatttgagctcagagaatgtcatgaacaaaccacccttaatggaggaaattgccattccttcagtcacagaactctcaaagtccggggtttgtttcatggccaccaatggagacatatcaactattggatttgacgtaaaaacagtaacactgtaccttccaacaattggtttagacttaaacagtgaagtgttgttgagaaacttagttgcttatgaagcgtcaactgcatcagggtcattggttttcacccgttacactgaactgatgaatgggattatagactctgaggaggatgcaaagattcttagagaaaaaggggttattttgaaccggttgaagagtgatgaagaggtggctaacttgtggaatgggatgagcaagtccattaaattgacaagggtgccattcttggataaagtcattgaagatgttaaccagcattacaatggcaggatgaatatcaaagtgtggaaattcataaagctttatgtatttgcttcatggaaatttctgacattctttgctgccatcttcctcttgttcttgatgtccttgcaagtgttctgctctttctataaatgcaatcgcagaagtcaagtcagtgtgactaaatga

SEQ ID NO: 32389 - DNA, 2169 bp, Glycine max
  Peptide Sequence Number=SeqID_149167
atgacgaactccatgggtcccccaccccccaaaaaccctaatccacctgacaccgcgccaccgtcaatgcctcctcctcctcctcgtgactcagcggaaccgtcaccgccgccgccaccgccaccagctcgcgattcgagcaatgctccctctcagggtgtggcagttccgtataagattcctccgtggggcgccgctccttgccatcaattctaccttgaagttctgaaggacggttccatcatcgacaaattcgacgtgttcgagaaaggagcttacatgttcggccgattggatctctgcgacttcgtgctcgagcaccccactatttctaggtttcatgctgttgtacagtttaagagaagtggagatgcatatctctatgatcttgggagtactcatggaacctttttgaacaaaaatcaggtggagaaaaacacatatgttgacttgcatgttggtgatgtcattcgatttggccggtcatctcgcttgttcatttttcaaggaccgtctgacttgatgcctcctgaaactaatgcaaaacttatgagagaagtgaagatgcgtgaagcaatgctagataaggaagcttcagtccgaagagcaaggcaggaagcatctcttgctgagggtatttcttggggcatgggtgaggatgctattgaagaagatgaggatgatgttgaagaagtgacatggcagtcatacaaaggacaacttacagaaaaacaggaaaaaacccgtgagaaaataataaaaagaatggaaaagattgctaacatgaagaaagaaataaattctatacgagttaaagacatttctcagggtggattaactcaaggtcaacagactcagattgctaggaatgagcaaagaataatgcagatattggaagaacttgaaaacctggaagagacactgaatgatagtattcgagagagtatgggtgcacgtacaggaaagctgtcccatgggaagaaaaaaggtgcagtggaagacgaagaagaatatttgagtgatgatgatgatgatgaattttatgaccggacaaataaaaagcctttacatcagaaacctggtgacaatcaagttgagactgcagatactcttcttgacaagagagaggtcatcaccaaggaaatggatgagaagaaagagttgcttatgatggaaaagaacaaaatattgtcgaagtcagagagtaccacacaagatgaagttgatgactcacttgatgcatacatgtcagggctttcatctcaactagtgcatgataaaagtgagcaacttgaaaaggaattgtcaacgcttcagtccgagctggataggatatgctacctgttgaagattgctgacccaacaggagaagctgccaagaaaagggagttgaaagtacacgaacccaaaccaaaaaaatctgaagaagtaattattaccatcaagaagaaaccacctgcagaagcacagaaaagcagtgagccttgtgtgaaagcagataacaagaatccacctgtggaaacccagaaaatcagtgagacccctgtcaaggaagatggctctatagaaggggaaaaggctggagcttcaactttgggtttagacaagtcggaacctgactctgacaggttgaaggctgaaaatgttgtatttgctgtaccaaagccccaatggcttggagctgtagaggatagggttatagatgatacccaacagttgctgccctctctgcatctgcatgagatagacgagtccaatcagtttgtggactataaggacaggagcaaaattttgggcagtggagacaatgcaaatacttcagtggaatctaaaattgagtctgctgctggtttaataataaggaaacggaagcaagttgagacaactgcaacaaatagtaatgatgcctctcaacaattgacatcttccacttcaggtgaaaaaatggctgaggatgctgtggcactattattaaagcataataagggactgtatactaatgatgatgaggaaagatatgaaggccaagagaggagggggcctaaaagagtgcttgggcccgagaaaccatccttcttgaataatgagatggattatgactcatgggttcctcctgaaggacaatcaggtgatggacgcacttccttgaatgatagatatggctactaa

SEQ ID NO: 32390 - DNA, 1104 bp, Glycine max
  Peptide Sequence Number=SeqID_149168
atgatgaacacgtatattccaagagagttaactgaagaaattctgatgaagttgcctgtgaagtctcttgtaagcttcaagtgtgtgagaaaagagtggaataatctgatttctgaccctgaattcgcagagagacatttcaagtatgggcaacggacagagaaattgatgatcacaacatctgatgttaaccacttcaaaagcattaaccccatcaaatccttacatgatgaatcttcctgccaatcattgtcccttagttttttgggccatcgtcatcctaaaccttgtgttcaaataaaaggttcttgcagaggttttcttcttctggaatcctgtcgtactctttatctgtggaatccatccacaggtcaaaacaaaatgatacaatggtcttccaatgtctccttcattacccgtggcgattccttattgttctgtcatggtcttggatatgatccaagaacaaaagattacgtggtggttgtaatctcctttgccgaatatgactctccaagccacatggagtgtttctcagttaaagagaatgcatggatacatattcaacttgctgcagatttgcattacaaatcatgcaagttttggactggccgcaacaacttaactgggacattttttaacaatgccctccactggtttgtttataattatgaggcatacatgcatgttgttcttgcctttgatttggtaggaagaactttttcagagatacatgtgccgaacgagtttgaatataaaatgtattgccaacctcatgctttgaatgtagttggagaatcactgtgtctatgtgttacgagggagatggggcaggttgaagcttcaattcaaatatgggaattgaaacaatacacagaccacacatcttggacaaagacgaatactttgattatcaatgacatttggtttggtttattcttaccaatatgcaatgctgaaaatggttgtattgttggaagtgatcatgctggcgtattggtcaaatggaatcaagatggagaggtggaagaacaaagatcatttgattatattcctgatggataccaagtgactgcgtatagagagactctttttacaatttag

SEQ ID NO: 32391 - DNA, 2292 bp, Glycine max
  Peptide Sequence Number=SeqID_149169
atgccccttttgttgagtttcccgtttcagttccacacttgtcttcacaagctttgttattgtccctttcttagtgcccctactcgtgccaatgcttatgtgtgcacacgtgataactaccttggcattgttttcttgtcacaatcgaaatactcaattgggtcaacagggtttcatgagtccactccactgtccaaggacacggttcctactgttgttgactttgatctgtgtgaagaagaagaagaagaatgtaatgatgatgttgtgtttgaaggaagtgaaacggttgataccaccccttttgtgtccaagaaggaaatgcctccttggggagaagtagaagtggaagatgatgatgatgatgatgatattgatgtaagagaagaatttggtacatctttagtttccaaggagaaatttcctctttggggagaagtagaactggaagatgatgatgatgatattgaaggaacagaagaatttcgtacatctttagtgtccaaggaggaattgcattcttggggagaagtagaactggaagatgatgacgatgatagaagagtagaaggtgtcaaagcatgctttgtgtccaagaaggaatttcctccttcgggaggagcagaagaaattattgatggtgttgatgacgatggtgaggacaatattgaaagaagagcaaacggggattcatattttgtgaccaagaaggaattgcctgcattgggagaagtggaagatgatgatgatcatgacgattttgacaacagtgttgaaagaagagcaaatggggatgtatattttggggccaagaaggaattgcctccctggggaggagtggaagatgatggacaccatgattctagacctgttgaaactacttcatcagctccacaggggataggactactgaatgagcatggggtgctttttcttgaggagttggatgagaatgtgctgtctaataggattttggtgcttagcagaactaacaagattagaagtgcaatggagtattttaggtctatggaattatcgggtctttctccaaatatccatgcttgtaattctcttatttctagccttttgagaaatgggtggtttgataattgcatcaaagtgttcaattttacaagagcaaaagggataactacagggcatacatatagcttgattcttatggcacatgcaaaggcacatggttgtgattctgcccttggattattcagagaactagagagtgaatgtgatgtggagaaggattttgatgcaattgtttacaacaccatgatatctatctgcagagatgttgacaattggagtgaaatagagaggttgtggaggagtatgaaagcaaatggatgtgctggaactcatgtcacgtatcacctattaatcaatagttttgtacgatttgaccaaagtgatcttgctctttatgcttaccgtgaaatggttcaaaatggatatgaaccagacaacaatacattgaatgttatcattagtgtatgtgctaaggagggaaaatgggatgctgcattaagtgtctttaacaaaatgttgaaggttgagcttaagccaaacttagttgcatgcaatgcattaattaactcacttggaagagcaggggaactcaagcaagtatttcaggtctacaacacaatgaaatctttagaccttaaaccagatgcatatacattcaatgctctattaagttctcttaacaaggctgataggcatcacaaagctcttgagctttttgagatgattgaaagagatcaaacatctcaattcaatgtacatttatacaatactgttttaatgtcttgctcaaagcttaggttgtgggatagggctatagaaattctgtggcagatggaggcttctggactgtctgatttgacaatgtcatataatcttgtcatcaggacctgtgagcttgcaaggaagccaacaattgcactgcaggtgtacaagcacatggttcaccagaagtgcagtccagacatatttacttatctatccgtgattagatgctgtgttcgtggagatctctgggaagagttagaagaaatcttaaataagccactcacagcaacatttgctaaccatgctgagtattatcagaccatgccaaatgccactctttataacgcagctgttcaagggctgtgcttacgtaaaaatggtgacatggcaaataagatctacacaaaaatgctagaaagtggttttcaacctgatgtcaaaacgcaagtacttatgcttcgtatgataaggaaaaggaggtag

SEQ ID NO: 32392 - DNA, 1386 bp, Glycine max
  Peptide Sequence Number=SeqID_149170
atggattacgtcaaatacagcttttgtttaatgcttaaagctttggcagccgatggaaatttcattggcattgtcaacgccttcccctactataagtacaatcacactccttgtctctccctcacaacactaggccttcaatttgggaacaagaccttcatagcctcagtggcttcccctgtggtccctactgacaccacagcaaatttcgctttgccagttgattctgagcacaagtcgaaagttttcaagctgttttccatggcaaaccctcacatgagaaccttccacttgtcctggatatcgttcttcacatgtttcgtctcgaccttcgcggcggcaccccttgtccccatcattagggacaacctcaacctcaccaaaagcgacatcgggaatgccggggttgcttcagtctccggcagcctcttctccaggctcacaatgggtgcggtatgtgacctacttgggcctcgctatggctgtgccttccttatcacgctttctgcaccaaccgtgttctgcatgtcttttgtgaatgatgctgctggttacataacagtgagggcttgtgaagggactgctgcagggtgggggaacatgggtggtggggccactcagctcataatgcctttggtttatgagttgattagaagggctggggctactcccttcactgcttggaggattgccttcttcatcccaggttggatgcctgtggtcatggggatcatggtcctaaccctaggcctagatttacctgatggcaaccttggtgccttgcagaagaagggtaatgttgccaaagacaaattctccaaggttagactctttcttctctatatgtttgaggacacaatcaatatatatgttgaattacttgagatgacatggatttttgccctcctctgtgggtactctatgggagttgaattaaccactgacaatgtcattgctgagtatttctatgacaggctttggaacctatggatcctccaaaccttaggaggggctttctgcatatggcttggacgtgccaattcccttcccattgcagtcttgcccatgatcctcttctctattggtgctcaagctgcatgtggtgcaacttctggcatcattcccttcatctcaagacgttctcttgggatcatatcaggcctaactggtgcaggtggaaactttgggtctggtttgacccaattggtcttcttctcaacctcaaagttttctacttccactggtctctcccttatgggtatcatgattgtgtgttgcactcttcctgtgactcttgttcacttccctcagtggggtagcatgttcctccctccttcaaaggatatcaacatgtccactgaggaatactattacaccgctgagtga

SEQ ID NO: 32393 - DNA, 537 bp, Glycine max
  Peptide Sequence Number=SeqID_149171
atggctgatcaagtttggcattgtcatgtttgcaaatgttgcctccttagattaaccaataaacttgcatcaagtttatatgcattaaagaccaagctactctttcttcaggtatattggaatctcacttgggttctaattgatgcattcacaccattagcggctgggctccaattctccaagatgagcaattctcactctgaaaatcatgatgaagctactgtggtgggatttgaagttccaaaatctcctgattccagttacaataatgtctaccctggaaatgaagatgaggcaagggatccacctatggtcccttcacatttgcaacacactttgctcaattatcctgctaatagagacactgcaggaactgttccattgcctaagaatgtgattctaaatcatctttacatcgagaatagagagtcaccaagatctgtggtggcgttgggattcactcatcgtttccgctctaaatatgttacggtcgtgctttacaaaccagtccaaagaaggggaaatacaagcatttag

SEQ ID NO: 32394 - DNA, 333 bp, Glycine max
  Peptide Sequence Number=SeqID_149172
atggcagtagctgtaactgttgttggtgcagcagctactcttcttgtaaagagatccaaaacttctgagtcaacacagattcaattcaaagtatgtgaagattgtggaggttctggtatatgttctgaatgcaaaggtgaaggattcgttcttaggaaacgttctgatgaaagtgctgagaaggcaagagtgcaagctaagaatatggccacccgattcacggcaggccattcaactcaattacttgtaccaggcttccaaagaagtggagctattgcacaaagtgctcttctggtcgatcctgttcaacctgtggtggcagtggaaagctaa

SEQ ID NO: 32395 - DNA, 123 bp, Glycine max
  Peptide Sequence Number=SeqID_149173
atgtcgtgcttagagcgatgcgttgaagctgcgcttagcggtggatgcacgctaagcccccagggtctgcttagcgtgactgctccttatagcacttcaagatttcagcctcttttgacctga

SEQ ID NO: 32396 - DNA, 129 bp, Glycine max
  Peptide Sequence Number=SeqID_149174
atgaagagagtggagacatggaatgaaagcgtcgccgcctttaagagagaaaatggtgttctgggaatgaaggatgcagtagtgcccacgacggctcaaaaaccctcgtcagtgactggggaaatataa

SEQ ID NO: 32397 - DNA, 2940 bp, Glycine max
  Peptide Sequence Number=SeqID_149175
atgtggcggcacgccgccaaacacgtctgccgcggtattattcgccaaaacttccaccctccaaggcttctcgctctctcccacggctccgttttctcccccaaaagggaggttttgctgtccagcgtggcaaaactaaactgtattgcccgtggcgatttccagtttcagtttggcgccaaagggtattccggtgttgccgaggcggtttcttccactgatgtggaggaagatggtggtactgctgttgatgaaattcagcaacttttatggcaggagatgaatgacgaagtggagagtcaactgggggaggaagagggtgccccaattgatgaaattcagcaactgttattgcaggagatgaatgaagaagagaagaatgaattggtggaggaagaggctgccccagttgatggaattcaagagctattgcaggggatgaagaaagagaagcagaagaaggtggttgggtataggtggaagaatcaggggaagggtgtggggcagtctaggtaccaggagctgagaaggaggcaggttaagattgagactgagatgtgggaagaggcggcgaaggagtatagggagcttttgatggacatgtgtgagcataagctggcacccaatttgccatacatgaagtcgctctttctcggctggtttgagcctctgagggatgccattgtcaaggaacaggagatgtatagtgaagggaagaataggatggcctatgcgccatactttgttcagttgccggctgacaagatggctgttatcgcaatgcataagttgatggggctgttgatgacaggaaacgaacgtgtcaccattggcactgccagggttgtgcaggctgcgtgcggcataggcgatgccattgaaaatgagaaaaaaaatataattatgttcgaatgttttttggaggcaggtatgaaatcgaagatggggagtacactactagctactcaaactgattcgtatctcctcaagtcacatacgcatattgatatgtatacaattaaagttagaatacacaagttcttggagaaaactaagaagaaaaagggtgatagaagcaacaaaaataaagcaggtgagtctgttgctgacatcaaagaggaacaaaagctacggaaaaaagtcattgatttgatgaaaaagcaaaagctagttgcagtgagggggctagtgaagggcaaggatgatacaaaaccgtggggagcagtcataaagacaaaggtaggaagccgtttaattgagctcttgttgcaaacagcatatatacaaccaccatcagatcaattaccggatgctgcacctgatatccgacctgcatttgttcattcatttaaaacagtgacaaaagagtcaattaaagcaagcagaagatatggtattattcaatgtgaccctctaattcttaaaggacttgaaagaaccgccaaaaatatggtcattccttatatgcctatgttggttccaccggtcaactggacaggttatgacaaaggtggacacttgttcttaccctcttatgtcatgcgtactcatggagtcaggcaacagcgtgaagctgttaagagggcccctaggaagcaactagagcctgtatttgaggctctggatactctcgggcatacgaaatggagggtaaataagaaggtactgagtgttgtagacaggatatgggctagtggaggccgtattgctgatttggtggaccgcgatgatgttcctttacctgacgagccagatactgatgatgaagcgaagataaagaaatggaagtggaaatacaaatctctgcagaaagagaacagagagagatattcacaacgttgtgacatagaacttaaacttgctgtagcgcgaaaaatgaaggatgaagagggtttttactacccacacaaccttgatttccgagggcgtgcatatcccatgcacccacacttaaatcaccttggttcagatttatgccggggtatattggaatttgcagagggacgctctcttggaaagtcgggcctacgttggctgaagatacacttggcaaatctatatgctggtggtgttgataaactatcatatgaaggtcgcttagcgttcactgaaaatcattttgaagacatatttgattctgcagacaaacctcttgaagggaggcggtggtggttgaaagcagaagatccattgcagtgcttagctgtgtgcataactctaactgaagctttaagaagttcttcaccagaaacattcatctcacatattccagtacatcaggatggctcctgtaatggcttacaacattatgctgccttggggagagacaagttaggggctgctgctgtcaatctagttacaggagagaagccagcagatgtttactcaggaatagcagctagagtatcaaacatcatgcaaagggatgctcagaaagatcctgcagtttttcgtgatgctcttcatgcaaggactttagttaatcaggtggatagaaaattggttaagcagacagtgatgacatcagtgtatggtgtcacttatattggtgcacgggagcagataaaaaggagattgaaagaaaggaatgccatttcagatgataaagagctctttggtgcttcttgttatgctgcaaaggtcaccttaactgccttagaggagatgtttcaaggtgcacgaggtatcatgagctggcttggtgactgtgcaaaagtaattgcttctgaaaatcaaccagtgcgctggaccactcctcttggacttcctgtggtgcaaccttaccgtaaactaggaaagcatattatcaaaacttcacttcaaattttgacattgcagcgagaaacagataaggcaacacctgccagtatattgcctgcacagcaattttgtcttgcaggctggtgtggttttatatgcaagatgcgtgagtatgtctga

SEQ ID NO: 32398 - DNA, 327 bp, Glycine max
  Peptide Sequence Number=SeqID_149176
atgggtgatttcgcgaagattttcaaccgttcttcgacgttcttcgttcattcttcggtcttcaaccggctgccgtctcttatgacggacgcgtggggtgctaataccttccctgtgcgtaaatacaattcccgaacctttcactttaaagttcgtagatcacttcttttccggtttttccgacgttttcctcaaataaacgttggtggcgactccgcgcgtattcctttcttggaacacgcacccgcgagtcacgcgtcgccctcccgccgaagggtaggttgcgacagttggcgactccactggggactattttttgagagttag

SEQ ID NO: 32399 - DNA, 426 bp, Glycine max
  Peptide Sequence Number=SeqID_149177
atgacccatcctattcttaccatagcattagctgccaccgtcaagtcccatatgtgtcgagggtatccttggtttaaaactagacacttattttttaaggcatggaagttcatttatgatcattttggtagcgtagaagagaatgagggaaaaggaaaaacaagagaagtaaaggaattttggaatttgtgtagtgatgatagtgatgacactaacaaaaatgtgatggcgatgctaattgataagggtgctagtgatagtgttaatgatagtagtagtagtggtaacagtgttggtggtggtgacggctgcagtggtatcgtcaatggtggttgctggagtacaagtgtgagatcaaatttcacatctgataagaatgaaaaggttgagtatcgtataaatgagaataagacttataaaccttag

SEQ ID NO: 32400 - DNA, 3003 bp, Glycine max
  Peptide Sequence Number=SeqID_149178
atggctacaaattccaactttgagcaagtaaccattccacgatttgatgccagaaaaggcacaagtttgacagaacctcagaaagcagacttggaggctagaaggctgaaggatctaaaggcaaaaaattatctcttcgaggccatcgatcgccccatcttagaaactattctttgcaaagaaactttcaaggacatttgggattctatgaagaaaaagtatcaaggttctgctagagtgaagcgtgcacagcttcaagccttaagaagagattttgagacattagcaatgaaggatgatgtcaccattgtagaaaagattttgcgatccctaacaccaacgtttgattatgttgtttgtgcaattgaagagtccaaagatatagatgcaccctcccttgatgaattgcaaagttctttgttagtacatgagcagaagatgaaccgaagttcaaatttgacagcagaagagcaagctttgaaggcttctaccaacactcattccacaggtagaggaaggggtagaggtagaggcagaggaaggggtcaaggccgaggcagaagcaactatagaggaaatcagcagcaacaacaagaaaaagaaagaggaagatggagccatcagacaagtttaacattgaatgttttagatgtgatcgaagaagaaaaagaagaagtgtgcctcctaacctcttgtcaagaagaaaaagaatcaagtaaaagtttgtggtacttagacacagcttgcaacaatcatatgagtggggacaagtcaatattcattaacttggatgtgacgtatcgtgataaagtaaaacttggtgacgaatccagaattttaattatgggaaaaggagaggtaacaatcctaaacaaagataacactaaagagactatcttcaatgttttctttgtcccagatttgaaaacgaatattctaagtgttggtcagctactggaaaatggatatgagttgttcttcaaagatggagcatgcaaaaatcaagattcaaagtcgattctaattgctgaagccacaaagacaggaaatcgaatgtttcctctttatcttcatatcactaaccacacatgtttttcagtgaaattgaaggatgacgcctggctatggcattttcaatatgggcatttgaattttggtggattaagaacactccaacagaaaaacatggtcacagatcttcctaaaattacacctctctcagaaatttgtgaagaatgtgttgtaggcaaacaacatagtagtcaatttccaaaagggaaatcatggagagcaaaggatgttttagagctggtgtattcagatatatatggtcaaaacaaatcagaagcttcctctactttcaaaagcttcaaagcttgtgtagaaaatgaagcaagaaagaccattcagactcttcgaactgatcatggtggcgaatattgctcaaaagaatttgatgtgtattgtgaacatcatggcattcgaagagagcttacaacaacatatacactacaacaaaatggtgtatcggagaggaaaaatagaactatccttaacatggcttggagtgggagacaaccatctgtggatcatttaaaattttttgggtgcatcgcctatgctcatatcccggatgagaagaggaaaaagcttgatgacaaagctgaaaaatgtgtctttgtaggtgtaaatgaaacatcaaaacaacccaattcaattattgtcgacaatgaagatgtaaaagaattgcagctacccgtaaacactgtcttaacatctccaaatgcatctcaaatagctcctgagacagagatttcaacaacaacaaatgttggaacaatagacgcaacaattgtagctcaatctaaatgtcttcgaaggaggccagcatggatgtcagattataagctgattgatcttcctaaaggacacaaaaccattggcgtaaagtgggtcttcaaaacaaagcttaaagaaaatggtgaagttgacaagtataaggtgcacttggtggccaagggatacaagcaagaatacgagatatcaaatctgcattcttgcatggatacttggaggaacaagtatttgttgaacaaccttggctatatcaagattggacatgaacataaagtgtacagattgaaaaaggcactcgatggacttaaacaagccccaagggcttggtatactcgcattgaggcttattttatgaaaactgaattcaagaaatctatgatggatgagtttgaaatgtccagtgttatgcattactttcttggcatagaggtggtgaatgcaagtgatgggatctttatttctcaaaagaagtacattggagaaattttggataagtttcagatgaaggattgcaaccctacaaacactccaactgagtttgtcttgaaattaaataaagatcatgaagggaaaaaggtggacaacactctctacaaacaaattgtaggcagtttgatgtatctaactgcaacaagactagacataatgaaaggtggaaaatcaattctatttggatttattgacaatgattatgcaggagatcaagatgatagaaagagtacttcatggtatgtctttatgtttggcacaggtgctatttcatggtcatctaaaaatcaatcaattgtgactttgtcaagtacaaaagctgaatttgttgctacaacaacctgtgcttgtcaagctatttggctaaggagaatacttgaggagctgaaattaaaacaacgagaagctactacaattgtttgtgataacagctcaataattaagctttccaagaacccagtgctacatggaagaagcaaacacattgatgtgaggttttattttctaagagatctcactaatgaaggagtaattgacttgaagttctgcataagtgatgagcaattggctgatacgtttacaaaatctctcaaggtttcagtttttcaaaacttaaggaggttaataggagtatgcactttgggtgatccaatttga

SEQ ID NO: 32401 - DNA, 438 bp, Glycine max
  Peptide Sequence Number=SeqID_149179
atgaaaaaaccaaaaactgttgttgggggatacacacatgagcatggcacagccaaaaccttgagacatgatctgatctgtgcatttaaaccaagagaggtggtgacctttcccactttgctttttgttggtgtcagagacaatcctaggttatcaagtatatataggctattttggaggccgagaggagcggccgttttggccctttatgtgctgactacttcacagatctatgatgaatattccttttcaacagagagatgctgggatctaaatgtagtggatattgtttccgagttggtttgcatttcagaaactgtgcagattattgagaatggaaagtggcctgggaacatggatatacatgaacacagacatataatggacatggtgaaggctttggctttagtaggactagtcacccatagctcgggttag

SEQ ID NO: 32402 - DNA, 768 bp, Glycine max
  Peptide Sequence Number=SeqID_149180
atgggcaaagcaaatggttgtgcaatagtgctgactttatggggagaaaaggatggggggctacacattattactggcattaacagccccaaagaaagcaagtgtttaaatgataaactatacgatcagaagcaaagttcaaagtccttttggaactttaagagaagtagtagttgtggaactggacctagaaggagtttttgtcctttgccacttctatctagaagcaattcaactggatcatcaacaccaagtgttaagaggaatccactttcaaaggagggtgttaacaacattaaacacaaacattcttccacaaggttgcctcatcactcctttgtaccaaacaactatcatcatcatcaaaagcctccattgaattacaagactcatcatggatcttatggtaccagtgtaagagtcaatcctgtcctaaatattcctcctgcaaagctatttgctccagaagttatagaagatcaagttgaggggcttgggatgcacactgatatgagttgtattactatcttatatcaagatgagatagaagggcttcaagtcagatcaaatgagggagagtggatagatataaacccatctgaaggaaccctagtggtgaacataggtgatatgttgcaagcttggagcaatgacttccacgcttttgttatgccccaggttgcaagcacaacattgaccacccaagagcaaggcctctcaaggatttcagaactcttcaaacacattacaagaggaagcatggcataa

SEQ ID NO: 32403 - DNA, 300 bp, Glycine max
  Peptide Sequence Number=SeqID_149181
atgtcaatcaatgatgaaaaattgaaggagctaatttttgagtttggaacaataacatgttgcaaggtggtgcttgaatcaaatgggcatagcaagggctatggttttgttgccttttctcctgttgaggatgcaagtacaattacacctttgcctgttggaatccctggatatcatccagggacaccaagacttgcccctccttggttgtattttggtcaaggggcacctggtctcgtaccacctcagccagcaggatatggttttccagcagcacctcttccaagacatgcgtcctag

SEQ ID NO: 32404 - DNA, 585 bp, Glycine max
  Peptide Sequence Number=SeqID_149182
atgcgcgctaaagaagcgggcctgcgcactcacattctggtcggcattggcagcgccatgttcatgctggtgtcaaaatatggctttgccgatatgctgactaacgatcatgtggcgctggatcccagccgtattgcggcgcaggtggtcagcggcatgggcttccttggcgccggtaccatcatcatacaaaagcagattgtgaaaggcctgacaaccgccgccggcctgtgggtgaccgccgcgattggtctggtgatcggtagcggtatgtacgaaatcggtatttacggtacggtgctggcgctggtggtgctggaaacgttccgccgtatcagccactggctgattggccgccatcacactcttatcgtccatctcaaagccaaaagcgtaccgctggtgttgctggtactgcagcgcgaaaatttgcgctatggccacatcgctgtggtcaatcgtaacgaagagagcgggctgtgcgagctgagcgttgaggtgacgttgtcacgcagatttcctatgcacagcatttatgacaaagtgatggaaatcaaaggcgtgcagtcgctggaaatgttttga

SEQ ID NO: 32405 - DNA, 735 bp, Glycine max
  Peptide Sequence Number=SeqID_149183
atggatatggagctcatggcattgcaaaactataatactaggtccctaatgtcactcccagttggtaagaagcctgttggttcaaaatgggtgtacaaaattaagcgtcgtgcagatggcagtatcgaacgctataaagctcgccttgttgccaaggaaaatgtgaaacgggcaaagcaaaagaacaaacaggtcaaactacttccggtcaacaagagagaagagaaaaagaaaaggcaccttgaaggcgtgacgcgctttgcaacccatgagctggagcgtgctctgcagaacgggacgcgagtagcggaaggactctttcctctcggagtcatcgaccaccactatgtaaagtatcttccccacctcgcccatcgcacgcaacctgcaaaggattattcattcatccattcacaaacacaacatgcaatcagaagaagaagaaaactaacttccaccgtaagcaaacaaaaacaaaaacaaaagtgtcccctccccgacattcatgcgacccggccccacacagaaaggaacttaaccgcaacaacgacgacaatgctgcaaagaagattattgaagaagatcgagaaaaggaagaagaagaagaagcctagggcgaggatgttcctcagccattgtttgaagaatggattattgaagggtgcggcattccgctttggtttgtgggaaagccatgatggggtccaccttgccctcttatttcaattacactag

SEQ ID NO: 32406 - DNA, 366 bp, Glycine max
  Peptide Sequence Number=SeqID_149184
atgaaaaatgttgtgttaagcatgctggcgaagatttcacaaattgatgccaccaccaagcagttgaccgcgcgcgttgaggctcagtcgctgctgatcggtgcgctggtactggccgtcagtaagaaaggcggtgtcactgaagttattgaaagcgccaacaaagccatcaacatggtgattgagtcagccgaggctgacgatatgcttaagtcggacgccgctattctgctgagcgagttccaggatctgttgacgatttcgcgtgcggttgacagcgccgatgatgtcatcaaccagcaggcgctggagggtattaccggtgtgagcagcgccagcgatgacgacaaacaggatccgtcttaa

SEQ ID NO: 32407 - DNA, 2415 bp, Glycine max
  Peptide Sequence Number=SeqID_149185
atgaggatgttgcggtggatgtgtggtaagactcgacaggataaaattagaaacgaagctattagagagagggttggagtagtgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtatgatcagccaaagagtgtttgaactcacaaggaaagagaattctactgatgttttgaagccggaagtagaggccctatcagattttgatgttttcaagaggaattttgtaaagagagatggtaaaagtgtaccatttgagttgtacaaaaggcgcacatctgcatttgttcggagagaaatttttctagatattgcctgtgatgctctggcagagtacaagtatgtgggtcctaaccagagagcagacttggtattagcctgcaggatccgggaaaggaaagagtctgtgacagtgttattgtgtggcactagtggctgtggcaaatccactttgtctgcattgctgggaagtaggttaggaatcacgacagtggtatcaaccgattctattcggcacatgatgagaagttttgctaatgagaaagaaaatcccttgttgtgggcttctacataccatgcaggggagtgtttggaccctgttgctgttgcagaagcaaaggctagaaggaaagcaaaaaagctggctggtgtgtcacatttagtttccaaggaagacgtaactgagggtcacaattctagcaaatctgatattaggacgttggagacgagctctggtcctactgaactgctaagtccaaaacaaatggctatcgaaggattcaaggcacagagtgagatggtgattgacagtcttgataggctaatcactgcatgggaagaacgaaaagagtctgttgttgtggagggtgttcacttgagcctcaactttgttatggggctcatgaagaaacatccttcaattataccattcatgatacacattacaaatgaggataagcacttggaaagatttgctgtacgtgcgaagtatatgacactagacccagctaaaaacaagtatgtgaagtatatcagaaacatcagaacaatccaggagtatctctgcaagcgtgctgaaaagcatttagttcccaaaataaacaataccaatgttgacaagagtgtagcagccattcatgcaactgtcttcagctgtcttcgaaggcgtgaggttggggaacaactatatgatcctgttagaaatactgtgacagttgtttatgaggaatatagaaatcaatgtgcagccaattctttgagctcaaaaggaatgtttcaactgatccaaagaaaaggttcttcaaggaatctgatggctcttgttaatactgatgggtctgtggcaaaggcctggcctgttaatttagttgactgtaatgggaagcctgtatggtgccatggaccagagaatggagttggacatccaatgtatggtcccttaagaattggcaaggcagaacctataaatcttcagtttggtttttatgggatcagtgcatggccaagtgatggtggcactagtcgtgctggaagtgttgacgagtctagagccgatggaactgatacaggtagtagatatgtatcctcttgctgtagctcaccaaggatgtcggatgttgccgcaaaggagctcaaggaagacttctcagtgcatggtagtgatgaagagattgacgatcaaccagaggtgggcagtgatgaggatttcagtgatgatggcgacaaacatgcccttgaagaggtgaagccgaacatgacattaacccaaaattacgttcattggtatttcagtgtgcttctgagtaattcatggaacttaacacgcacaatgttgtttttccgtgatggcgagttatcacttggaaatgaattgatgctaatctcaattgtgttagtggtaggatcagttgacgaggaatcgacaaaatccgatgaagagtacgatgatcttgcgatgcaagacgtgctggaaaatgggtattggtcagatgatgaagagtataggatcagggttgatggtgttaccggtgaactaggaagtaaaatgcatggggggtacaagtatcgtcgaaacctggatcttttccttagaagtagaagcgagttggcagagccactattttcttattcttctttgctcgtggaaaagaatgagaggaaagccaaattaagaacacgttctcttagtattcctgcattgggaaagcatcgttcagcagtgaatgatcccatcctttctggtgctcctcacaggtag

SEQ ID NO: 32408 - DNA, 387 bp, Glycine max
  Peptide Sequence Number=SeqID_149186
atggtcattcccaagttcaaggtgctggactttgacaagtacaaggggactacttgtctcaagaaccatctaaagatgtattgtcagaagatgggggaatacgcaaaagatgaggaattgctgatacattccttccaagaaagtcttactggggtagctgttacctgtacaattctgatatggctccggataggatgcaactacagaacatgtgcaaaaaaggagcatgaatccttcaaagaatacgcccaaaggtggagagacctggcagcccaggtggcacccccaatgacgaaaagggagatgataactgtgatagtagacacattaccagtgttctgctatgaaaaatggtgggctacacaccttcaagctttgcttatttag

SEQ ID NO: 32409 - DNA, 106 bp, Glycine max
  Peptide Sequence Number=SeqID_149187
atgccaacgtcatcacgtcggctcggcggctcctcatcagaatcttactccttgcaccctgccaatgtcattctgctcccaagaacaatgttcacgatcatcacag

SEQ ID NO: 32410 - DNA, 538 bp, Glycine max
  Peptide Sequence Number=SeqID_149188
atgaatttagacactatctttgcttttaccttagcttatattctactggtaataacctcatcagagttccctagtgttgctggggacgatggattctatagcttcaatgcttttctcaccgcagctagatcctttggtgggtttggcaccacgggtgattttaacactcgtaagagggaggttgctgctttcctagccctaacatctcatgagaccacaacaaatagagtccctggttatggtgtgatcaccaacatcatcaatggtgggattgaatgtgggaatggtcctactctaggatcagagttccctagtgttgctgcagatgatgttagcagcatcatcagtgcttcccaatttgagcaattgctgaaacacagaaacgatcaaatttgtgaggggaagaacggattctacagctacaatgcttttgtcactgctgccagaacctttgatgggtttggcactacgggtgatgttaacactcgtaagagggaggttgcagctttcctagcccaaacctctcacgagaccacag

SEQ ID NO: 32411 - DNA, 282 bp, Glycine max
  Peptide Sequence Number=SeqID_149189
atgcggagagggaaaaagagtaaccgttatgggaaacacgagaagagcaaaggcttagatgacagggatggattgaagaagtgggagaaagatgttggaagggagtgtgggagtgaagtgatgataaaggatgtgcctctgcagcatgtcgaggaacctttccaattcccaccgatcaatgaaaaagctaaggtagctttatgtcctgtccctacacttgtagttgtaggcctcattgtgcgcaaagagaataaaggagtaatagtactctctttagggtaa

SEQ ID NO: 32412 - DNA, 498 bp, Glycine max
  Peptide Sequence Number=SeqID_149190
atggcggaatcgagatcggagaagagattgaagtacaggagtggtagagtgaggactgaggagttagagcagcacaaattagtgaatttgcgggtcggggtcgtggcggatatcagtaatctcatacccgcccccacccctgttttgtgttatcggggaaaacccgaatccgaccctgaatccggacaatccggtttttatctgtcaaagtcgaggcgggttcaattcggttcccacggggtagtgtctctccctattcaaaattccgcatccactctctggaacaaattgcaggaacaaatctccgaacactccttcgacactcttctctacagaggagtgtcgcacatgatcaggcggcagattgaggagctagagagtgtctggcatggtgatcagtggtacccgactatgttgccattgaaggagatcatcgatggaattcacggtcaggtggcaaagaatgaggatgatctcaaggttattcatgtttcttag

SEQ ID NO: 32413 - DNA, 294 bp, Glycine max
  Peptide Sequence Number=SeqID_149191
atgaagatcaagaaaagaacaaaagaaaggaaagaaggattcccgatcaaagatcgaaaggaagtgaaaaggggaaaagaagcaactcttgatcaacgaaaggaagagaatagaaagtctccaaagccagattgccactcagaatcattcttgactggcaatattccaccccacatgaacaaagaggaaaaaaccgaaacacccagcttcctctccaaaaacgctgacctcgagaaaatcctattgattagccccatgtttcccctgcgtgtttgtttgaaagctagaagttga

SEQ ID NO: 32414 - DNA, 903 bp, Glycine max
  Peptide Sequence Number=SeqID_149192
atggaaaccatttcaaaatttccatgttcacaccaaccagtaagatccattagttttcctactagagtacaccccgtttctcaaagaattgaagcacttctaaaccacctaaaacctcatcattctcaacctttctcaagcactacttgttttgaagctgagacaatccagagtgacttagttgcgctttctgagttgtacaactgcatggaggaactcttccattctccgcaatctcaacaaactcttctacgctaccaagatgggaaattagtagaagaagcattatgtggctcagtcacattgctagacacatgtgagtctgcaagggatttgttgttggttcttaaggaacacatgcaaacccttcattcagccgtgcgtagaagaaagggatattcaaacattgaaagcatcatttctgcttatgaaagctttaagaagaaggcaatcgctaaacaacgtggacaactaaagagaatgaagaataaggttgattccttttctttattggatcaagatcaacagctagcgtttttggctagagttataaaagaagcaagcgccatcaccatctctatattacattctctattagtatttctgtccatgccaacaattggaacaaaagggtcctccttgatctcaaagttgaagccaacggttttgttttcttcccagaaagagcagaagaacaccaatggggttgcagatctcaacaatgttctgtgctccctccttagaagagagaaaaacggtgattccagtggtgaatttcaaagaacacaaacagtgttagagacattgaatgttaatattggtggtcttgagggtggattagattgcatatttagatgtttagtgaaaaatagagtgtcgtttttgaatatgctagctcattaa

SEQ ID NO: 32415 - DNA, 1830 bp, Glycine max
  Peptide Sequence Number=SeqID_149193
atggctaaaaaacgcagcgcatcagacgccaccgatgatgcacaaaacgacaccgtatcgctgcttccctcccaacgcaagaagcccaagcactctgctcctaaccccgacgcctgcttcgtcggaaagcccattccttctgccgaggcccgcgccaaatggccccaccgatacccctccgaggtgaaaaagaaagctccagctagaagctcagaagaggttacgagtgaaaacagtgaggttatgctggctaggtgtcattatcgtcaagctaaagtagatggagttgtttataacctctatgatgatgcttatgttaaggccgaagacggtaaaccagattatattgcacgaatcgttgagatgtttgagactgttgataaggaacaatgttttatggctcagtggttctacagggccgaagacactgtgataaaaaatcacggtgatcttgttgacaagaagcgggtttttatatctgatgtgaaggatgtagatttggcttcaaagaaggcaaaattgcctttttgtgattactattatgacatgaagtacactgtgccatatctaacattttccaacctagtcaatgaaacagttaaaaccgagagtgatgcatcttccacaatttctagtgaatctggatccattggttgcgttaataatgctaatctggcaaagagaaagactactcaaaataatagttctggttcctcgcagtggactttgctagacttgtattctggttgtggagccatgtccacagggctttgtttgggtgcatccttggctggaataaaacttgtcacaatgtgggctgtggacattaatgcacatgcatgcaaaagtttgaagctgaaccaccctgaaactcatgttagaaatgaaccagctgaagacttcttaaacctaataaaagcttgggccaagctttgtgaagagtttgcattattaggatcagaacggtcagattccgatccagacatggatgaagatgagaatgaagctgtgcaaaaagaagagtcaggaaatcaatctgacttggaggaatttgaagtagaaaaattacttgctgtgtgctatggtgatccaaacggcgtcaaaaaaccaggactatattttaaagtgcgttggctgggttatgattccagttatgacacatgggagccaatagatggattgagtgattgcaaggaagttatgaaagattttgtgacaaaaggctacaagaaaagattattgcctcttcctggtgatgctaactttatttgtggtggacccccgtgtcaaggagtaagtggtttcaaccgcttcaggaacgcagaagctccattagaggatacaaagaataagcagttgcttgtttacatggatattattgattttttgaagccaaaatatgtcctcatggagaatgtcgttgatattttgaagttttctggtggttatctggggcgttatgccataggccgtcttgtagctatgaattatcaagcaagaatgggcatgatggcagcagggtcttatggccttccacaatttcgtatgcgtgttttcctttggggagctcgtcctactgagcaattgcctccatatccgttaccaacgcatgaggtggtgtcaagaggttttgttcccactgagtttgaagaaattacagtagcttatgataaaaaggatacctgtcagctggctggtgctcttttacttgatgatgcaatatcagatctcccacctgttacaaatgatgagaaccaggatgaaaggaactatggagctcctgctcgaactgagtttcaaagatatattagattgaagaaaaacggttag

SEQ ID NO: 32416 - DNA, 900 bp, Glycine max
  Peptide Sequence Number=SeqID_149194
atggttggctcacacacagccaaggaatttcactatcatgttagatccattaccttgccttgtaggctacatccttcattatccgagattgaaaaagagctgaagaggctgaagacatgggaattagcctcatcacattcacaaactgagggcatcaaagcagggctaacatgggtcgaagagttgtataattttgtggaggaacttgttggttgcccacttactcaacaagctcttctacgctgtgacggaaagcatgtagagaagccacttgacatgtcagtttgtttgcttgacatgtgtggatcagctagagaattgttgtcattgatgaaggaaaatgtgctagaccttcaatcagccctgcgcagaaagggtgtgaattcaagggttaatagccagatttgtgcctacatttgtttcaggaagaaggcaaggaaagacatcacagaaaggctcaaagcactcaagacaatggaaagcggctttaaatcatattcatgtcctctcttattagatttagatcaccatctactaatggtgatcagtgtgctaagagaaataagcaaaatcaacatctcattttttaggaaactcctactttatatgtgtacaccagttttgaagaacaacactggtgggtggtcattgttcactagaatagtgtcctctggatcagacaaacaaaagagggtcataagtgaaatgggggacattgataatgttctttgcaccttccacgggtgttttaagaaaattgatacaaagactgatgtacaaattatgaagaggagattgggggaactagagggaagcattagagaattggaggcaggattagattgtcgctttagatgtttgatacaacaaagggtgtttcttaatcttttcacctcttaa

SEQ ID NO: 32417 - DNA, 675 bp, Glycine max
  Peptide Sequence Number=SeqID_149195
atggttgagctggccaagcttctcgaaacacatagttattcaatcacaatcctctttaccactggcttccacgaccacccttcagtcgacgcctacaaccaccgcatctccacctccaatccttccatctccttcaaccacctccctcatatcaccccaaccatcacctcaaccaccgtgagcttcgctgcgaacggcttcgactttatcaaacgaaacacttccaacgtagccaccaccctcacccaaatctctaaatccaccaccaccataaaagccttcgtgatcgacctcttctgcaccacggcgatggaagcagcttcttcgttgggaatcccagtcttttacttcttcacttccggatatggtcgcggtggaactgcgcgtgacgggaaacgcgccgctgaaggcggtgaacatgctgcaacccatattttggagagggaggaccctgcgtactgggacatgttacagttccgcacgcgccttccaaaggcgcgtgggatcatagtgaacgcgtttgaagagctcgagcctgtggcggttagcgccgtcgcggatggcgcgtgctttccagacgcgaacgaagcacctgttgtttactacgtcggaccactcatcgctgaaccgcaacaatcaggtccatactttgaactcgtctttttcattcaatga

SEQ ID NO: 32418 - DNA, 879 bp, Glycine max
  Peptide Sequence Number=SeqID_149196
atgacaaacaagttccatgttcgctcaaatagttttcctgctgtatctcatcctagcaccattagaatggaggaagagctgagcaatgtcaaaacttgggaagccacttccacatccacctccacatcaaagtccattggcattggcttatccttgcttcaagatctgcatacttgcttggaaggtcttctcaacatgggatcaacccaaaagctgatttccaaccatcaaggtgagaaatgcatggaagagcttcttgatggatcagtgagaattttggatatctgtggcatcacaagggacaccatgttacaaattaaggaaaatgtccaatcccttcattctgctcttagaaggagaaagggggattcaagcatagaaaaaattatagcccaatacaatttcttctcaaagaagatgaagaagattgccaagaagttgatcacatctttgaagcagatggagagcaaatttggagtatccccactcttaaatcaagaccaacaacttgttgctttggttagagtgattagggaagtcattgtaatgaacatgtctatcttccaatcattattatctttcttggccgtgcctgcttcaaagtcaaaggcaaccaaatggttattggtagcaaaattaatgcacaagggagtgacagcatgtgatgagaaccaagtgaattccaatgagttgctgtgtgtggaagcatctttaagcacacttgtaagtgaaggtactaatgttgcaaagatgcagggtgcacatgaaagattggaagctttggagaatgccattgaaagcatagaaaatggtttggagatcgtatttaggcgcatggttaaaacaagagcctcccttttgaacatcatgactcattag

SEQ ID NO: 32419 - DNA, 597 bp, Glycine max
  Peptide Sequence Number=SeqID_149197
atgacttccgcttcatcgactgcctcaagcaagttgagattccctgctatcagacaaccattaatattgcaatttaaagctgcgttccattgtgacaaggatgccatagaaataccagatttctatcagcgccaatggctaccaaattatccagaaattgttgaatttaagtatgatggggcaacctacgaaattcaagccaggcaacacaagggcaaactttactttgctgatggcctaacaagaatgaggacagaattgcagatttatgaatcagtgatcataaatttcctagcctgtgaccaccactcaaaatttgacctccacttcactccaccattacaccagcagacatgcaaaaaccgccgcgcaacaaggaaacatatctggacatatgaaatcacccaatcaatgctaggggcaccatatccactgggaattgctgataagtatatcactcagccttggtataaattcctccaagaaggtgattttagccatgcagacgaactctcattctactataggcgtgctgaaaaaatctgggaagttgtcatcagatgtgcaattgattgggatgacagtgatatagactag

SEQ ID NO: 32420 - DNA, 648 bp, Glycine max
  Peptide Sequence Number=SeqID_149198
atggcttcccttgatgatcataaaactaatgaagaaatttccatcaaccatgttgagattcctatccatgcaattggtgtagagccaaaaccaaaccaagaggtcaaagagagaagaaacattgactattctcagagagcacaatggcttcgtgcagccgtattaggagccaatgatgggttagtctcagttgcatcattgttgatgggtgttggagctgttaaggaaaacatcacggccatgcttcttgctggctttgcagggctaattgctggggcatgtagcatggcaattggagaatttgtttctgtgtacactcaatatgacatagaaattgctcaaattaaaagagataaagaaaataataatattggtgaagaagcacaaagggagaagttgccaaatccatttcaggctgctctagcatcagcactagcattttctgtgggtgcagtgataccactactagcagctgcattcataaggaactataagattaggcttgttgtcgttgctgttgtagctagcctgacattgttgctatttggtggtgttggagcagtgcttggaaaaactccagtgaggaagtcctgtatcagagtgctccttggaggttggatggccatgactataacttttggtcaccaa

SEQ ID NO: 32421 - DNA, 873 bp, Glycine max
  Peptide Sequence Number=SeqID_149199
atgctactgaaaacaccgtggcatccaacaatcaaccacaatgtgctagtgtccattaacgaggttgacaatgtagtccatattgttgaggagacatgttatagtttaaaaagatgcagatgcaatagggggtacttagaagggtcatcagacgaaatatcttcagatgaaagtggtgaggagatgagcttgctgtcgggtaaaacactgcacgtcggagtctccgatgatacccaggtggtgggtgtggagaagggtgaacaaacgagaaacagggagaagaacctttggtctggtggtcaatgcaatgaaaaggaaccaatggacaataaccaggaaccattgatatgtggacccaccaatctaaggtccagtgacagtgttcccagacttggggatgctacaatacacttttttgatggagtacagataccaactcgggtcccagcagggaaatatggaaagcaacagcaaagggggaagatatcaggtgaaaaggacaataaggttgacgcaatagaaggtagtgttgtgattggtggagagaagactgaaagtagagatgacaatggaaaacattgggaagaaaggggcccactcatgaatcagaattttgaattaaaggaggtacagcttcttcattcttcttcttcttcttcgccgccaatcttcttcgccaccatcgccaccattgttgccgtgtttaggaggaaggtgtgggtcttcgcgtttgtgcttcttcttcgcgtttgtgcttcttcttcgcgtttctacttcttcttcgaggtaagtttgtcattcgcgttttggtttttgccggcgataacggaaaacgttgtcgggaagttgctgggctgtttacggatcacttga

SEQ ID NO: 32422 - DNA, 462 bp, Glycine max
  Peptide Sequence Number=SeqID_149200
atgtccgatccttacatccctattgggtctactggcttgcaagtctcttctggtgatatctccaccgccggcattacaaatggtcttaaatctgcttctgccagtaatccatatagcttctcgtttccatttgcaaccaatgtttcggcaatttcaaccaacaaaatcgatattctgctggatactgttgtttttaatgtaaagaaaaatgcagaaactatcattgttgtgccgtaccgacttacgtattccacgtcagcaccggtcgacccttcgacagacccggctctttccttgctgatggaaagctgtaaaagtcgtgctcctctgagaatgtcatatagtgtgacactttacttgagattggtctcttggactggataccatcctaccagttctggcacattttcgattgcatgtccttcttcaattgctgacttgctcggaaatatatccaattag

SEQ ID NO: 32423 - DNA, 1119 bp, Glycine max
  Peptide Sequence Number=SeqID_149201
atgcagccagcatgtaatagtgctggaggactactttgcatttggaatgaggaagcatttaaagtagaaaaaaagatgaggggaaatggtttcatttacctgaaaggggcatgggcagcagatggtgcaaaagttataattgtaaacatttactcgccgtgcgatatagttctaaaaagaaatctgtggaaacaaatcagacagctaagaactgcaaatataggggagctatggagtatattaggagactttaacaatgttagaagaccatcagaaagagtggggatttctcaaaggatgcaagatgagagtattgtaaaggagtttaatgattggattgctgaattagaggttgaggatgtgctttgtgtggggttgaaagttcacttggtattgcagaagggtgccaaagaagatggtagacaggttggtaaagctacagatgtggttcttgtggggaggaaacccagatcagaagaagatttcctgggtgagttggggaacaacatgtatgccaaaggaggcagagggcctgggtatcagggatttgagaaagttcaactatgctttacttgggaaatggtgttggaacttgtttcatcatcaagggacctaagcttcatttgcaatcaagcggaggaagggagctggtttaataacaacataaaatggaaagtaggaggagggaatgtcgctgaaggagaagtatccaagactgtaccagatttctcaacaatatattcaacaaatggggataacaagaaatgcaggttgggaatgacaactgcagtggaggagggtttggtagtacaagtgcagcaacaagtcacttggacttggggaggtgattcaagtgggaagtattcagtcggaaatgcttatatacttctcaacagagtcgtcgaaatcaatgatgctagctgctctttttgcagaagtcatgaggaggatgcatctcatttattttccagttgtgataaagtcttgctgttgtggtgggagtcgatgtcgtggataaatactgtgggggcattttcagaaactccgaaaaaccatttccttcaattttctaattgtaattctgatggttttaggggtcaacgatggcagagttggtga

SEQ ID NO: 32424 - DNA, 918 bp, Glycine max
  Peptide Sequence Number=SeqID_149202
atgacatccgccattttccgctacgccatccgccatatttttatggcggattttttgctttccgccatgaaccgccatccgccattaacaacattgatccctatcatagcattgcccttgagagctgatgtcttggtggctgcactctatgatgcttcattcagcctttctggcttcaatgcaccagttgctggttgtttctttgctatcgaaactgtgctgaggcctcttcgtgcagagaactctcccccatttacaactgccatgattatattggcttctgttatctcgtcaactgtatctaatgttttacaggggatccaatctgctttcacaatacccgagtatgatttgaaatctgctgctgagctacctttatacctgatattgggaatgctatgtggtgttataagtgtggccctgactcgtttggttgcttggttcaccaaattatttaagactattcaggataagtttggcattcctactgtggtctgccctgctttaggtggctttggagctgggatcattgctcttaaatatcctggaatattgtattggggtttcacaaatgtggaagaaattctacgcactggaaagagtgcttcagctcctggaatatggcttctggctcaattggtatttgctaaagttattgcaacagctctttgcaagggatctgggctagtaggtggtctttatgcaccgagtttaatgataggtgctgcagctggtgctgtatttggaggcttttctgctgaagttattaattcagcaattcctggaaataccgctgttgctcagcccccagcatatgctctgccaggtccacataaggaaaagagtactatctgccagtttagaaatatcaaaggattgactatggaagatgatatcatttctgagcttccagattga

SEQ ID NO: 32425 - DNA, 204 bp, Glycine max
  Peptide Sequence Number=SeqID_149203
atgacattgcaatttgttgatcattcaattacaagaccctacagtgtggtggtggacgtgttggtcaaggttcgtcaattcacattccctatggattttgtgatcatggatatagaggaggatgttgaaattctattgatcttaggtcgtcctttcatgttgacggctaagtgtgacaccctctacccctcacatatatactaa

SEQ ID NO: 32426 - DNA, 534 bp, Glycine max
  Peptide Sequence Number=SeqID_149204
agggtacatctacttgggttgttgactgagaacaagagagggtacatctcttgtggatcagttctagtggagggtacatccactaggttcaaagagaacaagggagggtacatcccttgtggatctttgcttgacactgtgttcttatttgatgaagagtgtttaaaggctttcaacactttaaagaccagcctagtatccagtcccaggaaaggcagggtttttcatgccatctactatgtgagaaaggtcttaaacaacgctcagctaaattatgccaccacagagaaagagatgcttgcaattgtctatgccttggaaaaatttagatcatacctgatggatcctgttgctacaagagttttgccatatcctaatttcctccagggaccattgtttgtcagcatgcgaccttcatttgaccacttcaaaatgtttaacacctatcaccgtggaatccgtaaagtcctgggatgtttcagagagaaaccagccaaaaacatgaaaatgggagtgtatttagcaaattggggg

SEQ ID NO: 32427 - DNA, 375 bp, Glycine max
  Peptide Sequence Number=SeqID_149205
atggcggagttgcgtagcggatttctgaaaaaatgccaccgaatagcggtggcgtggcgggttgaagatggcggcgccatggcggatatggcggatatggcggcgaggcggaaaatggcggaatttgttttgtttttttggtccgcggtaggagttgggctgacccgacccaaccctacccgcgcgacctcggaacccatcgacgacccctgcaaccagccacgacagcagccacacgtgacccgctgcacacagcagccagcagcgacgacccacggcgtgaacggcggcgacgagcatggcagcgacgacccacagcgcgaacggcggcgacgagcacggcgtgaacgacggcaacgagcacggaggcgatga

SEQ ID NO: 32428 - DNA, 513 bp, Glycine max
  Peptide Sequence Number=SeqID_149206
atgtctcttgccactctctttggaaaacttcaagatcatgaaatggaacttatgagactccatcaacatgaagagaataataaaaagagggaaggaatagcgctcagagcctcgtcatcttctattcaagaagaaaatgacaaaaaggacttgactgaaatagaagaagatgatgatttcagattttttatgaagagattcaataaatttctgagaaacaaaagaaatcaaaagaaatcaaatatcaatccaaagaagaaacgagaagattcctccttagccccaaaattctatgaatgcgatcaacctgggcacatgagatttgattgtcttgtctttaaaagaagaatggaaaaatcaaacaagagaaatttcaaagaaaagaatgaaaagaaagcatacatcacttgggaagataatgacatggattcttcaagtgattcaaaaaatgaaatcataaatctgggtcttatggcgaaagactatgaaagcggagaagagttgacacattga

SEQ ID NO: 32429 - DNA, 183 bp, Glycine max
  Peptide Sequence Number=SeqID_149207
atggcatgcctgcaagtcggcggagacttggacgtcggtgatggtggtgagagaagagaggatatgtataagaaacaaaaggaattaaaaatgatatgtggtgcaaggagtaaggacgaaaatagaatgtttaagaacttcaaattaaaaagaaaggaaatcattacttccccatttgcgtga

SEQ ID NO: 32430 - DNA, 681 bp, Glycine max
  Peptide Sequence Number=SeqID_149208
gccattgatgtcgtcgaagaggccaaggtcaatgacctccaacattgtccaatctatctagaagcgatcttcaacgatgcgaaggcaatagcaaatttggcctatggtggtggtgttgaaggtgagtgttcaccaaggaagttggatccaggtgtcccaaattctttctccaatgaaactaatagaccttctcacggactctttctcctcatcgtcaccaccatcaccgccttgaccagcctcaacctcaacctcgctagcaccagcgctgctactgctactctttggttttgtggtgtgagccagagagtcttcgaaggcatcaatgatttcatgtatgagttggtggatgggagaggagaatttgtgacgtgggacttggatggagatcttaacatgcatctggcaaaggcaggagcagtttacaacaaaaccatgaggctttatgggatagcgtgtattgatgcttatttttgtggaagtagctcttcttcatttacatctttagaaacattgtacttctccaacatgaaggaatgggaagaatgggaatgtttaaagagactggtgattcgtgactgcagacaacctatggcttctgctcccttggctctaaaaattcatgaattagaactagaggattatggaaagttgcaatttgattatcatttgactttttga

SEQ ID NO: 32431 - DNA, 327 bp, Glycine max
  Peptide Sequence Number=SeqID_149209
atgatttggcttaaaccaaagaggaagcatttggacctgttgcacccagagaggaagctatcagaattgctaatgacactaatgcaggtggctccatttggtggttttaaaaagtatggcctcggaagagaaggctccaaatatgggatggatgaatatttagagttaagggattgtgttgaattgttaatagcacttttagatgttttggatcaatgggtatggcctgatacttggggtcctaggagaatgcattgtgtcatggattccattcctgccactgcaattgaaattggaggtgtagcacctatacagactgttggttag

SEQ ID NO: 32432 - DNA, 684 bp, Glycine max
  Peptide Sequence Number=SeqID_149210
atgccaatgcatttgggaaaacttaagaatcttcaagtattgagttcgttttatgttggcacaactactgagtttggtattcaacaactaggagaactcaatcttcatggaaggttgtcaattggggagcttcagaatattcagaatccctgggatgcattagcagcagatttgaaaaataaaatacaccttgcggagctagagttagaatggaaccaaaattctgatgatttaacaaaagaaagggatgtgtttgagaatttacatccttccaaacacttgaagaagttgtcaatcaggaactatggcgataaacaatttccaactttggagatgctcaccattagcggacatagcatggaagcatcaacacttgaaaggattgggtacatcttatccaatacttctcttgaactcttgttcattgattcttgcccgaatataaacatttccatcagccactgctatgatttccttataaatttggagatcagcaatggctgtgactctctaacaaccttttggctggatttgtttcctaaactttgtttgtttgatctcatgtgtcgtaatctacaaacaatttcacagggcctgctcataatcatctcaaggatcaaaaaattagtggatgtccaaagtttgaatcatttcccagtgaaggattatctgcaccctgggtag

SEQ ID NO: 32433 - DNA, 1035 bp, Glycine max
  Peptide Sequence Number=SeqID_149211
atgaagttgaagaagcttgttcttgctggaaactatcttactggtagaattccagatgctttttatgggctaaatgagttattaatctttcagttattattctttgagttaagtagcagttcattatctggctctttgcctttgacacttgggagcttaacttcagtgttgaagcttgatgtgagcaacaaccaccttgaagggaatcttctaaatcaatttgctcatcttaacaatctgacccttacggaccttaggaataataggttcactggagggttgaccttgtctttgcaagaaatgtcctccttagaggaattggttttgtccaacaatccattgggtggagatgtcatatacctaaggtgggaaaacttcaacaatttggccattttggagctgtctaacatgggattaataggggaaattcctgagtctttatcagaattaaagaggttgacatttgtgggacttagtgacaacaacctcacaggcactcatactttgaagttcaatgttccttcaactaagaggattgaagtgcagggatttgcagaacttcaatacgaaatgctaaggattattaggttgtgtcacagtagtggaaactatgaatgcaaatctaaatgcaaatctactgagaagaatagaatccgccttcatctgcgaaaaggaggggagggtgaagaattggcactggatttggggttccgagtgctattggagaggcatctcttctcgtgtgagatcaatgtcgttcttcatgaactggtagttcgagtcgagaagttggagccgagaactttgaacctcgtccagttcaatctacagggctttaatgttaatagggttcaacggaaggtgttcaatgtcaataggcttcaatgcttagaaagtgaaacggcaaatagggttcataacaatgaaacgagaatgctgaagggttcaatcgaaggtcacagggttgtctacagtgttcaaagaaacaacaatgctgaagggtcacagggctgtctacaggggtcaaacaaatga

SEQ ID NO: 32434 - DNA, 681 bp, Glycine max
  Peptide Sequence Number=SeqID_149212
atgggtacctccaagttgaaagcttcctccagaattgtggtgcgattggctgttagggactgtccgcgaacttgtcggggcctagggcgaggagcatggaatgcaacactacctcgaggtcatgcggtgagacctactagtggcatactatgcactaaatcattcgacgagggtgtcgaagctgtctgtggacctaggtggaagtccaccataccagtcaagaaggcgtctagatgctcgtctggatctattgtcccatcgtaccacttgaggttgagtgatttccaccacaaagcaatgtgtgagcggagtgctcgtcacccaggaaacattcgactcgagtctttagttgatcatggtcagcctttacctttcttaactcctcctcgtggcgtcgctccatctctgcgatgcgtgtttggagttgttgtacattatatgtgtctatcattaataccagatgaggatgggaatcttcaagaggggtctcacgtgaggccaaaccgaatgctaaccatggatgaacaagagaaagttgacaagagattgtggggtatgtttcaccatggccccacgtgggctcttagacttctcacatcggctttgagaggtgcctttgtcaagatgacaggagacgcgacctgtaaaacaaaggactctgacgctctagtaagtatatga

SEQ ID NO: 32435 - DNA, 393 bp, Glycine max
  Peptide Sequence Number=SeqID_149213
atgagcaacataagaaccacgaagcaaacagaagaagagcggaagaccgaggtagataaagacaacaacaacaacgacatgaacgacaacctccacaagaacaggaacttgccgagaacatcagagggtatccacctcgtcaacaaggatgaccctgtggtagtctccatcatcattgcaaacttcatggtttccagggtccttatcaactatggcacttccacaaatatcctgtattggaaaactttccaaagactcgaggctgggcaacaaatgaaggctaaagcacaaggagctgctgatgctgtgagcgagtttgacttggtttcccttgaaataaaccatgttctctacatagactttcatatttatgaatttgactctcaaacttaa

SEQ ID NO: 32436 - DNA, 186 bp, Glycine max
  Peptide Sequence Number=SeqID_149214
atggaaggtgttctatattgtaagcctcactttgagcagctcttcaaggagagtgggtccttcagcaagaacttccagtcacctgcaaagctagctgataagacaacacatgagctggggatacaaactccaagttcaacttggaaacacctacttactaagaataatcaacgttttactgaatga

SEQ ID NO: 32437 - DNA, 390 bp, Glycine max
  Peptide Sequence Number=SeqID_149215
atgcaaacagaagaagagcggaagaccgaggtagataaagacaacaacagcaatggcatgaacgacaacctccacaagaacaggaacctgcctagaacatcagaggctgggcaacaaatgcaggctaaagcacaaggagctactaatgctgtgagtgagttagacttagtttcccttgaaataaaccctgttctctatactgctgatgcatcatgcggcaggcgtaaaggcgacagatcctatgctggagacgagcatgccaacacggagggtgatgcggttgacgtttgcgacaaggtgatcgacgacggtggggtagtggaaggaggtggtgcggtggatcctagagcgaaggcagagcctaaaatggcgctgaggtggtggctttag

SEQ ID NO: 32438 - DNA, 1678 bp, Glycine max
  Peptide Sequence Number=SeqID_149216
atgtttgcatcttcggaatatcaagatgaccatgctccactgtggtcatttgttacaataaaggaaaagataggagatgggggtggtaataggctgtggagttgtaatttttgtgaaaaagttgtcaaaagttcatactctagggttaaagcacatttgctcagaatttgtggtagtgaaattgctacctgtccgaaagttactgatgcatatttggttgatttgaggagtgtttgtgaagaggctgaaaacagattaaagtctaagaatgttcctttacctactaacaaaaggactccaacaccaccaacattaccaccaaaaagaagaaaatcaagcaatatagagagtgcatttaatattgaggataggaatcatcttagagcagagatagcaaggatgttttattctgccggcttgtcattccatcttgctacaaatccacattttgttagttcttattcatttgctgctaattgtaatctaagtgggtttcttcctcctagttataacgcattgagaactattcttttacagcaagagaggtctcatattgaaaggttgcttcaacctatcaaatctttgtggagtttaaaaggagttacattggttgtagatggttggacagatgctcaaagaagacctttgataagcttcatggctatatctgaagaaggacctatgttttttaaggccattgatgggtccaaggagtacaaggacaaacattacatgtttgacttattaaaggatgtaatcaaggaggttgggccacaaaatgtagtccaagtcataactgataatgttcatgtttgtaaggcagttgggttattgatagaagctgaatttcctcatattttttggaccccttgtgtggttcatactttgaatcttggagtgaaaaacatttgtgctgcaaagaatgttgatggtaatgagaatgtcttcaatgaatgtgggtggattgctgaagtaattggcgatgcttcttttatcaaggttttcattatgactcattcaatgagattagcaatttttaatgagttttcttctcttaaattgctttcaattgctgaaactcattttgcctctatgatagtcatgttaaaaagattaaaattgttgaaacgttgtttgcaaaatatggtcattagtgatcaatggatatgtgacaccgatgcttctaatcttcacttagtgtatgaaatgtgggattctatgatagaaaaggtgaagacaaccatctataggcatgatgaagtgctagaaaatgaagtttctaatttctttgaagttattcatgaaatacttaattctaggtggagtaagagttgtaatccacttcattgcttagctcattctctaaatccaaggtactatagtgataattggcttaatgaggttccaaatagggttcctcctcatagagatgatgaactttctagccaaaggaataaatgtcttaagagatattttccacatgttaatgttaggaaaaaagtttatgaagaattctctaaattatcatcttgtgcgggtgactttggttcatttgattcaattgaggatagatgggcattagatccaaaaacttggtgggtgatgcaaggatcctctacacctatactccaaaaggttgctttaaagcttctagtgaagccatgttcttcctcatgct

SEQ ID NO: 32439 - DNA, 213 bp, Glycine max
  Peptide Sequence Number=SeqID_149217
atggattattaccacaccaatgtcaacagtgcaccctcaacaactatgagtatgaccatttcttatgagaaacttgctacttcatctacacttgataagcctgcaactgcaacttttcaagagggtcatcttgaaatttatctcaaagagattgaagctcatgagggcatactaactgtttgtgaaaaggatgatgttgagcaggatcagtaa

SEQ ID NO: 32440 - DNA, 307 bp, Glycine max
  Peptide Sequence Number=SeqID_149218
atggttcacttcaatgtaaacaaacggcccggcattaagaaaggtaaacagcccggcaaacgagaagccgcttgccagcatatagctgaaggcgcgtttgtgccgcaccagcgcgacaaaattgctcagcgtggtgcgcaggtgaaaacgctgccgctgctcgggcttaagcgtttcgcggatctgcgttaccaccagcacggtggtaatcagcgccgccagcgccagcgtccagaagatggcgtgccagttccacagcagcagcagccagccgccgatgatcggggccagcagcggcgcaatggtg

SEQ ID NO: 32441 - DNA, 153 bp, Glycine max
  Peptide Sequence Number=SeqID_149219
atggactaccaaaacatgagctacaatgctggacaagccaagggccaagcccaggaaaaggctggtaacatgcaacagggtgggcatcaaatgcaggctaaagcacaaggagctgctgatgctgtgaagaatgcaacatggatgaacaactaa

SEQ ID NO: 32442 - DNA, 462 bp, Glycine max
  Peptide Sequence Number=SeqID_149220
atgcgcgctgatcagcttttccgggcgcagcgggcggctaaacagatacccctgcagatgcgtgacgccccgattaaccagccaggccgcctggtcgccggtttccactccttccgccacagttttcaggttgagtttctttgccagcagcaacacggtgtcaagcaccggcgaagttacggtttcggtgccgatactctgcacaaagccgcgatcgattttcaggtagtcgaacggatatttttccaggtagatcagcgcgctatggccagtgccaaaatcatcgatggcaatcttgaaattgtgttcatgcagccaggcgaagatttcgccggcgttcttctcccgcaccatggtgcgctcggtgatttcaaatacatagttaaaatgatcggcgggcatactggcgatccatgcctgcacgtcacggcgaaaactggccgatgccagatgctgcggtga

SEQ ID NO: 32443 - DNA, 270 bp, Glycine max
  Peptide Sequence Number=SeqID_149221
atggcttcacctgccactgagaagcgcaaggagatgagttcatcacagagagcttcgattgttgccgctagtgttggagttgttgaggccttgaaggaccaaaggcaaaagaggaaggggagggggtggagctatatgtcgtcttgcaagatagctaatcttcttgtttctagccttgaaaaagagaaagaggtgcttcttaagtccctaaccgagcaaagatatgcatgcaaagaggcccaagacaacattaaagatgcaacacagtga

SEQ ID NO: 32444 - DNA, 1431 bp, Glycine max
  Peptide Sequence Number=SeqID_149222
atgagaattccccatgttcccttcctttccttcatattctgctacttcttcttgatacaccacaatgtttactacactggggtttcagcccaaattgttgaggatcaacaacaatcattgcttaaactgaagaatagcctcaaattcaagactaataagtctaaaaaagttctatcttggaatcaaagcatagatttctgtgagtggaggggtgttgcctgtgacgaggaggggcaagttactggccttgacttgagtggagaatctatgtatggtggatttgacaattcaagcactcttttcagtttgcaaaatctgcagatactgaatttgtctgctaacaacttcagttatgagataccatccggtctcaacaagttgaagaacttaacatatctgaatttgtctcatgctggctttgtggggcagattccaacagagatttcttccctgacaaggttggttactcttgatatgtcttgtctttcctatttatatgggcaaccgctaaaacttgaaaacatagatctacaaatgcttgtccgaaacctcaccatgcttagacaattgtatatggatgagcaaatcttttgggtagcaacattgtctgttgtagacttatcattcaattatcatctgtatggatctttgcctcaattcctactgaatagtcctcttcagacattgattgacaacttgctagatggaagccttccttcctatattttttatgtcccactgctacgaagtattcgactttccaacaacaatttccaagatcaattgaataaattttcaaatatctcttcctccaagttagagatccttcatttaagtggaaatgatttaaatggctccattcctacagatatttttcaactcagatcacttagtgtccttgaactatcttcaaacaagttaaataggaaattgaagctagatgtcattgatagacttgtaaatccaactacactaggactttcacacaaccatttgtcaatagacaaaatttttgcagatgttggcctaatatcttccatccccaatatgacaaatgtagagttggtgtcctgcaatctgatagagttccctactttcttgagaaaccaatcgaaaataacaactttagacctctcaagcaacaatattgaaggatctataccaacatcgatttggaaacttaactctgttgttcaattaaatctttctcacaatttacttagcaatttagaaggacttgtgcaaaactctagctccaatttgaaggtccttgaccttcatgataatcacctccaagggaagcttcaaatattttcgatgcatgccatttatttggactattcaagcaataacttcttattccatcagatattggtaattttctgtcttacacaactttcgtgtctcttggaaaaaacaatttatgtgtga

SEQ ID NO: 32445 - DNA, 127 bp, Glycine max
  Peptide Sequence Number=SeqID_149223
atgagtggaaagggattggagcatgttcggaaatcactttctcaatatcagcgtcttagagcatgtttggaaatcaaatgggataccaattgggaaagagggtttttagtttatgtaatatttaaag

SEQ ID NO: 32446 - DNA, 570 bp, Glycine max
  Peptide Sequence Number=SeqID_149224
atgggatttttagcggggcttttgcttctttatatgagtgaggaggatgcattttggttgttggtggcattgctaaaaggagccgttcatgctccaatggagggcttgtatctggcaggattgcctctggtacagcaatacctctttcaatttgaatgctcggtgagggagcatctaccaaagttgggagaacatttttcctatgaaatgataaatcctagcatgtatgctagccagtggttcataactgtattttcatattcctttccatttcatttggctcttcgaatttgggatgtcttcctctacgagggtgttaaaattgtctttaaagttggcttggccctattaaagtactgccatgatgacttgattaaactacctttcgaaaaactcatacatgccttgaaaaactttcccgagggtgcaatgaatccggatacattgttaccactggcttattctatcaagagtctgagcaaaaaaggtattactgagccaaactttgtttttatcttgaccagtgtccctgctcttttacctttgtcaaatagttggacttgggattaa

SEQ ID NO: 32447 - DNA, 550 bp, Glycine max
  Peptide Sequence Number=SeqID_149225
tcagttgcggaggcaacggatagcattgctaaaagaaccattgaggttgccaaggtagatcgaaggaaagccatttgtaatggttatgtgaaggggtacaaagaaatgcttcaaagtagtgatgaggagaatcctgaagtagcaaagtttagagagaaagacctcaaattcttacctaagatgaaattcctttttaagggtattattgctactggttttgcagcatatgcaccatctaaggattcaagacaatatgaaggattcaacataaaaacagaagagacaaatgatagcattgatgataacactgacatggaagtgaatgagcctgagatagacacgacaactcagaacatgtctttggcaaaggaaagtggacaaaggaagagaggtagagagggtgacaaaagaattggggttgctgccaagctttcctcacaattagatcgtattattcaaacatttgaatctagtgcatctgctcaagatccaactagcattactgcatgtgtagaaaagttgaaagatctactaggacttgagtgtggga

SEQ ID NO: 32448 - DNA, 417 bp, Glycine max
  Peptide Sequence Number=SeqID_149226
atggaaaagaaaagattggatgactatgaacctggtcctgttccttcaccaagagcattagatagatttgggtttgtaaaacaggatgttaatacttctgaaggcttagtcaagaatagatcagcctacgagtatgagagcatgagtgagtataaaaaatgtggccattggttttacctgtatttccatttacctctcattagatatagggaggagagaagggttagaaaatggaggaagatgattggggttggtggcagtgactggaagcattatctaaggagaaaacctcatgttgtgaaaaggcgtataaggaaaggaattcccgattgtttaaggggccttgtttggcaattgatatctggaagtcgagacctattgctgatgaaccctggagtttatgagaatattttttaa

SEQ ID NO: 32449 - DNA, 556 bp, Glycine max
  Peptide Sequence Number=SeqID_149227
atggttcatgttgttgcacagactccaaacacacttcctacaactcaagaccaaccaaatcctacctttgtaagggagtcaattcccactacccctgttagagatgcttcaccttcagcaccagatgattctgttacacctgagtacccaccagatccaaattgtgaacatattgttgatgaaaggcctttcattcgtgcatataaaggagagtttcaaccaacatatgggtgttctaatatcatatgggcaaaatttgatgaaccagctccaagttggttgaaggtgtcagttgacctttgcgataggtggtttggagagtttaagtcaaaggagtttcaaagaccaccaactgcttgggaggtgatgagaaaactaacaaatttgaagttgggagaatgggtcaatgacaagtcccgtgaatttgctgagaaatatcaacatcgtcgagatgaaatcttacaacgttcgacagaggaagacacatctacacaggattcccctaacactgttacttctgttaatgataatgaaatatatttgaatgttgttggag

SEQ ID NO: 32450 - DNA, 273 bp, Glycine max
  Peptide Sequence Number=SeqID_149228
atggagaagataaatcaaaacatcgtacaatcaactttgatgtacatttggttaaaaatagtcggtgaaaacaaaaagggtagagtccacaacatgggtcacaacttggagcttattagagggagtaatgagattattgagggaaatattgatgcaatcctccctaggaagggaccagccactaaagccatgagcaagagactccaagagaattgggttagagctgctgaagaaggccctagggttcttacgaacctcaggacagatttctga

SEQ ID NO: 32451 - DNA, 270 bp, Glycine max
  Peptide Sequence Number=SeqID_149229
atggtgacaaaaagggttaagaaattggagaaaataatgacacatgacaggtatcgtgttgcagaggttgaatggatacaagatattatgccaccagaaggaacaagagaaagagagactttacaacaacaaacatataatgcagctgaagatgctcattataaatttacatatcaacatcgattttttaaaaaaccgatgttggtactagtgtcagaacttgtaccagatttcattataacaaaacaactattattacttaagaactag

SEQ ID NO: 32452 - DNA, 315 bp, Glycine max
  Peptide Sequence Number=SeqID_149230
atggccaataaaaacatatcatccaatgaaacataccccccgacacttattcccaaaacaattccaaagctccaaaattccttaagggtaggaaaggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattgtggaagcaatcaatggggcaaaacacaccgaataaaatagatgatgatggctcaaattctcaccaaggataa

SEQ ID NO: 32453 - DNA, 486 bp, Glycine max
  Peptide Sequence Number=SeqID_149231
atgcttgagatgacactgacgaaggacactaagaataatatgatggcctttatagaccctacatggctacattacattgcagaagtagggagggaatgtcgggctgacgtggacacattcacaaagagcgatgttgactatatgcagagaccgactgttgaagtaattggtcacaaggcccatggacctgttccacagcctggatctatagtcattgctcgtgtcaccaaagtgatggctcgatccgcttcagctgatattatgtgtgttggaccaaagtcagttcgagaaaaatttactggcatcattaggcaaaatctaaccacagagaatattgttggtgaaagaacgactatgacggacgcagcgtccgattcacgaaacgatgcagtggtgaaagccaccaacaaattgaaagtcgtaggagatttcatatcatccgttcctgggatcaagatgggtgagttgtctctaggtgtttcatga

SEQ ID NO: 32454 - DNA, 345 bp, Glycine max
  Peptide Sequence Number=SeqID_149232
atggaatcatgtaatatttttactcgtacctatatccgatcaaagcgggtatttcctttcaaagtcagagcgggtttgaggcgatacctgtggggtgactcgccatttccattggtgagacaggcactgacatggacggtcccgccattgtcattagcgagacaggctaacatggacggtcctgcgattgtcactggcgatacacatgtgacagggggttaccgccattgtcattggcgaggcaagcacaggctacgcagtagaacactgaacagtagcaggctagggttcagcttttctgagcatatcgccattcgtaatggcgagataccttttgaccgttga

SEQ ID NO: 32455 - DNA, 457 bp, Glycine max
  Peptide Sequence Number=SeqID_149233
agaaagtacatataacgctccattaggatggtgttacggagataatattattgcattgggattactaaaaagtgctgtctttctggaagactcctatctctattctatagcagagcaagttgcaattaatgcattgaagagagaccatgaacgattcgttgttaaagatgccatgatctgccacggtactgcaggtgtttcatacatctacgaaaaattgtataaaattacctcgaatgaaaaattaaaggaatcatctcaaaaatggtttgaaactactctcgatttttactcagtagatgaagaatctcatggttacagaacttatgttggagatgatgaatatacaagtactatatcattactcaatggaaaaattgggatagcaattatgctattaatgcgagaaaacagtaatctagattcagattgggataatattttattattaaactaa

SEQ ID NO: 32456 - DNA, 354 bp, Glycine max
  Peptide Sequence Number=SeqID_149234
atgattgtctacctcatcacatacattctcacaccaagttcaagtaatcatgctcaagtaactgacgatgatcttcaaatagtctatggtttgaaatccgaaattcagatgaattgggttttgttgattgaagacatcatcctgaaatgtcgtcgccttgtggactatgagtttccatatgttgtgcttgcctctagattcattgattattttaaggttgttgtttccaatgaaattgttgactacaccaaagcctcttctgagataactaaaaggcatctcaagaagcttggtatgaggtatgccaaccatgaatggataatggctaaaggagcttgttgcaagaaacattga

SEQ ID NO: 32457 - DNA, 387 bp, Glycine max
  Peptide Sequence Number=SeqID_149235
atggctttgtcatcagtcaatgcaattgtgtattatgatggcacgatcaaaacaactaaacatggttcaacatttgctattggaaacaacattagcctaccaaatggtgaagtggtgaaggatatacattttcgatttcctgtatcatttattggtgattgtggcaagtacacaacatgcatgttgcacgatgatgaggatgtaatgactatggttttcatgttcatagacatctccaagctcacatgcctggagttgtatattacctccgtagactcacccacacaaacatgtgcacatccaccactaatttctagcaactctttcaattatgaggatttggatgaatacctcgctcaagcaatgaaccttgaatcaagcttttga

SEQ ID NO: 32458 - DNA, 252 bp, Glycine max
  Peptide Sequence Number=SeqID_149236
atggcatctacagtcggtcctcttctttggaaacaacaccttcacagatttggagaagtatatgttgcaaggcttggacaagttaaaatcgaaaataatttagtgattactttggttgaaaggtggagacctaagtcacacacatttcattttcctattagtaaatgcacaatcaccttggaagatgttgctctacaactaggtttacgcgttgatggtagaccagttattggcccaacatattatgattga

SEQ ID NO: 32459 - DNA, 195 bp, Glycine max
  Peptide Sequence Number=SeqID_149237
atgtttgttaaacctttccattgccataacatagttggaattttgggtttacaatgtctctatgcctgtgaatcctttccggataccacatgtttgcactgcaacaactgtgcagatggaacttcttcagatgatgggtcaccaggtgataactcagaagataatctctttgtgggggtaactattgcatcttga

SEQ ID NO: 32460 - DNA, 513 bp, Glycine max
  Peptide Sequence Number=SeqID_149238
atgagttccgaaggtggttttcaagttttagaactatccaaagtgccaaccttgatagcacacatcaaaagcattaaaggatacaccaccacgtaccgcaaaacatggttaacaaagcaaaaggttgttgaagacatctatggcaactgggaaagatcgtaccatgatctattaagattgttgcaagctatgcaacaatttcttcctagtatggtggtgggaaaggaaacactaccaatgccagcacaaggaggccaaccagtaaaggattgtgtcatgggggcccttcttgtggcagttgcacaagatgacaacaataaaatccttctgatagcctttgttgttgtcaagagtgaatcagtggaagcatggttgttcttcctccgaaatctaaaaaggcatatgaagcctatgttcaattactactacaacatgttgagggaggaagcagatgttgaccgagcaattaagtggctcatcgagattccgcgagaaaaatggaatctcgcataa

SEQ ID NO: 32461 - DNA, 501 bp, Glycine max
  Peptide Sequence Number=SeqID_149239
atgcgggtagcgcaggctgtgctgatcgagccaggtgcagccggaaggcagcggatgatggtgcagcagcaacagcgtatagcgctcggggtgagcatgcaggcagcgctccatccactcgagctggtattcgctcaattcgccgtgcggcacgccgaacacctggctgtccagcatcagcacctgccagctgtcgcccagcagcacctgtttggaaggcgcgatgccggcggcggccaatgcatcgaccatcgccggttgaaaatcatggttgcccggcagccacacgcagggagccggcaattgcgcgatgccggcggcgaagtggcggtaggcctcttgcgaatgatcctgcgccaaatctcccgtggcgacgatcaaatcgacgtcgcggcgctgcgcctggatggcgtccagcaccgcgtgatagctgcgataggtattgatgccgagcaacgtctcgtgttcgccggcaaaaaggtgggtatctgttatttgtag

SEQ ID NO: 32462 - DNA, 249 bp, Glycine max
  Peptide Sequence Number=SeqID_149240
atgagaacatctatagcttgggactattttgagaggtttgccaatgatgaagggatttcaaaagtaaaatgtaaaaagtgtggtaaagagtatgtggcaagaaatgatagtgggacttcaaatatgaaaaagcatgtgaagatatgtgatgtagatgggagaatatcttcctatccacttttggatcaagaaaactatacggacaaggtttttgagcttgtttggatagagtatttgaaaggagattaa

SEQ ID NO: 32463 - DNA, 366 bp, Glycine max
  Peptide Sequence Number=SeqID_149241
atggcatatgatcttggaatcttacttggaggcgggaatggtttgctgggagtcccagcatgtacaacaactacaatgaaaactagagagggtcaacctacatcatggaagatgccacaagtggatatggttattcaagaactgagaataggagatggcgaggaagttcaatggaacaagatatgggacattgaaattccaccaaaaggagcacacatgatttggagggctatgttagacagaatgccaactagggacaatctgctgcatagaggaattaatctggttaacacaaactgtccaatatgtcatcagcaggaggaatctttcaaccatgtattggacaccatgatgtatacaatataa

SEQ ID NO: 32464 - DNA, 378 bp, Glycine max
  Peptide Sequence Number=SeqID_149242
atgggagatgtgctcacaagtaaaaattcaacaagaaaacctccctcaagtcagtacccctctccaccaatttaccttgttcaccaacacttcctcccttatggtttagaagccacttcatggatacatgatgttcatggggtttctatcgaagaagagaaaggaaaaggaggatgctttcttcctaacttatttgtcaccttaagcaacaataagtgtcaagctaattacgttactatctttctagatgttgcttgtttggttgaaaattttctgttgaacacaaagcatggcacctccaacacaaaagaatttgttgaaatctatgtttccctagccaagaagcaaggtgttactaagagcgatatggcatcttag

SEQ ID NO: 32465 - DNA, 99 bp, Glycine max
  Peptide Sequence Number=SeqID_149243
atggacactcatctttgtgtgattggtgatcctatgaatggagttcaacagagttgtttcgtttctcattcctatgatgaggtgtattgtaaattgtga

SEQ ID NO: 32466 - DNA, 334 bp, Glycine max
  Peptide Sequence Number=SeqID_149244
cactctgccttcactcactcttcactttgcattcactcttggctggctcatcgaagtgtctagttcgttatcgcagatgccacatcatgggcagtcctcggtcaccaactcgtcgttgcaggatttcttcaccaccacctcatcgtcagtagttcgtggtgctcagttggctgtctgggagtcctccatcaccaactcgtcgtcatcgtcacataagctgccgcaaagttgttgtagtggtcgcgtagacactgtagatgtctcgttaagcgaagcatatgcgcttaacgagcaacatccgctaagcgagacatcagtttgcttagcgaattaa

SEQ ID NO: 32467 - DNA, 177 bp, Glycine max
  Peptide Sequence Number=SeqID_149245
atgacgaagaagtcaccatacgggaggacctcttggtggcttccgatgacacaaagggataccaacgatgacgatggtagtgtcatcagaccacaatggatgacgatgaagaagtgctcaaaaccgctgttttggcagtgcctgaattttgccttttggggtatgagggatttgtga

SEQ ID NO: 32468 - DNA, 2193 bp, Glycine max
  Peptide Sequence Number=SeqID_149246
atgtatacctggactaatggtagagtttggagcaaactggaccgggccctctgtaatcagctctggcttaactcctttgaaaactcttcctgccaagtggtgggttttgaatcaatttccgaccacgcttctttagtggtgatcacggaggtgttggtgcccagaggtaattccccctttaaattcaataatgcaatcgtggatcacccaaattttctgagcattgtttcagatggctggagtcatcaagtttctggatgtttcatgtttaaagtttgcaagagactgaaaactcttaaagctcctttgaagcttctctttaaacaagaattcagtcacattgctaactggatggaacaagatgaagtcgaatataatagacaactcaattccctccagaagaatcctcttgattcatcccttctcatggctcaagagctgcatcatcctgcctctttagtagtctgcaactcgggtcctaaagttcccattgattgctttgcctctttacttagccccatcaccaagcaagatgtctggaatgttatttcagggatggacaacaataaagcgttgggtcctgatggctataataccttattctttaagaaggcttggaacatcataggggatgacatttttgttgttgtcaatgagttctttatgtcaggaaaactactaaaacaaatccatcatgctctcattgctcttattccaaagtctgaccaagcatcccaagtgaatcattttagaccgatctcttgttgcaatttgttgtacaagattatttctaagattttggttaaccgaatagccccaatgctggagcatattattggtgcatcccaatttgcatttctaaagaataggaaaatgatggacaatattttccttgttcaagagctccttcgcaaatatgctcgcaagagaatttctcctagatgcctcttgaagattgatttacataaagcatacgattccatttcttgggagttcctagattggatgcttaagtctgtgggtttcccggctcaattttgttcctggattatggaatgtatcactaccacttcctttagtgtggtggtcaatggatccatctatggtcatttcaaaggtcaacatggattaagtcaagtggatcctctttccccttacctatttgttctttgtctggaacattttcccgtgatcttcatagcctcaaggctttcacacttggccttcgcagatgacattatgctcctgtccagaggagacttaccttctgtttcagcaacatttgctaagctccagcacttttgtaatattttggggctatctatcagcaccaacaagtcatccatttactcagcgggagtggaccaagatgttctttcagatatccaacaactcactggatttagtttgggctgcttcccttttagatacttgggtgttccccttttatcttccagactcaatgtatgtcactatgctcccctgctttctcatattacaagccttattcagggttggagcagtaaaactctctcctatgcagggaaggtggagctaattagagctatcattcagggaattgccaacttttggatgggtacctttcctttacctcaatccgttctagaccgtatcaatgcttcctgccgcaactttctttggggcaaagttgagatgggtaaaaataagcccttagtagattggtctgatatctgttcccccaagaaagaggggggattgggactcttcaacctaaaagactggaactttactctcctttcccgtattctttgggactttcattcaaaaaaggactctctttgggtccgatgggtccaccataattattttaaaggagacaatgtttgggacttcattagtccagcttcagattcagttttgattaagaagatcatacatatcagggacattattaccatcaaagaaggcaatgtggaggctgccaagcaaactctcaactcttggagtagcaatgagcagttgcttgctgggaaggcttatgactacatccgaggggtcaagcctgctgtcaattggaattttgttgtttggaatcctgccattcctcccaagatgtcttttatcttatggcttgctaccaagaaccatctgctcactttagaccgagttgctttcttgaacaagtgtctactgtcctttttgcaaaattga

SEQ ID NO: 32469 - DNA, 201 bp, Glycine max
  Peptide Sequence Number=SeqID_149247
atgactgttaaggttccccagcccaagctcagaacaacagtcagcaaaatcctacatctcataagcactgatgtcaacgccattgaatcggtcattgggagaaaggatactgttgaaacctcctataaggagccaggggaaattcagagaagcactaatgttgctcaggttaatccacagagaccttctagccatcactga

SEQ ID NO: 32470 - DNA, 294 bp, Glycine max
  Peptide Sequence Number=SeqID_149248
atggtagccataacccctgctaggtttcctcaacctccatttttccgaggatacgactcgaacgcaatgtgtgcttatcatggaggagccccggggcattccattgagcattgtatgaccttgaagcgtaagctatttctcgtccttggaaaattctttttgcaagaatcaaccgcttctttcattcttccttgctaccaggttgtgaaaacaaagatggatacctcagagccctacactggggcaatgaggggcatcatgcatgaacctcaagtgaacctaggggcagattag

SEQ ID NO: 32471 - DNA, 222 bp, Glycine max
  Peptide Sequence Number=SeqID_149249
atgcctggctgtcatgcagaagacgactcatccacgaaagaatacacctatccttctaatggctctgattctaatcctcaagttggcaacggagaggcttccatgccttggattaatctgttcaaggacaacaaaaagccttccaagggatttggcctgaaatttgtagatgcaattggctttgatgttttgatgatgatcatgatgatgtgttgcaattga

SEQ ID NO: 32472 - DNA, 249 bp, Glycine max
  Peptide Sequence Number=SeqID_149250
atggcgactttgctctgtgaatcccacgtggcctgcaaaccgccattggtattggcaattcagggtagcggtgcagctacggtggtgctgcagggtggtgcaggatgcgcagaaggccaaatcgcaagtaatggtggcgatttggctgttcaaatttttttttataaagcaatgcaggagcaggtgaagtttttgttcttgtttggcctacactttttggttgcttgtcataaaacgtatttgaggtaa

SEQ ID NO: 32473 - DNA, 537 bp, Glycine max
  Peptide Sequence Number=SeqID_149251
atggagacacagccttatagactatgtagcaggcagtttcccaggaaaaaagccctgccagaatgctgtcagaaatggggcgtaaagttctcatattctacccatgaaagcgattggcttgtattcaaattcgattcagaagatgatatgaatcatgtgctatttgcaggcccctacttcatcttccaaaggccccttttactgaaagtcatgcctcatttcttcgattttgggcctacagcaggttcaccctctgttcaatctcaagatgttgaggtggtagcttttacagagaccaatcctaataatccctctgggaaatccaaggaagaccaggttggattgtccactcaaccttgcatgcagcagccacaagccactgataatattcctactctccaaactccttttgatatttctggagttgagaattccaaaacttctttgcatcaggactcaactgaagatcctggtgatgggtttgttcgggtaaaaaccaaaccccgaaaaatagggaagaaagtgaaaatacagtag

SEQ ID NO: 32474 - DNA, 640 bp, Glycine max
  Peptide Sequence Number=SeqID_149252
atgggttctcggattcagcttctgcctatttgcttttggctgcacttgacatgcttcagcttcttttttggtagcatagtgagtgtgagaggagatgcaactgtgcaagggagtgttgccattgatggcaaggctgtgattggaaccattgatgaggattttgtgtgtgcaactttggattggtggcctcctgagaaatgtgactatgggagatgcagttggggccttgcttctcttctcaatctggacctcaacaacaagatttttttaaatgctgtgaaagatatggttgcttctgaatgtgctgcagcattttcaccgttgaaacttagattaggtggaagtttgcaagacaagctaatatatggcactgaagataatcaccaaccttgtactccttttgttaagaacccttctgagatgtttagtttcacgcaagggtgcctcccaatggatagatgggatgaacttaactacttttttgaaaaagcaggggctaagattatctttggattaaatgctcttgctggaaagtcaatacacggtggttctgcaaaaggaccttggaactacaccaatgccgagtcctttattcgatacactgttagaaatggctacaccatttatggatgggaacttg

SEQ ID NO: 32475 - DNA, 267 bp, Glycine max
  Peptide Sequence Number=SeqID_149253
atgcatggtgcaaacaaactgccagtgggattggcgggcctcagagctaggcgtcaggggcataggccatgcagcaggccatgcagctacgcttgcattgctttcttcttcttcttcttcatattactccagttcttcatattactccagtacattgcagttcttcttgttttctttctagacaatgcttgttcctgttactattacgtggtttctcctcttgcgagctattacgtggtttttctagttggtttagttagaatgtga

SEQ ID NO: 32476 - DNA, 1410 bp, Glycine max
  Peptide Sequence Number=SeqID_149254
atgaagttagagggttgtgaatcatatcacaaatcagccaatactaactaccgtggttctaacttctgctctgctgatggctgcacgtttgcatctagcgggacagagaaaagaaatgaccggattcacaaccctaatgggcctaaccctaaaaggcagtgtattaatgaattatgccggatgaggttggatgttccacttctcgatcagcttgttagagagtattgtgtttatagaggcattgttgactctgcatctgggaagcaacctatcccagaacctgtgaaaatcaaccaacaagaccctgggtattgctcatcaagggattgttctctcgagctagattgtaatgccagcaagcattctgatggtgaaacttctgttaccaatgctcagatggatggttcccctgaaaataactctgatgtgacaagcatgagacgaattgattttgaagtgcgatatgcttctgaacttgcaagcattcatgaagactgtagtaccagtggatcacagcaacatgaagatgcaagtgttttgcaacgatgcagattgtctgggaatggagaaaggagcaagcgcaagcggtggagaggacgatatgatggcaatagttacatgtccgatgcttctttggaagagaacagcaaacaagagcatagcattggtactgttgtttcaactatattgaaggagaaacagggctctgaaaagctttctgtacatgatattaataatgtggaagatagatatgagattctgttgggaatgaaggaattagctagcaaaggaatggctgctgaagcagttgaggaagttgaattcctcaagttggtcagctctggtgattataatgctgctttaaaggttgcttgcacccatttgggtcctttagctgccagtgatcctgctttattaaagccattgaaggaaactcttttggctttactacgacctaatgaagatgctcttggaaatgcattacctctacatgctctagctgcttctctccaggttgcagttggtcgtaggcttggtgttgaagaacctcaactcatgaaaataatgcgagctactctttatactcataatgagtggtttaaacttcaaatgtggaaagatcgttttgaaggtcttttgaggcttgattccttgaaggaagccaacactcccttccttgcaccagtcactacatccaaatcgtatgctgatagctgcacaaatggatcttctcattttcaggccacagtatcttcagggaccaggatgtcagaagatggtagtagtccaactcaagcatcttcaagggatgtcatctgtgacgaaggtgcaatacttaaagtaatgcaatacattggtgaagtccttttgcaattgcagaggcattatgttcaacagctctacccatag

SEQ ID NO: 32477 - DNA, 264 bp, Glycine max
  Peptide Sequence Number=SeqID_149255
atgtatcagtatcctttcgaaggtcatgacattgatatgtctgcaagcgaacattcgtttggtggtgttgcggaaacacatcctcatttttcatggccgaccatgaccccttcgcagcaacatgatgccccaatggcaacacctaatgccccattagctccgcattgggatgtacccgaagcaatacctgatatgggtgacttattaggtgttgatttgcgtcacgagttttctgcagaggctgagcaacaagggcggagatag

SEQ ID NO: 32478 - DNA, 249 bp, Glycine max
  Peptide Sequence Number=SeqID_149256
atgcatgcatggtgcaagcaaaccgccagtgagactggcgggtttgctactggtgaaggactcgccactcacagtggtgatatgcacatggcaagtgggaaccgccagtcaaactggcgagttcctggttggttcgtagggttgctttttcaggtggcaagtggtgttttagctttttcaggccaaaaggcaagttgcaactgccattggcgagttaagggcaagttgcaactgccattggcgatttag

SEQ ID NO: 32479 - DNA, 1330 bp, Glycine max
  Peptide Sequence Number=SeqID_149257
atggctacaccacctagctctcctcctcctcctcctcatcctcctcttcctactgatgcagcatcacattccccttctatcttgaagcgaaaaataaaatccaaacgcatgagatcattgtttattggaccaattggggcagagagacccctggtccatgtggatcctgcaaccgggaaagccgacagtcccaacagaaaaaagttaaggacatatttggggattgtcgctcgagataaggtggatgtgacatacgagaatgggaaacaagtccttgctacccaaaaggatttgatatgggaggatattcaagctgaatttgatatccctgaagcatctaatttgaggaccaaaaagaaaatacttcagaccaacgacatcagcaaagagaagtggactcaattttgtcagagttgtagagacccttcttgggaggtcattcagaaacaaaacactacccctcatgtgttgtctcgtgggggttatgaatatctagaaaacaaattgatggaggagaagaaaaagaaacaactagaggaagcagctcaatccagaagtactgacaccatcattgatcttccatctcctatcagacgacacgtgaagtggaagaaggcctgcaccaagaaatttggtcaaatgacgtctgaggcagcaaagaaaattgatgaaaagattgagcatgcctcacaaggaagctttattgcccacagacgtcaagatgtactgactgtggccattgggcaaccagaacaccctggtcatgtctgtgctgctagagtcggtgtcacgattaaacaatactttggaccggctccaaggatctcccacacatcttcgtccatggctcccgaagacttggagcagctgacgcaaaaactcaaggaccagggactcgcaatgcctcctaagcctaaggttggtccttcagctactcatgtcagcacaaaggagagttgtgttgatccctcagggaacgacttagacacgggtgagtcagagaaatatggattatacatcgaagaaaatcctcctcgtttggttgccattggaagactttatgaggggtcgaccaccgttcacaacatccctttggccaacgatcaagtcaaggttggtgttgaggaagttcgagatgcagatgctcacattcctggagctgtgggaccagggaaacctacagataggtcagatcatgatgtcgatgatcccttatatctgatgacattgatcatcccacaactttttctaaagccgatgcaggttatgtgggatgctaccatgtttggggtgtataatgacaactttcccttgtacataaagcatgaag

SEQ ID NO: 32480 - DNA, 496 bp, Glycine max
  Peptide Sequence Number=SeqID_149258
atgtctcaaagttttgatatgattggagctattgatgataacaaagaaacattcaagcttatagttcgaattgtggaccgggtttgtccaagcccggatacagtccatgccatttttaagaaagatgatatggaaagttgggaagttggacttaaggaagggaaagcgcaagtcgatcttgctgaaattcctcttcaatcatacgagtttatgagttttgaatacatcactcatggcaattatgatcctattatgttgattgatgtaattggggttgtagaggaggtcaaatttcagcttcctaatgggaatcctacaagattagttttaaaccttaaagatctgaggttgagttctgtatgtttgggagaaccatcaaatgtcagtcagtccctcagtatagggcaatattctcaggattctgacttttcggagcttgatcgctttttgtacaagtccaaggtccttagtatttcaaacattcgtgatgctgctg

SEQ ID NO: 32481 - DNA, 2064 bp, Glycine max
  Peptide Sequence Number=SeqID_149259
atgcaggcgagacaacggagtccgcgagggttttacgcgtcggagtaccgccagcagcgtgacggggggctgggaagaggccggagaggcggaggtgcctgtggcagcgacattttcgtcgaggcagggcgactcgcggcagagtatttggtctcccaggggcagctgccgcccaacgcgctgccgccgcccaagtggcagaaccacaagactccggcagagggcgggcggcagtcggcgctggcgcggctcgggagtgctgacgggaggaggaaattgggtgggtttgatgagttcgggcagaagggggggaggaggagggggagtttcagcaggagcaatgggatggattgggggagagagtataggaggaacggttcttggtctgataggtttcgcggaggtgccgtggatgttagggatggtgaggatgatgattatgagagtggtggatttagtgttagacaccaggatgaggaggatcagcaccagtaccagcagcagcagcatcagaatagtgttgatgatgcttccatgaaatcaaattcgaatttgaatgaatttgcgccgaggagtgaggatggtggtgatttgaatgataaggatggggataaggagagggtgaatgctgaattgatgggggtgaagcagagtggtatagggaaagatgtgagtgatgtggatatggaggttggtgttggaaatgatttggagagtgtgagcgttggggttaaggaggtgaaggatgggagtggtggcgatgatgatagtgagagattgaggaatgtgtctgatcagtggagtgatcaggagaatagtagctctggcggggttgttgctgatttggtttctttgtgcaagtctgttaaggtgcccaccaggacgcgctcttcggttacgcgcaagaatttgaaggctgggaataatggagataggagtgggactgcacaagatgttggggatcttcaaggagctgaggaagtggtgcctgaaaatgagtctgttaaaggctcctcatcgggtgatttgctaggtgagaaaagttatgatatagtatatgttgacgtagatgttgccgaggtagaacctgttcatgctactgaggatgtgaaagaattagatgctgtgtgtaaagccgaggaagttctatctttaggatgccaatctggtcaggatagaggttttatgcaggataccaaccaagagtctggtgctacactaccggggtatggaggttgcagttccttggctgaggaacatggtgaaaaacgtgttgccgaaaatgatgatgatgtgagggaggacaacaagaagctgagagaatgggtgccttcccttgttcctaagactgggggtggggggtactttctgcatagtaacccaattgaagtgaaagagagctcaggagaagatgaaatttcacatattgacaaagtgactatagcttctgatcaggggagactgatgagtagtggttctcagttcacagaaggagatagaccctttcttcaatgttcagaggagaagccttctttgccgagttcgtttagaacttgtgatctgaatctcattgaagcgtctgaagtgcatgaaaatcatgttgatcatccagttctgctgtacccccctgcggtttctgaaacaaagaaagctgtgccaattgacatagatctgaccatgagtcatgctagtgtatcagggaaattcaatactcatgcaacaaatggcaaagagattgaagtaattgatttagaaaatgatgattccattcaagaagagaagtcaatcaacagtatggatagaaagacagagactatgtttcctggccttgaaggtttttccaaccatgctcaaaatgctgctgacatgcatgatgttcaggatggatatgggcttatgatatcagagttgcttgggccagatttccctaactgtacttcagtacctggtgacataaactctgtgcacaatgaaatgagccttcatggtggaacggggacacttgctgaggatgattccatatatatgtcacttggagaactaagtatgccagatttttattaa

SEQ ID NO: 32482 - DNA, 528 bp, Glycine max
  Peptide Sequence Number=SeqID_149260
atggacgtgcagacgggcgagccgcgctttggcaacacccatcagggctacagcgatacctcgtgctggtcgcgcggccaggcatggggcatttacggtttcctgctcagctatcagcacaccggtgataagcagatggttgagttgtcacgcagcctggcgcattacttcctcaaccgtctaccggaagatgacgtttgccactgggatctggcgctgctcggtaccgacgccatgcgcgacagttcagcggcggcgattgccgcctgtggactgctggagctggtcaaggcgctgccgttgctcgacgcaaaccgtgcgtattatgaagagatggcgctgcgtattgcgctgtcgctgaccgataactaccttgctcacgacgacgatccgaccgaagggctgctgcagcactcggtttatcatatgggcagcggtaaaggcgtcgatcagtgctgtagctggggggactatttctatcttgagctgctggcgcggctgcgacagatctggcacccgtactggtaa

SEQ ID NO: 32483 - DNA, 2130 bp, Glycine max
  Peptide Sequence Number=SeqID_149261
atgtcttcgtcgaaagatgcagacccaagcctgggttacctgactcgcaaggacacggaggttaagcttcctcgtccaaccagggtcaagaacaaaacccccgctccgattcaaatcaccgccgagcagattctccgcgaggcacgtgagcgccaagaggccgagatccgccctcccaagcagaagatcaccgaccccaccgagctcggcgagtaccgtctccgcaagcgcaaggagttcgaagacctaatccgccgcgttcgatggaacatcggcgtctggatcaagtacgcgcagtgggaggaatctcagaaggacttcaagcgcgcgcgttccgtctgggagagagccttggaggtggattacaagaaccacacactatggctcaaatacgcagaggtggagatgaagaacaagttcataaaccacgcgaggaacgtttgggaccgcgccgtgacgcttctgccccgggtggatcagttatggtacaagtacattcacatggaggagatgctcggcaatgtcgccggtgccaggcaggttttcgagcggtggatgaagtggacccctgaccagcagggatggctctcttacatcaagtttgaattgaggtacaatgaaattgagcgcgccagagggattttcgagcggtttgttgagtgccaccctagggttggggcttggattcgctatgccaagtttgagatgaagaatggcgaggttgcgaggtcgaggaacgtgtacgagagagccgtggataagctctccgatgacgaggaagcagagcagttgtttgttgcttttgccgagtttgaggaaaggtgtaaggagactgagcgtgcaagggctatatataagtttgctcttgatcatattcccaagggaagggcagaagatttgtatcgtaagtttgtcgcatttgagaagcagtatggtgacagggaagggattgaggatgctattgttgggaagagaaggtttcagtatgaggacgaagtgaaaaagaatcctttaaattatgattcctggttcgattacataaggttggaagaaagtgtgggggataaggagagaatcagggaggtctatgagagggctatagccaatgttcctccggctgaggagaagcgctactggcagcgctatatctatttgtggattaattatgcactctatgaagagcttgatgctggagacatggagcgaacaagggatgtgtacaaggagtgtctcaatcagatacctcacctaaagttctcgtttgcaaagatatggcttctagcagcccagtttgaaatacgtcagctgaatctcaaggccgctcgtcaaatattaggaaatgccattggaaaggctcctaaagataagatttttaagaagtatatagagatagaactgcagcttggtaatatagatcgatgcagaaagctgtatgaaaaatatctggagtggtcgcctgaaaattgttatgcttggagcaagtatgcagaactggagagatctttatctgagactgatcgagctcgagcaatttttgagcttgcaatcgctcaaccagctttggacatgcctgagctgttgtggaaggcatacattaactttgagactgctgagggtgaatttgagagagcaagagcactttatgaaaggcttcttgatcgaacaaagcacttgaaggtatggttaagttatgcagaatttgaggcaacagctatggatatggacagtttagacttaccagaagatgaacaaaagaagcaatgcattcagtgtgctagaagggtgtttgagcaagctcttaactacttcagatcatcagctccagatttgaaagaagaaagggcaatgctattggagaaatggctcaacatggaggctacgtctggagagttgggtgatgttagcttagtccagtctaaactgcccaagaagctcaagaagagaaggcatgttgccactgaagatggttctactaggtatgtaactaactctgtttatctttcgactagttcccaaggaattgaagaattcatcgactatttattccccgaggaaagccagacaaccaatctcaagatcttggaagctgcttacaaatggaagaagcaaaaattgtcttctgatgattaa

SEQ ID NO: 32484 - DNA, 183 bp, Glycine max
  Peptide Sequence Number=SeqID_149262
atgaggccaaagctgcaacttttcatgggcactaaagatggagaaagaaccatttgcaagcttgctaaagggatcttgctccttaagcaagaggttgggggtttgattcccagctcttttgaatggagcgaacctggttgggaggggtctactcttttgcctttgtaccctggaggagattag

SEQ ID NO: 32485 - DNA, 1032 bp, Glycine max
  Peptide Sequence Number=SeqID_149263
atggctgcagatgatggtgtgaaacctccaactctcgagtttctcagcatctgcaagtctctcctcgccggcggagttgccggaggagtgtcacgaactgctgtagctcctctggagcgattgaagattctgctgcaggttcaaaatcgtcaagatataaaatacaatggaacaattcaaggcttaaaatatatatggaaaactgagggttttagaggaatgtttaaaggaaacggaacaaattgtgctcgtatagtcccaaattcagcagtgaagttctttagctatgagcaagcttccatgggtattttatggctctatcagcggcaacctggaaatgaagaagcacagctcactcctattctgcgtctaggagctggcgcatgcgcgggaatcattgccatgtctgccacttatccaatggacatggtgcgaggaaggctaaccgttcagacagaagcatctccttgtcagtacagaggaatttttcatgctctttcaacagtcttccgggaagaaggccctcgagctttgtataaaggctggctaccatcagtcataggagttataccgtatgtgggtcttaatttttccgtatatgaatctctgaaagactggttgattcgatctaaaccatttgggatagctcaagactctgagctaagtgtgacgacaaggcttgcatgtggagctgctgctggaactgttggccagactgtggcttacccacttgatgtcattcgccgaagaatgcaaatggtgggatggaaagatgctgctgcttcagtagttgctggtgaagggaagagcaaaattgagtatactggcatggttgatgcattcaggaaaactgtgcagcatgaaggatttggagcattatacaagggcctagttcccaattcagtgaaggccgagaaacattttgattgcaaactccattcttttcaggttgtcccttctatagctattgctttcgtgacatacgagatggtcaaggacattcttggtgtagaaatgagaatatctgactga

SEQ ID NO: 32486 - DNA, 609 bp, Glycine max
  Peptide Sequence Number=SeqID_149264
atggcagaacgtgaagaggctagcttatatggcgacgttttggcacatacaaaaaagacaggacagtctcacaggattcttggcagcgctgaatgcattatggagaaacttgatttggcgacaaaatcatcatcgtatcctcctagtaataatgtttgggactgtggcagcacgctgtatgactcgttcgagctcaactccttcaaacgccaactcgactcagctatagctaattcccctataagtagaaccctctccatgcctcatttaccggaacgttcacttcacgcgctgtcagagcaacctgcgacggtcatgtcccgaaagtccttcaaaatttctcgctcctttcagaaactccttcgctccgttttcaagtccaacaataaatccaccactacatccactagtttgagtttccaagtgccagagaaatactccagagaacgtttctacgttgtttatgataagtctggaccggttctctccaccatcccagaagttccggaatttgagatcggtgcactttcgccggagatctcttccttcgtcagaaggtcagcgtcggagcgcttcactcccaccgcaatcggtgtttcctgcgcttaa

SEQ ID NO: 32487 - DNA, 267 bp, Glycine max
  Peptide Sequence Number=SeqID_149265
atggcattcttaggagagacttcgtcccagacgatcgtgaactcgaggttggcattcatttttcaaaatggaaccgtcattcacaacgagtgtggggtttattttcaaagttctggtccagtgcccatgcgagtaccaaacctatgcgatttttcaactctcaaaagcagaatacacaacagtcttcggctaaacaacaatgaagttgtggatgaaattcattaccggcgaccagtggaagatacagaacaacagatgcaattttaa

SEQ ID NO: 32488 - DNA, 255 bp, Glycine max
  Peptide Sequence Number=SeqID_149266
atgaccccttcacagcaatatcatggcccaattccaacacctaatgccccgttaggaacacaatggaatgtaccgggacaaatacctaatacgggtgacttattcggtgttgatttgcgtcatgcattttctgcggtggctgacgaagaagaagcagggaggcatcggggcagaagaaatcctgatcgccaagcacgaagatgggatcgaccatgtggcacatcctcacggcatcatggacaccaaaatgaatga

SEQ ID NO: 32489 - DNA, 2595 bp, Glycine max
  Peptide Sequence Number=SeqID_149267
atggaacagttccggcatataggagaggtggttgggagtctgaaagcgcttatggttttgcgcgatgaaatccaaataaaccaacgacaatgctgtttgatcctggacatcttcggtttggcgatggagacgatcgcggaggagataaggcagaacctgaagctggaggagcgtaacacgaaatggaaggctctggaatttccgctgcgtgagctatgcagggttttgaaggagggagagctttacataaggcagtgtttggattccaaggactggttggggaaagccctcaccctttctcacaacagagaatgcgtcgaattccacatccacaatcttctctgttatttccccgccgtcatcgaggccattgagaacgctggactggtgtcaggctcggatccggacgagaaggagaagaagaaagtgatgctggctcggaaatacgacttggaatggaacgaccccaagctgttccagtggaggttcgggaaacagtatttggtcccccgcgatatttgcaagcaattggaacacgcgtggagggaggacaggtggagtctcgtggaagcaatcaaggacaagaagaagaagaagaagaagaagagcgagcagcgcctagcggatatgttgttgaagaaacttcttaatgggtcagagattgtcccaattgaggttcttattgggtcgaatgattaccaagttagacgcaggttgggtcgcggtggtaaggagtttaaggaaatccaatggctcggacagtgcttcgcgttgagacactttcagggtgagagacaagcgcacgaggccgaggtttccactctgctctcattatctcaccccaacatattgcaatacctctgcgggttttacgacgaggagaaaaaggagtattcccttgtgatggagttgatgaacaaggatttgtggacttacatgaaggataattgtggtcccaggagacagattctcttctctgtccccgttgtggtggacctcatgcttcagatggccagaggcatggagtacttacattccaaaaagatttttcacggacaccttaacccttgtaatattttgctcaagccaaggaactcccaagagggttattttcaagcaaaggtttcagggtttggcttgtcttctgtgaacaatattaacattaacagtgatgctcatgaggaccacgaccctttaacttggtttgctcccgaagttctgacggagttagaacaaacgccagatgcttatgctaattctacttgtacctcggagaaagctgatgcttatagctttgggatgatatgctttgagttgttgacagggaaagtgccttttgaagataaccatcttcgaggagccagaaccagccaaaacattaaagcgggtgaaaggcctttgtttccttaccgttccccaaaataccttgtgagtttgatcaaaaagtgttggcaaacagaccctgctcagcgtcctacattctcctccatttgtaggattttgcgttacacgaaaaagttccttgccatgaacacggagtcccatatcatgaacccagaactcaacaaccagattgagcttcaggcccctcctgtggactgctgcgacatagaaacgacgttcctaaagggcttttcaatggagaggacgacatctggtgtgttcgctgtgtcgcagataccctacgaaatgtttgcttataaagttgccgagaaattgaaaatcaatcccaacaacagcagtaagtgctgcgagcaccaaaaggaggagccctcttcgtgtaggagtgaaagtgatgagcaaagtgataacgcatccactgtggaagatccgttcccactactaacctctccgacatcagtttgcggtgacgcacggtctgtttgctcggaagccccgttcaggaaaactgttagaatgaagaaaccaacacccgtaaaggccaacaaagaacaaggaactccaaaattgttagtgacaaagtcattaccatcatctttatctaatcgagttttaaggactacaaaggtgaatcagtcgtcattggcaccaagcactttgagccctgcagctgcagatagaagacgacctcccgtagtctctgacaaagggaatcaatcaccactagtttcgagctcagtcaggagaaaaaaatatgacggaagcttgtcggattctaagggcagtttaaggctggaaaaaagggatcagccaccattagcattacaaggtagttcaaagatgaaaaagtcacaactgaagttgaacccttctttgagcccaagaagactacgacgttccaacactgagaccaatttgaaggggctcacgccgacccatacgttatgctctcagagaatatgcacaaacagaagtcgtagttatcatgtctcagatttggataacggtttaaagatgacaaaaggtaggttgtcatcgttggcattaagcccctatatgagaagaaagaaaacaagcggccatgtctctgactccgagagcagttttgtgaagaaaagaggaagtctttcaccattcgcattgagccctttgagtccttatgtgaggacaacctgtggccatgtctcggattaa

SEQ ID NO: 32490 - DNA, 1686 bp, Glycine max
  Peptide Sequence Number=SeqID_149268
atgcatttggaaaatttattccaggaggaagaggggcatgtgttgagaagggaaatccttcaatctgaattgattaatggattgcaagagttgtttagtgaggaattgtcatcaagtattgaccaagaagatgcagaatcagaattgttattgcatttcctcgttttgttaaaagagcagaagcagaacaatgccttcaaactggtagaagatatcaagtgcttggaatcagatattgaagaggtggataggaggcatgactcaagaaaatccttggtttcctctggcttgcagaatgattactcttgtcagaaagagattatgcctcttaaaaaggaatctttgagtttggaaatgctgccctcgatatccccaatctctaattcaaatgaagtgagattgatgagaaatatatgccatcttgaaagtgcttatttttccatgagatccaaacttcagctttctgaaacagatgcttcaactcaccctgataaagatatactaagaaatcgtgagaactggaatgtggctgaaaaaagcgaggaacaacctaagaaagatactttaggggcattctttgatggtttgtgcaagtatgcacgctattgcaagtttgaagtgcggggtgtactaagaaatgctgattttaacaatcctgcaaatgtaatttgctctctaagctttgatcgggatgcagattactttgcttctgctgggatatctaagaaaataaaaattttcgagtttagtgcactttgcaatgactctgttgatatccattatcctgcagttgagatgtcaaacagatcaaaactcagctgtgtttgctggaataactatattaagaactatcttgcttctacagattatgacggtatagtgaagttatgggatgctagtacaggccaagaattttctcaattcactgaacatgagaagagggcttggtctgttgacttctctgcagtatgccctacaaaatttgccagtggaagtgatgattgtactgtcaagctgtggagcatcagtgagagaaactgtttaggcacaatcaggaacgttgctaatgtctgctgtgttcagttctctgctcattcctcccatttgctggcctttggatctgcggattactcaacatattgttatgatcttcgcaatctcagaagtccctggtgtgtactggctggccatcgtaaagctgtgagctatgtcaaattcttggactctgaaacacttgtttctgcttctactgataatacattgaagatctgggatctcaataaaacctctcctgtgggtgcatccattaatgcttgcagcctaactctgtcaggacatactaatgagaagaattttgtgggtctatcggtggctgatggatatattgcatgcggttcagaaacaaatgagatttacacctactatagatcgcttcccatgccaatcacttcacacaaatttgggtccattgatcccatttctgtttgtttcaagtgtatgctggagagggaaatcagacatgcttattgcggccaattcaagtgggtgtgtaaaagtgttacagatggtttaaaggaaaggttccctgtggcggcaactttcttgcagttttgcgagttcctggagttttgcacttgtcgcccttgcactcaggctaaatcccatcaacctgctgggagcatataa

SEQ ID NO: 32491 - DNA, 180 bp, Glycine max
  Peptide Sequence Number=SeqID_149269
atggatatggaagacccaacgggtgatggcataccaacaagaaagtcaatagaagaatcaaggtcaacagaagaatcgaatcgaaggcaaccgaatgtgcagatacgtcctggtttgtggattatactccacatgggaaatcctatcttgggaaggggaatgacatatttgataacatag

SEQ ID NO: 32492 - DNA, 3018 bp, Glycine max
  Peptide Sequence Number=SeqID_149270
gccactaccactgcacttgttagccatctctgggaagagttcttattcatggacagtgaaagagcggacaacaaccaaggcacgaatgcaacacacactgcaatctctagtacacttaaaattaagattgctagcagcagcaaacaaggtgaggagagtttagactgctcaaacttaccttcaccaaacataaacaatgccatagaatcatcaccttatggttctcctcttgtgtccccaccttcatcagcctttgtttcagcattgcagtctccatatatatctccaagggccataatcccagacccccctaatggttcttctcctttggaaaaccaaccatcgctaccaattactacaacaacagcaaccacttccaccccagaagatgtgccaagcagttcctacactcccccttctgatcaatatgagttctctgatgacactgctgacacaaggctcaaatatgtgacatgttttcctgaagcagctcctgaacgcatctcattctcatttcaagtccctagaatttcttttacaaaaggtcctgtctcacctgctaccaatgctaaactaagaagctgtgatgtttacattggattccatggccagaaccccaacttggtgcgcttctgcaagtggcttaaatctgagcttgagcttcaggggattgattgcatgcttgctgatagagcaaagtactcagacagtcagagccatgagattgccgatagagtcatttgctcggtggcatttggagtggtggttgttacaagttccagcttcctcaaccattatagcacggaggaggtgagattctttgctcaaaaaaagaacttgatccctctcttgtttgatactggaccatctgagattatgtctcttcttaactgcaactctgttgacaaagaatgtaaagagacaattgatggactaatgaaatgcaatgagttgaatctagaggctactgatggtaactggagaagctgcatagtgaaagctgctagtatcttaagagcaagacttggtaggaagaatgctgagcagaaggataatatgcaaggatatgagagtttaccttttccaaggaacacatacttcgtaggaagagagaaggagattatggagattgaaggccttttcttcggtcgagggaactgcatggaacaagtccaagatcattgtagggcattcaccaaaggagaagctagtggaagtggacaatctgaaggccttgcagatgaggaaagtgaaccagtgataggtaggtgtggaaggtattttagtctagagatggggaggagcaaagagccaactttaggggcttgggttgaaccaaccataggaaacaattctgtgaagaggttgaagaataagaagtcaaagagtggaaactacaagagcttgtgtagcagtgtgatttgcattaatggagtttctgggatcgggaagtctgagctggcactagaattttctcatagatatcaccagaggtacaaaatggtcttgtgggttggtggtgaagccaggtatcttaggcagaacttattgaacttgtctctcaatttgggattggatgttggtgctgattctgagatggaaaggggtcagattcgtagctttgaggagcaagaatttgaagcattcatgagagtcaagagggaactgtttggtgagattccttacctgctgattattgataatcttgagacagaagtggaatggtgggaagggaaggatctatatgacttgataccaagaaacacagcagggacacatgtgattgttactactaggttgtccaaagtaatgagctatgatactattcagcttccacctttgccattatctgatgcaatgattctgatgataggccgaaaaaggaaagattatccagcagatgagatcgacatccttgaaaaattcaatgaaaagcttggaaggtcgagctttggtgtgtggataattggttcattgttgtctgaacttgcaataggcccttcttctctcttcgaggccataaaccaggagccactcaatgaagattcaaactcttgctatacgagcattgcagaagagcaatggtgcaagagcaacccttttctcatgaagacccttctcttttgtttggagactttagagaaaactaaagctaaagggaacctcttggccataagaatgctgcttgtgagtggctggttttcccctgctcccatttcagacagtttattagccaatgcagcaaagagtatccctatggtcgaaaaccgccttaagaagtggaccaaatctctgagcctaacacctagttgtttatcattgcggacgtggaaaaatgaagaagattcagcaatgcttcttgtgaaaatgggactggctagaagggctaatcaacatgatggatgctggcttcatttccatcccataacacaagcatttgccaaaagaaaaggtggtttgcagtatgccaaggctgcaattcaaggagtgagaaaaatgggcagccaagtaaactcagatcacttatgggcctctgctttccttgtgttcgggttcaaatctgagcccccactagtgcagctgaaggcaattgatatggttttgtacatcaagagaacagctctccccctagcaattcaagccttcaccactttctcaagatgcaattcatccttggagctcttaagggtgtgcaccaatgcactggaggaagttgagaagtcctttgtctctcaaatccaagattggtcctcacataattcaatttgttggaaaaggagactgcaaagagaccaaaaagtggatgaatatgtatggcaggatgtcaccttgttgaaggcaacactgctggagacaagagcaaagttgctagcaagaggggggcgtctagacagtgccaaggaactgtgcagaacatgcatcagtatcagaactgtgatgcttggccataaccatgcacagacgttggctgctcaagagacattagcaaggttggtgagaatgaggagtaagatatga

SEQ ID NO: 32493 - DNA, 666 bp, Glycine max
  Peptide Sequence Number=SeqID_149271
atggggtgttacagcgcacaaattgttcttggtgatctttgtttggttgatgctgcacatttaattgtcgtcggggcattgtttgggatgaaatgtgattttgctggagatgtcgtagaaggtgaaattgtctgtggaaatgatgttgatagcgaagatggatttcacagtgaagaggtagatgaaaatgatgagtcaaacaaaaccccatacaaatttgatgaccaagatgagtttgaagattttgatgaagaaagatcatttgaagatcacaagtatgagggcgaacaaaaagaagctgaagaggaagaggtagatggaattgatgttgaactggaagatctaataggtttgagcacaaatttaaaagtagatggtatagttattgatgaagttgttgatatattgaaatttgagatgcacaatatgacaattgttgatgtgcatgctaaaaaaggtattggtcgatgttttgacaatggtttgagctactgggataccaatttggttgttaagtgtgtgactttggttcatatttcaagagaggattgtgattatgcgcatcgtgaccaggaagactatgatcatttcattgaattgctgggtgcaaaactgagtaggttgaagcataagtattcttctttaccatcaactgaagagggaaaa

SEQ ID NO: 32494 - DNA, 941 bp, Glycine max
  Peptide Sequence Number=SeqID_149272
cctcaaggaattgggacgattgatgggacctctccaaaggcaagccttacggaggctgtcatatccctcgcccaatactatgaccagccattgaggtgcttcacgtttggggacttccaaatggtgccgactattgaagagtttgaggagatactaggatgccctcttggggggagaaaaccgtatcttttcaccggatttcttccctccttgagcaagattgcagctgtggtcggggattcggcaagagagttggatcccatgaagcaaactcgcaacggcgtagtaggcctgccacggaaatacttggaaggcaaggcaagggatatggcgagccaagagaagtggggcccgtttgcgggatatactagcattgttgatttttggggttgtcctctttccgaacatggacgcggagatgtgagaacaacagtgcacgaattgtctgttgtttacccgctctctgtgtgtggttggtttcacacctattccaacaagacacaagacacccgtgaaggcaaggaaggagttctcttctcgtgtggggactaccctaatgttccattgatagggactaggggttgtattaattataatcccgcactcgccataagacagctagggtaccccatgaggggagcgccaaccaaaggaagtctctcgcctttccttgtgagggatctaggcgcgcaaagtctcaaggtgatacaaagagtccataaggcatggagaagtccattgaagaaagacaaggagcttagaggcctccgaaacagcatcatcggtggttatcatggatggctaagagttcacacgcgagggttagattggctctccaaattgaaagttatcaatgaggagaacttcgaagctccggaggaagatgaagaagtccaagctctcaaattagagctagggaaggctagactcgccaaggagaa

SEQ ID NO: 32495 - DNA, 252 bp, Glycine max
  Peptide Sequence Number=SeqID_149273
atggaaatttttaatcataaaaaaagatggacgataatagacacttacccacgacttcttgctgctggtagaaaaatatttgattccttaaatgaaaaattgaatgtaagttgctcccaaatggatagtagcatgttcaaacatgaaggaaactttaaagtgacaccttcaccttggaatctgctacaacaaaacttgcagggataccaagccaacataggaagcttcaacactgaaacacaaatattataa

SEQ ID NO: 32496 - DNA, 342 bp, Glycine max
  Peptide Sequence Number=SeqID_149274
atgtccaacacttttcaagcttatgcttattacagtcttattgactttaacacagggaagtcttcctttcctgttgaagccttggctcatagaataacggttgtaggaactgattctcatccattcctacattttgaagcaggaaatgcacacatggaagcagtcaagcatttgtctatcattcataaagaaagaagtgaagcatatgcaaatgccaatgccagagtctccttgaaaacaaagctaggccaaagagatgtgtcagattttttaacaactgctattgctatggaggcaatggaacagatcaaatgctttcttataagcgaagatggcttttaa

SEQ ID NO: 32497 - DNA, 495 bp, Glycine max
  Peptide Sequence Number=SeqID_149275
atggagttgtcattgttgtcggtgatggagcgagaagaagcaggtgagccagtcggagctgattcaggagttgggattagtgtgccaggttcgaaggtcaaagaagctagtcagtacgactcgatggcaattctcttgtccccaggcaacaccaggcatgtgaaaggtgtgttcctcacgcaccacaacttcatcgcgttgattggagggttctatcacctcagaaatgtggtggatcatgacccgcacccgatgtcactctttacactattgttgttccacgtgtttaggttatgcatgctggttagggccattgccgtcaaggagacactcatcttcatgcagatgttcaactttgaagggatgctcaagtcggagcttgtgaagaagtgtgatatgagctctctccgaaatttgggttgcgacgacacactacttgagaataaggtctccaagaacttcagagccaaatttcccaacatgaaaattgggcag

SEQ ID NO: 32498 - DNA, 1446 bp, Glycine max
  Peptide Sequence Number=SeqID_149276
atgcttcttgtaaatacaagtgtcggtacagtcagaattaagatgtttgatgatgttgtcagaacacttggaaatgtgaagcatgttttagatttgaagagaaatctcatatcactaagtactcttgactctaaagggtacaagtgtactggggaaggtggagttttgaaggtgagcaaaggagctcttatagtaatgaaagggcagaggaaaactgcaaacttgtatgttctgcagggtactacagtcattggagatgcagctgttgtttcaaatactttgtcagatgacgatgttactaagttgtggcatatgcctattgggcatatgagtgaaaatggcatgactgaattaagcaggagaggacttcttaacagtcagagtattagtaaattggagttctgtgagcattgccttttcggaaagcagaaacgagttaaattcatgaaagggattcacaatacgaagggaatgcttgattatttgcactctgatctagagttccatctaacggaggagagtttgggcattcttcttgaagcagaaggtgatgtctatactactttcaaggagtggaagaccatgattgagaagcaaacaggaaaacaaataaaacatctgcgaacctataatggtttagagttttgttttggagagtttgatgctttatgcaagactgaaggaattgtaagacatcacaaagttcaccatactcctcaacaaaatggtgttgcagaacggatgaatagaactattatggaaaagcttcaacagcttgttttctcattaatctgtccccctcaactgccattgacaaaagaactcctcgaggtatggtctgcatatgctcatgttgataatggaaaactggaaccaagatctgttaaatgtgtttttcttagctataagtctggtgttaagggttataaattgtggtgtcctgagacccataaaaccataattagcagagatgttagtttttatgaaacttctatgttgcaaggtttgtccattactgactctggtgatacaagtgagaagaaaccaggcatgcagaggtatgctgaagctgatttggttgcttatgctctaaatgtggcagaagatattgatacaacagaaggaccttcaacatattcagaggcagaagagatggagtcccttcataagaacgacacatggaagttggcgcatctacccaaggataaaaaggcagtttgctccatgcatgattttgagcttgagcaattagatgtgaagactgcatccttgtatggtgagcttgaggaggacatttatatgcagcaaccagaagccaaggataaagaagaaatcaaagccgtcaaagctcaactcaacaaaaaatttgagatgaaaagacttgggagctgcaaagaagattccaagattcacagagatagagacaaacgggcaaattttacctaa

SEQ ID NO: 32499 - DNA, 153 bp, Glycine max
  Peptide Sequence Number=SeqID_149277
atgctgggtgcacgtagcaactccctcgcatggagtgggtcattgggtgtggtgtggtgcagtgcagaggtgacattgggttgttgcggtgatggtcttgggtggaggtctagggcagaggtggctaggatttgcttggaagatgaagagtaa

SEQ ID NO: 32500 - DNA, 144 bp, Glycine max
  Peptide Sequence Number=SeqID_149278
atgttggcagcagacaaggaagtgggagcaagtggtaccataaggtctaaaggagacatattcttaaatggtgctcaagaagggttaatgactaaggatgttgggagcaacatgtttcaccccacagaacactatccatcttag

SEQ ID NO: 32501 - DNA, 1358 bp, Glycine max
  Peptide Sequence Number=SeqID_149279
aattgatgagaagaaggatgatgttaaggaggttattgaggaaaaaagtaatggtagaagtgaagatatacctaagaaaacagcaaaacttatttttggtgaggatataagatgggctgaattgccacttaattgcagcctccttcagctgagagaagttatttgtgaccggttccctagactaggagcagttcttgtcaaatatagggaccaagagggtgatctggttactatcacttctgatgaagaattaaggtgggctgaaactggatcacagggttctatccggctgtacatagtggaagctaatcctgatcacgatccattatttgagaaatttaatgtaaagaatggagaaaaggttaacacttatagttctcctgtgaatggttctgtggtgaaagcgaaggacattattagctcatcatgcattgaggactggataattctgtttgcacaactgttcaagaacaatgttggatttgaatctgacagatatttagattttcatgaatttgggatgaagctctattcagaggctgttgaggagacaattacaagtgacgaagcacaaggcatatttgacattgctggtggtaagttccaagagatggcagctctagcattgttcaactggggaaatgtgcatatgtccagggcaaggaagaaagtgtattttactgaagattcttcaaaagagcatatgcatgaacaaatcaaaagttcgtatgaatgggcgcagaaagaatatgcaaaagctggggaaaaatatgaaacagccattgatattaagccagatttttatgaaggcttcctggctctaggacagcagcagtttgagcaagcaaaactttcttgggattatgcactctgtagtaatgtagatttagcaacatggccctccactgaggttcttcagctttacaacagtgccgaggaaaatatggagaaaggaatgctgatatgggaagaatcaggagggcaacaattgagtgaaatctttgatcccaaggatattggattacatctgcagaacatgggattggatgggctattcaaaaatatgtcatcagatgaaattgctgcacaggtggaaaatatgaagtctcaaataaatcttctgtggggtaccatgctatatgaactctcgatagtggagttcaaattagggctaccggtatggcatgaaagtttggaagatgcagctgagaagtttgaacttgctggagcttctgcaacagatatagctgtaatgttgaagaaccactgttctaataacactgatggtcttggattcaaaattgatgaaatagtacaagcatggaatgagatgtatgaagctaaaaagtggcagaaag

SEQ ID NO: 32502 - DNA, 699 bp, Glycine max
  Peptide Sequence Number=SeqID_149280
atggacatgaatgttggagccctcatctctggacagatcactcttatggctcagtctaactcctcgaggctcggatttttagccctcatcactgctttatgcatggcccaaggagtcacctcagattccttgatttttgaatccctcagcccagccatcaacttggcttacataaagaagaattgttggaacttagacgaccccacggtcagctttccatggacccacaaggccacggctagaggatctgaaggtccatcttctgctcctccccagacatctactgcaccatctcctattccttcagcaccagttcccgttacttccggtccctccgctcaaagcatagacctcatgatggcaatgttgaagagcattcaccagggtcaatacctggtggcctggccaagagtccagccttcttctcatggaagaggtgaggcctccgtagctcaagagcttgagccaaatccagagactacacctgctgctcaggaggatgatttagaggccactcccccagagtcatttgtaccagaaattgatccagaggcagatccaatgattacagaggccagtccacaggcatcaccagtatctacaccagtactagagctgagcaccccgcaaggatcaccagcaggcatgcctgggctgcatttgaccgatgatgaggccatggatcgggacccaccgtag

SEQ ID NO: 32503 - DNA, 486 bp, Glycine max
  Peptide Sequence Number=SeqID_149281
atggggaagaaaaagaagcaggtaggagaaacaagtgaagatagaggaaatcataagaaagttgaagataaaagccccaactcatatgacaatgataccttggcgtttatatcaatggctcaagagttgaaggatgaagggaacaagtttttccagaagcgggatgctgaaggagctttggtaaaatatgagaaggcactcaaattgcttccaaggaatcatgtagatgtttcgtatctgcggagtaacatggctgcgtgctacatgcagatgggactcggtgagtatcctagagcaatccgtgaatgcaatttggctcttgaagtatcgccaaaatatagtaaagctctgatgaagagggccaggtgccatgaggctttaaataggctggatttagcgctaaaagatcttagtgctgttttaaagatagagccaaataatatcatggcattggaggtcttgggtaaggtgaagcatgccctttga

SEQ ID NO: 32504 - DNA, 510 bp, Glycine max
  Peptide Sequence Number=SeqID_149282
gacgcagaggaaggctcgccgttgtggtgttgtcagagaagaagccaccaaggccgcgcgacacagagtgaagaagaccatgaagcgggttacagtgagtccgcgaaagatgatgcttgccatgtccaactacattccaaattttaatctaactagccagcaggatgcaactgaagcatttctccatctgttatgcttactgagagaagaatttggaggttgttatgctccaaagatgagttctttagcagaaatttttgcttcaaataatagaattcttactccaatacagagtgactgccaaagtgataaatggtttgaaaggataaattttgagattcctaatgaggtgtatcgcccaccagtagaggcttatcgtggctgctgtagacagattgagaaaagatatcagagaaataatagtcctcgctattatatctctattcttgaaggtgataaagatggaaatcaatcagaagccgaagagtccaacaatataccaaaaatcat

SEQ ID NO: 32505 - DNA, 342 bp, Glycine max
  Peptide Sequence Number=SeqID_149283
atggggtcgaaccaggcacatgcttttaagaaaagggtttcattaagtcaaggtcaagtatggaagaaagaatgtgctttacgacacccttaccaaacgcgtgccagagctattgaaggaggcagagattatgcctttgctgacatggcagaactgaacctagtgcccatcgtcgttatccctccgaagttcaaggtgttggatttcgataaatacaaggggactacttgccccaagaatcacctgaagatgtacaacaggaaaatgggggcatactcaaaaaatgaaaagttgttgatgcatttcttccaggaaagtcttactggggcagccgtcacctag

SEQ ID NO: 32506 - DNA, 1233 bp, Glycine max
  Peptide Sequence Number=SeqID_149284
atggataaggttcccacctcagaaagcccatcggatttggttggagagattcttctacacgtggcaccacatccccacttcgtgtcggtgtttattgttgcggcggttggttcatcatcgacggcatacgagatcaagtataagacatacgtggatcaactataccctaagcactacacagcaccaccaacaatggaaaaccaaacaacggggagggagaagagggcttacctcaacaatgccaatgagctaaagaagaagacaccaacggacgcatcgcgaagggagaagaggatgctgaagagcgaagctgcagaagaccaaaacaaagctgaagaagaaggcgtgaaaaaaggagtcgcagaagaaggagtcacggaagaaggagtagcggaagaagaaaaggctgctggtgcacaaaactttttaaaatatgcaggggaagggaatgaatgggatgctccgattcgccaccaccgttctccgaaccggatcgggttgttgccgcctctcaaatgctcctctttggagccggaaaccgccccgcctcctcccttcgactggactcacaagttgatcgccggtgtcgccggcgtcggattcctcgaaacctcgtacctcacttaccttaaactcaccggcgcagacgccttttgccccgtcggcggcggcacctgctctaaaatactcgacagtgattacgccctcgttttcggtattcctcttcctctgattgggatggctgcgtatggcttggttgctgcacttggtgttcaattggcttcgaagaattttcgttttgggattgagaaaccaactgctgaagcagtgttgcttggagccacaacctccatggcagctgctagtgcgtattttttgtacattctaaccaccagattctctgactcgtcttgctcctactgcttactttcggctttcttgtccttcaccttgttctttgttacactcaaggatattggattgcaagaggtgtctaaacaactgggtctgcaactgcttgttgctagcttagtgattctctcgctgaacgcatcctatagcaattcaaaatctgcctcctcaagcctggctgaaaatgatcttccatattttgcaactgagattacaactccgtcaagccctttcgcactatctctagcaaggcatttgcactccataggagctaaaatgtatggtgctttctggtgttctcactgtcaggaacaaaaagag

SEQ ID NO: 32507 - DNA, 975 bp, Glycine max
  Peptide Sequence Number=SeqID_149285
atgggactgaatattcaagaagctcatgcattttccaccactgatggattttctctggatgtctttgttgttgagggatggcctaatgaggaaactgaggagctgaaaggtgtgttggaaaaggaaattttcaaggttaaggagcaaaatttgtcaaatcagggtatacattatgctaccaacgaacaataccaggcaaggatggaaccctcccctcattgcattcaaataccatctgatggagctgatgtctgggagattgataccaaccagctgaaatatgaaaacaaagttggctctgggtcatttggtgacttgtacagaggtacatattgtagtcaagatgtggctatcaaagttcttaagcctgagcgcataagtacagatatgctgagggagtttgcacaggaagtttatatcatgaggaagattcgacacaagaatgttgttcagttcattggcgcatgtactaggcccccaaatctttgtattgttactgagcatgagaggaaagcatcactgaaatatcttgttcttcaacaggtggtcaaggttgctgattttggggttgccagggtgcaaactcagtctggagtgatgacagctgaaactggaacataccgttggatggctcctgaggtcattgaacacaaaccatatgaccagaaggcagatgttttcagttttggaatagctctttgggagcttttaactggagaactgccttactcttgcttgactccattacaagcagcagttggcgtggtgcagaagggcctacggcctacaattcccaaaaatacacacccaagactttctgaacttcttcagcggtgctggcaacaagatccaacgcagagaccaaatttctctgaagtaatagaaattcttcagcagatagcaaaagaggtcaatgatcacaaagataaagcatcccatggctttctctcagctcttagacgggcccatcattga

SEQ ID NO: 32508 - DNA, 1455 bp, Glycine max
  Peptide Sequence Number=SeqID_149286
atgtgtgatgtggatcaacaaaccaaaaagaagaatggtttgaaacaaagggagagttcattgggaatgcatgtttccttaattacaagtctcgtggcaactactttgcctactcctttgattggcactatgtcagctatggtgtttactactataagcacacctgacgaaacgcccacagtgatgactacctcattcatttcgcagaagatagacttggggatacatgatattatgtgtaaactatctagactgttagctgaaatagtaaaacccatggttcaaaatgagaggcagcaatccaaggaatttgaggataatttaggcaagatcaatcccattagtccaaccaagtatggattttatgtctacatggcaaaatatggtgaccttagccaattagcttccaaagacaatcagatagaacaattcatacaggagaacgaattgaggagagctaacaaagggcaaggatcccatttgatagttaatgtcgatgaggaaaatggggaggccattgtggaagaagctgagattatgacttatgagatattaagagggaaaccttattcgtgtccatctttaaagctagggagaataaagtattgtgccggatgggaaatagctttggaagaaggtcgctttaagctagttgataaggggtgcaaccaaaatggcaatagatacagatccttttccaaaactggatatcaatatggccatcctgggaagattctcagaaaagatttaacaactcttgctcaggtgtggagtgttctctcgtactccaacctggctcctacttcccacacctcggacctgacagtagatcgagctaggcagatctttggcctagtctctcagatggatatgaatgtgggagctctcatctccggggttgcttctgacagcctggtcttcgaacgcctgagcccggtcattaacttagcctatatcaggaaaaactgttggaaccctgatgatctgacagttactatcagaggggctaggagagcgaggacaaggccaactgaggccccttccacatctacagctcctcctccaacacgtaccctagcagctccttctacctcagctcctgtagattttcggcgtttagaagccatgcttcaaagcatccatcaggggcagattatcttattacaaaatttacaaatggtggcacctccagactctattccttcggtagagcagtttaatgagtcggtagcctggcctggaactcagtcttttcttcatagggaagatgaaggttccacagcccaggtaccacaacagatggaggatgagtcatccgagactaccactccagagcccttggtcagaaggaagaagacagatcaaacacaagaagctgcaaccacttttgagaaatctcttgaggccacttctgagccttcagaaccagtggcagatacagcttcacttcagtag

SEQ ID NO: 32509 - DNA, 648 bp, Glycine max
  Peptide Sequence Number=SeqID_149287
atgacacgcaacgaccaacatggtcgtcctcaccctttgtcgaaggctcaatgtctaccgaccgagactactaaattctccctgtttcttcatccagaggaaagcgagcccgatgacacgcaacgaccaacatggtcgtccgcaccctttgtcgaaaggctcaatgtctaccgaccgagactactaaagtctcctcgtttcttcatccagaggaaagtgagcccgatgacacgcaatgaccaacatggtcgtccacaccctttgtctaaggctcaatgtctatcggctaagactactaaagtctccccttttcgtcatctagagacaatcgtgtccgatgacacgcagcgaccatcatggtcgtctgccccctttggtcgaagactcaataccatgatggtaactcgctttcattgctctgagactatcaaagtccccttatcatccagagacaagcaggggggtgtgcctatcactgggcccatctggaatattctggaggagggttacttcaggtggaagcaacccagcttgcctgggcaagctgagcaagctgggaggcaaccacctcccccatttttctataaaatggcatggatgggggctgaggaaggggttgatgtagatgttgaggaagaacttgggtag

SEQ ID NO: 32510 - DNA, 468 bp, Glycine max
  Peptide Sequence Number=SeqID_149288
atggctgcgcaggttttgcacaaatattttttcatttttctagcactagttgtgtgccatggttcccttgtagcacatggcaggaaaataaatgtaaagccattgaaccagcaacattattcattaaacacaaaaactgtagctaataataatccttacccttcccttccatcacttaaaactaaagttgaatcaccacagtatgaggaagctaataaattgggagattcaggtgcagacaacacaaatgcattccgatccactacacccggagggagtactggtgttggccacaaaataatcacatcatcagaagataacaagatgaaaacaatggttgtagttcagagcccagatgttgaagttttcgtgactaaggggtcaaaagatgatttcaaacctactgacccaggtcacagccctggagttggccatgtttaccaaaacaaaattggacaggcaaattag

SEQ ID NO: 32511 - DNA, 715 bp, Glycine max
  Peptide Sequence Number=SeqID_149289
tggcatctcctctctctcttccttctccattccgctgccattcatcttccaagaagcaaaggaatccattgatgaagaagatcctaggcctataagctccaatggagcttacatcaccaatgtggagacacttcagaagtttgagaacagcaaaaagggaggagttgaggcaccagaggatgacgaagaggtgcaggcccttagggcagaactcgagcaagcccaaacagtcaaagaaaggttcaaatcagcagctctgaagatccgaaaggagaatgccgaactaagagatataaatatagctaccaccaaggccttggaacaagagaccaagagggctcgtagggaagagcacggccggaacaagttccgagtggctctgtggggcagcaatagcgagcttaagctccggagagaggaaagggaccaatcccaagtagaaagtttgatcttaaaagatgagttgaaggtttgctcgaggtccaaaagaaacatgtctcagcggttatgcgagacagagaccaacatgttagccatcatcagcaagtaccaagaagaacaaaatcttgccacggcccacgagcatagagtggcggacgagtatgcccaagtgtacacggaaaaggaggctagaggaagggtgatcgactcgttgcagacacctactctgcccttgaggagatccacggacttctcggctattgtcagcatatga

SEQ ID NO: 32512 - DNA, 935 bp, Glycine max
  Peptide Sequence Number=SeqID_149290
gacattctggttatgaagcctcagaagaaatcgccactgttgttaaggatgtcggtgttgatcttttcaatggtccttctcggagtagtattagtagtattaatagattgaacctaacacatgatgttcctttgttgcattaccccgagcctgtgtctttcaacaggagtgagtgtgctggtaatcctgtgcggttctttgccatattgtcgaatcagagatctggcagtgggtggtttgagacccttttgaatagccatattaatgtgagctccaacggggagattttttcagttagagaaagaagagtaaatgtttctaccattgtgcagactctggacaaagtttacaacctggactggctcagtagtgcttccaagaatgaatgctcagctgcaattggatccaagtggatgcttaatcagggtttaatggatcaccctaaggaaattgcagattacttcaacagtagaagtgtttctgtaatatttcttttccgaagaaacttattacggagaatggtatcaatgcttgccaactcctatgatcgttatgctaaactatttagtggaactcataaatctcatgttcattctaaagaagaggctgatactctttcaaagtacaagcctaccattaattctacatcattgctggctgatttgaaggatatggaaatgagaactgcaaaagcgttggaatacttcaacaccactcggcatatgatcctgtactatgaggatcttatacaaaatcgtactaagctaaaagatgttcaagagtttttaggattgccacagatggaattaacaagccgtcaggttaagatacacagaggaccattgtcagatcacattaaaaattgggatgatgtgaacaggacactagcaggaactatttatgagagtttcctccatgccgattattcatcttag

SEQ ID NO: 32513 - DNA, 300 bp, Glycine max
  Peptide Sequence Number=SeqID_149291
atgttgagaagtttgtctaagccttggagaccacaagttatagcactaagagcttcaaagaatctggaaaacctctctctagaggagcttgttggaatcctaaaggtgtattcagatggaaaagtaaaagcaagaagttttactaaaaagaagaagaaggacaagagtccaatcatttgctatgagtgcaagaagcctagacacttcaaatctgagtgcactgaccttgagaagaacaaagataagaagaaaaagttattcgtcaagaaaaagggaaagaaaggtcttatgtccatgtag

SEQ ID NO: 32514 - DNA, 174 bp, Glycine max
  Peptide Sequence Number=SeqID_149292
gtctatcctaacttaatcgaatgtacactcacatataaatttgtaactgcattgcatactgatagagaattcaggaaagtgttgaacattcaagaaggtgtcaccaccgcttacgctgctctagagatagaaagattggatattcaatcttcacttcatgccaccactagataa

SEQ ID NO: 32515 - DNA, 312 bp, Glycine max
  Peptide Sequence Number=SeqID_149293
atggaacttactcaagctatgatctcagctccccatccattggtactacgaatgcatgctctaacctatgttgatgtggcaaagaagaatatgattgttctggtagatcataaccatcttttgctatggaacttgaccttgcatgatgctgaaatagggctacaatgtgttgctgagccgtggtaccaatatttgagagataatgacttcagtgctggagatgagatatgtttctacttcaggcttaatcagaaagtatgggagctggtaatcagaaaacaggttgcttgggatgacagtgactctaattga

SEQ ID NO: 32516 - DNA, 225 bp, Glycine max
  Peptide Sequence Number=SeqID_149294
atggcttgggttgcatcacgtggtaatcagagcttgaatccagagagtagttcgaaaatatatccatcaattagcatggtttccgaaagtgatagtgatccaccttcccctagatccgctaagctaatggcttcattggctaaacacatggataagttgcaaagaaatgttgagtggaggatggggagagatttaatgagatacaaagaagcactcaagagttga

SEQ ID NO: 32517 - DNA, 375 bp, Glycine max
  Peptide Sequence Number=SeqID_149295
atgcagcctccacgagcaaaacattgtcatgattgtgacaagtgtgttcttcagtttgatcatcattgtgtttggcttggtaactgcattggccagggtaatcactgtaaattttggtggtacctttttgaagagacagcattgtgcctttggactggtgtcttgtatatttcatacctgaaggctcacattacaagggtttgccagatcctcacaagtaggggtgtcaatttggacctgcaaacggggatccctgcggggattcaccaggaaaaggaaaataagcccatccaaatttatacgttcaaaaggggcaacaacacacagacttggagtgataaccctaaacaccctttctctgatatgcgcggctag

SEQ ID NO: 32518 - DNA, 213 bp, Glycine max
  Peptide Sequence Number=SeqID_149296
atggagacgagagatgcgaccatggccggagacgagaccatttttggagacccgaccatgtgcttcattgttgacgccaacgaagatgatgtgaggccacgcgaaggtgttgcggtggtggccggaggtgttgacgaatgtggccatggaggagaggaagaagatacagagaaggagaggaagaagatacagagaaggagaggaagaagatag

SEQ ID NO: 32519 - DNA, 1650 bp, Glycine max
  Peptide Sequence Number=SeqID_149297
atgggacaatctgtttcctccgccgccgtcgcaagccgtcgtgagagggatccaggccacctctccgtcaacacctccaagaccagatccaccgccttgattacgccgatggccggttattcctccggcgccggcgaagacgaaagcgaaaaccgtcgtggcgaggccgttactgatgaaaccaccgactacatctccgatctccctaacgagtgcctggcttcggtgtttcagtttcttagctccgccgatcggaaccgctgctcgctcgtttgccggcggtggctccagatcgaaggacagagtcgtcacaggctttctctgaacgcggatgaggatctgtttccagcgattccgtcgctgttctctcggttcgattcggtgacgaagctcgcgttgaagtgcgaccgcagatccgtgagcataagcgacgacgcgctcgtgctgatctcgcagcggtgccctaacctcacgcgcctcaagctccgcgcgtgccgcgccctcaccgacgctggaatggaagcgttcgcgaagaactgcaagggattgaagaagctctcctgcggatcgtgcacgttcggatccaaaggcatgaacgcggtgctcgacaactgcgccgcgctggaggagctctcagtcaagcgcctccgcggaatcaccgacgcggcggcggcggagccgatcggtcccggcgtggctgcggcgtcgctgaaaatcgtttgcctgaaggagctctacaacggacagtgtttcggaacgctgattctcggggctaagaatctgaaaaccttgaagcttttccggtgctccggggattgggaccggctctttcagttaatggcagatcgagtcacgaacatggtcgaagttcacctcgagaggcttcagattagcgacgttggattgcaagcgatcgcgaatttttcgagtttggagattttgcatctcgttaagactcctgaatgttctgatattggacttgttgctattgcagacaggtgcaagcttttgcggaagcttcacattgatggatggaaggcaaatcgaattggcgacgaagggttgatagctgttgcaaaaggttgccctaatttgcttgaattagtgctaattggggtaaaccctactaaggcgagtttggaaatgttggcatctaattgccggaatcttgagcggttggctttgtgtggaagtgattcggttggtgatactgagatatcttgcattgctgcaaagtgtgtggctttgaagaaactgtgtattaagagttgtcctgtttcggatcaagggatggaggcattggcaaatgggtgtccgaatttggtgaaagttaaggttaagaagtgtaagggggttacccctgagggtggtgattggttgaggaggactagagggtcagttgctgttaatttagatactggtgaggcagagcttcaggaagcgagtgctagtgatggaggggcacaggacaatgttgtagagtttcctcagatgcctgcccaaatcgtggccgcagcagcatctgcatcaagcagcaccactcggtctagttcgttcaagttgagattagggcttttgtctgggaggagtttagtggctagcacttttaagagatggtcaggtggtagcactagtgcacgccatggttag

SEQ ID NO: 32520 - DNA, 414 bp, Glycine max
  Peptide Sequence Number=SeqID_149298
atgccccttgctaatagagctactttttccaaaatttatcttggtgactatcaaaaataccctaaaatagtcattcttgaggaatgggtggattgtgaaatgatagcaccggatgagacttctcaaaagaggaaagcaacctcgtttagtactgaaagtaagggttataagaaaaacactactgataagagtgatggtaagatcaaacttcctccaaaacccccaaaaaccaaagatcatgtgaaggaaaatttaggaaaaaattattccaccttttctgagtctagaaaagtgattgagacacacctttcaaatggcatattgagagatacatcttggctatcttactcgcaggatgtgaatgtagtagacctttcttcctctcaggttcattcgaacccaaaagatggcaag

SEQ ID NO: 32521 - DNA, 816 bp, Glycine max
  Peptide Sequence Number=SeqID_149299
atggaatatcttgggattgatctaagctgcgccgttggatctctccgccacggccagttaccggagaaggactgcttgctccctctcatttccaaactcctcggctacgccatcgtcgcggcttccaccaccgtcaaactcccccaggcacttatcgttaaccgttttcttcaatttttctttacatttgccgcatgcgtttcttttattatgcatatattccgtttactactgaagactgcgttaggcgttagagttaggattatgaaaattctgaagcatcagagtgtgagaggacttagcatgatatccttcgagcttgaagttattggatataccattgccttggcttactgtctccacaaaggccttccgttttcggcttacggagagttgttgtttcttttgatccaaggtgtgctaatagtttttgcttatgttttggtttctgtttattcttcgtgcaggactcttatattgtacgaattcgcctcacgtgaattgcgcggaattatgatatattgtgctgttgcacccactgtcttagctggtcaaattgatcctctcctctttgaagctctgtatgcatcccagcatgcaatctttctctttgcaaggatccctcaaatatggcaaaacttttctaacaaaagtacaggggaactcagcttcataacttcttttatgaattttggaggttcaatggttagagtattcaccaccatccaagaaaatgcaccgaaaagtggtaggcttgcttctcaatttgttttcatcatgtcttctgttgttgtcatcattgtcaatgaatgttaa

SEQ ID NO: 32522 - DNA, 207 bp, Glycine max
  Peptide Sequence Number=SeqID_149300
atgcaccaacatgacaaggtaggcatgctcgcagttaggggtggatgtatggacccgaatccgtggaccggtgagagaaaacaccaattgaaaaagagagaaagggggaaagcctcaagattcaagaacatggtcttcaagtccaacagaaagatctccacaaacaactcttccatggatttcaccggtgcaagcactcacatatga

SEQ ID NO: 32523 - DNA, 369 bp, Glycine max
  Peptide Sequence Number=SeqID_149301
atggctttacaacaatccacaataccaccaagtgttaatattgaagcttctcaagtagatgcggatccaatggatgcagaccctttcgccttcatagatgttttgtcttcaaattcaatgccttcaaaagcttctcaatcgagtctcaacaggcattttacccatttcgatgaggttgtggcctttgatgagcttcatgaggaaatggagtcaatcctcaatgtcttcaacaatgcttttgaggcccaccaacttgttaccaacatgctgttgacattgctgaaattgaatcttcgacaaagcatgatcgaactaaactcattcaagctcaagaaggatttcagaaagccaaagaaagtattatgttga

SEQ ID NO: 32524 - DNA, 277 bp, Glycine max
  Peptide Sequence Number=SeqID_149302
atggaattttttaaagaattcaaaatagtagattctgaaactgatgaagttcttccacctggttcaaagggcattttgaaagtcagggggccacaagtgatggaaggatacttcaagaattctttagcaacaaatcaggccttagatggggatggctggctgaatactggtgatatagggtggattgttccccatcattcaactgggcggagtcgtaactctagtggtgtgatcgttgtggaaggccgtgctaaagacactattgtgctttcaacag

SEQ ID NO: 32525 - DNA, 1080 bp, Glycine max
  Peptide Sequence Number=SeqID_149303
atggatttgggaagcgaatccgtggaagagaacgaagtgaatcatgatgggaatggaaacggtggttcttatgatgacgagaagattgggttgggtttggagggaaattcggatgtcaacggttcggatcaaaagggaacggttggcgaagttgaagtgggtagtgcggaaggtgtgaattccaaagggacaccaacaaaggggtttgggttgaagaaatggaagagaattcggaggaatgttgttaaggatccaaattcgagtgttgattcgggtaaagtcttgaagaggggcttgtctggcaatgccaatttgagtgaaagccagccttttctgcgcgatgttaaggagaagaatgaaggatcttcaaacatgtttgggaatgtagtgttctctgatggcaatgtgatccatggttcaagttcggattctagatatgcacttggatctggttttgttgttgggactgattctgagaatagcgaggatcagagtagcaagtcttctacagcggctagtgagcccaagttgaggcaagagaaaagccgtagtaagaatgtgaattcaaagcatttagctaactcggctcaacgagttcaaccgggaaagggacgaactgaaggcagtaagaaaccaggaggaggtggaagagtgaaaattgagaaggaaaattctttttctagtttggaatctgattcaagaagctccaactttaagcaaggtgttttttcggttactagtaatggaaagcatactagtaggccaaatgtttacgatggagttaatagtggtgaagcacacactaatgaacatttcactgagggtgttgaggctggttatggtaacgaaaatgttgtagaggatgaatatcttttacaagagaatttgggtacaaatttgtcttgggatgttacagaagaaaaaagtgtgaacaaccaatcttcagccgttgaagatcctataattgaatcggttagttgccttcaggctgtccaggaggcccttcaagaagttgatattgttatgtttcttggttttataatccttgggagaatgtatgttaatatattacctaattag

SEQ ID NO: 32526 - DNA, 285 bp, Glycine max
  Peptide Sequence Number=SeqID_149304
atggtgaatgagaatgcaagaacattcaattggatttcaggctttagcatatcaaatacagtatcagcattcgaagtcaagtatggaggagggatattatacgcaacctcacccttgcatatgaaaagaggctgtttctggattcaaacccataaccaacaggtcaccaaggcacaactttaccgttgtgccagggcttgccctcaagtaacaaaggataaattgtcatctagttttagagggcctacattccttgatactgggacttgggagacaaacttttga

SEQ ID NO: 32527 - DNA, 330 bp, Glycine max
  Peptide Sequence Number=SeqID_149305
atggcacatcagacacagaatgaccataatttgttcctgtgtgccaccggaaacgaccgcctctggatggcgaaaagggcgcagaatctgtatctacgcgtttacccaatcagcttgttgttcctgaatgataaagggcacagaatctgtatctacgcggcacagaatctgtatctatgtgtttacccactcagcttgttgttcctgaatgataaagggcgcagaatctgtatctacgcgtttacccactcagcttgctatcatgctttgagtcttagagatagcgaaagaaagtttctacggataaccactctgggtgggatcctctag

SEQ ID NO: 32528 - DNA, 285 bp, Glycine max
  Peptide Sequence Number=SeqID_149306
atggcgagagtgatgagcaaaattacggcgacaacgacgaagtctatttcgttgaagcctttgggaagagacagcaccgtgaggcgccatttggaggaggagattccgattgtggtgcctaggtatgccatcaagcctctggcgacggtgacattggaaagcacggaccaaagtggagctttccaatttttgtacctaacactcaattttcttgttaaccaaggccaaaaagaccacctaaacgagacttgtcaaccacttgagagcctaaccgaacttgcttag

SEQ ID NO: 32529 - DNA, 1221 bp, Glycine max
  Peptide Sequence Number=SeqID_149307
gcggtactgtttgacctgagcggccgcgtgctgtcggtagcggagtgcgccggcgaaacgcatcagccgcaggaaggctatgctgaacggccagttgaagatatctggcgcggcgtcagcaacgcggtgagtcgctgcctgcagcaagccggcacgcgcggcagtgaagtgattgccgtcggtgccgccggacacggcaacgggttgtatgcgctggatcgtcagcagcgcccgctgtttggcatccagtcgattgatcatcgcgccagcgccacggtacaggcgctggaatccagcggtgcggcgcagcagatttacgcgctgtcgttgcaaaaaccgtggcccgccgcaacgccggtgctgatcagctggatgcgtcagcatcagccggaacgctgggcgcagatcggccatctgctgtgtgccaaagatgtcatcgcccattttctgtgcggcaacgtcagcgcggactattcggatgccgccggtgccgggctgattgattaccgccagcgcggctacagtggcgaattgctggcgctgtacggcatcgaagaggcgctcgccctgctgccaccgctgcgtgaatcctgcgaggtcaccggcgtggtctcggcccgcgcggcacagctcaccggtttacccgctggcatcccggtggtggccggcatgtttgacgtggttgccagcgcggtcggctcgggcgtagtgaactgcggtgaggcctccattgtcgccggtacctggagcatcaatcaggtggtggtcgacaaacctgattatctgcgcccggtgtttatgaattcgatcatcgaacgcgaccgctacatggcgattgaggccagcgccacttctgccgccaatcttgactggttcctgcgtgaatttgatgatggccgcgccggccagggcgcggcgcgcagcagcgacagcgtggcacaggtcaggcctgacgcgcagctgccgctgtatcacccttacctctactcagggcggaaagccgaacccgccaaagccggcttttacggcctcggcggctggcatacgcgcgctgacatgctgtttgccctgtttgaaggcgtgacctttgcccaccgggcgcacattgaccggctgcgcgcggccggcattacggtcaaccaggccacgctctccggcggcgcgacgcgcagcagtgtctggccgcaaatgtttgcggatgtgctggggatgccgattcgc

SEQ ID NO: 32530 - DNA, 423 bp, Glycine max
  Peptide Sequence Number=SeqID_149308
atgggaccaaacaaattgccacatcaacaccaatgcatcaaaaattacgaaatatgcatgaatcgcgtctcttacgctcaccgtgaacaccttcacgaatttgttccattggttcgtagaagtcattgctatcttcccataaacactagatttgtagttgggcatcacaggcgagaaagcaatcgtcaacatcatgatgtctttgccagaaaaccagatccaacaagaaactggatcttggttttattccttcgcgtgtcaaaatcacttgttgcttttaccgcattctatgagcacaacctcaggtgggtaagttgtagttgttgcggtgatgtggtcgtcgctagcaacactgctaaaaaagagaaaaaggaaggtggtggggcgaaggcgacatcaatgccatcaagaatgagcaaatga

SEQ ID NO: 32531 - DNA, 399 bp, Glycine max
  Peptide Sequence Number=SeqID_149309
atggtagcctggcctgggactcaaccttctcttcacagggaagatgaaggtcccacagcccaggtaccacagcatgtggaggatgagtcatctgaagccaccattctagagccattcattagaggggaggaggaaggtgatacacaggtaagacaggtagctgttgccacttctgagagatctcttgaagccacttcagagtctcctgcaccagcggaggacctatcatcgcctcatcatgcagcaaacccctccactcctatcctagagatacctaaggacccgaccacactagtcctgactctggacacttctcctccagctactccaatatttcatctaatagatgaggaggatgttcagacacaggatacacaggaccagtcacaggaattctaa

SEQ ID NO: 32532 - DNA, 1047 bp, Glycine max
  Peptide Sequence Number=SeqID_149310
atgggtgaagctaaggaaatatggtctgcaccaataacccctagaacagcttcagtggttggaacacctgttgtggcatctccacctgtgtcatgtccaccctctcagcttcactctccatctctaacaaggtcacccctccttcaccctgaggatggagatgcaccacgtcctaataaaacttctaagactccaaagacaccaagaacaccaagaaccccaagaacaccacttagaatctctaatttgactccaaagttcctcacacctttggggagccctgtgaggaaagctctgaggttcaccaagcttgatcctcaggatgcttggcttccaatcactgagtcaaggaatggcccttgttctccctgtggccttcacttttcttggttgctaggatacttgcaggttacaactgaacaggacgtggggaatcataagtatgactctggcgttcatatggcaactctataccttatggctgctggggagaaacttgggaaaatcctagccttgttcccaatattgtacctatcagcagggacatgcaccacattgatcatcataggaggatccacagcaaggacattttaccaagtggtgtgtggtgaaacatgcactgccaaacccatgaccactgtggaatggtacttggtgttcacctgtgtagctgtggtgctatcacagttgccaaacttgaattccattgctggggtgtcactcattggagctgtcacagctgtagggtattgtactgccatttgggtaacctctgtggcacggggtgccctaaaggatgtgagctataaccctgtaaggactggaagcagtattgaaaatgcctttggagtgcttaatgcattgggtatcattgcctttgctttcaggggccacaatctcatccttgaaattcagtctactatgccttcaagcgagaagcatccatcacacgtgcccatgtggaaaggggtcaaggtttcttacacaatcattgccgcatgcttatttcccatggccattggaggctattgggcttatggccaattg

SEQ ID NO: 32533 - DNA, 117 bp, Glycine max
  Peptide Sequence Number=SeqID_149311
atggttcattttgaaagttttctatcaccaacaatggtagtattcatgatagtagtgatggtagtaccaacaataatagtgaccgacatgagaatggtcattaattatcaagtgtaa

SEQ ID NO: 32534 - DNA, 717 bp, Glycine max
  Peptide Sequence Number=SeqID_149312
atgtgtcctccaccttcgagtttggagccatgcgtagtgattcctcagtgcaattctccattctcaaccctttttcggagccccatgaattgcattttcattcatgtgtcctccaccttcgagtttggagctatgcgtagtgattgcttagtgcaattctccattctcaacctttttcggagccccatgaattgcgttttcgttcatgtgtcctccaccttcgagtttggagctatgcatagtgattgcttagtgcaattctccattcgcaacctttttcggacccccatgaattgcattttcattcatgtgtcctccaccttcaagtttggagctatgcgtagtgattgcttagtgcaattctccattctcaacctttttcggagccccatgaattgcgttttcgttaatgtattctccaccttcgagtttggaggcatgcgtagtgattgcttagtgcaattctcaattctcaacctttttaggagccccatgaattgcgtttttgttcatgtgttctccaccttcgagtttggagctatgcgtagtgattgcttagtgcaattctccatcctcaaccttttttggagccccatgaattgcgttttcgttcatgtgtcctccacctttaagtttggagctatgagtagtgattgcctagtgcaattctccattctcaaccccttttggaaacccatgaattgcgttttcgttcat

SEQ ID NO: 32535 - DNA, 825 bp, Glycine max
  Peptide Sequence Number=SeqID_149313
atgctgcaagtgccagatgaagccttatcacttgttatgagcatgggctttgttgaacgcgatgcaaagcgagcattgcgaatgaacaatcaagatgttgggggtgccattgatttccttgctgaggagaaggcaaagaaattgcaaaagagggaggaagatattcggaggagaaatgaaattaaggaacaaaagcagtatgggatgacacccttaaagaaagctgtggatctagagagattgaaggaattggtctctattggatttgacaaggagcttgctgctgaagcccttagaagaaatgaaaatgacactcagaaagcattggatgatttgacgaatccagaaactaattctgctttgcaggtcaatatcgagtcaaggaaaaggaagagacagaaacaagcacgagattctgaaattagaaacgttgtgcaaatgggtttcgaaagatcaagagtggttgctgcttttgaggccggaggtagtttagaagaagtattgcaaagactaacagcacaacctgggactgaccccacacaacctcaagaaaattcagcttctgcttcccatggtggtgcaagttcatctgctcctttgccagacaatgttgattctgatatagcgatgaacgaggttgaagatcccagtataacagaacaacgcgatgtagagatggaagatgagctctctgcagatatagcgaaagcagatgccttggctgattatgacatcgaagttaacgtcgaaggggaagccataaccgagtacctttccctggttgagtcggcaggcagttgtgggaaaactgctccctcccagtaa

SEQ ID NO: 32536 - DNA, 474 bp, Glycine max
  Peptide Sequence Number=SeqID_149314
atgcattgtagcagatgggcagaggcgcagagactagggcagcagggtagggcaacaggctatgtgcattacgccaaaaccattgacgatatagctggattacgccaaagccattggcgacatacgttcagcttaaatagctgcttcttcctcctatgttgtagatttttagtttcaggaaaatatgttgctttgcaaatttgtgatgatgaagatgttgaaaccattatcgaaagttttcaacaacaagatcaaacgtcagttctggaattgtacatagaaaaggatgtggttggtggttctatgtttcatgatgtaaattctcttacatcatgtggaaataatttatttaataataagccggaactgtcaaaaaatataagcaacttacatggtgatgatgatgatgattatcttgtttctaactcatacattgaagagtctttagagaaagatgatagtgttgacacttga

SEQ ID NO: 32537 - DNA, 927 bp, Glycine max
  Peptide Sequence Number=SeqID_149315
atggcgagattgaagataggagggacatgggcaggggtgctggaagaggtggacctccaggcgtggaccctggctacgctccgcgacctcgtcgccgcccgatcgaactccccctcctccgactccatcaacctcatctgcgccggcaagattctcaaagacgacgccgttccgccccaaactcttgcccaactcggcgtcaagaacaatgcgaagatcctcgccacgcgcacctccactcctcagcaaggacactccttcctcgcccaggaagaacgctcctccagactcgcgcgtataagggcggctgcgaatgcgatggcggacaggcatgcggatggggcattgccagttgaagacttcaatattgaagttgaggatcagagtggacagaaagtgagattaggctctgagactgatcagagtgtggaattggagtgttggaatgtgatgatcaagattctgctttgcagggcagtgatgatgggactgatgcttcacgcgaaggggaagcgacttatcagacaggggaattacaaagatgcactggaagtgcttagcatgggagaggagtcattctctctttgtgatccaaaagtcattgagctcattgacaatgttccaatactacaaatagacatggtatggtgctattttatgatacgagacatcagatggctctcagatgcaggaaagcgtcttgaaatggctcgggaaggtattgaacgtgctcatggaaaggattcttttcgcctcagactcttacaagtaggtcgatatccagaactcgcattgcatttgagactagagctacttgaaggggtagtggcatatcatattggccaattggagaaatccaaaaaaacattagcctcagcaaggacaaagtttatccagagtttcaattctgtttttgggttcaattag

SEQ ID NO: 32538 - DNA, 576 bp, Glycine max
  Peptide Sequence Number=SeqID_149316
atgcaaaattgggatactcatgatagtagctacatatatctcattgaacatagacataatcatttcctagttctagtacttaccactttggtcgatgagggcattcactttcctatccttgtatgccacattagctgttgttgtgagaaaaacattattatcacaaagccaaggatcatcctagacattaacgttgaagccattccctatctgtcatctacaaccttgacgaaccactacttaagatgcacagatattatgccaagtttggtggaatgggtttggttcaacggtttcattgctcatggtggtgttcatttggctaataggttaaaaaggatgttttggtggtctgacatgaagagagatgtaacaaactatgtggcaacttgttcgacttgtcaaaaagctaaggtggagcatcatagtcttggtgaactcacctacaacaacagttatcatgctagcattggtatggcgttgtttgaagctttgtatggtaaaaggtgtaggacacttctttgttggtatccagatggtgtgaacataactgtgggaccagagttcttacaatag

SEQ ID NO: 32539 - DNA, 291 bp, Glycine max
  Peptide Sequence Number=SeqID_149317
atgggtgagcatgtgttcttgaaggttatgcctaccatgagtgtaggaagggcgattaagtctaagaagcttacccctaagttccttggaccttatcaaattcttaggtgtgtaggccatgtggcttatgagatggatttgccacctttcttagccaacctacacaatgtgttttatgttttacagttgaggaaatataatttggaccctacgcatgtctttgaattggacacgatgcaagtgcatgaggatttgacctatgagactttacccacaaggatagaggattaa

SEQ ID NO: 32540 - DNA, 1761 bp, Glycine max
  Peptide Sequence Number=SeqID_149318
atggacataggaaaagaaagatcccttgaagaaacaccaacatgggctgtctcagtcttttgcttcttctttcttatgatatctttgatcattgagggaggtctccacaaattggctgagattttcaggaaaaggaaagaaaaatccctagggaaggctttgactaaaaccaaaacagaaatgatgaaattcggtttcatgtcctttattctcacaatatcggaagtgccaatatccaaaatctgcatcagcaagggagtggcaaattcttttctcccatgtaaagatgttgtggacttcacaggatctgctactcgtacttcaacctcaggattggacgtagcacctgctaccaatgaatccgccattgaagtcaactattgtgaagcaaagttttaccaagttaaagaatatgcacagctagaaaaccaaggcatggttagtttaatttcaagtgatggaatcctgcagctaaacattttcatctcctttttggccgtgtttcacattttgttctgcacattgacaatgtgccttggaaaggcaaagatgagaagatggaagagatgggaggatgagacccaaacacttgaatatcagatagctaatgatccaagaaggttccagtatacaggtcaaacattgattgggaagcgtcatttgaaattctggagctatcattctcctttgctttggatggtttgctttattcggcagttctacggatcagtatcaaaagatgattacttcactctacgaaatggtttcattgcagctaatatttctttaggaagcaatttcaacttcaagaaatttctttcccgcacttatgatgaagattttgagaaagttatgggaatcaggccgaaaaatcatgaaccccaggcttttgatgctcttgcaggatttggatctggattttctccatacttttcatattttttagcgcgcacggttgctttacttgctgggacaaaactacaagtaataataacaaagatgtgtgtggatagttgcaaggaaaagtcagtgatcaaaggaagtctacttgtaacacctagtgatgcccatttctggtttcatagacctgaatggcttctccatttactcaagttcatccttatccagaactcctttcaacttgcattcttcacctggacttggtatgaatttggtccaaggtcttgcttcaatcgaaaaagagaggacattggcataaggattgtcatgggtgtagctgtgcagctcttttgtggctatgtgacattgcccctttatgcacttgttactcagatgggttctagcatgaggagagaaattttcactgagagggtttctagggacctaaaaaattggcacaaaagagctaaacaatctgtgtccaaaaacaactcaacttcaagcaaacactcagatactttgcattccaaagaatgtgacaattcagtaagaggatcagtggatattgtgcacacctcagataatgtagtgctcacaagccctccttctcacatgataagtggagaggaggaaaagagcattgcaccaaccaatgaacaagagatatcaagtaactccacttcagaaataatcaaaactactcaggaagagaatcccaagatcatcaccagaggaacctatgacggtgagatctcatttggaagcagctggaagaatgtgggaagtagcaggggcattggagaaattggttcaataattgaagaagatgatgctgaaaaattgcctgagttgattccataa

SEQ ID NO: 32541 - DNA, 504 bp, Glycine max
  Peptide Sequence Number=SeqID_149319
atgggtgaagagaatgaatcattgatttttccaaattgttcaagcaaagcaaaagaatgtttagaacaaagtagaaggtgtcaggaagcgtttaaatgtttttttgtaagaaaggtatcacatctaacatggagtagaaggccagatgaaaatcatgttaagatagtcttgagttacacaaagattccacaaccttccaacaagaacctcctaattcacctattgtcgagcacaagtgcaacaccaatatatcttcgaattacaattttccatttgtgtgtcaacatcgttagagctaacaacaccgatgggtttaaaatgagtgcactgagggttcaaatagagtgcgtcaagttgagggtttacaatgagtgcattgatggttcaaaatggagtgttgatggaaggagaagtggtggtgatgtgatggcaaaagaagaaacaatggcaatgtatgtggaggcctccaagagagggaatcctttcttcaattttgagttatga

SEQ ID NO: 32542 - DNA, 374 bp, Glycine max
  Peptide Sequence Number=SeqID_149320
tgctggatagtgatacggaaaacatcagcaaactagaatatgctaggatccttatgaggattgcatctccccaagcaatatcaacatcggacaataacaagggtctggagatcatgtcatcacactcagagtgttcctctgatgccacgacattctttggagaggaagaggaggtagaaaatcaggtgaagatgggtaaatccgatgatcagagagaggaaagagggtatggtttagagcaaaaatgcatggaagtagatggaaaaccaggaaagggtacatggggagggcgttgcaccatctcttcaagaggcaaaggctttaaaaagtcaaactcaaggtctgcctcagaggatgatgtcaatagaccttga

SEQ ID NO: 32543 - DNA, 231 bp, Glycine max
  Peptide Sequence Number=SeqID_149321
atggagggggttgttgagttttttaaaaagttctggatgtggaagagatcggagagaaccgagcttgaagagaaagctattttgcagagcattggaggagatttaaatatttcatttttagtatgcttttgccttgatcacgtagatgcatgctcagttaggatcattcaacatttggaaatgttctggtcaagtttagtccaacaagagggatctaaggacaatgcttga

SEQ ID NO: 32544 - DNA, 360 bp, Glycine max
  Peptide Sequence Number=SeqID_149322
atggatgccattgcattattgagtagatatgggagggtgacccttgtggatgatgggtgtccttggctaatagggtggaatggcagtcaaaactgtggaagcaatgacttccaagattattttgataatgcaaaagaatcaagagttaagcaagttccaaagaatcaggagtcaaaaaacttcaagaatcaagtttcaaagaatcaagattcaagaataatcaagtttcaagattcaatcaagtttcaagaatcaagattcaagaataatcaagatcaagattcaagactcaagattcaagaatcaagagaagactcaatcaagataagtactaaaaaagtttttcaaaacattgagtag

SEQ ID NO: 32545 - DNA, 138 bp, Glycine max
  Peptide Sequence Number=SeqID_149323
atgtcgacttgggaaaacctgcacaccatgaagccaagagtgatgtcattaaatataagcaacccaaagataatgaacattggtggtgctatgtgcttaatgttaaggagaaggaattgtttgttttggactccttaa

SEQ ID NO: 32546 - DNA, 234 bp, Glycine max
  Peptide Sequence Number=SeqID_149324
atgtcagggaaagggcacaatgtgagggtgttgctcaagtgttctccgttatcaattgtggcatttctggtgctctctagagctcctcctccggctgctctgttagggttcccaaatgttagagagaatgagaagggattgaagcctccatttcatggtcctacgttcgatgcatctttctcccaccatagacattattttgcaaatcccaatggtgaagacgtgcggaaatga

SEQ ID NO: 32547 - DNA, 957 bp, Glycine max
  Peptide Sequence Number=SeqID_149325
atggcaacccaaagtgaagaaaatgctacaaaattccttcaagcttatacccagattgatgatcatagtttgagattcatacactccatgtcccttaaatgtgcaattgacttaagcataccagacatcatacacaagtatggccaacccatgccactctcacaactcattgcttcactaccaatccacccatccaagacttgctacatccatcgcttgatgcgactctttactcattccggtttcttctctcggcacgatttggtcgaaaacgaacaagaagtgatcacgtatgagctaactgatgcatctagactactcctcaaggaccacccttttagtttgaggcctttgttgctagtcacacttgatccaagtgtgattaagtcatggtgtcaattctctacttggctcacaagtgaagaccgtacaccgtttcaaacggagaatggggtgacatattttgattatgctaagcgtgaccccaaattcggtcacttttacaatgatgcaatggctaaggacactcgattcgcttctagtgtggtgattgaaaactacaaggaagtgttcgagggattgaagtcaattgttgatgttggaggaggaatagggaccatggctaaggccattgctaaggcattcccacaagtgaagtgcactgtgtttgatctcccacatgttgttgatggcttgcaaggaacagaaaacatagaatatgttggaggagacatgtttgaagtaattcctgcagctgattgcattatgctgaagagccctcacagtccaggtacaacgacgcaattatcaggggcgcgctctaccattgagctaatagcccgtcgtacgggcctcccgccagagcccgctatgccaaaagcaagagaaactccatccctctctttccttttttcaccccatccatgtcgccctcgtgtggcgacatggatggggtga

SEQ ID NO: 32548 - DNA, 239 bp, Glycine max
  Peptide Sequence Number=SeqID_149326
atgaagaacggtggaaaaccttggcgaaatcgccaacggaaaggtctcggaagcgttacggaagcgcctcggcttggattttcttcacggaaacaatttttgtcactaattttaagtgttctcagataccaggagggttctgccctccttcccctatttataggggaaaagagggaggtggttgccgcccagctcgcccaggcgagttgggttgcttccaccagaacgcaccgccatct

SEQ ID NO: 32549 - DNA, 1012 bp, Glycine max
  Peptide Sequence Number=SeqID_149327
gatagaggttgaaagagagagctccgctaggatttctattacagaggctgatgacccccttactcgatccacgaggaaggtgaaatggaaatcggatgatggagaacaccatgcaggaagcaagatagatgcagaaaatgataaaggaaagggaattggtcatgccgacgtatgttatggcagcccgaacaaggaagttttgcttactcctatctctcaagtagacgcgggaagatttaaagagattccaattacggatgatgagtttagtgagtggtgcaaaccgtggaggggatcacttatggtgacggtgctgggaaggaaggtgggattgagacaactggagactaaattgaaaagagattgggagaagaagggatctattaagattatagatgtccctcgagattactaccaggacaaagcgtgtgtgaagcaggcttccaatgaggtgataaggtgggtcttggaggacggtggtaaaaaggaggaggtagtggcggatgagaggcagctggtgctggagctgaatgctagtgcaattaaggatcataatgataataacgaaaataaaggaacaaatgaggatgttatggacacaataaatggcaatgattctagcatttatggtccatggctattggtgaaaaaacccgttagaagaggagaagatggcaacattaatgttttcaataatgtagcgtcagggccaacaactactaaggcccataaggagatgtcgttggtggtgaaatcgaaggtatttttactggaagaggaaacactgaagtttatcaagctgatccaagaagcttcccaacctaaggaatccaaggttgctactccaaacccaagcgttatgaaagggaacaaggctagttctgatatggagtctgagaacgatatgggcactccatcaagcatgcaagcagatgttgtgacatgtaccctctatccaaggttcacattcacgttaatcgccaaattaaaatcttatcaaataagggtatga

SEQ ID NO: 32550 - DNA, 954 bp, Glycine max
  Peptide Sequence Number=SeqID_149328
atggatggaagttggatgaacgcatgtcatatgagccttgcatgtgaggaaggcatggaacaattattgcaattttcttccaaaagaagtggaccggatgaggacgaaaaacattttttcccttgtataaactgtttgaatgggagacgacaagtagtgcatgatatgcttccaaaggaaaacagattgtcaaaaagttactatcaggcgaagaagatattgtgtccgatgggtatggagtatcagaagattcatgcatgcccgaatgattgcatactatacatacatgattttgaagaaatgaacaaatgccataggtgtggggtatcgtggtacaaagtcaaggattataacgaccgtagcagtgatgaaaactcgaagaaaggccccccagcgaaggtgttgtggttgactgaaactctaatggaatgctctgccatccgactgatggaatgctctaccatccgactaattccttacatggcatgcacatgggagaaactctacatgtggaaagaccttacatggcatgcacatgggagaaactctaatggaatgctctgccatccgactgattcctcccagtggaagaagattaatcgtttgtatctggattttgacaaagaggcaataaatattaggcttggacttgccactgatggaattaatccctatggaagtataagcactcaacacagtctgtggcttgttttgctagtaatttacaacttgcctccttggttgtgtatgaagggagaatacatgatattgtctatgatgatatcgggcccaagacagccagaaaatgacattaatgtttatctaattcccttgattgaagacttgacaaagttgtgggatgaaggggttttagtgtttgatgggtttcaaaatgagacttccgatttgcgtgtaatgctattttataccattaatgactttccaacatattga

SEQ ID NO: 32551 - DNA, 726 bp, Glycine max
  Peptide Sequence Number=SeqID_149329
atgaaggatgcatcatctgagttttacaatcttccaatagaagagaagaacaagaatgcaatgacctcaaatgaaatacaaggatatgggaagggttatctagtttccgaggagcagacacttgacaggtcagatgtgctgatgctgcacatttactccactcggtacaggaagcttcaattttggcctaaaattccagagggattcaagaaggggaattgcgctgagcaacccaaagttgcgctaagcctaattccaaccgagaggaaatgcgttgagaccccagagggttataaatacgtccttagcgtgaaaaacacgactttcactctcctcttctcccaaaaacttctcccaaactctagacctaattttccaccacccaagaccaccaatggccgtcgttgcttgccgttggacccccacaccaagaggaacactttaatcggagcagaatcctcagagtcctccttgaaaattcgatggagaaaatcccttaatcctccatttcaaagtttctctgagtgcactgaccttctagggtctttgacacttgctttgggccacgttcatgcgttggatgttgtgtataagtgcactgaccttccagggtttttggcacttgctttgggccacgttcatatgtcatatgtagtgtatgttcatggggggtggagtgcactgaccttgtcggatggcccagacgtgggtgacaagtgtggttaa

SEQ ID NO: 32552 - DNA, 1005 bp, Glycine max
  Peptide Sequence Number=SeqID_149330
atggaggaagcacccactttagctccatctataccattagaaaatgttcaagaaatggtaaggaatgatcctttgcatgtgcctataggatatgtgacgagtcaagaagaattggagaaagccaattatatgcctcacctttcatctgagatccctgtcattgatttagcattgctctcaaatggaaacaaggaggagttgttaaaatttgacgtagcatgcaaggagtggggtttctttcagatagtaaatcatggtgttcaaacagagcttatgcagaaaatgaaggatgcagcatctgagtttttcaatcttccaatagaagagaagaacaagtatgcaatggtttcaagtgagacacatggttatgggaagggttgtgtagtttctggagagcagacacttgactggtcagattcactaatattaatcacataccccacccagtacagaaagcttcaattttggcctaaaactccagagggattcatggagataatagaggcttatgcaagtgaagttagacgagttggggaggaactgcttagttcaatgtcagtgattatgggaatgcggaagcatggtttgagtccacattctgacacaagcagcatcaccttgcttatgcaagacgatgatgtaactggcttagaaattcgacaccaaggaggatgggtgccagtgaacccaataccagatgctctagttgtcaatgttggagatgtaactgagatatggagtaatggcaaatacaagagtgtagaacacagagcaatgacaaataagaacaaggaaaggatttcttatggattatttttgtgcccacagcatgacgtggaagttgagccacttgatcatatgatagattctcataaccccaagttgtttcagaaagtaaggtatggagattatttgagacaatctctgaaaaggaagttggagggaaaaacacacctaaatgaggcaaagttaaaggagtctgatctaaggaatcaagatgattaa

SEQ ID NO: 32553 - DNA, 1350 bp, Glycine max
  Peptide Sequence Number=SeqID_149331
atgggagcatgtggctttgggaatttgattaaggatatttgtaaggaatatgagacttccatactgtttctgtttgaaactcatgcaagcaaagaagaaggggtggagaggattttacctaagcttggtttcgatagtagcttcattcagcctgctcacgggcacttaggtggtatttggtgcttgtggaatgatgactattggaaggatcgatgtggaggatcagtaaacccttcgaggaaaaatgctattgacttccaacgaaagatggaggattgtgaccttattgatgcaggctttcagggccttgtaatagaggaattttggtgcaaggagttgaattgggatgatagattacgcgattttagggtggaattgaggagatggaataaagagggtgatctggaacgagtattaggaagtattaagacaaggggaacttctttggtttcaacggtctcgagcaaaatggatcaaaatcgtgtttgggttggggatcaagaaactctagaaaggttagtgattgagtattatgctttgctttgtactgatgatacccctgattcacagttttgcatcagcggagttggtgaacccgtggatttggagaaggcttatgataggcttaaatgggaatttgttctttggaatggagaggccttgagcaaattccttccttctagaggcattcgccagggagaccccatcttaccttatttgtttgtgttatgcattaagagactttttcaattgattaatcatgttgtggagcttggccattggatcccaatccaattctctagatttggtccaaagttgtctcatttggcttttgcggacgacctattattgtttgcaaaagctactatggatcaagcagagactctaaaaaaggtcatgaatgtgttctgtctaagttctggccaggaggtgagcgaagaaaaaactgtagtttatttttctacaaatgtgttgtggcaacaaagagatcaaattgtaagtgcgcttgattatcaaagaatgacaaaccttgggaagtacttaggagtgcctctccatcatgataaagggacaaagcaaagctatcaatgccttatggataaaatgaatcaatggctcaacaattggaaggtctcaagactatcattggcaggcagggttaccttaccaaaggacatgacttctactaaaaaggttcgttggttgaattggaatgcttgttgcatgccaaagaggagtgatagttttggattgaggaaggaaacttctatgaatcaagcaatgttgtccaaggcagggaacaaatctgtggagaggaattgtgaagacttggagcatgatgtcttctaa

SEQ ID NO: 32554 - DNA, 843 bp, Glycine max
  Peptide Sequence Number=SeqID_149332
atggtgctcaaaaagagcttctgcagaaaaatgaaggatgctgcatctgagttttttgaacttccagcagaagagaagaaaaaatatgcaatggactcaagcgacatacaaggttatggacaggcttatgtagtttctgaggagcagacactagactggtcagatgcactgatgttagtcacttaccccacccggtataggaagcttcaattttggcctaaaactccagagggattcaaggaaataatagaggcatatgcaagtgaagttagacgagttagtcaggaactgcttagtttattgtcagtcattatggggatgcagaaacatgttcttcttgaactacatcaagaatcacttcaagctttacgtgtgaactactaccctccttgtagcacacctgagcaagtactgggtttgagtccacactctgatgccaacaccatcaccttgcttatgcaagatgatgatataactggcttagaaattcgacaccaaggaggatgggtgccagtgaccccaatatcagatgctcttgttgtcaatgttggagatgtgattgagatctggagcaatggcaaatacaagagtgtagaacacagagcagtgacaaataagaacaagagaaggatttcttatgcattatttttgtgcccacaggatgatgtggaagttgagcccctggattatatgatagattctcataaccccaagttgtaccagaaagtcaggtatggagattatttgagacaatctatgaagagaaaaatggagggaaaagcacacatagatgtggcaatgacagaggattctgaatctgatatgaggaataaagatgaataa

SEQ ID NO: 32555 - DNA, 1638 bp, Glycine max
  Peptide Sequence Number=SeqID_149333
atgtcgttgaaccgtggtggaggaggagaagaagatgaactctatgagcaactatggaaagcgtgtgcaggaccccatgtggaagttcctcgtactggccaaagggtcttctatttccctcaggggcacatggaacaattagaagtatcaacaaatcaggaactaaaccaaaggattccactcttcaagcttccctccaagatcctttgtcgtgtcgtcaacgtccatttactggctgaacaagaaacagatgaggtttatgcacagattactctagtgccggaatctaatcaagctgagcctatgagccctgatccgtgccctgctgaacttccaagtccaagagttcactccttctgcaaggtcttaactgcctctgatacaagcacccatggtggcttctctgtcctcaggaagcatgccactgaatgccttccagctttggacatgtctaaatcaaccccaactcaggaattggttgccaaggatcttcagggctatgaatggcgctttaagcatatatttagagggaacaatggagaattgcgggttggagtgaggcgcattgctcctgtgcagagcagcatgccatcatctgtgatttctagtcagagcatgcacctaggagttcttgcaactgcatctcatgctgtagcaactcagactctttttgttgtatattataagccaagggcaagccagttcattgttagtgtgaacaagtatttggaggctatcaaccaaaaatgtaatgttggtatgagattcaagacaaggtttgaaggggatgaatcccctgaaaattacaaaagatattctaaaacacggtttattagattttcgggcacaatagttggagtagaggatatttcccctcactgggtaaattcaaattggcgatctcttaaggttcaatgggatgaacctgcatcttttccaagacctgatagagttttaccatgggagatagaacccattctggcttctgttcctactacatcatctcaaactgctgctataaagaataaaaggccacggcaagcaagtgaacttgcagatcttggagacacaccattagctttccctactttctgggatgctggactgacacagtctgatatggcaaaacttagtgtcatggccgaaatcaaaaggagtgacagtagttcccatatgtggcatcataacagtaaaagcagcaacaatggtatatcaatgaatcagacagaagcaagttggctatcttctccttctcaattatatcatgacacaaccgatgatagcaagagcatctcagcttggcctatttcaaaacctcactcagagagattgaacaatgatcatttccttgaccaggttgacaaggagatcaacaaagtagaggctgctacaagttatagattgtttgggattgaccttattgatcatgcaaggaacaactctctttctgcagagaatgcatctggaatcacctctgagtgcaaaattgatgtaaaccatgtgtccgatatctcaaaggcttctaaagaatggaaccaagaacagctacaactatctccaaaagagactcaaagcaaacaagtttgtagcagaagttgcactaaggtgcttgacatgtcacatgtgttgcttatttag

SEQ ID NO: 32556 - DNA, 345 bp, Glycine max
  Peptide Sequence Number=SeqID_149334
atggaatgggctcgaaagaatcagatatcagttgtggaaaattgcaagcgatattctacctacaaatgccttgaggagctatggtggcttcttgtggtgtgttttgagatctctaggagattggatttctgtagtgtgcttgaagctaagctttggggtattatgtatgacctccaaatggcagctgaggctaaaatggaacatttgcatgttgctattgatagtctccgtgccatgatgcttatttatgattgtatgcaatttgagggtcacaacatcgcttctttgttggaaagtgaagtgaagtttcagaagctgcacctttggccatattgggagaaatga

SEQ ID NO: 32557 - DNA, 207 bp, Glycine max
  Peptide Sequence Number=SeqID_149335
atgcctctaagtgattcaatccgttgggatcccatagtggattccatcacaatgctcatcgcgcaaaaactcatcatccttaaagggtcttacaattggtttccaaatgttagaaagaagaagggattggaacccccatttcattatctctgtgcgagggacatttctctcacgaaagacattatatcaaaaatcccaacggtgtaa

SEQ ID NO: 32558 - DNA, 549 bp, Glycine max
  Peptide Sequence Number=SeqID_149336
ggactcgcactgcctcctgagcctgaggttggtccttctggcactcgcgtcaatacaaaggagagttgtgttgatccctcggggcaggaccaagacacaggtgagttagagaaatgtggattatacgtcgatgaaaatcctccctacctggttgcctttggaagattttatgaggggtcgaccaccgttcaaaacatccctttgggaaatgatcaagtcaaggtcggtgttgaggaagttcgagatgctgatgctcgcattcttatacccactcaagaggttcggttagtagggcagacacttaacgctttccttgcttggccgatacatcttgtgaagcgtttgtcaaaacatgttatgtgggattctatcgtatttggggtgtataatgacaacttccccttgtacataaagcatgaagatctttctgaaatagcacacggtggtcaatgtctaagcatctatgttatacaattgtggattctgcatatgagtgagacaagtatgggagcagggaatgtcgatgtgtatggattcctcaagccatag

SEQ ID NO: 32559 - DNA, 330 bp, Glycine max
  Peptide Sequence Number=SeqID_149337
atgatgttgctttcttttgaatctatgcatgcagggtggccccaacctacctattgtgatttttgtggaggagaacatgtaactggtgattgtcatttgtacttcatgaaaaattctttgttggagcaagaggtatatgttcaacatgaaagccttcctcaagttagtatctctttccatcatctgaatgtcaaggaagaaaggcatgaagaatttgataaattcataagtgcctttattgccttgttcaccaacactttctctacaaaggtttggaagctcccactttgttacttgactttcatggaattcctccccaagatgagatag

SEQ ID NO: 32560 - DNA, 807 bp, Glycine max
  Peptide Sequence Number=SeqID_149338
atgaaggatgcatcatctgagtttttcaaacttccaatagaagagaagaacaagtatgcatcggcctcaaatgacacacatggctatgggcaggcttatgtagtttctgaggagcagacactagactggtcagatgcattgatgttaatcacgtaccccacccggtacaggaagcttcaattttggcctaaaactccagagggattcatggatataatagatgcatatgcaagtgaagttagacgagttggtgaggaactgattagttcattgtcagtgattatggggatgcagaagcatgttcttcttggactacataaagaatcgcttcaagctttacgtgtgaactattaccctccttgcagcacacctgagcaagtgctgggtttgagtccacactctgacacgagcaccatcaccttgcttatgcaagatgatgatgtaactggcttagaaattcaacaccaaggaggatgggtgccggtgaccccaataccagatgctctagttgtcaatgttggagatgtgattgagatctggagtaatggcaaatacaagagtgtagaacacagagcagtgacaagtaagaacaagagaaggatttcttatgcattatttttgtgcccacgagatgatgtggaaattgagccccttgatcatatgatagatgctcaaaaacccaagttgtatcagaaagtcaggtatggagattatctgagacaatctatgaagaggaaaatggagggaaaaacacacatggatgtggcaaggatagaggattctcatctcacgaaaaaagatgattaa

SEQ ID NO: 32561 - DNA, 342 bp, Glycine max
  Peptide Sequence Number=SeqID_149339
atgactaggtggatgactttaaagaatctcatgctagaggacgctgaaacacaatgctctgataagatgatagagggtgttacaacaacactggtggaagcacgatccaaacgaaccagaacagtggaattggtggacaacgatgttggtggttgtgtcaccagccaaaaaggagatggagctacggtggcaaatggcggctaccaaaaaatgattcacaaaaggggaaagggttgttggaaagttaaagcaggttaccgaaataagtacaatgattgtaaaggcccactcggtgggaacaattttcgttattccctcaacctagctctagataccatatga

SEQ ID NO: 32562 - DNA, 249 bp, Glycine max
  Peptide Sequence Number=SeqID_149340
atgagtcacaatgtagagtatgatgagttagtgagtgaaatggaggaagcaccctcttttgcttcatctataccagtccccaatgttcaagaaatggttcctttcattgatttagcactgctctcacgtggcaacaaggaggagttgttgaaattggacttagcttgcaaagagtggggtttctttcaggataactattacgatatctatgtagcctatttaaagggcagccttaattatgcaaattaa

SEQ ID NO: 32563 - DNA, 294 bp, Glycine max
  Peptide Sequence Number=SeqID_149341
atggctgttaaaaattttgaggtgatcaaacgaaggtcgcatgccgacaaacaatggtctccggacgaaattagggaagaatttgaggctagactatctcaagttaagtctaatgttgcatcaagtgttggtaagtcacaaatcactcctttagaccttgttgaagaacaaagacttaggactcggggttgggttgcgactgtgggaccaaagcgtaaaggacacctttacggtattggagatcttgctcatacttataaatgtggagataacaacttcatgcaacatacataa

SEQ ID NO: 32564 - DNA, 264 bp, Glycine max
  Peptide Sequence Number=SeqID_149342
atgaagtccaagtgcaaagcaaggaaccatttggtgtttcgatcaggaagacaaaagataccaagaaagaagggcaaaagggtcttttccttgtttttcctgggccccagcccgcccaggccagcatttggctcgcctgggccaccaaataacttcaaggctaagggactagctcgcctgggtgagctcactgctttagggttaagtttcagctcgcctagggaagctgcaaccgccccaaggtggccttttgcctataaatag

SEQ ID NO: 32565 - DNA, 405 bp, Glycine max
  Peptide Sequence Number=SeqID_149343
atggcaattgaatccggccacatgcttgcagaggtgaatattgaaggctctctggaaggggttcacaatatttctaaacaaaaagaaacattagttaaaacaccaagtagtgtactcaggtctagtaaaacttatcttgagtctcacccttgtcacgaaaaaacaatctcaaaagcttctggtgcttccccaccccatcctcaaacatccattgccaccccaccccaccatctcttcactttcctcaaactcctcactgagccagcctaccccatcctccaacatcgtcgtgtcccctcaatgtaccaccacccaactcagaccccaacgccaatcacgtgcaacaccactcaccgccctaccacccaacccaagattttgacatgcacaacccatgatgtttga

SEQ ID NO: 32566 - DNA, 555 bp, Glycine max
  Peptide Sequence Number=SeqID_149344
atggaggataccaatgagttgttgcacctcttggtggatgctatgaataggggattgcgtgatgccaatgggtcacttagcaaacaaaatgtagaacgaataatacttcctcaattcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagtcaacacctccatttctatttaaaacacaagcagagcttgtgttggcatgtgcagcacttcataattttcttcgcaaagaatgtcgttctgatgaatttcccgtggaacctactgacgagtcttcatcttcatctttagtgttaccaaattacgaagacaatgatcatgaacccattgttcaaacacaagagcaggaacgagaagatgctaatatatggaggactaatataggttcagatatgtggagaaatgctaataattag

SEQ ID NO: 32567 - DNA, 1629 bp, Glycine max
  Peptide Sequence Number=SeqID_149345
atgttgagagtgaagggagggagcaggccgccgtgggtggggctcggtgccgccgtttgggtccagatcgcgtcggggaacacattcaccttcccactctactctcactctttgaaatcagttctcggcttcgaccagcgccacgtcacgctcctcggcgtcgccgtcgacatcggcgaaaacctcggcctcctccccggcctcgcctgcaacaagttccccccttggcttctcctcgccgtcggctccctcgccgccttcctcggctacggcctcctcttcctcgccatctccgaaactcttcactccctcccttacataacgctatggtttgctctagttgttgctgctaacagtagtgcgtggttaaccactgccgttctcgtgaccaacatgagaaacttccctgctagcagaggctctgttgctgggattctgaaaggttatggggggcttagtgctgcggtttttaccgagatttacagcattgtgcttcataattcttcttccaagttcctgttgtttattgctgttggtattcctgttgtttgcttcagcatgatgtttctcgttaggccttgtactccggccaccggtgacgaccctgtagagccttatcattttctgtttgtccaaggttccagcgtggtcttgggtgtgtaccttcttgcgactacggtagtgggcaatattattccatttagtggtgctgtttcgtatgttttggtggctgtgatgattctgctactcattgctccacttgctgtccctttgaagatgacattgtttcctaggaatggttctaaatcagactcgccagagcaacaagttgggtcttctgagggcaaagatgagaatgctgaaccactgctggcgtcttcgtcggcaggagcccttgggagttttgatgatcaggatgatttgtctgaggtggccgaacttcttgctttgggtgagggagcagtgaagcagaagaagagaaggccgaaacgtggggaagattttaagttcactgaggctatagtgaaggctgatttttggctgctattttttgtcttctttgttggtgttggcactggggttactgttcttaataatcttgctcaaataggtattgctcaaggggaggaagacaccactaccttgctgtcaattttcagtttttgcaactttgtggggcggcttggtggaggagttgtttctgaacattttgtcaggacaaaaacgatcccaaggaccgtctggatgacatgcacccagactcttatgctcgttgtttaccttctgtttgcctatgctatcaatggaaccctttatcctgcaattgcatttcttggtgtctgctatggtgtgcaagtttccgtgatgctcccaactgtttccgagctttttggtttgaagcactttggcgtgttgagcagcttcatgtcgttggggaatccgattggtgcattcctcttttcagcactgctagcagggaacatatatgacaatgaggcagcaaagcagcatgtgtgtgctgccggcatcgtcttgagcattattctgactttgagaattaagcccgtttaccaaatgctttatgctggaggctcttttaggctacctcaaacatcttcaaatcactga

SEQ ID NO: 32568 - DNA, 198 bp, Glycine max
  Peptide Sequence Number=SeqID_149346
atggggaatgatgcagactcaaacagtggaacagaggatgacattcattcttcaactaactttgaattctacttacaaggattagagagggccaagataatagtgaacaaaccattaccacaaaagcggttagagaccctaatagaagcacaaaaacaagcactgcttgaagaagttgaggaagagaacagtcactag

SEQ ID NO: 32569 - DNA, 123 bp, Glycine max
  Peptide Sequence Number=SeqID_149347
atgaagatcttcatcactttgaaggatgttgtagaagggcatgcaagaaacaaggttcggcataagactttaaaaggagttaggggttggggacggtttgattacagcacagggagagactga

SEQ ID NO: 32570 - DNA, 234 bp, Glycine max
  Peptide Sequence Number=SeqID_149348
atggatatacagaacaacaacccatttgatcatgacaaccaacagtatccctttgcaatgtccaacaacatagcacctccccctagtgatattgtcaaaagtgcaagcgcggagatttctggtgaagggatgattgagacatttcataatgataatgaagcactggctactgtggacaatagggttgtgcttaatgtgatttctcattctctttgtttgaacaacttcatttag

SEQ ID NO: 32571 - DNA, 459 bp, Glycine max
  Peptide Sequence Number=SeqID_149349
atgaatgagaaagggggaaggaaactaaagctggcaagcagcacaactttctttttatatcgtgtgcggtgtgcgagtcatgtctcgtggactcttggtttatttagaagcagagatcatggcttaagccatgttgaaacaaaagaggagactcacaaggagttggttaaacagagagaagaaaccagactagagctgcaagccttcgttgaacaacaaaggctggagaatgagcagtatcggctatctatccagaatgtaattactgataagttcaccattgtcaattctgttgtccacccatcaccagctgtgactctacctcaaccacctcttgttactcgacctccacaaccaagtattccaccgccacctgtccactcagtgccacctccacctgctcagtctaaagcaccaccaccaccaacccaaccacaattgccacctactcaagattaa

SEQ ID NO: 32572 - DNA, 303 bp, Glycine max
  Peptide Sequence Number=SeqID_149350
atggaacgttgcattagttttcctgtgttgaaagacaatagcaacactttgtggttgagaggaagcactggcatttgtctaatgatgcttgagtctaactctttcaatccaaaatcatctttgtgtcaaactggcctgcgcttccgtgactgcaaccacattgtggagatcgtgtttgtggagatcgtcttcgccacttatcgattgagttcgtgtttgtcgcaaactgggctgcgcttccgtgactgcaaccacattgtcgagttcgcgtttgtggagttcgtgtctgcgcttccatcgaag

SEQ ID NO: 32573 - DNA, 411 bp, Glycine max
  Peptide Sequence Number=SeqID_149351
atgcctttaaatgtgtcaagaaacaagttagacgacatagtcttctatgttccaaatgaagatgataagcttaaaggtcaagttggagaagatgttaataatgataatgctgatgtagataacctacgaattcctgatgatgatgatgatgatgaagatgttgatgatgaagatggtgcaagaaatgcaacagatgatatcgtggatggagatggaagctacatggaagataaatgtgagttggagagatgctcaaggaatggtgtttgggataatgggaatggaaaggagaggaatgagttagtgttggaaaggaataggactgcaaggtactctcctagtcctgacaacaatttacaatggttgttggctttacttgacttgcatgagagaaatttttggagaaattaa

SEQ ID NO: 32574 - DNA, 153 bp, Glycine max
  Peptide Sequence Number=SeqID_149352
atgaagagactgagtgtgacgatcaaggtggtgctgaggcagagcgaagaaaaatcggcggaaggtggagttgagttggtcaaagagggtttcacacatgcgaaggatttcagattgctacttcacttttgttcatctctcttacatgtctaa

SEQ ID NO: 32575 - DNA, 552 bp, Glycine max
  Peptide Sequence Number=SeqID_149353
agtcagttgttcatactcctactcgagcaaccttcaaccggtaaaaaagcgctaagagatatggaagatcggaaaaatacatccttctatagggagtttgaattcaaggaggaagataatctggttcataccttatcattctcccaagctgcatttagaaccatagaatgtgtttatgtgggttattcacctagtcacaaagttgaagttccaaatcatgagtttggctcttctaatgactctacagatatttctactcctcttactaatgatctaggtgtttataatcaaatttcttcaaatcagaatactggttatggtccctatctttccactgttagacctactaacattcatccacaagtctatagggcaaaagcaaaaagccaaatgaaaatgcaagaaactgtagtaggagaaataaactttgatgatgacagtgccaagaaagttatcatggttgttgttgaatatgcaaaaacatatccaagatttgaggagaactacaaatttatttcccgtgagttgacaatattaaacagatactattga

SEQ ID NO: 32576 - DNA, 228 bp, Glycine max
  Peptide Sequence Number=SeqID_149354
atggcaaaaagaaaagtggatgaattggacaacactgaaatcatcgagaagacaagaagcaagggcattgaatccagcaacaacgtggctttgagggaggaaacgtgtaaacaaatttctaggtatttctacatcaacgtcgttcccttgaaagttgcagaaagtgaaggttttcagaaaatgtgcaaccattttggaggccctaccttcaagccactctcttacatg

SEQ ID NO: 32577 - DNA, 195 bp, Glycine max
  Peptide Sequence Number=SeqID_149355
atgggccatcactttaaaaagagggtgtcaatcaccacgatttcgataggcatgatggcgtggcagagaggacgacaacgaagaggagagatcttgggttgtggttggtggtcggagaaaggaatggttaacatctcaaacttgttgtgcttcacaaagcatgctcgtgcaaaagtccataagagtgaattgtga

SEQ ID NO: 32578 - DNA, 270 bp, Glycine max
  Peptide Sequence Number=SeqID_149356
atgactcattactgtagtggtgatgaacgcaacaatgccaatggcctcatcgacgacctcaagcacaccaattcatgggaaaggaaagagttaaatgattcgacaaaaaaacacaaaaggggtgtatttagtaaaaagggggtgcaaatagcaatcaggcccacttgggccttccagaaggttccaacagaaggcggtgccttctggtggaagcaatcctgctctcctgggcgagctgggcgacaaccacctcccttttctctcctataa

SEQ ID NO: 32579 - DNA, 297 bp, Glycine max
  Peptide Sequence Number=SeqID_149357
atggcttctaggaaacgtaaaagtattggttcaagacccacatcgcagtatgacacaaggagattctcttccttagatgcttggaccagatacatagataatgtgctggggagaaacattttaccagagaggaaagtagagatatatcactctgagctagatgagtttaaggctgaattggagaggcgtaatttccataaacaccccaccaatttagtcgatgggagcatagacgtgactttggtgaaagagttctatgcaaatttatacagttctgaggaccatccaccaaagtag

SEQ ID NO: 32580 - DNA, 309 bp, Glycine max
  Peptide Sequence Number=SeqID_149358
atggtagaatcgtcaaagaaacgaaagggttcttccgcctccgcttcggcttcaagagctcatcgttctggagccactagcatccacagcaccaattccaccctcattgtcctcttccccagtgttttcttccgacgaacagtagaaacggacaacactctgatttctgaagtttttgggataaaaatggtcattgaccagtcccttttccatgacttaaccaaattacccagtgacggtgtaccatttgaaggtacactaaatgacgactggaaatttgatttctctgcccatgatgcccgccagttg

SEQ ID NO: 32581 - DNA, 129 bp, Glycine max
  Peptide Sequence Number=SeqID_149359
atgagtgagatacgaaggtttggaagtttgggaatggaggaacgtcgtaagagaaaaggggctgcgcagggatttctggaaaatgtgatatttatagagcaggacgcgtggccatctgttctagtgtaa

SEQ ID NO: 32582 - DNA, 264 bp, Glycine max
  Peptide Sequence Number=SeqID_149360
atggaggagtttgatactcgggtggcctggccaggagaccaaccttcttcttatggagagggtggggcctctacagcccaggagcctatgactaaggagcctctagcagcaataggaacaatagaggatgaggatgagctcactcctctagagccttttgattttgatgcaggggtggagcctgagcagactattcaggattctttagcagctccagcactagatcttaatgaagaccagccacaggaggagcagggcgtttaa

SEQ ID NO: 32583 - DNA, 201 bp, Glycine max
  Peptide Sequence Number=SeqID_149361
atggttaacgctgtctctagaacatttccattggatttaatgatgaaaactctgcattttcagcgcaaaggagaatctggtaaagcatcagcatcaaagttgtgcgctaagcacgaaatcagtgcgctaagcacagcaggtgccttcagccaggctcagcgcaagactgacgctaagcccaattccatttactcgcgctaa

SEQ ID NO: 32584 - DNA, 276 bp, Glycine max
  Peptide Sequence Number=SeqID_149362
atggaattgggcttagcgagctcgctaagccaattctacagaaaaaattggatctgtgttcactcgctaagcgcgtggctatcacgcttagcgcatgagtcatttttcctaaggcatgctaagcgagtcacttgcgctaagtgcccaatggcttcccgtaagagaaaagccacggctttagtgtctcatgccggttatgatagatcaagattcgtatcacagaaggcctgggaccattactcaaataatgtgcttgccaggaacattctgccataa

SEQ ID NO: 32585 - DNA, 162 bp, Glycine max
  Peptide Sequence Number=SeqID_149363
atggagatgaaaggcttcgtacgcgggacgctaggatgtatgcggtttataggcgttaagaatccagacgatgtcaaatccagagaggttgagccgcagagacaaaaagatgaggagatgaaaaaacgtgaagaatggagtctggagagtgagatacattag

SEQ ID NO: 32586 - DNA, 486 bp, Glycine max
  Peptide Sequence Number=SeqID_149364
atgggatttgtttgttggcgtgtcaaagagggtggagaaattggagaagcaaattgtgaagtgaggtcagggagtgaagccaaggataacatagacacccaaatacctttagatgtgtgtaggatatgggcttgtaaaagagtttggagaaagccatttattaagagaattggtaaaggtccccaaacatcagaatacataagttctaatgttgagtttgatgttacaaaggattcactaaatgaatttccagggaagggtgaccaagacgagcatgccagaggagtggagggggtcgaatggtggatagtgttgttgcttgagtgggtgataagtgttttgttgtgggttgaagggtgtatatgtcaccgctactttggtcatgcatcaatgtcacgcccattgtatgatccttcacacaaaaagaaaaagggtgaaattcaacataaacattattgctttgacataattttgaaatggatatga

SEQ ID NO: 32587 - DNA, 2133 bp, Glycine max
  Peptide Sequence Number=SeqID_149365
atgttgtgtgcttgttccggggagcaattcaaatttgaagaggcgccaccacggtcaccagactccttggcaacaagggatttctctgcaagtggcctttcttcaaggactggggattgggaatccaaatttgatgaaacacaagtagaagatgttgaatctactttaaaagaagctctctcattaaactatgaggaagctcgggctttgttggggaggcttgaatatcaaagagggaactttgatgccgcccttcaagtttttgagggtatagacataagggctttggccccaaggatgataagggctatagctgaaagaatcaaacaaagaaagccacgttccaaggtggataatgggcttcctaatgtgatgtcaatgcattcagtaagcctgcttcttgaggcgattttgcttaaatccaaatccttagaagaacttgggcgatacactgaggctgcaaaggagtgcagaattgctgtggatacagttgaatctgctcttcctaatggaatgcctgagggtattggtgaagcttgtaagttgcaagaaatgttccacagagcattggagttgcttccaaatctatggatcaaggcaggtttgccagatgaagctgtcactgcttatcggcgggctctagtcaagccctggaatttggagccgcggaggttggcctgtgtgcaaaaagatttagctaccacactactctatggaggtgttgaagtaaacctgccccctcagttgcaagtgaatggtctaacaacacctatgagtggcactgaagaggctatacttttgctattaatactttcaggaaagatggcacttcaggaaatagattgggaccctgaaataatggataatcttacattttcactttcaattactgggatgtttgaatcattagcggatcatgtagagaagatccttccaggtgtttatgatcgagccgagaggtggtactttcttgctctttgttacagtgcagcaggacagaatgatatagccttgaaccttttgaggaaggcttgtggtagttctgaagcaaagcatagaccccattttccttcatttttgtttggtgcaaagctgtattctctaaatccaaaccatgctcgtgaaggaattaaattatcacaggaagttattgatctagccaaacatcaaaataagcattttttgggtcagggccaaaaatttcttggcatttgccatggagctgctgctagaacatctgtactggattctgaaagaattatatttcaaagagagtctttgaagtttctaagtgatgctgccctaaatggaaataatgacccagaagtgatgttcagccttggactggaaaacgcaattcaaagaaatctaaatgcagcttatgacaatataatgatttactcagacatgatggctggcagctcaagaagaggttggcagctgttagcactcatagtatcagcacagcagcggtttcaggacgccaaaactatagttgattttgctttagatgaggctggcagtatagatcagttagaactactgagactgaaagctgtacttcaaattactcagcagcaacccaagcaagcaattgagacctacagaatcttgctagctgtaattgaagcaagaaaagagcattggctacaagctaagacattcaggcatgaggcattaacagaacagaagttggaaatggaagcttggcaggatttggctaccatttatgcagatattagttcctttcttgatgcaaaagcttgtgttgacaaggcccagttgatagaatttttttctcccagaagttggcatattactgggttgttgtttgaagctcaatctttgcataaggaggcctttgtttccttctcagtctcgttgtcaatagaaccggattacattcccagtattatttcaacagcaaaattgttacttaaacttggaatgcaatcacttccaatagcaagaagctttttaatgaatgctttgagattagaccccacaaaccatgatgcatggtttaaccttggattggtttcaaaaatggaaggctcgttacaacaagcggcagattgctttcaagctgcatatgagctgaagctttcagctccagtgcaaaaatttgagtga

SEQ ID NO: 32588 - DNA, 798 bp, Glycine max
  Peptide Sequence Number=SeqID_149366
atggatgtcattgcctcaccatcatcaaatcactcaccactacttgatcgtgcatcaacactagctctttttagtccagctactcgatccatgcacaatatccataagcccaacaaaagttttcttttaactaccaagcatccccttccatccaccattgaaccaacatgtgtctccgaggcaatgaaatcaccaaaatggcatgaggctatgagtaatgaatttaatgcattacttgcacaaggcatagaggctattcctaccaagacaagtcttttactcagtcaacacaaatatatctgtgaccttcttgaaaaggcaaaaatgttagaagcaaaagaggttcaaactccactttccactagcacgtctcttacattaaacgatggcactacaattgtagaccaggctcagtacaaaagcattattggtgctttccaatatttatccatgactagaccagacattgcctactcagccaatcggctagcacaattcatgcacaaacccatcactatacatatgacagctctaaaactcctcctgccatatctcaaagctacaatatttcatggacttcatctccacagagggtcatcaccgtctctttatgcctttagtgatgtcaattgggcatgtaacaaggaagattatacttcaacttccgctcatcttgttttctatggaaggagcctcatctcttggaaatcttccaaacaacgtgcaatagcttgttcatccacaaaagctgaatatcgatccctagcaacaaccttagctgaactcacatggatttga

SEQ ID NO: 32589 - DNA, 264 bp, Glycine max
  Peptide Sequence Number=SeqID_149367
atgggtctttgctttggttgcttcggcgtagacaaacgcatgagcaaggaagaagagagattggcctctgaagaagcgcgtgccaaagctgctgaagccgcacagaaaaggcaagagcaatttgagaattctgcagcaggacgagctgctcgtgcacagcaacaagcaatggcaaagcaatctgcaaataccaacaaaggcgaaccagttctaaaggttggtttggtgattcaagatgccacttatggttttggcaactattga

SEQ ID NO: 32590 - DNA, 1377 bp, Glycine max
  Peptide Sequence Number=SeqID_149368
atgggaaaacgtaattctcaacgtaaaaatactgcaatgttggataacgacgatgatagtagtagtagtgtgagttcgtcatcaacttcccgaactgatcacgtctccgtctccgtctcagggaacgaagaagtgcacttcgatcaagatgctctgctcgatcaagctctcgatgctttggatgaaaaaagggattccacgagggagagagcgttgtcagtgatcattggggcattcagtagcaaaatgcagcatcagtttgtcgacaagaagaaagatgaaatcaacttagtgcctgtttggaagctcaatttaggtctgaaagcactgaaattgggatccaaaaaggcatctgcaaaggagatagctttgacatcacatgccattggtttgttgtccctgactgtcgggtgtagtgataatgcacgtgaaatatttgaggaatcagttcgtcctcttgatgaattcctcacatctaaatcagatttgacaaaaattccttcattgctggaatgcttggctataatcacttttgttggtgggaatggtctagaggaaacagagagatcgatggacatactgtggcgagtgattcatcccagattgggttccaatgtagttgcagtcaaaccttctgctccattaataactgctgtggtatctgcttggtcctttctcgtatctaccatgagcgatttgaagctaaattctaaaaattggcaaaattcaatatcttatttatcaagtcttctagacaaggaagaccggcctgtgcgtattgctgctggcgaagcactggttgtaatttttgagattggaatcacagagaaattttctgctgattctaagggtgcaagtgatatgactcaagaagagattaatcggcaggaaagttatacccatttacaaggattgaaagcgaaggtcatcaatcaagtcaaaaacctttctgtggaggctggtggaaaaggttctgctaagaaagatctgaataatcagaggaacttgttccgagatatcgtagacttttttgagtatggttactctcctgaaatttcaatgaaaattggtggtgattcactgcagacatcttcatggtcccaaatgatacagttgaactttctcaagcactttttagggggagggttcgtcaagcatatgcaggaaaatgagttccttcaagaagtatttaatttcacacccaagagaagatatcttaataacaatgaacatcggatgtctagtggtgagaagagaatgtttaagtctccaaattcagttcagaacaaggctaggacccaattacttaataagcaacggttgttatctgagggcagaaacttgggtcactacgcagccaatatggttgatgactga

SEQ ID NO: 32591 - DNA, 270 bp, Glycine max
  Peptide Sequence Number=SeqID_149369
atgtcacttgacttcacgggtcaggatgacaaaggtgcagaagacgatatattgtctggtccaaagacctttctgtattattcttttgctttcttccggtctttgatcgggaactttcttttctttcctttctcttctttcaaaggcaaggatgggcattctcaccctgggtcaagggttatggtgagttgggattttggcttaagacttgtagaacggctggacatgatatatgtcggggtgttggtttggccagcggttcagggataa

SEQ ID NO: 32592 - DNA, 294 bp, Glycine max
  Peptide Sequence Number=SeqID_149370
atgaagttctcttggaatatctccctcttgctttttgaaaattctgttgctggtaatcgattacaaacatctggtaatcgattacaagttcaaaattcaaattcaaaaccctttttaatagctatttttcaaaattgtcttttggtaatcgattacactgcctggttcagtgaggtctttggacttgctgatgaggggttttgcgacggtgatgaaggaggtggtggtgcaggccacgatgtcaaggagtcgccgaatgtgtgcgacaatgagctcttttgtgtagtcctttga

SEQ ID NO: 32593 - DNA, 216 bp, Glycine max
  Peptide Sequence Number=SeqID_149371
atgttgcaagggaaaaagcaacatgaaagcaataaagagatgaatgacaacatgactccctacgctgtggaacttccaagaactcaagatgaagatccaatgaagttctgccattgggttttgatgaagacaaaccaaccaacaaaaacactctcaaaaagtcaagccaaagcaaaaaatagaagttgtgaagtcaaggttcaagaccaagattga

SEQ ID NO: 32594 - DNA, 399 bp, Glycine max
  Peptide Sequence Number=SeqID_149372
atggggccatcatcaagccaggttaggcagctgcttttgagaccaaaagtgtctttcgagtcacatgtagatatagtggtcacttttccttcgaattggaagattctcaattggaaaaagaactacaaaacaagaacgacacgtagaggccatgcaagtgtgactgtgtcgagaatgggacgatgggacaggggtggaagtggtgatctgtcaggcacgaccactagtggtggcctgtcaggcgcgaccagtagtgttggcctactaggcgcgaccactagtggtatcctgtcaggcgtgtccactagtggtggggagccagacacttccctctttcctataaactcattttcctccgtttcattcttcgttacgagatcgtttcattcttctttacat

SEQ ID NO: 32595 - DNA, 750 bp, Glycine max
  Peptide Sequence Number=SeqID_149373
atgctgaacccttttgtttgtggcactttccataacgaatatgatgatgaaccatgtcttgcaagtcctaattctagccccagaaaatataaaagaaaagttagcaagaacaacccttattccgctcgtggcctagacaagttttctgagcttttggctgatcttgatgagaagaggcagaagatttattcacagatgaaccctcatgacatctctttcgttcgctttgtatactccaacactaatgatgatattgttcctgttgtggtcaaggtgaaaaacaacaaggatcagaaacacagcaagagccaagaactcaaagtggtgagagcaagaacaacaacaatgacgttgactcatacatcagagtactcaatggacaagtctgcaacaactgatcaagaaaaccctgctgaagaaagaaagcaacaccagatagaaactcatgcaaaggtagctaagaagaagaacaacttttcttgggatatggggaagccttctttctatgttcctgtggttatgatattgattttgttgctcttgattgtgtttggaagatccgttacaactctttccatttgtattttctggtatgtgatctccactttgaagggtagttcatcatcaaacacatcgaagtccatgacgaagaaggattatgttagagggttgagtgaaaagaagattgtgatcaatgaagggacaaggaaaaaaaatatgttagagggtggagtgaaaaaatggtggtga

SEQ ID NO: 32596 - DNA, 171 bp, Glycine max
  Peptide Sequence Number=SeqID_149374
aggaaagggtacccgagtgttgagagggtgaaagagttggtggggaaggcttttgattgggggaagttgaagaggaggacttctgcagcttctagtgattggaatgctgcaaggaactctgggtctttagagagggatgttagatcaggcaatggtggaggtgatatttga

SEQ ID NO: 32597 - DNA, 1113 bp, Glycine max
  Peptide Sequence Number=SeqID_149375
atggcgaataacgagaacgagacatgttccttcaccgatttcccagaggacattcaggtgtccatcctctcgttcctgggcccatcggagatcgcaaccctagcctgcacctcgaagaaactgggctctctctgctccaccgtctccaagctctggttctctatgtgcgagcgcaggtggggctccaacacccgcatcacccaatgggcccaaaagcccgccatctccttcaagcaactctaccacaccctccaccgctgggagaatctcctcggcttctggcgccgaagcggaaccggaatcccttccttgctcttcttcgagtggggcccatccttcatctccgcttctagggtttccccttccgactccgattcgaacacctatggtgtcaccaaaacgccgttcctctggatgagcctctctgaggagggacacgtggtcacgtttctcgatcccgacgggaggagatccgatttcaaacccgagaatcggagcgaattggtggctgtggatgtgagtttcatggggaagacgcattttgttgtggaggagaagcgggttagggggggtgatgacgatgtcgtggtggcggagagcggatcgccgccggagagactgatggcggagatttaccagcatttcgcgaacccgcggagccccgggagtgatcggtccaggaggcagaggcggcgcgagaaggagaggctctacgggaggaagtgggagcctcagcattttgtcaagattgtcaactgctcgccgactccggcccgcccattgcagggcctgtggaagggaatttgcggtgacatgagtttggcattttaccttgtggcatatgatgacattgggggtattgcctgccggtggattggggatcctcctgaccatttttcaggacaggccccggttttctggacgtctaatgctacgtttctggaatctcccttttctccagaggaagaatctttgtatgacagtcgtgttcatcttcaaccgcttcaactgggcaatgaagttcttgagcagttccctttgtcggactgtgaattggtaaatcaaattcagcagttccagttgtcaggcaatgtggccttgctggaacaatga

SEQ ID NO: 32598 - DNA, 102 bp, Glycine max
  Peptide Sequence Number=SeqID_149376
atggcgagttcactgcggactggacgcgtggaacgcaaaccgccagcggcgcagggctacggtgcaggagctccagtggtaggggtgcagtgcagactgtga

SEQ ID NO: 32599 - DNA, 174 bp, Glycine max
  Peptide Sequence Number=SeqID_149377
atggttgaggaggagttggaatccactcaaagagtgattttagccattgttgatcctgtgctcattgctgtttccaaaagtgctcctgcgctaattgctggaaagtcaagtgtgcttaagcctccaactcagaagtctatgatttataccaacagcctaatagagagcacataa

SEQ ID NO: 32600 - DNA, 441 bp, Glycine max
  Peptide Sequence Number=SeqID_149378
atgatgctatctactgccaaaggtgcacagtcttacaatgacattagaatagtcaatggggtggaagctaataattggggtactgcacactacctaagaaaattatttgtcaagcttttatttatgaacaccatggacagaccagaatatgtttggcaacagacatggcaatggatagcaaatgatatcatattcaatcatagaaaacaagaatatgctacaagccaacagaaggagcttgcgagattttccatccatgccatacccaataggatatgcacgaaaccaagggtgccaagtattgtgcaacaaagggtgccaagtatctcgaagcggccagtcaaaggaactgatccggaaaataacagaaaaacgtatttcccagtcaccagaggctccgcgcttgataacggaggacacatgaacagcgctaggcaatga

SEQ ID NO: 32601 - DNA, 162 bp, Glycine max
  Peptide Sequence Number=SeqID_149379
atggctttgcagattgcggaggcgttgggatatggtgggtttgtcaggatgcttgttgatgctttgggacacgtggcagagggagaacacgttgaggagatgaagaagatgggatttggctctgtttcactacttgtagataaagatacggacgatttttaa

SEQ ID NO: 32602 - DNA, 118 bp, Glycine max
  Peptide Sequence Number=SeqID_149380
atgaggggaggaggtttcatgacaactcgcctaggcaagctagttgcttcctccagaagtaacttgctcgcccaggagagcttagctcacccaaaagagctgattgcttcacctttaa

SEQ ID NO: 32603 - DNA, 258 bp, Glycine max
  Peptide Sequence Number=SeqID_149381
atgactgaagcacgtctaaggggggtacagaaagtaaatgataacaagaataaaattgaagatcgaagaagacgaagaacgaacgatgaatgttgcagaacgggtgaaaatcttcgcgtaattacccaaggaaacggtacggaagcgcctcagcttggattttcttcacgaaaacaattttcctcagcaatttcaagagaatacgaagtgccaagaaggctcaaccccttccttcttcattcctccccctatttttag

SEQ ID NO: 32604 - DNA, 798 bp, Glycine max
  Peptide Sequence Number=SeqID_149382
atggcgcagctcgatgccgtggtcgagcgcctgcgcgcggtgccgaggccggggcaaccggcgccggcctggctgctggtcgatgcacgtgcgcgccacatcggtgaagcgacgctgcaacaggcgttggccgaacgtggcgaggacgatgccctgcaggtgctgtggctgcaggacgatacccttccggcacgcccgcgccagcggcagctaccctcgcatttcgacgacgctgcgctgcatgcactgctggctgcaccggtcgcgcatgcgcgccctgccgcgctgctggccaacgccgaacaggggcagcccacgcccacgctgccgccgttgcacctgcgcgtgctgctggtggaagacaacacggtcaaccggatggtggccgagcatctgctgcgcgtattccagtgcgaggtgcgcaatgccgccgatggcgagcaggcgctggccgcccttcgcgaaggcggcgtggacgtggtgctgatggattgccagatgccggtgctggacggctacgccgccacgcgccactggcgtgcggaagaagcggaaaccgggcgcacgcggttgccgatcatcgcgatgacggccaacgccatggccggtgatcgcgagcgctgcctgcaggccggcatggacgactacctgtccaagccgatcgcacgtgccacgctgcatgcgctgttgcagcgctggggtggcgggaaggctgcatcacctggacagccttccgtagagccaacgctgatgtccggcggtgcttttgccgttacgcaccaccccgtcagtagctga

SEQ ID NO: 32605 - DNA, 654 bp, Glycine max
  Peptide Sequence Number=SeqID_149383
atgatgggccgcgatgcgctcgatgcgtgcccgcagcgttgcatcggcactgaacagcagcagcggtgctggcgcgcgcgccatcgccggcaggtcgccaggaaccttcagcagcgggatctcgaaccagaacgtagcgccctggccaggcgtggactgcacgccgatctgcccgtgcatcaggtcgatgatgcgcttgcagatggccaggcccaggccggtgccgccgtagatgcgggtggtggatgcgtcggcttggctgaaggactggaacaggcgtgcctgcagtgtgtcgtcgatgccgatgccggtatcgatgatctcgaagcgcagctggtgctgcgcggcaccttcgcccagccgcagcacgcgcagctgcacctggccgcgggcggtgaacttgattgcgttggccagcaggttgctcagcacctggcgcaggcgcaccgggtcgccgcgcaccggcaggcgcaccgaaggatccagttgcaggcccagggccaggcccttggcgtcggcggcgcgctgcatcagctgcaccacgccatcgagcaggtcgcgcaggttgaagctggtgatctccagttccagcgcctgtgcttccagccgggagtagtcgacgatgtcgtcgacgatgcgcagcagctgctgtga

SEQ ID NO: 32606 - DNA, 285 bp, Glycine max
  Peptide Sequence Number=SeqID_149384
atggcttcgagaaagctcccagccaagaggtccgggaaggatgcaactggagagggttccagtgcagcctcgcaggtggatgtggactttgatggacataggttccggagtacgaagcaccaacaacggtttgaggctcagctcgtatcacccatggctaagtttgatcctgagatagttatggagttttatgctaatgcctggcctaccgaggaaggagttagagacatgcactcctgggtgaggggccagtggattcccttcgacagggatgccatcagttag

SEQ ID NO: 32607 - DNA, 150 bp, Glycine max
  Peptide Sequence Number=SeqID_149385
atggagagcataagaatcaagggacaatgcacttacttatttaggggtaaagaaaaattcaccccaccctttcttaagctttctggtgcagacatgcttgcccaggtgagccaactcgcccaggtgagccagctcgcccaggcgagctaa

SEQ ID NO: 32608 - DNA, 201 bp, Glycine max
  Peptide Sequence Number=SeqID_149386
atgtcccctgaatatgcaatgaaaggactattttcagagaaatcagatgtctttagttttggtgttttggtaatagagattgttagtggaagaaggaactcaaaattttatgacgacaacaatgctcttagccttttaggatttgggttatttgttgagtattccagcggaggaagcgcagttcatatcaatgttgcttaa

SEQ ID NO: 32609 - DNA, 324 bp, Glycine max
  Peptide Sequence Number=SeqID_149387
atgaagtttaaccctagggtttccttaagccctcgcaagagccacaaggctcacttcattgttctgttgagcgtgcgctacgtcttgatgagggcgcctttctccattgatctccaatcgaagtacaacgtgtggtccattttggttcacaaggacgacaaggttaacgactctaggtctatcaccgcaagtgggtcatccgcattgaccacatcacccgaccacaaatccttgctcaatcggaaggccaagggtcgtgccgctgccatcaaggaaaagggtaccaagttctctcctgaggatatcaagcaatccgtctattag

SEQ ID NO: 32610 - DNA, 348 bp, Glycine max
  Peptide Sequence Number=SeqID_149388
atgggtgaagcagaggaggtgcaagagaagatgaaggccgacatggaggccatgaaagagcaaatggccacaatgatggaggccatgaagagcactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggaggtgaagattatgcctttgctaacctagaaaagttattcctaatacccaaacatggtcattcccaagttcaaggtgctggactttga

SEQ ID NO: 32611 - DNA, 290 bp, Glycine max
  Peptide Sequence Number=SeqID_149389
ataaatcgccaattggtctagaaattgccaagactggaaagaagaatagaaagaaaaagaaacaagcaaccactaaaacatcgggtaagtcttcttcttcttctgattatctttcaactcataagccacttgtagaaaataacatggttgatcgaggaggagaaggaaatagaccaccaaggaggactcttggtgactatgattatgaacaaggaccaaagcattacaataacatagtcattcctcttttcagcaataaggtcgtggaattgaagctaaacactgcttag

SEQ ID NO: 32612 - DNA, 246 bp, Glycine max
  Peptide Sequence Number=SeqID_149390
atgccaaaagaaatgctagagactcccatgttccaaaagaaagtgtcactagctttcaccattttatatcagtattttacaaagattttggcaccactgcctattggttttgctgtgtttctagtgcatttggctacaattcctgttacagggactggtatcaaccctgctagaagtctaggtgcagccattatcttcaacaaggaccaagcttgggatgaccatgtgagtcttcttcatccttaa

SEQ ID NO: 32613 - DNA, 234 bp, Glycine max
  Peptide Sequence Number=SeqID_149391
atggaggttgatagatttttccttggcttactactgtcatttggttatcgagtaagtatggtagcaggggcttgtggaaagtttagccatgtgggaactaatgcaatcctcccaaggaggggacccatcaccagagccatggctaggagactccaagaagattgggctagagatgtaggacaaggtcctagggttttcatgagccttagagtagattttggaccgatgggctaa

SEQ ID NO: 32614 - DNA, 303 bp, Glycine max
  Peptide Sequence Number=SeqID_149392
atggaagaattggaaagcccgcttagcgtgcaaaacaagcccaacgcgcattctcgctcaccgcacaacacatgcttagcgcgaaaaagacccacgaagaagtccaaagacgcgcttagtgcggaagcttgcgctaagcccgaagtcagcatgaaaattaacctacctagtgcctatataaggaggaggaagcaaaagaaaaagacacggagtctcataacccatgcactgggtctatcccttagggaaaaccctctctctttagtcatccatcattttcttccatccacctatatcccctaa

SEQ ID NO: 32615 - DNA, 800 bp, Glycine max
  Peptide Sequence Number=SeqID_149393
caacgggcagttcaattgcttgggagaagtttgaaagcgagatcatcccctcaccagcaagcagcggggcgctgtcacttaaggcctgataatccattagttcatactcaatgtaaggccggactcgaaccggcacgtatttctacggttgattttgaatcaactgcgtctaccgatttcgccacttcggcactgaagaggatgcggaaaacgtgggcgattataccgttacgcgcttgcggcgcaaccggaatcgatggggatacgtataagcacaacgaggttgagatgaaaaaagcaacacaacggttagtttggggatggggtatcgcagcggcactggtggccggtagcgcatcggcggcgagctggcaggatcagctgagcagcgccgcatcgcagctgtcgcagcagaacagcggcaacaccgccaccagcaacacgcagaacggcggactgtcgctctcttcgctcagcggcctgctgaacggcggcgataaagcggtgagcgccaacagcatgaccaacgccgccggcgtgatggagtattgcgtgcagcacaacgtggtggataacaacgtgaaatcggtgaaagatcaggtgctgaataagctgggcctgagcagcaccaccgcgcagcagcagaaaaccgattaccagcaggggattcagggcctgctgaacaccggcaacggtcagcagctgaatctgcaaagcctgagcaactcgccgatgggtgagaagctgaaaaccaaagcctgcgatgtggtgctgaagcagggcaaaaaatacatcggcat

SEQ ID NO: 32616 - DNA, 942 bp, Glycine max
  Peptide Sequence Number=SeqID_149394
atggacatggatattgacataattgtttttgtattaagatcagtcatctctttttgtgcagttgatatgattagatgctggaaatgtaatgcttcttatcatgttgaaaaggcacctttggaatcatatgctgatattggtggtttagatgctcagatacaggaaattaaagaagcagtcgaacttcccctgacgcatcctgaactgtatgaagacattggtatcaagcctcctaagggagtcattttatacggcgaacctggaactgggaagacgttgctagctaagcacaatcagtttggtctaacacaaaggcttgcttactttcaggctgtggcaaactcgacatcagcaacctttttacgtgttgttggtagtgaattaatacaaaaatacttgggagatggtccaaaacttgtaagggaacttttccgagttgctgatgatctttccccatctattgtcttcattgatgaaattgatgccgttggtacaaagaggtatgatgcccactcaggtggagaacgtgaaattcagaggactatgttggagttgctgaaccagttagatggtttcgattcaagaggtgatgttaaagtgattcttgcaaccaacagaattgaaagccttgatccagccctgctgcgacctggtcgaattgacaggaagattgaatttcctctccctgatatcaaaacaagaagacgcattttccagatacatacttcaaggatgacattagctgatgatgtcaacttagaagaatttgttatgactaaggatgagttctctggagctgatataaaagcaatatgtactgaagctggcttacttgctttacgagaacgccggatgaaggtgacgcatgccgacttcaagaaggcaaaggataaggttatgtttaagaagaaagaaggggtgccagaaggactgtatatgtga

SEQ ID NO: 32617 - DNA, 810 bp, Glycine max
  Peptide Sequence Number=SeqID_149395
atgtgtttggttcgtgacaaagatgagatgcttcctctccactttgctgcaatgagagggcgcgtggaagtcatcagggagttgatcaaagccaaaccaaactctattcgggagatgaccgaaactgatgatggttctgttcttcacttgtccattcgctataaccatctcgaggctctgaaattgcgagtggaatcactgagagatgaccatcatttcctatcactcaaagacaaagaggataactctcttctgcatttagcagtgaaacgcagacaaatcaagatcattaaatacttgctttccctatccgaaatgagtatggaaataaatgctttgaatagggagggtttaaaagctatggacatgttggagcgctatcaaacagattttgtgagccaacacacttttattgaaggagttgaaaagcctgcaaatgaaggtatagcacaagtagtttcctcagcaaccctaatcagcaataaggaaaaaacggctttgccaacatatagacgacaacaaaattcctcacaagcacaaagcataactattgaacttgtacaactagatcctcctccacaaccctcacctcaacaaacatcatcatcctcacaaaccaacattaataatattcctgaaccaccacagccctcaccaagcaatggtcctcatcagctccaacatgtgacttcacaaaacatcacaagtgaacaaggacaagataaatggaacaggtttgagaggttctgcaaacgtaatccatcaagaagcagtttgtgcagtttctcaatctccaattgtccttcataa

SEQ ID NO: 32618 - DNA, 825 bp, Glycine max
  Peptide Sequence Number=SeqID_149396
atgagagaactctatgaagcttcattaaatggatgtgtgagtaccttagacacattaataaaaaaagaccctcctattctaagcagagtttcactctaccccttcactgaaaccccattacacatagcctccttgcttggacatttagagttttgtcagattcttcttcagaatagtcccaatttagccactgaattggactcaaaagggcgttgctctcttcatctggcttcagctaaagggcacactgaaatcgtgaaagcgcttttgaggacaaaaccagaaatgagtttggtgcgcgacaaagatgcgatgcttcctttccattttgctgcaattagagggcgcgtgggagccatcaaagagttgatcgaagagaagccaaactccattcaagagatgatagaaagtgatgatggttctgttctgcacttgtgcgttcgctataaccatctccaggctctgaatttgctagtggaatcactgagaggtgaacatcaattcttatcagccaaatacaaagaggatagcactattctgctttcagcagtcaaacacagacaaatcaagatcattaaatatttgctttcacaaagcatcacaagtgaacagcaaggacatggtaaatggaacagatttgagaagttctgcagaacgtacctgctagaccaaggtaattggatagacaaaaagacaagggagcaattgatggtggcagctactgtgattgcaaccatgacttttcaatcaatgataagtccacccggtggtgtatggcaaaccgatactcataaatcccaagatgggtgttcttgccctaactaa

SEQ ID NO: 32619 - DNA, 1438 bp, Glycine max
  Peptide Sequence Number=SeqID_149397
cgaggctgatgtggccgaggacgatcaggaagaggagattgccaccccacaactgcccaaaaatacgatcctatacggccctccaggcaccggtaaaacgtaccgtactatcgatctagctgtccgcgcttgcgatcctgcagcttattcccagcagttgggtaaagatgaaagcgaaaggcgtcgcgagctgaaaacgatttatgatcgtctggttgctgaaaaacgagttcgttttattaccttccatcagagttttggctatgaagagtttatcgagggactaagagccgaaaccaccgaagatggcgacgttagctacgaaatcaaaccgggcatttttaagcaaatttgtgaagatgccacttttggacacgccggggttcagcagaagcttgatgatgcgctaatccgtctgcaagagcgtctggctgaagaggggaatattaccctgaaaacgcagcatggtaaggccttccagcttgcttacaaactcaagacctgctttggcattttcccgtcgcaatcgaaaaaagcggatttagggaagggttacaatgcttaccttaaagatatccgtctcatgtaccaagacccgcagataaaagtacacaacccgtcctatgtgagaagtatccttaattacctgattgaaaaggaaaaaattcctgcacactcagaggaggcggaaccggaaatgcggcaaaactacgtcctgattattgatgagattaatcgtggcaatatctccaaaatattcggtgaactgatcaccttaatagagacttctaaacgtgccggagagccagaggcgttgagtgtgatgctgccttattcccatgacccgtttagcgtaccgaacaacctctatctgattggcaccatgaataccgccgatcgttcgcttaccgcactggacactgccctgcgtcgtcgattcgagtttcaggccatgctacctgacaccgatgttctgaaagacaccgttgttaaaggtatcgacctgaaacgtctgctacagaccctgaatgatcgtatccaggtgctgtatgaccgtgagcatagcctgggccatgcctttttcatcccggttgttcaggcgaaggatgatgaggacctggcatttgagcgactcaaacggatcatgcgaaacaaggtgctgccgctgctggaagaatatttctacaacgactggcaaaaaatccgtatggtgctgggtgataaccaaaaggataacaaatcacaccttcagtttgtgcgtgaggcaaaagaccagaaacagtttgccgacctctttggtctgagcgggaccgatgaactgcatgagatcggtgccagcttccagcttactcctgaagaagatgaggtttgggataatccgctggcttggcaacaaatctatgttccatataaagaggatgcggagccgagggaatga

SEQ ID NO: 32620 - DNA, 394 bp, Glycine max
  Peptide Sequence Number=SeqID_149398
atctatctatatcgacccaactcctccacagcaagctgtctctgcaatggcattaaagtttcatttaccattgccaactgcccttaaccgagagatggctaagtggtgtatgttggtgttggttcttgctctagctctggctgtggccacaagtgccagagatgcacccgaagatgttggtctcaaggaccagaagaacttcatcagctatgctggagttggtggctattcaggaattggaagcaatggactaccttttggaggtgccggaataggtggtggcaccaccgggataggtggattgggaggattcggaggtcccattggcggtggtactggtggcagtgttggaggtggcgttggcggtggtagcatacctcatcccaccccttga

SEQ ID NO: 32621 - DNA, 645 bp, Glycine max
  Peptide Sequence Number=SeqID_149399
atgtattttgacgacattacacctgttggtgatgtcagtgttgccttcgaccagattcatctcgaccggcatatgaaccattatgaacatgcgttggcatgggcgaagcatattcttctggggcagtcgcctcactgtatgcagggtgatgctaacgctatttcactgcttttcccaatggaggctgtttttgaatcttttgtgactgcatggatgcgtcatcgttataacgataactggcatgtgaaggcacaggtagattcgcataccttggttcgtctcaatggtaaaggagtatttaagcttaggcccgatatctatctacaacttcgtggggagtatgaggagcaggtgatgatttgtgacgttaaatggaaaatggtggagggaggaaaggcgacactcgaacagtcgcaggctgacctttaccagatgctggcctacggtgtgaactatcaggagggaataggggatatgctgctgatttatccttcgcatgagggttttagtcagccgttacctcatccctatgaattcagccatcaaaaggaaaacccactgcgtttatgggttgtgccatttttcattggtgacagtttgcaaacttctggcctgcgtttccctgatgagaaaagcttgatttaa

SEQ ID NO: 32622 - DNA, 879 bp, Glycine max
  Peptide Sequence Number=SeqID_149400
atgccagtaaacaaaaaccatcaccgcgagacctaccgcaagcgctttgacaaggtgttcgactatatcgaacgccatcttgatgaagcgttgctgctggagcaactgagtgaagtggcgcacttttcgccgtaccactttcaccgccagttcagcgcctggtgcggcatgccgccggggcgttacatccagctgatgcggctcaaacgggcgtcgtaccggctggcattcaatccgcacgagaaaatcattgagattgcgctcgatgccggttttcagcatgccgaatcattcagtcgcgcctttaagcaggtatttgacgtgacgccgagtgaatttcgtcagcagccggtgtggatgacctggcatcagcgcatgcctcagccacccgtcaaacggagagagagtatgtcagttgagattaaaatgtttcccaccacgccggtggcgatgctcacgcatcacggcgatccgcagcgtatcaacgaaacggcggcgcagtttattgcctggcgcaaaagcagcggtgcatcgccggtgcgcagcagccagacgttcggcgtcgcgccgcacgatccgaccagcacgcccgccggggattttcagtatcacctttgcggttcggtgaccgcaccgattaacgaagacaacgcctttggtgtcgtcaatagcaccattcccggcggacgctgcgcggtgctgcgtcatcacggttcgcacagcacgctgaccgagctggcgcgatcgctctacagcgaatggttgccggccagcggtgaagagctgcgcgatttcccgctgttcttccactatcacaacttcgtgcatgaagtggcggaacacgaattgctgacggatatctatctgccgcttaagtga

SEQ ID NO: 32623 - DNA, 780 bp, Glycine max
  Peptide Sequence Number=SeqID_149401
atgaatgttttgattgtgtatgcccatccggaaccgcgctcgctgaatggatcgctgaaagactttgccgtgaatcatctgcagcaggcgggccatcaggtgcaggtgtcagatctgtacgccatgcagtggaaagcgcagctggatgccgccgacacgctggcgcccccggtgggcgcacattttgatgccacgctggattcgcgtttcgcctacgacaaccagctgcaggcagcggacattgccgccgagcaggagaagctgcgctgggccgacacggtgatttttcagtttccgctgtggtggttttcgatgccggcgatcatgaaaggctggtttgaccgcgtgtatgccaacggttttgcctatggcgtcggcgagcacaacgatcaccactggggcgatcgctacggcgaaggcacgctcgctggcaagcgcgccatgctggtggtgaccaccggcggctgggagtcgcactacgcgccgcgcggaatcaacggcccgattgaggatctgctgtttccgatccagcacggcatgctgttctatcccggcttcagcgtgctgccaccgctggtgctgtatcgcgtgcagaagtcggcgcaggaacgctttgccgactggtgcgccgcgctggcgcaacgactggatcgcttagcgcaggatcaaccgattgccttccgtcgccagaacggcggtgaatatgagattccggcgctgacgctgcgcgaggatcttgcggaaggcgagcgcggatttggcgtgcacgtggcgcgctga

SEQ ID NO: 32624 - DNA, 654 bp, Glycine max
  Peptide Sequence Number=SeqID_149402
atgtcatgggagggtgacgaaagcatggggtcgtcctctcctcttggccttattgcgcagcacctctgccctacgaagcaccttagcatgcaccgccgctacctggagttcccgtccttcatgtacgccaccacggtcctcgtagtgtcggacgccacactagaggacactggctgtgttgctgcgctggccatggccgcttcggcgttggtcgttgggttgccggaatcgacgcacttggtcactaagcaactttcagttggacagcttgtgaaagtttttgttagcacggtggtggatagtggacggacaggggtggccgttcacccagttcacgttatatatattcgattatacgctaagaatacttgtgagaggttcgattgcaacattgagaccatttctgcctcagacaactcaactgctgctggttttatcgctcaagtcaagtccctctccacaacaggagccaagcttctacagagtattagaagtaaacaggatggcatgcattgggaatggccacaaacaagaattttccactcccattggattgacccagaagataaactgcaagacttggagttaacaataagagtctatggacattgctctatcaacttgtacttcttttcctgttggggtcatcgatga

SEQ ID NO: 32625 - DNA, 675 bp, Glycine max
  Peptide Sequence Number=SeqID_149403
atgcatgagcaaattgccacagcattccaggctaatggtgaagtaggtcaagttactgtgcatcatttgacatccatctctctaatggctacaatgcacgaggacatatgccacgttgctggaaaaaaaggtgtggcaatgatcatattgcccttccacaaaaggtggggaagggaagatgaagaggtgacagaagactcagggcagggttggagggaagtcaatcgaaggtctaccgtgggggtgccagaaggtatgaacaagaacctaagaccagtgatgtcgctaggaaaagagtgtataattttcattggtgggccatatgatcgcaaggttttggagttaggtagcagaatggcagaacatccagcaattaggttgcttttagtgagattcacttcatacaaagaagctaggggcgagggacctaaacaaaactcaccaacatccaccaccaactgggaaaaagaaaaggagttggatgaggaggcaataaacgagttcaaggctaaatggcaggagtcagtggagtacattgaaaagaacgcaaccaacataacagaggaggtgttgtcaattgggaaagccaaggattacgacctagtaattgtggggaagcaacaacagattgagtcaaccaagttgacaaacatagattttcgtcccgagcattaa

SEQ ID NO: 32626 - DNA, 1118 bp, Glycine max
  Peptide Sequence Number=SeqID_149404
tgttcgccagcgtgagcacgccgttgtgggccgacgaaggcgtctcgtttagccataaagactgggagctggcttgtgataatacgctgacctgccgcgccgctggctacagcgccgaagagggcgcgggcggatcggtactgctgacgcgcgccggcgggccagacagcctgacgcacgggcgcgtggtgctggccgataccggcgacgatgatgcgcagcaggtgaatgcgctggcgctgtggattgacgatcgcgcgctgggcgaagtcagcaaagcggagaacgatgagtggacgctaagcgacgcgcagacccaggcgctgatcgccgccatcaaaggcagcgccagagtggagtttcgcggtgcggccgagccgtttgagctctccggcaacggggcctttgccacgctgttaaaaatggatgaggcgcagggacggctgaacacgccgggcgcgctggtgcgcaagggcaaccagccggaagccagcgtgccggcggcagtggcgatgccggtgattcagcaggtccatgtgctgaaagccgcgccgcgcccgctgacgccagatgaactggcacaggtcaagccaaagctgattgcctcgctgactgacgacgacagctgtgacaatctcgcgccgtccgacgatcagccagaagagggcgcagaaccgcctacgctgacgccggtagatgcgcagcaggtgctgatcgccgcgctgtgctggcgcggggcttacaacgaaggctatggtttctggctgctggataacgcgctgcagggcacgccgcagctgatcaccgattccggatctgattatcacgacggcgtgatcagcgaagcgcagaaagggcgcggcattggtgactgctggagcaccgctgcatgggtgtgggatggccgccagttcgtgcagagcagcgaggccaccaccggcatgcggctggggcacttaatccgtcacggattttgccgcgtcccagacggccatgacatgggcgatggcgttatcgatctgcgcaccgttgacgccgtcgcgcaccagcaccgacacgcccagcagaaaagcgtcgagggcgatggcgagggcggcggcatcggtgtcggcgcgcaa

SEQ ID NO: 32627 - DNA, 255 bp, Glycine max
  Peptide Sequence Number=SeqID_149405
atgaggcgagtatctaaagtcacacatttggaaggcccgactgggtttgagataaaaaaacaacagagcaaggccagaaatgacaggaaggtgctggaaaacgtcagaaattaccagagatggtgccagagaaaagtaggtcatgtttcagaaacacaagggatcaatattggtgctacagaacagagcaaggctagtcagatttgtatgagcaaggcagaaccacagaacagagactacggtgcaaagaagtga

SEQ ID NO: 32628 - DNA, 1014 bp, Glycine max
  Peptide Sequence Number=SeqID_149406
atgaaaaattttgtcagggactcaaaattaaaatcggatagcttagctaaattccctcgtagaacaagtggttcatctggacttcatagtcaggcacaacagtctgaagatcaattacagcagcagtcacagccaccccagcatatggtgccccatacttctaatggtgatcaaaactctgtgcaaactgctgctatgcaaattgcttctagcaatggtgtgacaagtgtaaataattccgtcaatgcagcatctgcatctgcatcaaacaccacaagcaccattgttggacttctccaccagaattctatgaattctagacaaaattcaatgaacaatgcaagcagcccttatggaggtagttctgttcaaattccatccccaggttcctctggtaatgtaccacaagcgcagccaaatcaatccccttttcaatcaccgacaccatcctcatctaacaacccacaaacatctcaccctgccataacttctgcaaaccacatgggtacagcaaactcaccagctaatattaccttgcaacaacagcagacatctcttcctgctgaagctgaccctagcgatgcccagagctcagtccagaaaatcattcatgagatgatgatttcttcccagatgaatggcccaggtggaatggctggcactggtttgcttggaaatgacatgaagaatgtaaacgggattctaccagggagtaacagtacagggctcaacagtggcagtggcctggcgggtaatggggctgtgaacagtagtaattcaggtgttggggttggtggatatggcacaatgggtcttggtccatctggtatgaccaatggaatgagacctgtaatgggacataattcaatcatgaatggaaggggaggaatggcatctcttgcgcgagatcaagttatgaatcatcaacaggatctgtcaagccaactacttagtgggctaggaggagtaaatggctttagtaatcttcaatttgattggaaaccgtctccatga

SEQ ID NO: 32629 - DNA, 372 bp, Glycine max
  Peptide Sequence Number=SeqID_149407
atggccttggagaactgtgtggcagtcaccacagtaggaacaagtgctagacctcaatgtcttcatccattcagcaaaagggaaaagcttgttttccccactttcagaggatttaagaaatctttgacaaaaacagttttaacaaactcatctcctctttattctgctgctggtcaaagaaatctcgttttatctgcaatgctcgtgaagcagatgatagcccctgccattgatgagttggcgaaagagtatgctggaaaaattgcatgcttcaagcttaacactgatgactgtcccaacatagccacagagtatggaatcagaagcatagcaactgttctgctcttcaaaaatggagaaaagaaagcgtaa

SEQ ID NO: 32630 - DNA, 252 bp, Glycine max
  Peptide Sequence Number=SeqID_149408
atggccctatttgacacaggggctgattcaaattatattttagaaggattaattcccacaaaattctttgaaaaaacttcagagaaactaagaacagcaagtggatcctcattaaagatcaattacaagttatctaatgcaatcattgaaaatcaaggtcttaggattaatacaaacttccttttggtaaaaaatcttaagaacgaagtaatcttaggaactcccttcattagatccctgtttcccatctaa

SEQ ID NO: 32631 - DNA, 285 bp, Glycine max
  Peptide Sequence Number=SeqID_149409
atgtggttccctggcagttttcccttcaccagttatcccaaattcttgaacattaatcagtgcacgcttcgtgttcgattaattgcctctgagcctaacctgcgttcatgcttaatgaacaaagggctaactagtattgtcgcaacgtgcccttcgcgggcgagcgagggcgaggctcacgggtgcgctttccaaaggaggaaagatgcgcggagtcgccaccaacatttatttgtgggaaacgtcggaaaaactgaaggaaaccggtcaaaaagaaaattctaa

SEQ ID NO: 32632 - DNA, 177 bp, Glycine max
  Peptide Sequence Number=SeqID_149410
atgcgtctcaaagaaatgcctccaaagaaactctccacgaagaggtctagaagagacgccgcagcggaagggcccaattccacccccgagtttgatagtcaccgtttccagagcgtcgatgatatgaaccctcatggcacaagggctgacttaggatcgtctaggattaaaccttga

SEQ ID NO: 32633 - DNA, 276 bp, Glycine max
  Peptide Sequence Number=SeqID_149411
atgctctgggtcaaacacccacatcactacatgaaagggctgagagcatttcgggttttacaaagggacatcattttgaaattccgatcattccaatgtgaccggggttcagtgaagaggaagcataaagcatacaatggcggtttccaaactcagaataatgcaaagccgcgagccaaaacggacggttccactccgatcaacgggttcctctcgttgtggagtttcaatagggaacaatggcggtttgtggtggttaatggtggctatgggtga

SEQ ID NO: 32634 - DNA, 231 bp, Glycine max
  Peptide Sequence Number=SeqID_149412
atgggagaaaaagaaggaatattagcttctttggataaaatggcgaactcttttaaccgaatggtggtggaaaaaatggatggtaaagttgatggtgaagatattcaagaagtattccgtgaggcagctttgataccagatcttactgacgatccaaagcagttagctattgtgaaagcccttccaattcaccaaaagacagattatgttttaacacatcttggagaatga

SEQ ID NO: 32635 - DNA, 963 bp, Glycine max
  Peptide Sequence Number=SeqID_149413
atggtgggtgttatttcgttggtaacagggatggctggtcctagtgggtttggatcagcttccactgcagaacaggttactgatggaattgatgccagcaacctcactgcaattatcacaggaggagcaagtggtataggcttggagacagcaagagtgttggctcttcgaaaggtccatgtgatcattgcagttcggaacatggtgtctgcaaaggaggctaaacaacaaatactagaggagaatgagtctgcacgagtggacgtaatgaagctcgacctttgctcagtgaattctattacatcatttgtggacaacttcatagctcttgatcttcctctcaacattttaatgttgttctttaaccaatgtcataaggacactggtggaaagcatttgccttttgctttagcccttgctggtggtcatttccacttgacaaacctgcttcttgacaaaatgcaacaaactgcaaaagccactggaatagagggcaggatcataaatctgtcatcaattgcccataactacacttatagaaaggggattagatttaataagatcaatgaacgaaaaggttatggtaacaagaaggcgtatgggcagtccaagttagcaaacatattacatacaaatgagctttctcgtcgcctgcaggaagagggtgtgaatatcacagccaactcggtccatccaggagtgataatgactcctcttatgagacactcatcttaccttatgcatttcttaaaggtcttcaccttttacatatggaagaacgtcccccagggagcagccacgacatgctatgttgctctccacccaagcgtgaaaggtgtaactgggaagtactttgtggattgcaatcaatgcaaaccaagttcacacgccaaaaacaaacagcttgcaaagaaactctgggatttcagtaacgatttgatcaaatcaatttcgaaagcttga

SEQ ID NO: 32636 - DNA, 114 bp, Glycine max
  Peptide Sequence Number=SeqID_149414
atggacacccgtctccgtgatgatcctatgaatgaagttcaacgggggtggggggtcagaactcactctttgagaattcacctagtgagtgtggtggagggaccgccacgatga

SEQ ID NO: 32637 - DNA, 954 bp, Glycine max
  Peptide Sequence Number=SeqID_149415
atggacacatgctctaatactaatgttgtgcttgacgacaacttcataagtaatcttggaaggactttcaatgagtcattacagattcaagatgctcataaatctgttcttgcttctgaggagaatgatatctataatgtgaatgaggaaaaattatgtgaagcaatgaaagatcaagagacaaacataaatatgacgtgcttgaaaaaatctgcaacttttccaattcctaatacaatgttgccttcaagcccatctgataaggaggctgatacttcagtcacaggaccactcaatgagcattctgctcatcaaacttactcactctcagtatctccgcctgctcctctgaagcttatatctgccatgaaaggtagccgtgagaaacatgggggatcacaggtgaaattgaatgtgaaatgggcctctgatgtgtatgatcctatacctacattattatcacacactgttagaagcaacaagaagcagcagaaatccaggaagaagaagcctgaaaagaagaatggaaagaagggtcaaaagggaaattcatctcgagggggcagcaacaaagataagcaggttcgcaagctaggtgggacttctggtttgtgctacaagtcaatggattcttgtgataaagtgcttggagcttctactgaattagatgctcttgaagttcgaagccaggattcatactgtggaactagcttcctgaaaaaatcagttactgaagtgcactactcgtgggaagatcctccttctacagctttcttagccttctccgcaatcatcactgaaaacatgctgagaaactgtcgatgtcttcaacacacctacgatctccccgtttgcaccaccgacgagaacaaagcaactgtcaacactgtctcaaagactcaaacacgatattggaccgcagcacttgtcggactcacaccttctaattcatag

SEQ ID NO: 32638 - DNA, 228 bp, Glycine max
  Peptide Sequence Number=SeqID_149416
atgtacagaaacattagaacgagtgtgcctgcaaatagttttttgataatgttgcaaacactaaaagcgagtgatcgggctcaagagcgaaaccagaacaaatccgacatagacagttacgataacgcaagtgaaacgacgacgtgcgagtgtgaagtgagagcagcgaaaatagaaactcaccggcgcaaggggaagctcgtctgcagaaggaaggaaaacaagtga

SEQ ID NO: 32639 - DNA, 705 bp, Glycine max
  Peptide Sequence Number=SeqID_149417
atgagtgcattcccgaacggttccaactcgaacctcgacaacctcctcctccaaaccatgatgggcaggctccagctgcgagctccgataaacaaccccttggtcacacagtccctcgaggacttcctattaaccgatctcggcgacgacgacgacgacaacgagggcgaggaaaccttcgagggacagtcggagctcgcgagagaggaggccaagctagaaagggaagtcatcaagatcatcctcagcggaaacggagagtctgttctcatgcccaattcggggcaggccgtgtcggttcgcgaccaccacatatgcgtggggtttcaagacgaagagggttctgggtatcgcgtgtgggagtggcatggccacatcatggcttttgatgaggaatttgggtacaatcctgagtatatatacggtaattactttcagtggtttaaggctagacctttttctgttgctgctgttgccgatgctagggctgatgttgagaaagaggaagaagaagaggaggaaaaactggaaaatcagggtttgagggagttgattgatagcaaggattccgcggatgctcgcattcttcacaggaacatcaacgctgcttctccaagattattcaaatattatgcaaataggttgttcattttttttatggcaaaccttgttaatggggcgattgattgcttgaatggggtataa

SEQ ID NO: 32640 - DNA, 660 bp, Glycine max
  Peptide Sequence Number=SeqID_149418
atggttgaaaccgagatggatgcagaaactgttgcaaatgtggttccaccaaaggagactccaaatagtgtttccatttctcatcattcctcacaccctccccttaatgagaggattatttcatccatgaccaggagatctgttgctgcacacccatggcatgaccttgagataggtaactatgttttcttccgcaatgcaggacctggtgctccaattatcttcaattgtgtgattgagattgggaaagggagcaaggtgaaatatgaactggacaaaaagtcggggcttatcaagatcgaccgcgtgctttactcatcagttgtttatcctcacaactatgggtttatccctcgtactatttgtgaggacagtgatcccctggatgtcttgattattatgcaggagccggttcttccaggttgctttcttcgggccaaagcaattggtctcatgcccatgattgatcaggatttagacaagaagaatgaaaacaaggaagttgcagtaaacgactttttgcctgcctcagctgcttttgaagcggttaagcgatccatatcacaatatcaatctcttaaagtaacatttttctatattgagaaggagcttgtatgcggattacatagtggagagcttgaggcggtagccgatgaatga

SEQ ID NO: 32641 - DNA, 258 bp, Glycine max
  Peptide Sequence Number=SeqID_149419
atggctagaaaggaggtcgaggtggaaagagaagtgataaagattatccttgagggcaatgacaaatccattctaaagcttaattcaagttgtttaagcttagacctgttcctcatgctattgctgttgttaagcctctccaaaagagaggatgaggagaaatgggagaaccttgacttgaggaaattcatttataccaagaattacatcgaggcttgcattcttcttaggagcgtcaacgttgctcttccaaggtga

SEQ ID NO: 32642 - DNA, 273 bp, Glycine max
  Peptide Sequence Number=SeqID_149420
atgaccaatcttctttcttcgagcaagatgtggatttggtggaggaggaattctttggtttttaaccaagtctggatgtcaaacagtgtgatgattgctaacatcagagctatccttaaggatattaaggggagtaagattagttgcacaaatctgcaatatggagttgctgatgtggtcaataatgttggtggccttgagaatcacactctcaaggattgttttattatgaattgtgatggtgctttatgtcaagctactgaggaaggataa

SEQ ID NO: 32643 - DNA, 429 bp, Glycine max
  Peptide Sequence Number=SeqID_149421
atgtgctcagtgataagcgcgcaaggggtggccgttgcgaccgccgtggccgtctccggcacggtgatcctcctcgccctccgtctccagaagtctttcccaccaccccaattctccgttcaccaccaaatccctccttctccttctccggttctgcgatcttgcatatccaatgtagggaagaagagcaagaagaagaagaaaagagtgcactttgcggaggacgtggtggagtcgtgcagagacggagaagagttcaggaagcgaaactcacgatcgaaggttctgaagagttattataacaacaacaacggggaagaagaagaagaagaagcgaagatcggaggaataatgcctgctaacagggtagctttgtataacggaattcttaggggccgtgtggcccaacgtttggcctactcttgttga

SEQ ID NO: 32644 - DNA, 159 bp, Glycine max
  Peptide Sequence Number=SeqID_149422
atggcagccacaaagcaatgtgacatgcaaatctcaccgatgaatattatcttacttcatcagctttatgttgatttcgctgaattaagaattgctaatttattatattgtgttaaaagcaatctcaaaaatgacgttttaaggttgagaggtgggtga

SEQ ID NO: 32645 - DNA, 159 bp, Glycine max
  Peptide Sequence Number=SeqID_149423
atgacgagattccagaagcgatggatgggagaagcagaaagaaaggttttgggggcaacaaaggcgagtggattttcggcttggatcaggcccactaagcatgagtggatgtgtaaaggggcactcaggagttttgctggtacacccagcataacatga

SEQ ID NO: 32646 - DNA, 414 bp, Glycine max
  Peptide Sequence Number=SeqID_149424
atggagatagagagaaaaaatgatacgaaagaaaaagtagatggcatagtttgctcaggaatggcttattacatccaaggagcagtgatgaaagataggggaccggtctttgttacaacttttaaccctctctgcatggtcattgtggctatcatgggctccttctttctggctgaaataatgtacctcgggagggcggttggagctattgtaattattttagggctgtatcttgtggtgtggggtaaaagccaagactacgagtcatcaagtccaattactaaagagcatatattggcatccaagcaaacagtagaggagaacaacggcaaagaggaggatcattctaatcatggggtcatcactctcagtaacttaggcgcgggaaacatagcacgagatgaacaagtatga

SEQ ID NO: 32647 - DNA, 741 bp, Glycine max
  Peptide Sequence Number=SeqID_149425
atggctggtaataaacaaaaactctttaacagactgaagccattcataggtgtagtgttcttacagtttggatatgctggcatggatgttctatccaaagctgcactgaacaagggaatgagtaactatgtatttgtcgtgtaccgtcatgtttttgcctttgttgtcacggccccttttgcactgatcttggagaagcctgttattgaccaaaatttatattttttgggaatgaagtacaccacagcaacctttgctgtttccatgtacaatgtcctccctgccattacctttgtcatggcttggatttttaggcttgagaaggtaaaactaaaaagtatacgcagtcaagcaaaggtggtggggactttagcaactgttgcaggtgccatggtcatgacactgataaagggcccagtacttgatctttttggaacacacacaagcaatacccacaaccagcaaaatggtggggtgaatcttcaacatgcaataaagggatcggtcatgatcacaattggctgctttagttgcgcttgtttcatgattctccaagctattaccattgaagcctaccctgctgagctctctcttacagcatggatatgcctattgggaacagttgaaggtggtgtagtggcactggttatggaaaggaagaatctttctgcttggtctctgcaatgggatacaaaactgctggctgctgtctacagtgtaggttctttacttctacagtaa

SEQ ID NO: 32648 - DNA, 235 bp, Glycine max
  Peptide Sequence Number=SeqID_149426
gtggcatcaacttggaaactacctctgcctagtgtgtgtcttatggactcaaaaccttggaacggtgtctatgcaactttgtgctcttgttagcagcaagagttgctcttctgcttggactttagcagtgcaacaagtcgatgacaacgaagaatttgtcaacggttttaagggacaacacctaggcatagtggcagtagagggagctatattcttgcttttcatgtccacttga

SEQ ID NO: 32649 - DNA, 1020 bp, Glycine max
  Peptide Sequence Number=SeqID_149427
atgtgggactcagcagcaattgcgaaggaaaggagaaggagttgttccgaccgagatcgttacgtcgtcgtaccggatgatttatcagaggggtgggtgatggattctacaagcggaatgaagaagaaatcagctcctggtcctggcactgggggtccagacctcaggatgttcgtggggacgtggaatgtcggagggaagtcaccgaacgaaggcttcaatttgaggaattggcttacgtgtccttccccagctgacatctatattatagggttccaagaaattgtaccgctaaatgcggggaacgtgctggggccggaggacagtgggccagcagcgaagtggctggggcttattcgtgaagccttgaacagcaacgaggagttggataatactggacaaaactctcccaagagttcaccacgctattgcttagcagcaagcaagcaaatggttggcatcttcttgtccgtgtgggtacgagctgatctttgcaaccatgtcaccaatttgaaagtatcttgcgttggcagaggcatcatgggctatcttggaaataagggatcaacatcaattagcatgacattgtacaacaccacattctgcttcgtttgcacccacttgacttctggggagaaatttggtgacgagttgcgaaggaacttggacgtctccgaaatcttgaagaaaactaagttttatcactcgtttaagtctcttgctcatccactccctcctgaaagcatactagaacacgataatattatttggcttggcgatttgaattatcggctagcttctggctacgatgacacacatgaactactaaagaagaataattggcaggcattactagaaaaggatcagttaaggatagagcagaaagctggtcgagtattcaaaggttggaatgaagggaacatatactttgctcccacttacaaatacttgaccaattctgaccactatgttgcccaatcctccaaatccaagataaaacgacggactcctgcttggtaa

SEQ ID NO: 32650 - DNA, 147 bp, Glycine max
  Peptide Sequence Number=SeqID_149428
atggaaatggcaagagcaaaagatgttactgtagtggttaaagtaattgaaccactaatatcaccgtacacctatcagcttggtgccgtactgcatccaacggccaggggaaactttatactgggtaaggtctttgtctctaattag

SEQ ID NO: 32651 - DNA, 229 bp, Glycine max
  Peptide Sequence Number=SeqID_149429
gctgttttactgttgctcatctgattcattggacagacctgcctcaagtacggaagataaagcgcatgagcttgctgagactgaccacacatcacctattaaactggatgcaacagcacatgcacacattgaaaagcacagatacttgtttctacagagaaggctattgagcatagcttggcaagcaccggtcgtgccaacgtgcgagcaacggcaactactcggatag

SEQ ID NO: 32652 - DNA, 321 bp, Glycine max
  Peptide Sequence Number=SeqID_149430
atggcaaaggaaggaggtggaggaggatgttttgtggtggtgcgactggtgaggaggaggtcgtgtgactgctgtgaagaaggtgaagtcatgggagaagaagttgccatggcgggagtggtttgtacaaagagaaaggtgttagggtcggagaaggatagtttggtattttcaagcaaaatgagaggtgtaagatacacatatgagagtgctccattcaaatccgttattcacctactatcaatccaggcccataaaaagaagcagttcagtttttcggattcggattcgggttgcgttctcattttggatctgaactga

SEQ ID NO: 32653 - DNA, 339 bp, Glycine max
  Peptide Sequence Number=SeqID_149431
atggagtcccgattcaagagtaatccccaattacgcagagcttgtgtatctgagaattgtcttttttcagaagttttgattctatttctgctaaagttgactcggttcccctcctccaccttccttgtaggcctttgctgtgcaaatgatgacaagcagcaggagaggtccccatctgttattgtcattggaggtggcatggctgggattgctgctgctcgggcacttcaagatgcctcatttcaggttattcttctagaatcacgggaaagacctggtggccgaattcacactgattactcatttggctttcctgttgaccttggtgcatcgtggtaa

SEQ ID NO: 32654 - DNA, 297 bp, Glycine max
  Peptide Sequence Number=SeqID_149432
atggtgcttccgccaccactgcgatggtctacctttgccgttaatggaaatacaagacgaagagcaagagagggaaggagaacgatctacgacggtgcgttcgcgtttggcggcttcggtgggcatcggaagagaaggtggttttcagatgtggctcacggcggcgatgaagatgaggttccaacgaagactgaagttgcttgggacgcagcgaggaatggaggttgttcggtggttcgtcgttatctggcgttttccttttgcgaaggatttcaaacgggttcgtgtttggcttga

SEQ ID NO: 32655 - DNA, 4064 bp, Glycine max
  Peptide Sequence Number=SeqID_149433
agagtgaaactttcaggcttaggagtctcaggattgttactcccataacaaaccagggacgtggcggggatggaaatgagaataggaccttacaatctgattgggaaaaggaaattggtagattgaaggagcttatagaagtggagaagggaagggctgattctgagaggaagaatgctactgaagcttgcaagttactagagaatgagaagaataaggttgttgaaaaggaaaaggaaattggtggattgaagaggcttatagaggcagagaagagaagggctgattctgagagcaagaaagctgctgaagcttgcaagatggtaggggatgagaagaataaggttgttgaaaaggaaaaggaaattgttggattgaagaggcttatagaggcagagaagagaagggctgattctgagagcaagaaagcttctgaagcttgcaagttggtaggggatgagaagaataaggctgctgaaaaggaggagggaatccgtagattgaaggggattatggaggtggagaagagaaagaatgattctgagaggaaggaagacactgaagcatgcaagttacttggagaagagaagaaaaaggttgctgaaaaggaaaaggaaattggtagattgaaggggtgtatagaggagaagaagagaagggttgattctgagaggaagaaagctactgaagcttgcaagttactagaagaagagaagaataaggctgccgtaaagggggagattgccagaattgaagcagagaaggcagtgaagtatagttttcagattggtcaattagagaaacaggttaatgaagcaaaaacaaagttggtgtctgagatttctacgtttagagaggcaaccaaaaagtttgaagctgaaaaccacaaactattagcagagaaaagaaatgctgagtcggggatggcaaaagcgaatgaaaggttagaggttgaaaaacaaaaggtcaatgaggaaaaaaggcgtgcagatgcagagatggttaaattagagaagcagaaggcgcttgctaaggataactggaacaagttcatgaaagagaaatgtcttgctgatcagatgtctcagcagttagaagaggataagaagacgattgaggatttgaaacggaagatccatgaactctcatccttgacaaaacctgttgaaatggctgctgacagcaaggtcaatgctgatagtacagaagtgaagcttttgaaaaacaaacttaagcttgaaaagctaagagcaaaacataccaggcaaaaatataagttagaaacaagtcgttacagtattttacggcatgatttaggtcgtctaaagatggatttcattcaatttctacaacgccttgatatactggatgcatccttttcacctgtcgctggaagtatgcatggccaaacaaagtttgagaatatactagatatgcagaattcaaatgtcacgagacaaatttgcaatctaaatttgtctgagacatgtcgccaatttgagaatgagcttctggaaccctgctgcacaacaatttatgcaagtgacccattgaggaaaaacatacagaacactcaactcctcactccaggtggaaattactctgaaaaatccatcacaggtattggttctaaattggagcctcttgttagaggatcagacagaacaaagttacagagttctgcagtaaattccagtacagaatctttttctgatggacagttgatgggctcacaggatgcagccattttcccagttactgcatcagcaaaattaactcaggactgcaagccacctgacaaatctgttgatgtgcaccacaggaagaggaaaagaatgcaggacacaattgaatataatgcaaatttatctcctgagaaactctctgatttgcatggtttgatttatagaaaagttggcaaatgcttagaaggaggaaaagaggtgcttcataatctgaataatttacaggaagagaataaaagggcccacaaaaagagaaagaaatctcgtagagaaaaagtggacatgatacctttggttaacagggatgagcaaaagggcgcagaagaggccgagactgaggtctatgacgatgcaaatgtctgtagacatacttcctgccttgctccacatactttagaaacctctgaagcatgtggggataggatatgtgatgctgcgaataatttcgattcgatggttaattttgataccgtgcctgatggaaattatatgaaattattagaattagaagatgctaccagtgaggaatgctatagaaaagcaatggattttcccatttctccatctcttcctgaaattgaattttgtgacacatttgaagagggtaatttgacgaatacgtctctagagaaagcactccaagatgacatgttgagttcaagaacagacctgtttacttcaccttacctcaatgtaattaatgttgaaatcaattctaacgaacaaaaatgtgatgattgcggagtttcttgtaatttacatatgcgcattacagaaaagccaaggacagctttttcggtggaggatgtaattggatcattaaacaatcaacttcctgaattttgtgttgtcttttcaaatattgaggacaatagtatcatatctaggatacttgttgctacaaaaaattgtatagctcggtgcaatttggcttctcaaacaggctggggggttgctaacattctgactgcacttaaaatggaagaaaagctctcacagaaggagaaggtttcagtactgttaacacttatgatgttcaactttgccatgactgcaacaaagacatttggaaaactctgggatgggaatttattccactgcttgcaatcttattctgaacatatttgcacagagacaagagtcctgtttgtagagaattattctttgcatgagctgcttagcctcattgaagattttcttattgagggaaaagtaatagtaaacaatagagtatatgctgaaactttgtcttgtgatttgagagttaatgattttctggattgtgttaatcaagtatcatccgatgtagcttcaagtgaacaattggcggcagcaagtattatattagcatcagtatgtgctgcaactgattatgttggatttatttgtgatgcttcatatcatattcttcagtcatgcaagtgggattctctgatggtgctgactattctccatatttttgcttatttgggcggagagaagttttttaacatggataattttggattaatggtgaccgttttgaagtctctagttatgtttcttgaggatgagagcccatctgttgcatctgcctgtcttccttcaataaatcagctgcatgctgagttgtgtatgaatgttaaatgcccattcttggaaggtgttgaatccattgatgcagttgcatgcttgctcttggaagagataaagcgaataaatttgtctgattccagattaatgtcagacaattatgatgctgaactatggtataatcaggatgcaattcaatgtaccattagcaagaactgtgatgtgccctgtttgagaaaattctcgatttttgctactcaaccagatgcccttaggaacgtcaatttttgtcgcctgaatgacgtcctgtcattggtggaactggtttcaaacaaaatgagctggcactgggctgatatcaaacttgttcctcagcttctgaatatactcgactcgtgtgtagaggagaactttgctgttcggataattgttcttcttggtcaacttgggaggactggagtagattttggtggatatgaagataaaggagttggaaacctgagatgttatttgtttacttatttttgccgcacctcttccatgaaagcaggtctttctcttcaagttgctgctgccactgctctgtttggccttcttcctcttgattttgaaaccctttttcatactaaaatcaatctttcagcatattctaaatcggtttctgacaatgctgaaagtttgaggaagtggttctctgggctggataaagatcaacagaaattgctatctgatgtatttaacatgtaa

SEQ ID NO: 32656 - DNA, 138 bp, Glycine max
  Peptide Sequence Number=SeqID_149434
atgtatacatcaggagagagaaagctaggcggctggttccactgctggttaagagcttttgcttatgttgcaagaagttcttgcagtgaattggaacacttcctggttggggtggataagaaatcacagggttggtaa

SEQ ID NO: 32657 - DNA, 261 bp, Glycine max
  Peptide Sequence Number=SeqID_149435
tggcgctacctctgttgtgttgaggttgctgttgctatggggtttagggtttactccattaccgtcgtcaccgactcttcttccatctcttattagtgaagcgatctgttactcattcattgcattgcgtacaacatggcattctcaacgaatcgagatcagactcccaaatctgactccacgaacccctgctgtgaactctggaagaagaagtactcgaagacccaagaatcgcggaatgctctgcgacaagccgtcaag

SEQ ID NO: 32658 - DNA, 1806 bp, Glycine max
  Peptide Sequence Number=SeqID_149436
atgctactttgcttcaaaatcccttctttcccactttgcacctctgcccctgaaaccaatttcaatgatcacaatgaagccgagagtagtagtagtagtagtagtagtagtgacaatgagacagagtgggagagattgctcaaaccctttgacctcaaacagcttaggaggtcactctcgctcaccccaattagcccatttcagctttgtaaattgttggagctccctcttgacattcccacttcaatggaactgtttcaaagggctggtgcgcaaaagggttattctcacacctttgatgcttgctatctcttaattgataagcttggggctgttggggacttcaaagttatagagaagttgttgaagcaaatgaaggatgaaggccttctgtttaaagaatcactctttatattgattatgaagcattatggtaaggctggattgcctggccaagcaactaggcttttgttggacatgtggggtgtttattcctgtgacccaacttttaagtcttacaatgttgtgttggatattctggttgatggagattgccctagggtggcacctaatgttttctatgacatgttgagtcgaggtgtttctccgaccgtgtatacatttggggtggtcatgaaagccttgtgtatggttagtgaggttgattcagcttgctcacttttgagggacatggcgaagcacggctgtgttccaaattcggtcatttaccagaccctgattcatgctctttgcgaaaacaacagagtgagtgaagcattgcagcttttggaggacatgtttctaatgtgctgtgagcctgatgttcagaccttcaatgatgtcatccacggcctctgcagggctggtcggattcacgaggcagcgaagttgcttgatagaatgctccttcgaggtttcagcaccgatgctctgacttatggatatttaatgcatgggttgtgcagaatggggcaagttgatgaagcgagggcgttgctgaacaaaattcccaaccccaatactgtgctctataatacattaattagtggatatgttgccagtggaaggtttgaagaagccaaggatcttctatacaataacatggtaattgcaggttatgagcctgatgcctacacgtttaacataatgattgatggactagtcaagaaagggtatttggtctctgctcttgaattattaaatgagatggtagcaaaacggtttgagccaaatgtgatcacatacacaatattgataaatggtttctgcaagcaaggccgattagaggaagctgctgaaattgtgaatagcatgtcagccaagggtctgagtctgaatacagtggggtacaattgcttgatttgtgcactgtgcaaggatgggaatattgaagaagctttacagctttttggtgaaatgtctggcaaaggatgtaaacctgacatttatacatttaattctttaataaatggactttgcaagaatcataagatggaagaggccttgagtttatatcatgacatgttcttggagggtgttattgctaacactgtaacatacaacacgttggttcatgcatttcttatgagagattctatccaacaagcatttaagcttgttgatgaaatgctatttagagggtgccctcttgacaatattacatataacggccttatcaaagctctgtgtaaaactggggcagttgaaaaaggattgggattgtttgaagaaatgcttgggaaagggatttttcctactattatctcttgcaatatactgatcagtggcttgtgtagaactggaaaa

SEQ ID NO: 32659 - DNA, 1769 bp, Glycine max
  Peptide Sequence Number=SeqID_149437
atgataatggtaccggtagcgagatacagcgtcctgtggcttgtgagtcctgaagttgtaattggtgttgatggccctatctttggtggtcctaaagttgtaattagtgtccttggtggccctgcctttggctgtcctgaagttgtaattggtgttggtggccttacccctacctttggcggtcttgaagttgtaattggtgttggtggtcctgcctttggtggctttgaagttgtaattagtggcattgcctttgacagtcttgaacttgtaattggtgttggtggccctaaagttgcaattgatgtggacggtcctgcctttggtggtcctgaagttgtaattagtgttggcagccttacctttggcagtcctgaagctgtaattggtgttggcggctctgcctttggtggtcctgaaattgtaattggtgttggtggtcctgaagttgtaattagggcctttggtggccttgcctttggcggtcctgaacttgtaattggtgttggtgttggggattctacctttagtggtcttgaagttgtaattggtgcccttgacgatcctatctttggcggtcctaaaattgtaattggtgttggcaaccttccctttggtgttcctgaagttgtatttggtgatggtggtcctaaagttgtaattggtggtcctgaaattataattagtgcctttggtggtcctaaagagcaaggaggttcgggtgttgcattggaagtggctttggatgatggtgttctgtgggtagcttcaatttttggggtgggggtttttgctaagtttggaacttcacctattgttatagctccaagcatgaagctctcttcttctggatttaatcctccggctgaagaagaaggggagaaaaaatgtttgaattctgaactttggcatgcttgtgctggccctctggtttctctgcctccggttggaagtcgtgtagtctactttccccaaggtcatagtgagcaggttgctgcatcaaccaacagggaagtagatgcacatattcctaattaccccaacttgccaccacaacttatctgtcagcttcacaatgtgacaatgcatgcagatgctgaaacagatgaagtatatgctcaaatgactctgcaacctctaagtccacaagagcaaaaggaggtgtatctgctgcctgcagaattgggtactcccagcaagcaaccaaccaactacttttgcaaaacattgactgcaagtgataccagcactcatggaggattttctgttcctcgaagagcagctgaaaaagtcttccctcctcttgattactcacagcagcctcctgctcaagaactaattgccagagatcttcatgataatgaatggaaattcaggcatatatttcgcggtcagcccaaaaggcatcttcttactacagggtggagtgtctttgtcagtgccaagaggcttgttgctggtgattcagtccttttcatctggaatgaaaaaaaccagttactcttgggcatacggcgagcgaatcgtccgcagactatcatgccatcgtctgttttgtcaagtgatagcatgcacattggtcttcttgctgctgcagctcatgcagctgccactaacagccgctttactatattctataatcctagggcaagcccatctgaatttgccattccgttggccaagtacgttaaagctgtgtatcatacacgagtttctgttggcatgcgatttaggatgctctttgagacagaagaatcaagtgttcgtcg

SEQ ID NO: 32660 - DNA, 706 bp, Glycine max
  Peptide Sequence Number=SeqID_149438
atgaattcatcaccaggattcgtcaaattggcctttgattgcaccattgccatcttatggaagaggaagggaacggcctgcaggaaggtatatgagttttatccatggagatggagtttaggatgtggtgaaaatgggacaatagatgggcaaggagatgagtggtggaacaagtggaagcagagaactcttcagtttaccagaccaaaccttgttgaatttgtgaattctagagatattatcatttcaaatgtaatcttcaagagttctcccttctggaatatacacccgtatagcaatgttgttgttcgatatgtcacgattttggctcctcgtgactctccaaatactgatggcattgatccacattcaagttcaaatgtgtgcatagaggattcatatatatccactggagatgatcttgtggctgagaagagtggatgggatgaatatgggattgtttatggccgtcctagctcagacataactatccggcgcgtaactggatcatctccatttgctgggattgctattggcagtgaaacctctggtggggtggagaatgtactttctgagcacatcaacctttacaacatgggaattggtatccacattaagaccaacactggcagggctggatatataaagaacataaccatgtctcatgtgtacatggaggaagcaaggaagggaataaggatctcag

SEQ ID NO: 32661 - DNA, 507 bp, Glycine max
  Peptide Sequence Number=SeqID_149439
atggacattgtgtacctcgatacctgtctagcctcgttatatagacaggagacgacgcatcctggcttgatcccggagctcttaccggaggagcgggagggccaagcaatgtcgacgacggtgctgggagcgggaacctcagcactgggtgctaccatgtgtgttggagttgtcagtgccaatgtagggggagagtttatcggaacaggcgatggtggagaactcaccagaactggcgttggcggcgagctcacaggtatcacaacaggaggtgtagccgcaggaggagtggccgtgggaggtgtggccaccggaggagtagttgctggagctggagcaacagctttaaacgaaggagatgctatcatggaagatgaaacgggaagggttgcgattgcagcattgggggatgaagatggtggagatgaagtgagagaagcagcaggcgcaattgattttggtttagaaggggttgtggctgggaatgctatcaacacttttttttaa

SEQ ID NO: 32662 - DNA, 216 bp, Glycine max
  Peptide Sequence Number=SeqID_149440
atgttcttctttaacaggcaggttaaggttaaggttgatttattgcaaaacctagagctcatcaggattgatttattgcgagtgtggaaggaggttaaggttgtgaatgtcatgaacgaaaagaaatttgggacaaattctgtacatgtgtggtgcgagatacggtggggtgtgaggtgtcgtgcgaggtgcagtgcagtgcgagatgtcgtgtag

SEQ ID NO: 32663 - DNA, 273 bp, Glycine max
  Peptide Sequence Number=SeqID_149441
atgaaggacatgtggcttaagttagaagttttgggagtgagtgagaaaataatcaagggtccagatttgggatgcaaggaagatcctgctgcagcggcaggagaggatcgagaaagttggagtgaggtttttgtgttaactcgagaagcagaagcagaagtagaagcccgtgttgagtttcactttccactgcacaaacaaagcacaacgcaagcacacgccatcgtcatgtttctgccagagtcgctgtttcttagcgcactgtcactgtaa

SEQ ID NO: 32664 - DNA, 2796 bp, Glycine max
  Peptide Sequence Number=SeqID_149442
atgggaactccaactcttggccttgtacttgtactccttctttcgttcttaacatggcctgcttctgtttcttcttctcttcccatgtctttgagaaggcaagcctctatcttggtttctctcaaacaagattttgaggcaaacactgattctttgagaacctggaacatgtctaactacatgtccctttgcagtggtacttgggagggtattcagtgtgacgaaaagaacaggtcagtggtgtcattggacatatcaaacttcaacctttctggcacactttcaccttccatcacaggactaaggagccttgtgagtgtttcacttgctggcaatggcttctcaggagtgttccctagtgatattcacaagctaggagggttgagattcctcaacatatccggcaacgcgttcagcggagacatgagatgggaattttctcagttgaatgagcttgaagtgcttgatgcttatgacaatgagttcaattgctccctccctcttggtgtaactcagctccacaagcttaatagcttgaattttggcgggaactatttctttggtgaaatccctccaagctatggagacatggttcagctcaactttctgtctcttgcaggaaatgatttgaggggtctcataccacctgagcttgggaacctcactaacctgacacagcttttcttgggatactacaatcagtttgatggtggtatccctcctgagtttggtgagttggttagtttaactcatcttgaccttgcaaactgtggcttgacaggtccaattccccctgagttgggaaacctcatcaaattggacactctctttttgcaaactaaccagctcagtggctcaattcctccacaattaggcaacatgagtggcttgaagtgtcttgatttgtcaaacaatgagctcacaggagacatccctaatgagttctcaggccttcatgagctcacactcttgaacttgttcatcaacaggttgcatggtgaaattccacctttcattgctgagctgcctaacttggaagtgctgaagctttggcagaacaacttcacaggtgccattccctcgaggcttggccagaatggtaaactggctgagcttgacctctcaacaaacaagctcactggattggtgcctaaatctctatgccttgggaggaggctcaggattttgatcctgctcaacaattttctctttggatctttgcctgctgatcttggacaatgctacacactccaaagagttcgtttgggacagaactacttgacaggatcaattccaaatggttttctttacttgcctgagttggcccttttggaattgcagaacaattacctcagtggttggcttccacaagaaacaggcactgcaccctctaaactcggacagctgaatctatcaaacaatcgcctatctggctccctaccaacttccattagaaactttcccaacttgcaaattctgctgcttcatggaaatagactctcaggagaaatccctccagatatagggaagctgaaaaatatactcaagttggatatgagtgtcaacaatttttctggtagtattcctcctgagataggtaactgtttgttgctcacctatttagatttgagccaaaaccaactagcaggccctatcccagttcagctttctcaaattcacataatgaactatcttaatgtctcatggaaccacctaagccaaagtcttcccgaggaactcggggccatgaagggcttgacttcagcagatttttctcacaatgacttctctggttcaatacctgaggaggggcaattctcagtgtttaactctacatcctttgtgggaaatcctcagctctgtggatatgagctgaatccatgtaaacattcttcaaatgcagtattggagtcccaagacagtggcagtgcaagacctggagttcctgggaagtataagcttctctttgcagtagcactgttggcttgctcattggcatttgcaacattggcctttatcaagagcagaaagcaaagaaggcactccaattcatggaagctgacaacatttcagaatctggaatttggaagtgaagacatcatagggtgcataaaggaaagcaatgtcataggaaggggtggagctggggttgtataccatggaacaatgccaaatggagagcaagtagctgtgaagaagctcttgggaatcaacaaagggtgttctcatgataatggcctctcagcagaaataaggacactgggaagaatcaggcacaggtacattgtgaggctgctggcattttgttccaatagagagaccaatttgcttgtttatgagtacatgcctaatggaagcttaggcgaaatcttgcatgggaaaagaggagagtttctcaagtgggatactaggctgaaaatagcaacagaagctgcaaaagggctttgctatttgcaccatgattgttcccctctgataatccacagagatgtgaagtcaaacaacatattgttgaactctgaatttgaggctcatgttgctgattttggacttgccaagttcttgcaagatactgggacatcagagtgcatgtcttccattgctggttcttatggttacattgctccagaatatgcatacacgttgaaagttgatgagaaaagtgatgtctatagctttggagtggtgctgctagaactactaacagggagaaggccagtggggaattttggggaagaaggtctagacattgttcaatggaccaagttgcaaacaaattggagcaatgacaaggtg

SEQ ID NO: 32665 - DNA, 453 bp, Glycine max
  Peptide Sequence Number=SeqID_149443
atggaaatcgaggagatatttggtgggtgggacaatcttctgtgtgcgagtcttcatactgctcccggctattacttcagctactgcatgtctaaggataccatgaaacagaacataatgtgcttgaatgaaagtatcattgttatcacgaaggcacatacctactccaaaggaggtttggtctatgaatatcattgcatcgagattacacttggtgtagtcatgtggggaggagaccatgagattgttgttcgagacaatgatagcagaacgaacactataagcgtcaataggagtgaatttccaaaacaatttgtcatcatcacccaggttcaacaatggtgtggctttgaaagagtcaatatcttcttggttgaagatattggtgatgaggttcagattccatgtatgagaagaaggatcaattatgttactaaccttgagatgctctaa

SEQ ID NO: 32666 - DNA, 222 bp, Glycine max
  Peptide Sequence Number=SeqID_149444
atgaaccacattgatcaaggagtagagcggaacagttccggcaatttggttcaaacggaaggaaccgcgacaagcaacgatgcacaggttaataatcgtgcgcgctcctcctccaataaggactcaccggaaacagaatcgccggctgcgaatatcaaaagaagagaaggtaggaaagaaaaaggacagaagaatcggttgatgtttgaggaatcgcgttaa

SEQ ID NO: 32667 - DNA, 1347 bp, Glycine max
  Peptide Sequence Number=SeqID_149445
atggctttctttaggaacttttcaaatgatacagtctcacatggtgtcatggaagataaaagccaaggacagaatgctaatagagttcatagatcagtaggtaatgattgtactgatgcaacttctagtgagaaggaatttgatatgaacatggaggcacagtatgatagtgatggcgaaccagatggttccagtagactgcaaactgaggcaacagctgatgatggagatgctgtgaaagaatcaaacttgcagactactggtagtaaaacagctatggtcggaaggtggggttcaacattttggaaggactgtgggcaaatggaccctcaaaatggttctgaatctgggcaggaatcaaaaagtggatcagattatagaaatgcagatgggtctgaagataattcattggatggaagagcgggaagattagactcagatgatgatgatggacaaaaggaggcaggaaaaggtccaagaggtcactctgatgttcctgctgaagagatgttgtctgatgagtattatgagcaggatggggaagagcaaagtgactcattgcattatggtgggatcaaaaagcccactggatcgaattcatggccacaacggatgtcgacctctgcaaatagaactttgcataggaatttgaggttttcagatgatgttgaagataatgatggtgaggatgaagatgatgatgatggtgataatgataatgatggtgatgatgctgattatgaagaagaggatgaagcagatgaagatgatcctgatgatgcagactttgagcccgccacaagtggtcatgctgcaaacaaggataaagattgggaaggtgaaggctcggatgaagatgatgacagtgacgcaaatatagttgtctccgatgatgatgaacctttctatgctaaaagacctaaaggaaggcaacgaggtaagattggacaaaacataaaatctaccagagaacgtaaagtgtatgctgcatctggtcgacaaagaagagttaaatcgtcttttgaggacaacgagtcaacaacggaggattccgacagtgatggtgatgaggatttcaaaagcacaaaaaagcggagtgttcatgtccgcaagaacaatggtcgctcgtctgcagccacaggcttttcttcgcgcaacagtgaggttcgcacttctagtaggacggttaggaaggtatcatatgttgaaagtgaagagagtgaagaagctgatgaagcgaaaaagaaaaagtcccaaaagaaagaagagagggaagtgacaactccattgaaacaaccattggatttgagtagcctaaagtggagccaaaaggtcaatcctaaatga

SEQ ID NO: 32668 - DNA, 611 bp, Glycine max
  Peptide Sequence Number=SeqID_149446
agatctcaggtatgaggtttgctgattgcttggcagagtttaagctaaacatgcaagatggtaatttcagttgcattggttttgatgaagaaattgaagaggacgatggtgactccattgaaaaggtgctctggcatcagccaaagggcatggctgaagatgctcaaaggaataatagatcaacagagcctgttttaatgagtcacttgtttgattcggaaattgattggaatgagattgaatttttgataaaatggaaagggcagtcacatttgcactgtcagtggaagtcttttgctgagcttcaaaatctcagtggttttaagaaggttttgaattatacaaagaaaataatggaagacatcaggtacaggaggacaatctcaagagaggagattgaggtcaatgatgttagtaaggagatggatttagatattatcaaacagaacagtcaggtggaaagaataattgcagataggatcagcaacgataattctggcaatgttattccagaatacttggtcaagtggcaaggactatcttatgctgaagcgacctgggaaaaggacattgatattgcttttgctcaacatgctattgatgagtacaag

SEQ ID NO: 32669 - DNA, 1008 bp, Glycine max
  Peptide Sequence Number=SeqID_149447
gctcgtgaggctgctatggcagttcaaggaaagatggtagattctcagcgtaagaagagcaaagcaagtttgcggaagcttgagaaacaacctgaatggttgaagggtggagagctccgtgattatcaacttgagggtctgaattttcttgttaacagttggagaaatgatacaaatgtcattttagctgatgaaatgggccttggaaaaactgttcagtcagtatcgatgcttggttttctacagaatgcccagcaaatccatggtccttttcttgtagttgttccattgtccactttatcaaattgggccaaagaattcaggaagtggcttcctgatatgaatattatcatatatgtaggtactcgtgcaagtcgagaggtttgtcaacaatatgaattttataatgagaaaaaacctgggaagccaataaaattcaatgcactgttgactacatatgaagtagttttgaaggataaggctgttctctccaagatcaaatggaattatctgatggtggatgaggctcataggctaaaaaatagtgaggcacaattgtatacgacactttcagaatttagcaccaagaacaaattgcttatcactggcactcctctacagaacagtgtggaagaactatgggctttgcttcatttccttgatccggacaagttcaggagcaaggatgaatttgttcagaactataagaatctgagttcttttaatgagaatgagcttgcaaatctgcatatggaattgagacctcacatacttcgaagagttatcaaagatgtggagaaatcattaccccccaaaattgaacgtatccttagggttgaaatgtctcctcttcagaaacagtattataagtggattttggaacgtaattttcacaatttgaacaaaggagttcgtgggaatcaggaaatgcctatacttgatgcgtggtttctttccaccatgcaaacttcattgattgtcaaaagtagcaagctagagttggtatag

SEQ ID NO: 32670 - DNA, 2091 bp, Glycine max
  Peptide Sequence Number=SeqID_149448
atggatatagatgagattcttgaaagagcagagaaggttgaagagaaggaaactgacggggaacaaggaaatgagttattaggtgcttttaaggcaagatatgtggacagtactgttgccaatttttgcaatgatgaagatgatggaagtttctggagccgttggataaagcctgatgctgtatttcaagcagaggaagctcttgctcctcgatcggctagaaatattaaaagctatgcagaggttgatccatctgaaagaagtaataaaagaaaaaagaaggaacctgaaccacctgagcaagttccaaaacgccggaaagcagagtattctgctcatgcagtaccaatgattgagggagcatctgtccaatacggagtgatctactccttgccaggatctaagatctcttccttgctccttttgttggatagagttaattgttgtactgctctgtgggtcagccagtgggttttgaaatatggcaatgagagccaaatcgacttaattgctgctgaggttggtggtgctgttggggcagctccacctggagcacagattgaacttttcaatgctcttgttgatggttgtacagaagcagtagaacttggaaatctagatgcaaaggggcctttgctggatttttttggtgtaccagtgaaggcaaatgatctacttacccgtgtccaacaacttcagcttttggcaaagcgcattggtcgatatgaagatcctgtcgcacaatttcgcgttctgtcatatctcaaaccatcgaactggtccaaaggttgtggatggaatcaaattgatgatgctagattacttcttggaatacattaccatgggtttggtaattgggaaaagattagattggatgaaagacttggccttatgaaaaaaattgctcctgtagaacttcaacaccatgaaactttcttgccacgagctccaaatttgaaagaccgtgctaatgcccttttggagcaagaacttgctgttcttggtgtgaaaaatgccaacagcagagttggacggaagccttccaagaaagagagagaaaatatgattaatttatcactgttacgtgggcaggagaaaaagaaaaaatcgagttctgttaatgtccaaatgagaaaggatagatttcagaaaccccagaaggttgaatctatagtaaaggaagagggtgaaatgtctgacaatgaggaagtatatgagcagtttaaggaggtaaaatggatggaatggtgtcaagatgtgatggttgaagaaatgaaaactttgaaacgtcttcacaggttgcagcaaactagtgccaatcttccaaaggaaaaggtgctttcgaaaatacgcaactatttacaacttcttgggagaaggatagatcaaattgtgttagaacatgaacaggaaccctataagcaagatagaatgaccgtgcgactgtggaaatatgtctccactttttcccatctttcaggggagaggcttcatcaaatatattccaaacttagacaggagcaagatgaggcagaggttggcccctctcacacaaatggatcggtatctgtttcatttagcagaaatggaaatccattccgtttccatatggagaggcaaagaggattaaaaaatatggctacctatcaaatgccagaaccagttgataatactgggaaatccgaggcatggaaacgaagaagaagaactgaaagtgacaatcacttccagggtcagccaccacctcaaaggaccgttagtaatggagtccggattgctgatcctaactcactcgggatcctaggtgctgggccgtcggacaaacgctttgctagtgagaaaccttataggacacaacctggtggttttccttcaagacaaggcttctcttcagaggctgattacaagagtgttggctttcactctgcatttatacagcttcagctattgtacattctgtggaatttttttcttccacccatgcgaataagaccttgtgggatcccttttgggtgtgttttggcggatatgaggaatatccctacactgggattcgcatccttgaagatggctgaagccaaaaagatctaa

SEQ ID NO: 32671 - DNA, 759 bp, Glycine max
  Peptide Sequence Number=SeqID_149449
atgggtctgtccaaggagaatctgaaaggtctcatactagctttggtgtcaagtgggttcattggggcaagttttatcattaagaagcaaggccttagaagagctgcagcagtttctggtgtcagggctggtgttggtggttattattatctcttggagccactatggtgggtgggaatgatcacaatgattgtaggagaggttgcaaacttcgttgcatatgcatttgctccagcagtcctagttactcctcttggtgcattaagtattattgtgagtgctgttttggctgacattattctgaaagagaagctacacaatcttgggatattgggctgtataatgtgcattgctggtagtatcattattgttattcatgctcctaaggaacaacctattacatctgttctggaaatatggaatatggccactcaaccagcttttctggcatatgtgggctcagtaatagtgttggttttcattctggtcttccattttgcaccaagatgtgggcatacgaatgtgctagtttttactggaatttgttcattgatgggttccctctctgtgatgagtgttaaagcccttggaacttctttgaaattaacttttgaagggaaaaatcagttaatctacccagagacatggttttttatgttagttgttgctatatgtgtcatcatgcaaatgaattatcttaataaggaactgctctttgttttgagccttttgggagggggggagaaagatttactgtaa

SEQ ID NO: 32672 - DNA, 333 bp, Glycine max
  Peptide Sequence Number=SeqID_149450
atgtttaaggattgggatggacaaagtggtggaactattgtgtcagaaatatgtggcttcatcattgtgctctctggaacaataatgttgcatgcgactaaggacttcgagagaagctcttcttttagaggtgtggtagtgatcctttatcgcctacgctatctgcccgactttttaccggaaatggtgactcattacttaagcaagatgaggaaaatggatctcccgagagtaatatgcgctcaagaaggcaagaattggggaagaagaagcctttccctggagaatctgaatgagatgcccatcagattatactacaccatgaagctgtag

SEQ ID NO: 32673 - DNA, 405 bp, Glycine max
  Peptide Sequence Number=SeqID_149451
atgtcttattggacagactacaatttggaattgctgccattttttggtcttttcggtagtgctggaagcttaacacaaactcattactgcgggataacaaaaaaactagaaattcagtcaaatgaagggattatgcagcaatatcgagaaagaaatgaaaaacgaggctcaatcattcacatcggtgggatccacttgttctattacaagacaaaagaagcagtaggttacacttggacagcaatttcttccttcagaacaaattcaacttcttcattttgccatgcaaggggagatggtggagagtcccatgataacggagaagaaggaggagagctccactgcattgaatggtcaaaccaatcagaaaattgggacattggcaattctacaggttctgggtag

SEQ ID NO: 32674 - DNA, 137 bp, Glycine max
  Peptide Sequence Number=SeqID_149452
atggagaggaaaatgcacaatcctacttcttccacagtgttgacaatattgctacttggagtgctttctcaaaaccttgtcgtccctgtaacatgcactcccacctcctcaccaactcccttcactggaacaagcta

SEQ ID NO: 32675 - DNA, 1290 bp, Glycine max
  Peptide Sequence Number=SeqID_149453
atggcttgggggaaacctgtgttggaccgtgtgggacttataattgagattttcaatgctcatgcctttaccaaggaagccaaactccaggcggaactcgcagctctgtcctacaagaagaccagacttgttcgcattcgtggccctgatggtcgcaatacatttggggcttctggagaagctgaagttgttagcgcccgagggagaggaagtgggggacaaggttttatgagtggtgctggagaaactgaacttcagcttcagcgacgaagaatcctagagaggagaaattatctattatctcaaattgaagaggtccgccgcacccgggctttgcagcgtgctggtcgtaagagacgtggaggttcatctggagaaggattagccactgttgctgttgttgggtatacaaatgctgggaaatctacattagtaagtaggctatcggacagtgatctgtatagcgattgtcgactgtttgcaacagttgatcctagagtaagaagtgctgttcttccttcagggaagaaagtgcttttcagcgacactgtgggattcatatctgacttgcctgtacagctggtggaagcatttcaagctaccctggaagaagtggtggaagcagacctgcttgtgcatgtggtggattcaagtgctcccaatcttgatgagcatcgctcaacagtgtttcaagttcttcaacaaataggggtgtcagaagagaagcttcagaatatgattgaagtttggaataagattgatatggaagaagaatgcatggatgttgatgaatatcttgatgatgaagacaaagatggagatgctgatgaaaatagcagcttcagtggagaagatgatgtgaaatctgaggtattaccagaaagagagaaagatcgtgctgggagtatttctggtgcagaaaatgaaggcatcaaggaggttgactgtgagggcatggaagaaaaagaagactattccgatggttggctatatgatgatgatttggttgatgaagatgaattttgttcaccttcaacggtggccgaccaacaaaatgagtcctataaaaaggacaacagtgtcgtgaaagatggctcgataggacaatctggtcctcatgtgaagacatctgctgtcacaggagttgggttgcaagagctgctggaattgatagataagaaacttagtgttcagaataagaagggtgcacgagtggttgaaagaagtatctatgaccgaaaatggaggccctcccacaatcaggagtctggcatagcagttgaacagtag

SEQ ID NO: 32676 - DNA, 249 bp, Glycine max
  Peptide Sequence Number=SeqID_149454
atgcggcgcaggaactgctcgagagtgctccgaagtagcgattggcaccggcgcgaggtgataggttgcggcggaaggtgcgatcgaggttccggcggcgatgctccgcggattccggtgatcgagaggtcggcaagctcgcggcggcgcggcggcgcggcggaggaggagaaaatcgcggcgaggaagtatgatctggaaaatcagttgcagaggagagagaggaacggagctagagagagaaagtga

SEQ ID NO: 32677 - DNA, 804 bp, Glycine max
  Peptide Sequence Number=SeqID_149455
atgagaaaagcggaaggtagagcaacgacgccgtttccagtttcagcaaaacacacagttgagattaaaaagcacaacttgatgaggttatcgttgaggcatgctttggtgtttgtgttaatcggggcgttgtggaacttgcaaagggcagagggtatccgatttgtgatagacagagacgagtgtttctcccatgatgtgaagtacgagggtgacactgttcatgtctctttcgttgttattaaggctgattctccctggcattacggcgacgaaggtgtcgatctcgtggtaaagggaccttctggcgagcaaattcaagattttcgggacaagaccagtgagaagtttgactttgtggctcacaaatccggggtccataaattctgcttcaccaacaagtctccttatcatgaaactgtcgattttgatgtacatgttggtcacttctcttactttgagcaacatgcaaaagatgagcatttcacccccttgctggagcagattgggaagttggaggaagctctatataacattcagtttgaacagcattggttagaggctcagacagaccgccaagcaatagctaccataccaaaagagaccaccctgttgagaacattgcttcctatctctttgacaatgttcactgttgagaacattgattctgtgaacgatgcaatgagcagaagagcagtacacaaggcaatttttgaatcagcagcactgattggggctagtgcgctgcaagtctaccttctgcagcgattgtttgaacgaaagttgggtacctcaagagtttag

SEQ ID NO: 32678 - DNA, 216 bp, Glycine max
  Peptide Sequence Number=SeqID_149456
atggcttccaacatctcgccctctgcctttgataaagaacagatatttggaatggctgaaaaggagatggaatatagggtcgaattattcaacaagtacaaggagtctgagctaaatatgggtgaaaatagttgcattgaccgctgtgtttcaaaatattggcatgtgactaatctaattggtcagctgcttggttctgggaggcctccaatgtaa

SEQ ID NO: 32679 - DNA, 138 bp, Glycine max
  Peptide Sequence Number=SeqID_149457
atggaagattacttcaatttccatgcttttaaattgattgttggaacccataatatggattgtttgtgttatgctgtggtaatggtgggtatagctccaaggtcttctatttggggtatttggggtctgaaaaagtga

SEQ ID NO: 32680 - DNA, 768 bp, Glycine max
  Peptide Sequence Number=SeqID_149458
atgaagggtgctggtttggttgctgatacggtgatttatactattcttattgatgggtattgcaggaatggcaatgtggctgaggcgttgaacgtgcgtaaggagatggtggagaggggagtttttgcggattactatactcttactaccctattcatgggtagggctcttggtttgtttgagacgctgactcaaaggagccttgtgacgtataatacgttgatggatggcttctgcaagattggtgaaatggagaaagctaaggagttatggtgtgatatggtgagcagggggatattgcccagctacgtatcatttagcattttgatgaatgggttttgcagtttaggacttatgggtctagttgtggactatgccaatgccatcactggttctgtatatcacaggaagcacaaccctggtggatgtcttcggagcccggacataatagttgagccttcctgccttggtggagcctggatagaagtcattgcaattatgaagtgtagcatgggagattggaagttgaagcattcttttttcttgctctcaagtagcatgagaatggtcaccagtcaccacctaagttctggttcaaagcctttcactatgtctcccagctgcaaacaagtggtgctggttgcgatgatggcatcactgtgtttgaccggagctagtgcatatccaacccacatgggcgcaggcaggggctgtggcctgtttagtgtggtggaatattgggatccaaattcaaggtatggaacttga

SEQ ID NO: 32681 - DNA, 171 bp, Glycine max
  Peptide Sequence Number=SeqID_149459
atggtgatggaagaggatgtggaagaatttatcacaaatgccgagaaggtggaggatgagatattgtcaatggtgcgtaaggattggacggtgatgcgacttttgttgacatttttggactttacgtttgatgtgactcacacgagtcatcaccatgcttcacttcgctag

SEQ ID NO: 32682 - DNA, 1235 bp, Glycine max
  Peptide Sequence Number=SeqID_149460
ttgtggctactacaaggaggttaccttcagattctggtgcctttgcggactgggcagcgacagcttcctccggtgctggtggtggtggtggccgcgctgtccccgtcgacgagctctccctaggcttcaatgcgggtcccgctgccgccacaggacccaccgccggaatgtggtccaccccaactaggtcaatcaattaccctgaaatggggatgttcgtggtggcaccagcttcttccttccaccctaatctccaccaccaccaccaccaccaccaccagccgtcgccgaacgaccccgccgtcatggtggattcactcaaccccgccactgcactcggcgtcggcgtcatccccctcctcgccccgacgccgtgccacgaatccgacaacaacatcctcggaaacaggacacgtggcggtggaattcagttttggcaagaccaacaacaacataatcaaggcaactacacgaagaagccccagcagggtcttctcgaccataatagtaacaccagttcggggaatttggttcagaacagtggcggggtaactgcttctggaactagtagcggaggaacaacgtgccaagattgtggaaaccaggcaaagaaagattgtaccaatagaaggtgcagaacttgttgcaaaagccgaggctttgattgccctacacatgttaagagcacttgggttcccgccgcacgccggagagagcgccagctcatgacgtcggccaccgtggcgccggttgccggctctagtggctccacttccggcactaaaaaacctaggctcattgcttcacaaaccacaacaacctctcacacatccacttctaacaccacccctcctagaagctttgacactagctctagccatcaagatgcggggttcaaagagtcattaccggggcaagtacgtgcaccagcggttttcaagtgtgtaagagtgacggcggtggaggatgggcaagatgagtatgcgtatcaggctgtggtgaagattggtggccacgaattcaaagggtttctctatgatcaaggtgcggagaatagggatgtgtatcctaacctatctgagttgcatttgggtggtgggaatggtggaagtggtggtgcgggaagaaatggggtttcatcttcctctccaatgatggatcctaatgatgtttatgcagcttcgggtggagggttattagggggttcttcagcatatggtaatccaatgaattga

SEQ ID NO: 32683 - DNA, 1398 bp, Glycine max
  Peptide Sequence Number=SeqID_149461
atggattcattcaatcagagtgttcagaattccagcttcaggtacaatccaaatttgaacacaaggacacatgcagatgaagaagctgagttctcaggaattcttgatatctttgtccatcatgccaggaatattcataacatatgcatctatgacaaccaggatgtctatgctaagttctctctcacttacaaccctgatgagactctctctacaagaatcatcaatggaggtggcaaaaacccaacattcaatgaaaacttgaggttgaagatcacccaaatgaatgctgttctgaaatgtgaagtttggatgtttagtaggtcaaggattcacatggaagaccagcttttggggtttgctttggtcccaatttcacaagttgttggcaaaggaaagttgactgaagattacagcctttcctccactgatcttttccactctcctgcaggaactgtccaactaacactgtctttggacccctctttggcaatcaactcctcagtgaatttgatacctgaatcagcaaagaactcatcaatatcatcagaagttattttgcttgatagaaagatctcagaagttatgttggatccagttgagtatgctagaattgaatttcctgacatcagtgtggtgaaggagaatcagcaaatggtatctgagtacttcaatttggcttctcaagatactaattctgctccttcaaggtccaacattggagggtcactaccatttcttcaccttggtgcatctcctcaacttgatgattatgagatgactatgatgagctcaccagatgagaatcatatagggcccatttctccaaatgagagcattcagaactcttgcttcccaggttctaccatcacaaccttgagtagtgatgatataaactcagcagattcagttgagaaaaagaaccatttgagcactggtgactcatcaaattctatcactgtgtcaatcactgtggaaggtactcaaaactgtggtgctggtccagataccccaacttccaagaaagaagaaggtgaggccagaggtaacaaagatgcaaacttctcaagcaaggaaaaggaaagcaaaaaaatcaataataacaacacagaagcttcaaagtttggtcaagtttattcagctccactagggaacatcaatttagaagctgagcaagctgctatgcaaaaacaaatagtggacatgtatatgaggagcatgaagcagttcactgagtccttggcaaaaatgaagctaccaatggaccttgacaaacctgaaaaagtggatcatggtgatgttgatgtgattcagaatcttgacaacagcaaattagaaattgataagaagaaaaaggatggatcacgtgtgttttatggtagtagagcattcttctaa

SEQ ID NO: 32684 - DNA, 411 bp, Glycine max
  Peptide Sequence Number=SeqID_149462
atgatttctctcacaggcttttacaccaacaacaacctttcagcttcttcaccccccaacaacattccctatccatccttcgcaattcaattcacgagaggaagccctcccaaactctttggaggccgtattggaggcaagctcattggtgtagaacctgtgcatgtaatggcttctatcgttaagaagcatgagtaccataagccaaatgttcagcctgtcatcaaaagtactcgtggtgctaatcactatgttgacatcaccaacaacactgacaataatcaccttggtttctctaatattggaccttcaagctcatctccgatcaatatccaaaccactactactccttatgctcctacagatgctaacatgcatgctctatctgaacaaccccaccaatcaggataa

SEQ ID NO: 32685 - DNA, 744 bp, Glycine max
  Peptide Sequence Number=SeqID_149463
atggcaaacaatttttgtgcaccttccctttccccacctccgccatcacctctatcatcaactttgtcttcacctatcttcgttatcccttctgagtcagatgtccctcctcctgatgtggttgcaattgctaagaggcttaaaaggaagccatctggctcagagaataagcccaagccagtcatagaggaatttcctaaacccatgttcctaatggtccccgctggcatagacattatcaatgccatcattacctttgcccgcaaccaacatgctagtatcttggtgcaccatgcttcaggcaccatctctcaagttaacctttgcaaccctgtatatccttttgatgatttgtccttccagggaaacatgtacatgttttctttctctggattttacaccaaaagcctttcacctttacctccaaagaacattccattttccttcttcaacattcgattatcgaagggaacaacaccccaacacttgggtggccttattagaggcaagcttattgctgcggaacctgtgcatgtcatggcttcactcctcaaggagcatgagtaccaagagattggtactcatggtaaccgttatgcttctattatgaataatgctatcaatggcatcaccaacaacaacactgccaatcatcaccctggaatgaatgcccaaccccttgcttctcctacagatttgaacatgctctatttgaacaaccccaccaatcagggtgataattaa

SEQ ID NO: 32686 - DNA, 417 bp, Glycine max
  Peptide Sequence Number=SeqID_149464
atggggcgagcaaagtcactgcttttgctgcttatggtgcttttgttttcctttgccacttataatttggtagctatgatcatggaccataaggcagatgggttggagtctttgaatagaaaaatgatggtatcgggaaagactaattcaaagtttcatgttgccgtgaccgcaaccgatgccgcttacaatcaatggcaatgccggattatgtactattggtataagaaagtgaaggacatgcctggatcagatatggggaaattcacccgtattttgcattctggaaggtcagaccagctgatggatgagattcctacttttgtggttgatccacttcctgagggcttggataagaataagcctattcctttcacaactttggggtgtgggggagaagtagaagggttcgtttga

SEQ ID NO: 32687 - DNA, 678 bp, Glycine max
  Peptide Sequence Number=SeqID_149465
ggttatattgtcctaaatagaccatgggcttttgttcagtggctggagaaagcagatattgaggaagaatatattctgatggcagaacctgaccacatatttgtaaagcctttgcctaatttggctcagggaaccctgcccgcagcatttccatttttctatataaaaccagatcagaatgaaaaaataatcaggaaattctatcctgaggaaaacggtcctgttactgatgttgatccaattggcaattctcctgtaatcattaagaagtctttgatggaggaaatagcttccacatgggtaaatgtttcattgagaatgaaagatgatcaagagactgataaagcttttggatgggtgcttgaaatgtatgcttatgctgtggcatctgcattgcatggtgtaaagcataatcttcgcaaagactttatgcttcagccaccttgggacttaaatgttgagaataagtttatcatccactatacatatggatgtgactataatatgaaggtatttactccttattacttcatccagggggaactgacatatgggaagattggagaatggcgttttgacaagaggtcttatcttttgggtcctccacccaaaaacctgcccttaccgcctccaggagttcctgaaagtgtgctagcatcacttgaaaaagccaggtga

SEQ ID NO: 32688 - DNA, 2100 bp, Glycine max
  Peptide Sequence Number=SeqID_149466
atgaatcgtcaaagttactctcagctttctggtgatgttaaagctcttgaagtcaatggaagaggaaaaggggaagcaaaacttgtgaacagggatactggtgtggatacctgtcttagaaagggaggagcatccaatatacaggacacttacaaatccttctgcacacgccttgtccgtctaaatggaatcttattcactcgtacaagccttgagatcctcaccgaagttctctctcttgttagcgctggcctgcgtgagcttttatcatcagggcaagacgaagagctgaattttggcacagatactcttgagaacaaacttgccattgtcagaattgtttccattatcatatttacagttcataatgtgaataaggaatctgaaggtcaaacatatgcagaaattgtacagcgtgctgttctacttcagaatgcattcactgcagcttttgaattgatgagtttagtagtagagagatgtatgcagctgtgggatccttcttgtagttatctcttaccaggcattttggtttttgttgagtggttggcatgttatccatatcttgctgcaggcaatgatgtggatgagaatcaggcaactgtcagatcaaaattttggaatcattgtatatccttcttgaacaagctactttcagtttggcccatgtctattgaagatgatgaagaggagacttgctttaataacatgagcaggtatgaagaaggggaaactgaaaaccggcttgctctgtgggaggattttgagttaagaggatttggtccacttctccctgcacaaaccatcttggatttttcaaggaagaataacctcggcagtgacagtgaaaaggaaagaaaagctcgggtcaaaaggattttggctgccggaaaggctttagccaatgttgttaggattgatcagaaaatgatatattttgactcaaagggaaagacatttgtaattggtgttcagcctcaaatctcagatgattttgttatttcctcctattcaggtatgcctaatgcagaagatttattgaaagacaacaccgtagtagacaagacaaaagtcggaatcggtcatccagaccaccaacagtacattgaaggagaggaggatgacgaggttattgttttcaaacctatagtggctgagagacgagctgatgtggttgttgcctcatcacaggcaccccatgaaggtttagaatcagttccaaaagcttctattggggatataaaatttaatgttaattctacttctaaccctctgaatgatgcaaatcatcaaatttctttacctgcttctgttagtcctatgatgcctcaacacctacaaccagttcagccacattcttcgaggtggttagaggaggaaatatctcttgctaacagtttgaaaggacttagattcttggagaatgggcacgtgatgaaacctgacttaccatttaaagctgctgtggcaatctctgaccatgctgcacttgcagttcctacccagcaatctgtaagtgctagtactaatatgttttatgctcatgatctctcaaaagctgaagactttgcaatatcatccaaaattgatgccattgcatcttctggaacattcactgataactctgttgtgaaaacatcatccaccttgcaagctggtttgaaaaaatctctggtcagccgaccttctaggcaccttggacctcctcctggtttcagtcatgttcctcctaaacaaggttcacccactgtttctgattcaattagtgggaatccaattatggatgattacagttggttggatggatatcagttgcctgcatcaaccaacgatttaggccctgatggtcctcttacttactctcagtcaaatcctcatcaaattggtttgagtgggacagccagttttccctttcctggaaaacaaattccatctacactgcaggtggagaaacagaatggttggcgagattttcagactttggagcttttaaaagcacaccataatcagcagttgcagtcacagttggccccaaatggaaatcagcattttactccactgcctgagcaatttcaaggacagtcaatctggacaggttaa

SEQ ID NO: 32689 - DNA, 783 bp, Glycine max
  Peptide Sequence Number=SeqID_149467
atggataaagtgtcttcgtcacgggagcgtgcacaacgcctttatgagaaggtagcctctggcaattggcatacagccttacactggttaaatcttgaattggagaataagcgaaggagatcagctcaggcgcaggtcccatcagatccaaatgcttggcagcagattcgggagaattatgaagcaataattcttgaggatcatgctttttctgagcagcataatattgagtatgctctgtggcaattgcattataagcggattgaggaattgagggcatactttaatgctgctcatgcttctgtaagctcaaaatcatctcagggagggaaaggtcctgttcgacctgaccggataactaaaataaggctgcagtttaagactttcctttcagaagcaactggattttaccatgatcttattatgaaaatcagagcaaagtatgggcttccacttggttactttgacgactcacagaataatgttgtcacggagaaggatggaaaaaaatcttctgagatgaagaaaggtttaatatcttgtcatcgttgtttgatatacttgggtgatcttgcacgctacaaaggcttatatggtgaaggtgactcaataaagcgtgagtttgcagcagcttctagttactatttacaagctgcatctatttgtcctacaagtggaaatccccatcatcaggtttttggcattcctgtctctgctgtgttttgcttttggctgttcacatttcttgttgatcatagtttgaggctactgtattccatttaa

SEQ ID NO: 32690 - DNA, 972 bp, Glycine max
  Peptide Sequence Number=SeqID_149468
ccaaggaagacaccgtcagtggaatcagttgattcttccggagaagaggagcttgctattcagagactagagattgcaaaaaatgatttgcaacacagaattgcaaaggaggctagaggcaatgcaattttacaagcaagcttagagagaaggaagcaagctttgcatgagcggcgcttggcacttgaacaagatgtttcaagattgcaagaacagttgcaagctgagagggatcttagagctgcattggaagtaggcttgagcatgtcttcaggacagctttccagttcacgtggcatggattccaaggtgtacacattctgtaaaaaatctgcaattgtacagacaaaggctgagctggaggagattgcacttgctgaagctgatgtggccaggttgaagcagaaggttgcggaactccatcatcaacttaatcagcaacgacagcatcactatggctcacttactgatgtgggtgatcgataccaacatgcccaaaatcatcctcaacagagatttcttcagcaagattttgattcaaccctggcctttgttaatcacgagaggaaacaaaggactgaggagagtttgttgggcactgattggagaaatatcaaaggacaagtattggcatctggtaatggtactagacagccttctcgaaagcaatttttagagtcaagtcctagtgactccaaaagtactgaggcatcaacaagcatgtctgtcgatgatctcggtgccattgattcggcctctgtaccgtccacctcaagagtagcagatgtgggggaatatgcaagacatccacctgtagcatcttcaacattagtagagttaactactcgtctcgattttttcaaggaacggcggtcacagttgatggaacagctccataaccttgatttgaattatggttctacaacttcccaagactttgtctataaaccgtcatcgccgtcatggagttga

SEQ ID NO: 32691 - DNA, 456 bp, Glycine max
  Peptide Sequence Number=SeqID_149469
atggggattctgtacgcgctggttggtcgtggatcggtggtgctggcggagttcagcggcaccaccaccaacgccagcgcaatcgcgcgtcagatccttgaaaaaatccccggcaacaacgacacgcacgtttcttactctcaggatcgctacatcttccatgttaaacgcaccgatggactcaccgttctctgcatggccgacgacaccgccggaaggcgaattccttttgcgtttcttgaggatattcatcagaagttcgtgcggacttacggacgcgccgttcactccgctcagccttacgggatgaacgaggagttctctagggttttgagtcagcaaatggagtattactccagtgatcctaacgccgataggatcaatcgtctcaaaggtgaaatgtctcagctattcaaacactgcctaagttcaatgaacaagataattgttccttag

SEQ ID NO: 32692 - DNA, 1293 bp, Glycine max
  Peptide Sequence Number=SeqID_149470
atgtctgctcctttagcggcttttgagcgaccgagacctggggcttctaatacgagtgcccttccacagagaggtggtgaagtaaacctgacattggggggtattgacttaaacaattcagggagtgttgttgttagagaagacaaaaagcttcttacggtattatttccagatggacgtgatgggcgagcattcacccttaaggcggagacatcagaagacctgcttgaatggaagacagctcttgaacaagccctcacacaggcaccaagtgctgcccttgttatgggacacaatgggatttttcggagtgatgcaagtgattctatcgaagggtctttccatcaatggagggacaagcgtccaattaagtctctggttgttggaagaccaattctgctagcactagaagatattgatggaggcccatctttccttgaaaaagctcttcggtttctagagaagtatggaactaaagttgaaggaatactgcggcagtctgcagatgtggaggaagtagataggagagttcaagaatatgaacaaggtacaaacagttatcttaaacgtcctagcactttacatgcatttgaagagagtcagttgttggtacttggcaagactgaatttggtcctgaggaggatgcccatgttgtgggtgactgtgttaaggagaatagaatgactccatctgctgttgctgcttgcatggcacccttgctcttacggcctctgctagctggagaatgtgaactggaggatgaatttgatgccagtggtgatagttcggcccagcttcttgctgctgctaatgctgctaataatgctcaagcaattattaccactttgttagaggagtatgagagtatatttgatgaagaaaatatacagagatgttccatgtcagcagattctcgggttgaaaacagtgggagtgaagattcaactgatgatgataatatagatgtgaaagaaaatggttaccatgatgcagagaatgaagttgatcaggagacagatgatgatgctgatcgtgttcagagtggaaaattgagtgagagtagtggttatgctggcagtgatctttatgattacaaggcatttggaggtgatgattctgatgttggatcctccagtagtaaccatgctaagactgaaaatgctaatctgaatgctgttccagataccccagggtctgaggatcaaaacaagcaaagaaaggccagtgaaacccagttgatgaaaatgatgcttcgaatttgttgccttcatctgaatcttatcgatccatgg

SEQ ID NO: 32693 - DNA, 729 bp, Glycine max
  Peptide Sequence Number=SeqID_149471
atggggcatcccctcagtcaactaccaaactaccttaaagatggtgcagcctgcttcctagatgttggtacattaacaagcggaacagcaaacataacaccaggaagcaagggcattaaggagcagaagcaagatcaagaggtgcagaagcaggatcaacaggtacagatagcagagaagcccaaaagaaaggtactggccctcgaagccagcttcaattctgcacctaacatgttgcctcctctcttccaacaggctttatggctggggccatcatcctcattttgggcttactcatttatgcttgtaccccttcaaatggttcctcgggcaaatatcaatagcaatagcagcaatgtcaatgttgagatcagtttgtcagttaaggcttcgtatggcactggggctagtgctgctgctgaaggtgataggccaagggagatattggtgcagcatttgttggtcaaagaagatgaccagaagcttctgttagatattcagcaaagaatctcttcaggtgaagatttgagtgatcttgctgtggaatattcactgtgcccatccaaagaagaaggagggatgcttgggtgggtcagaaagggacaaatggcggttttaccgctttcagatggaaaagacacagttactgtgaactttctttgggaagaggaagcagatgaggttcctgaatttgaggaggctgcatttactgcacctttaaacaaagtg

SEQ ID NO: 32694 - DNA, 243 bp, Glycine max
  Peptide Sequence Number=SeqID_149472
atggtgtttgggatggtaatagacagatatgtaatagtgtactttgcgattttgtatattcgacaccatgcgggcatagttactgatgagatgttagatactccgaaggctccatttatagttgttggtctgttggaggctcttgctgctgccactggaatggccgcaggagtctctacaatgcttatactttcagtgttgacaatgtacagcataaataatgatgctgatgctggagggtaa

SEQ ID NO: 32695 - DNA, 240 bp, Glycine max
  Peptide Sequence Number=SeqID_149473
atgggagaccgggacaccacggcttacacgaccacacccgacaacattcagtcaatagcgcaagacgtgacccagacccttcgttgcgtgatggatagcaacgcctgctctcctgactggcgggtgcaattctacgtgttcccatacgcctacactcggtcgatgctccacaagttcagacggtgtttcttgcatatgaggattatcgatgtgagggaaacgtcacgaattcaagaatga

SEQ ID NO: 32696 - DNA, 201 bp, Glycine max
  Peptide Sequence Number=SeqID_149474
gtacggaatgtcatgatagaaaatattgacaaagttttagatagaggtgatcggttggaattgctggtcgataaaactgctaatatgcaaggaaacacatttcgcttcaggaaacaagctcgtcgcttcagaagcactgtttggtggagaaatgtcaagcttacgtatattcttgatctaaacctcagtcttattagttga

SEQ ID NO: 32697 - DNA, 408 bp, Glycine max
  Peptide Sequence Number=SeqID_149475
atggcatgcggtcattacaagttgccaagtggttgcagtcacagggttttaggaaagtatacaatctttctgggggaatccatgcctatgctgtccaggttgatccatcagttcccacatattgatttacaatgtagtcctttacttgtcctctttctatctttgaacatgagagcaagattttgtgggatgtccatgttacctttaggaattggaattctcttggtacggacatgtatttattttggattaagagtaagaggctacatatcaagtgctagattttttgtgaagctggccttggctgtgaggtggtttatgattttctcagcaatttcaatactatggctctctattcctggctggaatcatagctgggttaagggttccttgattgagtacctttaa

SEQ ID NO: 32698 - DNA, 1396 bp, Glycine max
  Peptide Sequence Number=SeqID_149476
atggaggacgtgaaaagcacttatagcatggggaaagagctagggagagggcagtttggtgtgacacatttgtgcacacacaagagcacagggaagcaatatgcatgcaagaccatagcgaagagaaaattggttaacaaggaggatatagaggatgttaagagggaggtgcaaatcatgcatcatctctcagggcaagctaacattgtggaacttgttaatgtgtatgaggacaagcaatctgttcatttggtgatggagttgtgtgcaggcggcgaactctttgatcgcatcattgcaaagggacattacactgaacgtgctgcggcttcattgttgagaaccattgtgcagattgttcacacttgccattccatgggagtcattcatagagatcttaagcctgagaatttccttctcttgaacaaggatgagaatgcacccctcaaggccactgatttcggtctctccgttttttacaagcaaggagagatgtttaaggacattgttggcagtgcatattacattgcacccgaggtcttaaaaagaaaatacggaccggaagttgacatttggagtattggtgtcatgttatacattcttctatgcggtgttcctcccttttgggcagaatccgaaaatgggatattcaatgcaatcctacgaggccatgttgactttacaagcgatccatggccatccatttcacctgcagcaaaagatcttgtaaggaaaatgttgcattcggatcccaggcagaggatgacggcctacgaagttctgaatcatccatggatcaaggaggatggagaagcaccagatacacctcttgacaacgcagtactgaataggctcaaacagttcagagcaatgaacgaattcaagaaagttgctctaagggaagaaatcatgggattgaagcagatgttcagggggatggatactgacaacagtggaaccattacaattgaagagctcaagcaagggcttgcaaaacaagggactaaactaacggaacaagaagttaagcaattaatggaagctgcagatgctgatggcaatggaaccatagattacgatgaattcattacagcaacaatgcacatgaaccgaatgaacaaagaagatcatctttatactgctttccaatactttgataaagataacagcgggtacattaccattgaagaactagagcaggcactcgttgagtttaacatgcatgatggcagggacatgaaggaaatcatttcagaagttgactcagataatgatggccggattaactatgatgagtttgctgcaatgatgaacaaaggaacactagaagttggtaccaagaagaggcgtgattcaaccatgatgatgagtgaaatatcaaggagtgtccagcatg

SEQ ID NO: 32699 - DNA, 1881 bp, Glycine max
  Peptide Sequence Number=SeqID_149477
atggagccggcattgttattagggttggaagaagaggcgaaggtggtggttacagaatcatcatcattatcatcgtcatcaagcgcacatagattagtcccttggttgaattgggatgagtggctcttcgttaaacacgctctcttctccgattcccctcactctgtttcctctgctctcaaacgaatatctgcttggcgaagtcgaggttccttgccagttctcatcgaagtcactgcttccatcatcgaaattcaactcaaagacccctttttcagggagagctttgctgcccatagtggtcctacccggttcaaacaggattgcctccagtgggagaggatacctgtggatgaatcaaatgacgcttctctttcggaggagatgcttgctatgctgtattgcatggctatcatgaggcttgtgaatggtgttgttgagaagacacgcaagaaagaagtgacgtcaatagcagtggcagccgatgcgattggtattccgcgcatgctgattgatattcgccacggtgaacaaagtgccctgctttttgtcttacttattgctgtaattgcagagggatcacatcgtgagcttccgtcacttaagattgttcgtagtgcttctgttaaggcacttgattggttaaaatcttattattgggaacctcagagcaaagccattccttttcatggtgaaggaatagcaaatgtcaagaaagaaattaagtctaagattcgtgaactagctatctgcttgaaagtcaatgggagtgcccagtctagttcttcactactaaaagcaaaacagattgtttctgtgttattggagtatttgttgaaagctttaagttcctcagagttggaagagaatgcagatggtgcttcgattggtctaaccactcaaaatgttttggccgattggaagcttatcatactcaagttgtgcaataaggaaccagaattacttctgaaccttcttaaggaaatccttgatatgattgagactcaggaagatatgaagtataaagaagataacccaaatatgggggtttcacactcgaggacagagtttcggctttcttctttgtttgcatggcttgttggaattctcagtaaagatccttctgcaacagcaattatgccaaaaagagttttgcatgaacttcttcgtagatgtctccttgtatcacaactttgcaacaagcagctcctggattcagcacttcagcttgcagagctgatgaatgacagctacttgatggagaaagttcaaaagttctctcttattagtttgtccaatttagagagtgcagatgatgaaagccctttattgacttcaaagaacattttccaatttgaggaatccatgcttgaagccgctaaaaagctagagttagttaaacaacagataatgaaaaataaaaaactaatggcaatggattgtgacactaaaaaatcacagacttggactttggcaaaatcatggaacccgtgtccaattggcatgttgccccgtgctgttgggtcatctggttgtcttcctgttcttaacattgttgatggtgaaaaacagaatcaagtatcgccttgttgtcttcctgttgttgacattatcgatgatgaaaaacagaatcgagtatcagaaaaggaagagaattggaaattgaccccacatggtgccaagagagatgccactttagaccttcttcaacttgataattcaactgtcaagaagatgagggagaccaaagaatttggtgaattaaacaatgaattgccattgcaaggggagaaaggatgtctcgtggtaggtggagtttggaagaaacttacagaagaagagctactagtcattgagtcttctgtaaggattttagtttaa

SEQ ID NO: 32700 - DNA, 822 bp, Glycine max
  Peptide Sequence Number=SeqID_149478
atggctttcacactagacaggtgtgaagatagcatggtgttcactatggagtctcacaagtcagtgcctgctccctttctgacaaagacataccaacttgttgatgaccctcacactgaccacattgtgtcttggggtgatgatgaaactacatttgttgtgaggaggcccccagagtttgctagagatcttcttcccaactatttcaagcacaataacttctcaagctttgttaggcagctaaatacctatggattcaagaaggtagctgctgataggtgggagtttgcaaatgaatacttcagaaaaggagcaaagcaccttctatgtgaaatccacaggaggaaaacccctcaccactatcaacaacactaccacatgcatgaccaaccaccacagcttcttcagccagatgaaaacatgtgttggattgatgctcctccattaccatctcctaagccaggcactgacatcttagcagcactttctgaggacaaccaaagactgaggagaaagaacttcatgctcttatcagaactcactcacatgaagaacctatacaatgacatcatatacttcatccaaaaccatgtaagtcctgctgcttcctatgatgaacaaagaagcagaagtgctattctgaagatggtggaattggattcatcaccaaatgttataagaccaactaagagccgtattatggagaagtctttggtgactaattctagtgatgagcctaataatagttctgtgaagctctttggtgttcctctttgtggcaaaaagagattgcacccaggtaaccttgttcaacaagaatag

SEQ ID NO: 32701 - DNA, 1002 bp, Glycine max
  Peptide Sequence Number=SeqID_149479
atggtggacatgatggatatctccttctccaacgagttctgctacatgagtactgcatgtagtttcagccaagatatgtgcttctacagtgcaccaactagtcctagcaggctcaaagtaagaacatcctttggttctcaaactggccccacaacaccaagagcaacaacacatgaggatgatgcaaactccaatgtgaatgagtttgaatttgaaaccagtcgcaggttcaatgttagtgtcggtgacttggacaccgagacaaaccaaaaggatgagagcccttttggggattcattgcagactatggcatttgctgatgagctattctgtgatggtaaggtgttgccactaatgccacctctcaaacttcctccaaggatgcatcagaatggggatggtagcattatgagcactcacagctcaacactgacgtctccaaggtcccccggatcggtgcttagggttcggttttcacggcaatgtttgtggaatgatgactttgatcccttcatggcggctttggagaaggtaagagaagaaaagagagggaaaccaagtgcaagacatggtctcaggaggactaggtcactttctccattcaggagcttcaacaacaagtgtgaaagaaatgtgggaatatcgaagtcaagtcaacttgagtcacattgttgtgacacagctcagctagtatgtgaacttaagaaagagccattaaagcacgtgtcaggaagaataaatgtgctatccgagcccaaagggttggtgtttgctagacaggtgagactagtgggagtgagcaatgacactacaaccttggagaggacctcagtttccaaagtttctaaggaaacaaagaaagatgaaaggaaaagaggtggtttttggagaaggaatacgaagagagaaaatataaagaagtttctctttgggattagtaacatgtggaaagccaatgctcatcacaagttagaagataaaatggcagcacaggagaaataa

SEQ ID NO: 32702 - DNA, 1212 bp, Glycine max
  Peptide Sequence Number=SeqID_149480
gatgtggaggagcttatcagtttagctcctgataagctcttgttgaaatggatgaatttccacttgaagaaagctggatatgagaaacaagttacaaacttctcttctgacctaaaggatggagaggcttatgcttacttgcttaatgctcttgccccagaagtggcaggcccatctgccctaaacacaagtgatccaacagaaagggcaaacatggttcttgagcaggcagagagattagattgcaagagatacctcactccaaaggacatagtggaggggtcacctaatctcaatcttgcatttgttgctcaaattttccagcataggaatggccttacaacagttgacagccagaaaatgtcctttgctgagatgatgactgatgatgcagagacatctcgggaagaacgatgctttagactatggattaacagtcttggaatttccacttatgtcaataatgtttttgaggatgtcagaaatggatgggttctattagaagttcttgacaaggtttcagctggatctgtcaattggaagctggccacaaagcctcctataaagatgccgtttcggaaagttgagaactgcaaccaagtcataaagattgggaaggaactaaacttttcattagtgaatgttgctgcattcctgtggcagctgatgaggtttactatgcttcaacttctgagaaatttgagatcacactcacaaggtaaagagattactgatgctgatattctaaactgggcaaacaataaggtgaaaagagcaggaagaacttctcaaatggatagtttcaaggataagaatctttccagtggcattttcttccttgagcttttgagtgcagtggagccaagggttgtcaactggagtcttgttactaaaggagagactggtgaagataagaagttgaatgcaacatatataatcagtgtcgcccgaaaacttgggtgttccattttcctgttacctgaggacataatagaggtcaaccagaagatgattctcattttagctgctagtataatgtattggagcctcaagaaacctgaagaaaacatcacccctgaagcatcgcctaaagcttcagtagatggtgaaagcgaaacagatttagttgatgaggtatcccatttagccattgacgaggtatccaatttagccattgatgagacaacttcggagaatgctagctcttcttaa

SEQ ID NO: 32703 - DNA, 720 bp, Glycine max
  Peptide Sequence Number=SeqID_149481
atgtgtactttatgggatctacccagaaccttccctggtcacccatggctggacactcctgagggacatgctgctctcaggcgtgttcttgttgcctattctttccgtgattctgatgttgggtattgtcagggattaaattatgttgcagcattgttgttgcttgtcatgaagacagaagaagatgcattttggatgcttgctgtcttgttggaaaacgtcctggttaacgactgttacacaaacaacttgtcgggatgccatgtggaacaaagagtgtttaaagatttactttctaaaaaatgtccaaggattgcgactcatttggaagctttggaatttgatgtctcccttgttaccacggagtggttcctttgcctcttttcgaaaagcctgccttccgagacagctcttcgcgtatgggatgttatcttctatgagggtgctaaggttatatttaacgtggccttggcaatctttaagatgaaggaaaatgaattagttctaacccatcatgttggcgaagtaatcaatattctgcagatgaccacccatcacctatttgatccagacgatctattgacagtggcatttgacaagataggttccatgacaacaaataccatatcaaagcaaagaaagaagcaagaacctgaagtgatgaaggagcttgatcagaggatcagaaggctaaattcccttagaatggaggacaaatag

SEQ ID NO: 32704 - DNA, 189 bp, Glycine max
  Peptide Sequence Number=SeqID_149482
atgccactaagatccaaatatgtactgtccagatcgagattgaagcttgcgttttggattttccttcgagatcttaatcgatattgttttcgtggttctttgaagaggtggaggtattgttgtcgggacaatggagttgtcagttgcggtgttgtcgttgactacggtttggagtcaccatggcattga

SEQ ID NO: 32705 - DNA, 246 bp, Glycine max
  Peptide Sequence Number=SeqID_149483
atgaggctgatgagtctggcttgtttctcaattctactgttgattctgttcttgttcaaaatctcatcatcttctgctgctgatgggtatgcgaaatctcaaagctttagaactgagcctgtgtcaaatcttggcccatttaaaggaaaatcacgacagaacacgggtgaaggtggtggtgaagcatttcttggtgatgagaaaaggataatctacactggtcctaatcctttgcataacagataa

SEQ ID NO: 32706 - DNA, 1302 bp, Glycine max
  Peptide Sequence Number=SeqID_149484
atgtcaagtttggaggaaccacttggtcttgacaagttgccaagcatgaacaccattgataggattcagaggttctcatctggttcttgccgtcccagagtcgataacttgggcatgggaaactgctggattgaaggacgaagttgcagcacatctaacagctgcaatgaagatgatgaagagtatacagcagagacattcccatggaaaagacaaacaagggacttatccccagatgactccttcagtcaaaaaactctgatcaaaggaaggaagtcaatgaaatttggaatgattgatgattcattctctgattgccaaaccagtccaaaatgccataccaaagatttgcaaggtttggcttataagtatctgaatagtataccaaagtttgtaaagatagtagaagttggtccaagggatggattacaaaatgagaagaacattgtacctactgctgtaaagattgaattgattcacagactagcttctactgggctatctgttattgaggctacaagttttgtttctcccaaatgggtcccacagctggctgatgcaaaggatgtaatgcaagcagtgcataacttgagaggcatcagattaccagttctgacccctaatttaaagggttttgaagctgcaatagctgctggtgctagagaagttgctatttttgcatcagcttctgaatcattttcaaaatcaaacattaactgtagcatcgaagagagccttattcgtttccaagctgttactcatgctgctaaacaactctcaattcctgttcgagggtatgtatcatgtgttgctggatgcccagtggaaggaccaatccctccctcaaaagtagcatatgttgccaaagaattatatgatatgggttgctttgaaatctcccttggtgacacaattggagttggcacaccaggaactgtagttcctatgcttttggctgtgatggctgttgttccaatagataagatagctgtccactttcatgacacatatggacaatcccttccaaatatacttgtgtccctccaaatggggattagcacagtggattcctctgttgctggtcttggtgggtgtccatatgctaagggagcttcaggaaatgttgctactgaagatgttgtgtacatgttgaacggccttggcatcaaaaccgatgttgatcttggaaaattaatattggctggggaattcatcagcaaccatttggggaggccatccacttcaaagactgccattgccttgaaccgtgtcacaagtaatgcttccaagatttcacattaa

SEQ ID NO: 32707 - DNA, 321 bp, Glycine max
  Peptide Sequence Number=SeqID_149485
atgaaatgttgtagtcggtttcacctaggaattaagtcagaggctttggtgggaggtgggaggtgggagcagacattcatctctatggagcggtcatgggacaaggttgtattcaattcatggatactacctgggtcccttctcatggcagaagcaacatcatccagacaaattgcatctgggtcagcacagaatgaggtgctaaaggaatggcaagatgcatgggacgaaagggataaggattttgagaagcaaggaattaatcaacaagattcattttggagcaagctaaagtcagaggctgctaggaaggtattctga

SEQ ID NO: 32708 - DNA, 327 bp, Glycine max
  Peptide Sequence Number=SeqID_149486
atggggttgaagaatgattggagtatggtatatttacgtttcaagaaccgcatcaaatcgttgtcatggccgccagattggaacaacagcaacaacagcccatcaatggttaagcagaagaacatgggtgatgaaggaagaaacagaagggtgtttcaggatattgggaatctcgtgggtttacaaggccatggaaatggaattaacctgtctaagcctgtcacaaggaactttcgtgctcaattattggccaatgcacaagagaagaacaaggttgttatggggagtgtcattgtttggcagttaccatggacagcctcgagctga

SEQ ID NO: 32709 - DNA, 255 bp, Glycine max
  Peptide Sequence Number=SeqID_149487
atggaggctggcttactttctttagatgtttcattctctgtcaccaaaaatactacattgcataagcacaataaaaattgcccagcttcagaatgtgttctggaagtcatgaaccttgccatggacgtcccttcagttggcaccatcaatgaaggattcaagaacgagctgcttcatcagtacgagatagagaagaacaaaggtgcaaagtcaatattaagaaagtgtgccaacattcttcaagactggaaataa

SEQ ID NO: 32710 - DNA, 1650 bp, Glycine max
  Peptide Sequence Number=SeqID_149488
atgcgagagaaaaatccaacggtcaagattgaatatagaatcgaccgttggaggccagagaaccaaagaaagagagagagagagaaggaaaaggttgctaccaacaaacagagtgcggtggcgacaaccgacgtaagcggcggaggagagacgcggaacggtggtcttcagggttttctgtcgtcgctgttctccactctcggcggtgtttttgggtcaacgtttcaagaaccgcatcaaaccgttgtcatggccgccagattggaacaacagcaacaacaacaacaacccatcaatgttggtgaggttaagcagaagaacatgggtggtgaaggcagaaacaacagaagggtgcttcaggatattgggaatctcgtgggtaaacaaggccatggaaatggaattaacttgtctaagcctgtcacaaggaactttcgtgctcaattattggccaatgcacaagagaagaacaagaaatcaagcactgaagcgaacaatggagcagtggtagcaactgatggggatggtgttgggaattttgttcctgctagaaaggtagaagcagctaagaagacaaaagaagaacctgaagtgattgtcattagctctgatgatgaatcagaagaaaagccagctgcgaagggaaaaaaggaaagggaaaaatctgctaggaagaatgccaaagccttcagttcagtcctctctgctagaagcaaggttgttcctttttttcttcattttttggaatgtggtttgggacttggggttgaggctgcttgtggacttccaagggatttgttggtgagcattgatgcaactgacatggacaatgaattggcggcagccgagtacatcgatgatatctacaaattttacaaagagactgaaatgtatttgattttgatgaaacaggaagagggttgtgtgcatgactacatgggttcgcagccagatattaatgccaagatgagatcaatccttgtggactggttgatagaagtgcataggaagtttgagctcatgccagaaactctatatttgaccttgaacattgtcgatcgattcctatctgtgaaggctgtgcctaggagggagcttcagctggttggcatcagctcaatgctgatagcctcgaaatatgaagagatatgggcaccggaggttaatgactttgagtgcatatcagacaatgcttatgttagtcaacaagtgttgatgatggagaaaacaatccttaggaagcttgaatggtacttaacagttccaacaccctatcacttcttggttaggtatatcaaagcttccactccatcggacaaagagatggagaacatggtgttttttcttgctgaacttggattgatgcattatcctactgcaatcctgtatcgcccttctctgatcgctgctgctgccgtgtttgcggctcgatgtacccttggaaggagccctttctggacaagcactttgaagcactacacaggctactctgaggagcaactgagggattgcgccaaaatcatggtcaaccttcatgctgccgctccaggaagtaagcttagggcagtttacaagaaattctgtaactcggatctttctgctgttgctcttctttctccagcaaaggagaactgtcttgaacaagcttag

SEQ ID NO: 32711 - DNA, 702 bp, Glycine max
  Peptide Sequence Number=SeqID_149489
atggggttcgatgaaaacaaagaaactggagagaaaagtggggcaacggatcatgcaaatgaagaacattataaaagtgatggcgagcccttgagaaggcacgtgagtgatgagtcctctatccatgcaactgaagatgatcatgaggaggatgaagttggatccaaattacaattgggtcctcagtgcactctgaaagagcaccttgagaaagataaggacgatgagagtttaaggagatggaaggagcaactccttggaagtgtggatgtgaacaatgttgcagaaattctggaccctgaagtgactattacttgtttgactatcatctctcctgatagagatgacattgttcttcccattcctgaaaatgggactccaaagggtttatggtttactcttaaagaaggtagtcattaccgcttgaaattcaccttccatgtgagcaataatattgtgtctggcttgaaatacaccaatactgtttggaagacagcggtcaaagtggatagctcaaaagagatgcttggaactttcagccctcaggcagagccttacacacatgagatgccagaagaaaccacaccctctgggctatttgcaagaggatcatattctgcaagatcaaagtttcttgatgatgacaacaaatgctacttggagatcaactatacttttgatattaggaaggaatgggcttga

SEQ ID NO: 32712 - DNA, 636 bp, Glycine max
  Peptide Sequence Number=SeqID_149490
atggaggtcatcaaacatagaaagccaaggaaaataactcaatattggatccgctatacatgtggtgcagttggtttgtcagtatgctccatttggctcttgcggcatagtagattggtggggagttctgatcttgataattgggttcaggaagctaggaactcaacatatagcttttttaggaatcacgtagaggaaccgattttttccattagggatgaactttttgacacatttaagaagaggcatcaaggtattatggacgttgaagaggtgcagttaacttccaactcactacacagttgtgttgactctcttccatggcttgaattgaagctgattctaatgttgttggctttcagtgagcagacaaagggtcagaagttcccagtgaatgcttcggatcaggaaatgatggagatagtcatggatagggacttgggtattatggggtgcctatgtcccacatcgagtagtttggatgcttggtggagaagtggtttggttcccaccccccgctttaagagggttctcctagtgcttgggtgcttatcagttggtatcaaagctggctgtcgatgtcttgagaagggctacctatggggatttcggctctcaagggcagtgctaagttag

SEQ ID NO: 32713 - DNA, 597 bp, Glycine max
  Peptide Sequence Number=SeqID_149491
atggcggttccaccatcggaaactgaatccgttgagaacagaacattcctttcacaattttactctcactatctcggaaaccgaatccacgctctctatccctacttctccacaaatttcttgtccaccttcgttctccgcttcagatcaacgcagcgtcgggaatgtctccctcttccgctaccttcctcttcactcgacgctcccttgttcatgaccaagagatctagagtgcatgatgttttggaggatatattagagcgtgttttgataaatttgcatagcgtccaaaagaatctgcagttttggcagtccagagctaagaggtcagattccgagaaggcacgtttcatgatatttgagaggggtccaagagcttttattgatgaaacagttaaattgttgcgtggactcactgctcagggttcgtccacacagaatctgagccaatctgcatctgattatatcgacgagagagtaggctttttgagtagcttaagatattcgctcgccacatttttggctcagggaattcctctaatgggccttctgagggattatgaggataggtttaacaggatagttcagtcagcatag

SEQ ID NO: 32714 - DNA, 189 bp, Glycine max
  Peptide Sequence Number=SeqID_149492
atgttccagctgcaacaactcacatatgaaggaaatttcaaggaagaagtgaaacataaattcgaaagtgtatgtaaggcagcatggtgcagccaccaacccaacctggctaagccagagacttgtcccaatacctcggtgtccccacttgggtcacaagctgatgttactcaactcgacatgctctag

SEQ ID NO: 32715 - DNA, 810 bp, Glycine max
  Peptide Sequence Number=SeqID_149493
atggctaggattaagaaaattatgcaagctgacgaggatgtagggaagattgcaatggccgtgcctcttctagtttctaaagcactagagctatttctgcaagatttgtgtgatcgaacatatgatataactttgaggagaggggcaaagactatgaatgcttttcatttaaaacagtgtgtgcagacttttaatgtctttgattttctgaaagatattgtcagcaaggttcctgatttaggtggttctgttgcaactggtgatgaccatgctgtcactaagaggaggaaagttgctggagatgatgataatgacagcgatgaggagctcaagagaaataagaagccagagcctggacatagcagtggcagaggaaggggtagaggcagaggtaggggtcttggcggtggaattagaactgtagatcaagagatgagttcacatgccaagtgtgaagatgattctgatgtcttgaagcagaatgacaaccacactcagagtaatgaaagcatggaaaatgtgctggaacctgaagaagttaagcagagttttccagtaagcgaactggccgaagtgtctgttcgaaattttgacttaaatttggacccagatgagaatatggattctttagacacaccaacttctgtcccaactagttcatctgcaaaatcagtgtcagaagagaagcatgaggaataccctggatggtccttgtctgagatggaaaaaatgatcattgatcccattcaactagctaacttaaatggaaggattgatgaagatgaagaggattatgatgaagaaatgtag

SEQ ID NO: 32716 - DNA, 603 bp, Glycine max
  Peptide Sequence Number=SeqID_149494
atggaggattgtacggtgtggttttctttagtgaaatcaggaaaccttgacgctttaaaacgccttattggaaataatagtgaagtgctcatgaccataaaggacagcgatggaatgagcctactgcataaggctgctttatgtcgccaacgtagcattgtttcctatatacaaggtttcacatccagagaagataaccttgtactgggaggggtcgacaataaaggtaacaacgttctacacttagctgctgcgaagcagcaatcttcgtcacatctattaagaaacgcaaaggtggaaatgcaaaatgatctcgcatggtttaaggaaatcgagaagaaatttcatgaattcagctacaacacaatggtgaacgacaaaggcaagacaccagaggaggtattttatgatcaacacgaggatttatctgacaagattaaagatgattccaaagaaatagccaactcgggcatgattgtggcaatacttgtggccacggtagcatttgccgctgctctcaccgttccaggtttttcgacgacagcttgtggtctagatattatcgtctgtccaaatttgaaaaatttgatgtttccgctttaa

SEQ ID NO: 32717 - DNA, 141 bp, Glycine max
  Peptide Sequence Number=SeqID_149495
atggctttcgcactaaagcaggaagtggtgtcggtagccactgctagcaacaggaaaaaaaatggagctttgaggaggagaagaacaaccagatacagaacaaaaccgagaccaaggcagatctcagatctcaaatcatga

SEQ ID NO: 32718 - DNA, 536 bp, Glycine max
  Peptide Sequence Number=SeqID_149496
atgaaatagacaaaggagctcaaattatttattttgctgaactgatacagcccattgaggaaaggataaataatgtcaaaactttcataaagggacagattatagacatcttgtacatctgtttaacagcaacatgtctttttacaagtagcatagtgtacataggagaggttgtatggttttgtttgttggttttatgtggtggagatacaaattacaattctgtcaagccggagttggaagtgcaagctgtaccaatcacagatccgtttggcccttccattacagatgaaaacttggaggctgtgattgtaagcaaagagacattaccgggaggattggctataaacagaagaagagctgaaagaggcctttcacagttgaagatattagaaattattctcgtggatcttatgcagattgaagttgtagatttggtctctggagaatcaggtgaaattaagctgagttcatcaatgctacggaagattgaggctgaaaaggctaaacaacaaaacacgatatcggaaacttag

SEQ ID NO: 32719 - DNA, 1953 bp, Glycine max
  Peptide Sequence Number=SeqID_149497
atgtctcctgcatcccgatccaagtctaaagacagaaaggctaacaaggatgctcagaaggcttctgcaaagcctacaggatctagtaatgctgtagctggtgttccagccagtgcatataaccccttattaggaacattccatactctggacatgtcaccagctcctacctcaccaatacattctaatggtcgttttcggaacatagatgagacagatgaacatcctgtcaactcattggttgctggtgttgagtatgattctgtttctaacaatggtagttggtctggtgagtccgaagaacataaagacaaaagctctaatgttcctgttcgaccggaatcagtaccgggagctgataatgacaagcgggagaaaatccgccagaagaatgagagaaaacatcaacggcagaaggaaaggcgagcacaggaattgcatgagcggtgcactggttaccttatgtctaggaaacttgaggttctttctcaacagcttgtggcaatgggattttctcatgaaagggcaacaatggcactgatattaaatgaaggtagggtggaggaatcagtagcgtggctgtttgaaggtggtgaagatgcagatggtaacaaggatacaaacataggtaggggcaatttgaaaattgacatatcagatgagcttgcccggattgctgatatggtaaccaggtacgattgctcgaaacaggaggttgaaagagtgattgttagctatgagggtgatcttgatagggctgcagagaccttgagagagttgaaacttgatccaccatctgctccaccaaaaccagaggaaaccggtgatcctcctattattaacaatgttaagcagtcaggagttgcaagtcagagctcaaggccacaaacaaaacccattcctttaccaaatcaacccaaaaaagatgacaaggattttaactatacaaaggctgcattgactattggagtatcttcagattctagtaataaaaatatgcaacctctaaagagaatccaatctgaatggacaaagccccaacaggctactgtaccagctgataaaaggtggccaagtgcaggatctaatccttccgtttcttattcactggcatcaccattgcaaatgtcacccccacctgctaagtccgaaacacaatatatgccagctggaggtgattttaagaaccttcagtctggagttgccagggaacaattaatcatgatgcagcggccccaaactgtaaatgcaaagcaagttccagccacaagcatgagttcatcacctcctggaatagctgctagttggtatccaactaacagttctgatgctgtcagatctaataatggctttatatctcatgctcctagcactagaagcctcagtccaaactatctcaattctaatcaaatgtaccaccaacttcagtatcaacctcaacaatatcagtttgttggtggcagcagcagcaattcagtagatcaccaagggaatagcatatggaatagaacaggtgcaactccaccgcttgctgctgctacttctctaggactcttttctggtctaggatcagcaggcccatcaggggcttcttctccagtagactggagcactggtgggacaatgcagttcgattataccaacatagactggtccttggatagaagtttagcttcaccaaggtcaaacggtttatggctaggattttcaccgtttttaaggagtaatagtgctccgatgtatgatgcaaatacttcaggagttgtagctcaatcatcaatgagaccagtgccctcaaatgggagcatgaatgctcccatgcctggattgcaagatggtggagtagcttctgctgagacatctactgctggttcccgggagtggagttctccatttgaagggaaagatctttttagtttaccaagacagtttgtttcttctccttctctgtaa

SEQ ID NO: 32720 - DNA, 780 bp, Glycine max
  Peptide Sequence Number=SeqID_149498
atggaagaggcaatggcagatcaaactggggacaaaattcaaataattcttggaatcagaacaatagaccacaatgtcaaatttgtggatcctactcactatcgaagcattgtcagagctcttcaatacatcattataacaaggcctgaaatttcattctccattaataaggtctgtcaatttatgcatagaccacaagagcatcattggagtgcagtgaaacggattttaagatatctccaaggttcaattacatatggcttgcatatcaaaccttcgcaacaactgcttatcatgggtttttgtgacttagattggggttcagaccctgatgatagaaagtctaccatatgttactgtgtgtatcttgtaccaaatcttgtatcatggtcttctaggaagcaagtcgttgtttctcgaagtagcactggggctgagtatagaggacttgctgctgttgctgcagatattttatggctgcagaatttgctcagagagttgtgtgttccagttgcattgccaagaatttattgtgataatttaggtgttgtccaccttgctgcgaatcctatcatgcattctcgcacaaagcattttgagttggatttgcattttgttcgcgataaagtcttgtcgcgcgagcttgttgttgttcatctgcctgctgaatttcaggttgttgatattctcactaaagtttattcaaatcctcaatttacaatatttagatccaaactcaaggtttcatccacttccaccatgagtttgaagggggtgtaa

SEQ ID NO: 32721 - DNA, 1002 bp, Glycine max
  Peptide Sequence Number=SeqID_149499
atggaagggcaaagtgtagttgttatccatgatgcttctagagaaataaatgttaaaatctttgaatggtctctacatggcttgttacttgtgccaggagatatgctcacactaattgcagtcatgcaccaggttattactcctatgggttacaaaagcagtgtggacagcaggttaatgtttggagctaaccagaagatgattgaggcacaagctgcaaggaagaaggaagagtatcttaacaatccggagcttgctcagatttctgaactatacaaatcagaaaaggttggatttaagatagaaacaattacagggtcatcactaaagacagttgcattgaaatcagccatgaagctaaaggcaaactggctcatactggacaggaaaatgaagaatgatgaggagtatttcctccggaagctttcttgtggtatcttaagagtaaggcgtttcaataaaattctacgtttaagagaaccactacacctcccccaagaaacacaacccggtagcacccatgaaacatacactgacagtataccactaccagacacttcaactgaacatgatctttacgtcttcagcgctgagacttcccctaatacatctaaaaaaatgataggtcaaggaggagataatcagatgaaccaggaacaaggacataccctaaagagcctccatgatgaggaagggttcttaactcctgatcaactgaacatggaagaaaaagacaatagtattaagcatatggaaagtcaaacacaaagaagccaacactggcaagatgaacaaaaagaaaacagaaacaatgggaatgagagggacccaaaaccgaaacagaagttagaagaaaaaaattgtgacataacttgtagtggaagcaaaagagaaacagaacagaaaatcttctgcaccaaggtgtatcagaaaggtggtgaaagatgctcatcttttggtggagctagaaacttttatcttggaggggcggaagaatataca

SEQ ID NO: 32722 - DNA, 309 bp, Glycine max
  Peptide Sequence Number=SeqID_149500
atggctgtcaccttctcagatctacacaccgaagagggcatcaaatccctcgatcaattcctttctgggaaaacctatatttctggggatcagttgacaaaggatgatattaaagtgtatgcagctgttgttgaaaagccaggggacacttttcctaatgctgccaagtggtacgatgctgtctcttctcaacttgctccaagctttcctggccacgctcaaggggtaagattcagtggcgctgctgctccagctgaagctgcacctgccaaagcggaaactaatagcaaaagccttatcttatcttaa

SEQ ID NO: 32723 - DNA, 777 bp, Glycine max
  Peptide Sequence Number=SeqID_149501
atgcaagtaaatgaagaacacaacaaaccttgctcagacccatttttacagtggagtcagtggcagttgcttgattctcttttacctacgggtggatttgctcattcttttggccttgaagcagcagttcagtgccacttagtgtctgattccaatgaccttaagacatttgttatccatatattggagaatacaggaagcttactccttccttttgtgtactcagcttccatgttgcccaatttagaaacttggcataagcttgacaaaatattggatgctaccctaactaatgaagtgggtcgaaaggcatcaatctcgcaaggatctgcattaatgagggtggcctcagctgtgttttctgaggtcccctccctcaaaaccatgagagatacttctctgggtttagggactgtatcttttcatcatgctcctgtatttggacttatatgtggagcactaggatttgataaaactagttctcagagagcttacatgttcatcacaatgagagacgtgatttctgctgctacaaggctaaatttgataggaccccttggtgcagcattgttgcagcatcaggttgcccctaatgctgaagttatattagaaaaatggatgaatcgagctgttgacgaagcatgccaaactatgcctctgttagatactgtgcagggctgccatgagactgactcggagactagtatagtctttgaaggaacagggacacatggtaatgatttgctgaaattttattgtgcagtcatcccaatttag

SEQ ID NO: 32724 - DNA, 1917 bp, Glycine max
  Peptide Sequence Number=SeqID_149502
atgcgcttcgtcggcctagacctcgattcctttgcctaccacgtcctgttggacgccctcgtcgagaaaaactatctcaatgcgtttgacatcatcgtgaggcaaattcgctccaggggctacgagaatcacatgaccaatgtcattgttgttaagcatttgtgcaaggagagaaggttggaggaggctgagggttttctcaatggtttgatgtgtcgtggagaggagttaaaagggcctgaagtgagttttttggttggtgcattgtgtgagagttataggtttgagcgtgcctttgagttggttaagcaatttggaagctctgggttggttccgttggatcatgcttatggggtttggataaagggtcttgtccggggtgggagggtggatgaggcattggagcttttgcgggagaatcggcttcgcgaggtttatgatttgttggtggatatgagtgagagctgcattcctcctgatgcggttaccatgaatgctgtcttgtgcttcttttgcaaagtggggatggcggatgtcgcgttggagttgtacaactccaggtctgacttagagttgtctcccaatcacttggcttgcaagtatttgatacttactttgtgctgggatgggggcgctaaggaggcgttcaatgtgctcagaagcaccgttgaccggagttattttcctgatgggcagacgttttgcacccttgcgagtgctttgtgcagggagcgcaagattgatgagatgaaggagttgttgtatcttgccgtggggcggaatattgtgcctcctacgtcgatgtatgacaagtacatatcggctctgtgccgggctgggagagtggaagatggttatttggtacatggggaacttaagagtgttgctgccaagacgtcgtatgttaagatgattaagggttttgttaagtctggtaggggagatactgctgctcggcttcttgttgaaatgaatgggaagggtcatacgccgattcctcggttgtgtagatatgttatttgcagcttgcttgaaatggacaattcaagagggcgctttttcaatttactggagatgctgacccgttgtcaacattcttgtcagacttacaactttttccttgatggagctggacatgctatgaagcctgagttggctagggaagtatttgagttgatgcaaaggaatggcattacgcccaatatgtgttctcttattcttatgatgaatggttatttgatcagtgggagaatttctgatgctctgaatttttttaatgatgtacagcgccggggtttggcaactaagaagttatatgttgccttgattactggtctctgcaagtccaataaggtagacatttcacgtgagtactttttcagaatgttaagagttggattgaatccaagccttgaatgctatgagcttcttgtgcaaaagctttgctcattgcaaagatatagtgaagcaatgcatatcattaatgtatctcagaaaatgggacgtccagtaagttcttttattggcaatgtacttctttatcattctttgatttcaccgcaactctacgatacatgcgttaatttaagaggagtggaagagggggtattttctggtaattcaacactttgcttgatgattggtgcattttctggtcgtctcagagtgagccattatattacggacctggaaagattaatcgagaagtgctttccacctaatattttcacctacaatctgttgctaaaacaagtagccaggagtgatatggacaaagctcgtttgttgtttgctcggatgtgtcaaaggggttatcaacctaatagttggacatatgatatcatggtacgtggtttctcaattcatgggaggaatgatgaggctaggcggtggcttaaagaaatgtttcgaaactga

SEQ ID NO: 32725 - DNA, 417 bp, Glycine max
  Peptide Sequence Number=SeqID_149503
atgggttttgggacactgagtttatccgtggtggtccgatttgaggccactaatttcaatggtttgcccccatctcggtcgtccaattcgttgcctcatctctcgttcacaaagccatcttgggttgtgagaacggagtctaatgttcggaagaaaagaagaaagaagccagatccgcattgcgtggtatgtgaggggagtggaagagttgattgtcaccagtgtcatggaaaggggaggacaaaccaggttcatttggaaatgctcccgaaaggtgaatggccaaaatggtgtaggacttgtggtggaagcggtcttagttactgctcccgctgccttgggactggagagtatagggatgatggtatttggttcaaggtattagagaatgtcttggtacagcagctttacttgtaa

SEQ ID NO: 32726 - DNA, 354 bp, Glycine max
  Peptide Sequence Number=SeqID_149504
gtagctaaagtaaaccaaagaaagttgaagatgtggcgtgttctagctgcagtgacaagaaaccttcagagcacaagaaagagttccaaggtggcagatgagagcatgtttgaatcaggaaacggtgtagagctatttggacatgagaggggaagaagatcacaacatggttgggggcttgtgtgtagcattcttcaagcccccatatcaatactctcatgtgtttctcaccctcaggttaataataatggctctgatgggatttgggtaactactggggaattctcatcacaggtgtctgaaatgaaccatctcatggtaagtgatagcatgagatatgcaattttgatgtag

SEQ ID NO: 32727 - DNA, 570 bp, Glycine max
  Peptide Sequence Number=SeqID_149505
atggagggcgttttggggctttccggcaatggcgtagccgacgaccaggatgtcgtggaagcggacgcggtggtggaagatgcgccggcggaaggagtcgaggaagtcgaggacgaggggcttgaggtcggcgcgggcgaggatttggaaaatggcaacgaaggtggcgcgggtgtggtggaagtggggctggtggccggcccagtcgaagaacttgaggcaggggaggatggcggagagagcggcggagaagtcctcttcgccggcgggggaggaaaggatttggtggatgcggttcaggagggggtcgaaggggagctgctggagcttgaggctgaggaggaggatgttgattgggagggtgatgatgatgcgagagaagtgtatgcagcatggtcggaggagcacgggttgagaacggtggagatgaaggatttggatctgagacggtgtttggttacttgtttgagcgggagcatcatggattggaatggaccaatggaactggaatgttcttctcgttctctcagggttccattgcattccaagtgtttgtgtttatgtccgtga

SEQ ID NO: 32728 - DNA, 396 bp, Glycine max
  Peptide Sequence Number=SeqID_149506
atggagtggatgaaaatacctttaacctcgccgaatccccacctctcaatcctacccattagggctgtgttgggctggacagacaaaagacagaagatgtcctctgtttgccacctttgctccgagctctccaacttcaatgagtatgacctcgccgacattgacgccatcaacgaagagctcagttgggtcaaagaaacgggagatttgcttcacaacgaggcgatgaaggttctaaaatgcggaatggaagggttgaaccaagcaaagattgggatcgagttgaaggtttcacggctctttccccatcctatgcagctacattttttacccctacaccccttcgacagcgacgccaaagtcggagcaatccctgccgctagagagaggctctag

SEQ ID NO: 32729 - DNA, 659 bp, Glycine max
  Peptide Sequence Number=SeqID_149507
gtggcaactattgagaaggaactaaacaggcttgaatctgaaggtgaggacagacaactatctggccaagagttgcttgttagaaaaaagcttcaagaggaactatgggcagctgcacaagcgcaagagtccttaatgaggcagaaagctaaagcaagatggatcaaagaaggggacagtaattcaaagttcttccatagggttgtaaactcaaatcgcaagtccaacactttgagaggtgtgcttgtaaatggtgtctggaggaggaaacacggctgcctaaaatcagcttctatctctgtattgatcaatggcagcccttcgtccgagttcaccccacaaagaggcataagacaaggggacccactagctctgctattattcaatgttgttgcggaagggctaaacggattgatgagagaggtgttgaagaaaaatctgtttcaaggctttctagtgggtagaaaagaggtggaggttaacataccacaatatgcagatgatacactcttttttgggaaagcatctatggaaaatgttgaagcgatcaaggtgatcttgagaagcttcaaacttgcctcaggactcagaatcaatttctcaaagaattgctttgggaaaattgggatgtcagaaagttggaaggaggatgctgctag

SEQ ID NO: 32730 - DNA, 162 bp, Glycine max
  Peptide Sequence Number=SeqID_149508
atggaaatgatccaaaagtccacttctagtgacaactcccaagggtggtttcatgtaacttcactagcttctagagatatcatcctcttagataataacattgtggcggtgccatgtgtgcatggagcaacaaatatttctaactacgaatgtaatagatag

SEQ ID NO: 32731 - DNA, 189 bp, Glycine max
  Peptide Sequence Number=SeqID_149509
atgacaaaagccaatgtttctttaaaaagaataataaaatgggatgaagtaactctccctgaaaaatgggtcatggagaaggccacaccgtctgatccccgacccgctccaattattgaaaaaatcaaacaagacaactcaggaaagaaaggatatagattacccatggatgcaagacatcataggtga

SEQ ID NO: 32732 - DNA, 1176 bp, Glycine max
  Peptide Sequence Number=SeqID_149510
atggatatgaagttgaatattccaccaattgttttatacttagtgttgactatttctggtacagctcaatcagttggcatcgatataaaaaaatttggcggaataccagatgcagatataacacaggctttcacggatgcttggaaagtagcatgtgcatcaacaagtgcaagcaaaattttaattccaaatgggacatacaagatgaaagcagttgatgtaaaaggtccttgtatggctcccattgaaattcagattgatggcacaattcaagcaccggctgacccaaatgcactagacggggctaagcaatgggtcaaaattggatatgctaactttattaccttatcaggtaaaggtatttttgatggtcaaggtgcaattgcttggaaacaaaatgattgtagaactaacacgaattgcaagataccttccatgaattttggtttcaatttcgtgaatcattcaatggttcggggcataacttctaaggacagcaaaagcttccatgtcattctttttggatgctacaacttcacatttgatggctttcacatcagtgctccagagactagtatcaacactgatggaattcacattggaaaatcgactgatgtgaaaattcttaacaccaacattgccaccggagatgattgcgtctcactgggagatggcagcatacatgtaactgtccaaaatgtgaattgtggacctggccatggcattagtgttggaagccttggcaagtacacgaacgaagagcctgtgaaagatcttttagtcaaaaactgcactttgacaaatactgagaatggtgtgaggatcaagacttggcctaattcttcacaaacttatcttgtcactgatatgcattttgaagatattaccatggttgatgtcttgaatccggtgatcatagaccaagagtattgtccttggaatcattgcccaaaacagagtccatcaaaaataaagatacgcaaggtttccttctcggatattaagggcacttcaaaaagcaaggaaggagtgatttttatatgtagcaaagctgtaccatgtgaggacgtggaactaaataatgttgctcttacattcaaaggagatccaatagttgctaaatgtgctaatgtcaggcccaaatttgcaggaaaagctcctccttgcaccgcttaa

SEQ ID NO: 32733 - DNA, 540 bp, Glycine max
  Peptide Sequence Number=SeqID_149511
atgaagaaagctcttttcaagccaaagcccaaaacaccagtggagctcgtgcgccacgcccgggaactcatcatctttctggactccaatgcatgcactcgtgaaagtaaacgcgaagagaagctatcagacctaagcaaaatgatactggagataaggactgttctttacggaaacggcgaatcagagccaaatgccgatgcgtgttctcagatcacgcgagagtttttcaaagatgacacatttcgccttttcattctctatctgtcaaatcttaaacttggggcacgccaagatgcaacccacgtgattgcaaacttgcaaaggcagcgggttaattcgcaactaattgcttctcagtacctggaaaaaaatctagatcttgtggacatgctcataggcggttccagtgtgctggataaatggttaatgaaagtttatttaattagttatgagaaagagggtgacattgctttgacgtatggtgcggttgcaagggagtgcatacgccaccagagcgttgcaaggtacgcaatttaa

SEQ ID NO: 32734 - DNA, 1611 bp, Glycine max
  Peptide Sequence Number=SeqID_149512
atgtgtaaggaattggattggatccgtcaggaacatgcctttttcttataccctatggttaggtgcttaagaaggttggctttgtccatttctattgatgctgctgccacttgcatttataaaatgcaatcagataatggcaagttatttatcggtggaatatcatgggacacaaatgaagagcggctcagggagtatttctgtacttatggggaagttgtggaagcagtgataatgaaggatcggacaacaggtagagctaggggatttggtttcgttgttttttctgacccagctgttgctgaaatagtcataaaagagaagcacaacattgatggaaggatggttgaggcgaagaaagctgttcctagggatgatcagaacatactgagtagaaacagtggcagcatccatggttctcctggtccaggtcgcactagaaagatatttgttggaggtttagcatcaacagtgacagagagtgatttcaagaagtactttgatcagtttgggactataacagatgttgtagttatgtatgatcacaacactcagaggccaagaggttttggatttatcacttatgattctgaggaggcagttgacaaggtcttacttaagacgtttcatgaattgaatggtaaaatggtagaggtcaagcgagcagttcctaaggagttgtcaccaggaccaagccgcaccccacttggtggatataactatggtcttactagggtcaatagtttcttaaatggcttcacccaggggtatactccaagtactgttggaggctatggacttcgagcggatggtagattcagtcccgttgctggtggtcgaagtggatttgctccatttggatcaggttatggaatgagcatgaattttgagcctggtttgaatgctggatttggggggaatgcaaatttcaatagcaatcttagctatgatcggggagtaaatccttattttattggcagctccaataggtttggaagtcccgttggatatgagagtggaaatggaggaaacaattctttcttcagttctgtgactcgaaatttgtggggtaatggtggccttagttctgcaaattccaacgcatacattggatcagggagtgggagtgttggagggaacacgtttggcaacactggagtcaactggggttcttcagcaatttctgggcagcagggaggagggaacaatatgtcacaaagtagtggcaacctgggatatggaggtggtgacaacagttatggtttggggactggaggatatggaagaagcactggtgccgcttttgcaccaacatcttcatactctgcatcaaatggcggtgttgatggggcttttgcagacttttacaataatagttcagtttatggggaccccacttggcgatcttcaaattctgagagagatggatctggtccctttggttatggatttggtggcgtagcttcagatgtttctgccaagagttctcctggttatgttggtggttacactgttaataagaggcagccaaataggggtaagagttacaataatttagacgaatgcccttttctagatgctagacattttgaggaaatgttgtctgattga

SEQ ID NO: 32735 - DNA, 2013 bp, Glycine max
  Peptide Sequence Number=SeqID_149513
atggaggttgtgagtccaaaagattattctgtggcctcgagtcctttctcctcacctaacattggagccttgctgaagatcaaggtcatcacatggagccaacaaactggtttacctgtttctgtcagtgttcgagttaaagacaaaacgttcaagctgcataaacagtttcctttgacttcaaagagtggatacttcaagaagaggttaaacgacacatctgaggttgagcttccagaaacattccctggaggaccagaaacctttgagatgattgccatgttcgtttatggatcctccacattgattgacccttttaacgttgtgccccttaggtgtgcagcagagtttcttgaaatgactgaagatcactgttcgggcaacctttgtgaacggtttgatctttatctgaatcaagttgtgttgcaaagttgggatgacacccttattgcacttcaaaggtgccagatgctgcttccctggtctgaagatctgttaatagtgagtcgatgcattgaatctcttgccttcatggcatgcatggaagtgcttgatccggaaagaaggagagacacaccagttgtgaaagtggaagagttggcttccaaagattggagctgtgaaatagtgaaggatgttgtgagcctagacctgtggatgagggatttgattgctctaccctttgactttttcaaaagggttatagggtctttgaggaaacaaggaatgaaggagaagtatgtgagtccaatcattgctttctatgcaaacaaatgggtgctctctaaaaagacacgccaatttttggagagttcctgtgacaaggttggtgaaggtggcatgaatagcaaagcttcagtgattctacaaggtgttgttgatcttcttccagtgggtgataaggctaggaaagtgattccagtgggtttttattttgccttgctttctagatctcttgagttggggttgaggattgaaagtaaggcaaagttacaagaccaaattacttcacttttgcacttttctcaagtggaggattttcttcttccagaaagtggagcagagtcaatgtcctctagcatggagtttgtaactatggaaagcataatttcagcttatgtagcatctagctcacgtgtaagccataccccagaagctagccgttacagggttgcggaattgtgggatgcatatttattcaatgtagctgcagatccagatatgggaccaaagagattcatggaactcattgaaagggtaccaccatcttatagacagaatcattaccccctttacaaaacaatcaacagctttgtcaagacacattcgggtatatcccaagatgataagggagcagtgtgcaagtatctggactgtcaaagattatcacaagaggcatgcattgaagctgttcaagacgaattgatgcctctacgtctaattgtccaagcactttttgttcaacaactcaatacacacaaagccttcaaagaatgctcagattcattcagatatgcacattgtggagacatgtcaggaagcctatcaagctctaggtgtccatattctgcaagtcagaatctaggagagagcccttacactgatggacctgatctcagtagcaggccattgagcttcctgctgcagaaagacaacgtaatgcagaatttcaagttctcaactacagattatgagtcaacaagtttcagaattcaaaatcttgaacaagaactcgtgtccttgaaaagaagccttcaattgcacaacattgtaacaaaagcagaaccaaatttgatcaaaagccagaagatgaagccgtgtggcttagaaactcgatcacagagcaaaaggaggaacccgattggacaagcgactagttgcatcagttctgtaaactttgcttcacaaagaaggaatgccagcaggctactccaggtctttcgccgcataactttgtttggaagtaggaaattgaagagaaaaccgggaactcctagtcaattgtccaagtaa

SEQ ID NO: 32736 - DNA, 894 bp, Glycine max
  Peptide Sequence Number=SeqID_149514
atgcctgcagagaagtccaacagtttcgataacgaagtggaagcgttcgttgaggttgatccaacagggaggttcgggcgttacagcgatcttcttggttgcggtgctgtgaagaaagtttacagagcgtttgatcaagaggaaggaatcgaggtggcgtggaatcaggttcggctgaggaacttcagcgaagaccctgttctcatcaatcgccttcactctgaggtggatttgctcagaaccctcagcaacaagtacatcatcgtctgctacagcgtgtggaaggacgaggaacgccacaatatcaatttcatcactgaagtctgcacctccgggaacctcagggattaccgcaagaagcaccgccacgtctccattaaggcattcaagaaatggtccaaacaggtccttgagggattggagtatcttcatacgcatgacccctgcatcattcacagggacctcaattgcagcaacatctttgttaacggcaacattggccaggtgaaaattggtgatcttggattggctgcaatagtgggacggaaccatgcagcacattcaattttagggacaccagagtacatggcaccggagctgtatgaagaagattacactgagatggtggacatatactcttttggaatgtgtttgcttgaaatggtgacaacagaaataccctacagtgaatgtgacagtgtggccaagatatacaagaaggtcacgatgggaatcaagcctgaggccttgagcaaagtcacagatcctgaggtgaaggaattcattgagaagtgcatagcacagccaagggcaagaccttcagccacagatctccttaaggatcctttcttttatgaactcaacaatgatgaagaatcaacgccaatcaattga

SEQ ID NO: 32737 - DNA, 1566 bp, Glycine max
  Peptide Sequence Number=SeqID_149515
atgcttcaatctccagggcactcgccgctccacatctcgtcgccgtccccttcaatttcccaggtatcggcgcaaaaccctaacgatccaccatcatcatcgtgtgcgaagcacccagcggtgttggacgaggacacgtacgttgaggcgttggagaagatcatcgagcgcgactacttccccgacatctccaagctccgcgaccgcctcgactggctcgaagccatcaaaaccggcgaccccgtggtcattcgcgaggcccaattgaagatccttgaacgccgcgccggcacaaccaaggtaaccaatcccaacgatgcttctagaacaacctcccacacacccggttccacattcgttagaaatttcacacctttcgatgaatttgacggaaaaccctctcaaaccccccgtgccccggttcccgaggccaaagagggggagaataacgatggtggggttgatacttcgcttggcctcgatcaatttatgagaaggtatacgagtgaggacaatcatagcttttcgaagattctagagaaagtgaataagaagaggaaagagaggtttgggtttttgaatgaggatgttcagggaattgaggatgtgaagagggataggattactgatggttatggaacctcttatcagcctccgagtacccttgaaggttggaattacactgccaagaatttgttgatgtatcatcctgctgatcggggtgaggtccctttgactgaggaggaaagagcgaatagaattaaagccgccacaaaggagatcaatcgcgggaacactaggtttcatggtaaaatgatggattctaggcccaaagatgatggaactgttgaggtgctttatacgcctgttgctggcgctacgccagggcctatgtctcttagagaaggggataagttaaagaagtatgatttggaggatttgaggaaaactccgaatccgttttatttagaatctgggaagaaagctgagaatggttatagctttgttaagacaccgtcccctgctccgggtgttgatgaatccccgtttattacttggggagaaattgaggggactccgctgaggttggatctggaagatatacagcttgatattggtggtagtgctgatggacctcattacaggattccttctgcgcctacaagagattcaaaggcacactctctttctagggaggctgcacgcaagataagggagaggtcaaagatgtttcataagcccccattggcatcaccggttagaggggggagtgccagtccaagcatgcggacattgtctcctgcagctcagaagtttgtgaggaatgcgtttgccaagtcctcctcttctgttgatgaaacacttcgggcaagttaccgcggttctactcctgctttggctacacctacaagtgttagtagaagtgtgtcaaggtttgctagagatgggagcttggcttccagggacaagaaagccacggaagccattgattgtgagagaggcccgaggcgtgttcccattgatcaagtcagtaacttgttcgtggtcgttgttgctgaaaactga

SEQ ID NO: 32738 - DNA, 201 bp, Glycine max
  Peptide Sequence Number=SeqID_149516
atggagttttggatgttctttgctttacgccaggattttaggccatcaatcgactttctgaagttgacgtggacaaaacttgacaactactgcatgacaggatgttatttatttgtcatgtccgaattttacgggcttttaggagatgagttctatgattctatctcaacacctatttccacaggctcacttcatgtgtag

SEQ ID NO: 32739 - DNA, 200 bp, Glycine max
  Peptide Sequence Number=SeqID_149517
atgactaatgcaaactgtccgcaagagtcattgcattcagtctcaaacgggaatctaaggtttgacactgcacaaactcttgtgtcaaggttctttcaggacgagggtgagagccctgtcgagtctgatgaaacaaaagtccaaacttggagcagccaacactacaggaacgaacctgtggttgttgttgctgctccacg

SEQ ID NO: 32740 - DNA, 219 bp, Glycine max
  Peptide Sequence Number=SeqID_149518
atgccccaactagggttgctagccttcaaggggaacaggaacaaagtggttgacattctcgttgggcacgtgcagtgcattgggtggtgtatagttgggagtcaaatccgcctcaacaacggtgctggtggctgcaactgtggccgcattgtcctccatcatggaggtcatttggtgatgcaatcctccctaggaaaggaccagttaccagagccatga

SEQ ID NO: 32741 - DNA, 321 bp, Glycine max
  Peptide Sequence Number=SeqID_149519
atgtccaacagggccctggggtttcaagctctggttacgagcctctgtcggtcctacagggtgcccgtaccccctccagcaaggtcatgccatcatgacatagggatcatgcccgcaaggcacccggtggacccaaagaagggtcctggggtttccagttctgattacgggcctctgtcagttctacggagtgcccgtcgccccaacaaggtcatcaggccccccctaccaattgagctttcatcaagaagtactgcgcccccaggcaggtgcagggcgaaacaccagagcagcattgggatggccggtagcgggcaatag

SEQ ID NO: 32742 - DNA, 327 bp, Glycine max
  Peptide Sequence Number=SeqID_149520
atgttgctaagtagcaatgtcatctacatctgtgtaagagtggtcatgttggtgcgcatgatcggcactcgtctctttgcagcggcacgggtgaaatcttgccccggtatgcatagtagcagtgtgatagcctccctctctggttgtgctcgcacagctggccctcctccaatatcagcggggcagaggaccttaaattctcttaaggtgtggatgtggagcacactgaaaatgaggacacgtagccctctaaaggtgagggcgtgcagccctctcaaggcgaggatgtgtagtcctttggaggtgagggcgtgcagtcctctcaag

SEQ ID NO: 32743 - DNA, 150 bp, Glycine max
  Peptide Sequence Number=SeqID_149521
atgactctattttgcacacggcttcctatcgaatcaaagatcaaacgtggggtgggatatcgccagtcgagaacgaccttgaatggcaatctgaagggaagagacaccaaaaatgggtcttcctttgccggcagttccttaccttgctga

SEQ ID NO: 32744 - DNA, 607 bp, Glycine max
  Peptide Sequence Number=SeqID_149522
atgatgaagcaagagttaaaaaaatcactgaaagtagagttatctcatattgcatcacatctgtcagcccccattgaggcgctagaaatacaagctctacttgcgcgtgttagcacaaagggtagctgcactggacctgaaggaagcgaattacttaaagagcttttgaatggtgatgacgatctgatgggcttgttcgtagttgttgggcaaaatactatgcttgcgggcttgggaaaagtgtttgagaattcatccaccatacataatgttcgttatgaaaatgatgttgttaaggttcaggttgtcagaacatacatgcctcacgctgaggtccctattcctacatcagaggttcattatcttgagcaggccgttggcacattcgttgcatggccgacacatcttgttagggaagtaactaatgaggtggtcgtaggacccgataagcctccatcaaagtctgttggagaaccgaacaggttaacatatgtggccacagatgacccactgggagaattggttaagaagtcatatgtagtttacacaaagccaatggagttggcatgggatggggcgaaatttgggttacctaatgccacaaatg

SEQ ID NO: 32745 - DNA, 783 bp, Glycine max
  Peptide Sequence Number=SeqID_149523
atgccaagttcacggcaggaaaggcatgggcgcttcataggggaatgcacccggcagcgggggcagagtcctatatttgccgggcggatttcttgtgatgtgtccctaattatactttgcgccagatcatgcgccaggcggtggaacggacgtcccaccgcctggttgctacagcgtggcgtcgtagtcgatcgtcagcggcgcgtggtcggaaaagcgttcgtctttatagatcgcgacgctgcgggcgcgggcggcgatgccgggcgtggcgatctggtaatcgatacgccacccgacgttcttggcccaggcctggccgcggttgctccaccaggtgtactggtccggccgctcgtcgatggtgcggaacacgtcgacgaagccgcgcttgtcgaacacgtcggtcagccaggcgcgttcctcgggcaggaaaccggaattcttcaggttgcccttccagttcttcaggtcgatttccttgtgggcgatgttccagtcgccgcagatgacgaattcgcggccggtcttcttgtgctcgtgcatcagttcgtcgatccacggaccgaagcggtccaggaagcggtacttggcctgctggcgttcgtcgccgctggagcccgagggcaggtaggcgctgatgaccgacaggttcttccagtcggcgcggatgatgcggccctcgggatcgaattcttcgcagcccaggccgatgctgacgcgctcggccgcatcacgcagatagatgccgacgccgctgtatcaattctgacggcatggtga

SEQ ID NO: 32746 - DNA, 369 bp, Glycine max
  Peptide Sequence Number=SeqID_149524
atgtcttcagtcattgcatgctttcaaaagctgacaatgaccctcatttacatttcaaagaacttcaatgtcttcatgctttcacgggttttactgcttagactttcgctagtggtcggttggatgctcacttgggcgagcaagttgcttcaggatgaagttatcagctcgcctgggcgagctaccttcagcccaaatgcttcattttgctataaagaggaagaaagaagagaaaacaaggccaaatgcttccgaatcgcatttgtgatcgattcctacaccgttcatcattcgttcttcggccgttctttgttgttctttatcgttcttcattcttcatccggtttgtgtttgcttttaaggatttga

SEQ ID NO: 32747 - DNA, 648 bp, Glycine max
  Peptide Sequence Number=SeqID_149525
cgcgcctgtcgggcatcaacgtggcgcgcaccaagctggctgtgttcgccatcaacggtgtcatggtggctatcgccggcctgatcctcagctcacgtcttggtgctggctcgccctcggcgggcaatattgccgaactggacgccatcgctgcctgcgtgattggcggcaccagcctggcaggcggcgtcggttcggtggccggcgcggtgatgggcgccttcatcatggcgtctctggataacggcatgagcatgatggacgtgccgaccttctggcagtacatcgttaaaggggcgattttactgctagcgcgcgccacgatgcacgaaaaacgttaccgtattacgctgctgtttaacgccaacaaggtgtatgaccgccaggtggtggaaggggtcggcgagtatctgcaggcttcgcaaaccgactgggacatcttcattgaagaggatttccgctgccgcatcgacaacatccgcgaatggctgggcgacggcgtcattgcggattacgacgacagctcaatcgaaagcctgctcagcaatgtgccggtgccgattgtcggggttggtggctcttatcaccgccagcaggattatccgccggtgcactacatcgccaccgacaacgctgcgctggtggaga

SEQ ID NO: 32748 - DNA, 627 bp, Glycine max
  Peptide Sequence Number=SeqID_149526
atgatagaacaaaacatcattggtagtcatggatacggtatagtataccgcattgatgttggttcaggctatgttgctgtcaaaaaggtttggaataatagaaagttagaaaagaagctcgagaagtccttccgtgcagaagttagaaaactgagcaatattcgtcataccaacattttgagattgatgtgttgtatctctaatgaggattctatgctccttgtgtatgagtatctagaaaatcacaacctagataggtggttgcacaagaaggttaagtcaggttcagtaagtaaagtggtccttgattggccttggttgaaaatagccattgcatttgttcaaggtttaagctatatgcaccatgactgttcaccacatatggttcatagagatataaaaacaagcaacatcattttggatactcaattcaatgcaaaagttggtggttttggactcgctaagatgttaattaagccaggggaacttaacaccatgtcagttgtgattgggtcatttggctatattgctccagaaaaaagtgtttatttcaacattgatgtaccttgttatttgttggaagttggaacagggccatatctattttcatatgtccatgcattctga

SEQ ID NO: 32749 - DNA, 302 bp, Glycine max
  Peptide Sequence Number=SeqID_149527
ggtgcccgtcccccccagcaagatcatgcaatcgtgacataggacacccagtggacccaaagaagtccaatagggtcctggggtttccagctctgattacgggcctctgtcatttctacggagtgcctgtcaccctgggcaaggtcatcaggttccctactaatcgagctttcatcaagaagtattgcgccccaggcaggcgcaaggcaaaacaccacaacagcctggggatcgccagcaacaggcaacaaatgcaccgtcgccacctccagagcccctcagctcatccacaaaaaggttag

SEQ ID NO: 32750 - DNA, 165 bp, Glycine max
  Peptide Sequence Number=SeqID_149528
atggagagtgttggttggtgggggcgagggaactggacaacgagtaagaaaataagagcatgtctggtagagggaaaggagtgggagggtgcaaatagaatgatgcaccaactattcctaatttccattctcacatgggatgtggtttctatcttctaccattga

SEQ ID NO: 32751 - DNA, 246 bp, Glycine max
  Peptide Sequence Number=SeqID_149529
atggctaaaacaaaaccccttatgcatatatttctgttagaacatcctaatccaaaagggaggtataatttttcagagtgtatgttttcttctcatagctcgtccaagcaaattgaaggtatcaggctactagatttatcgtcaaagaagctgatagatgctggatttatgtacaagtatgaacttaatgaaatgcttcatggttcaatcaaatgctgcaaagaaaaagggtttcctgtgaggtag

SEQ ID NO: 32752 - DNA, 2268 bp, Glycine max
  Peptide Sequence Number=SeqID_149530
atgagttcgtttcgtaaacccttcgtggccattctctgggttgttctgtttctgggtctccatgaggcagcggaaccagagaagagcacatacattgtacacgtggcgaaatcggagatgccggagagcttcgagcaccacgcgctgtggtacgagtcgtcgctcaagaccgtgtctgactcggcggagattatgtacacctacgacaacgcgatccacggctacgcgacgaggctaaccgctgaggaagcgcgtttgctcgagacccaagcggggattctggctgtcctcccggagacgaggtacgagcttcacactacgaggacgcccatgttcctcggactcgacaagagcgccgacatgttccccgagtcgagttccgggagtgacgtcatcatcggagtcctcgacaccggcgtctggccggagagcaagagcttcgacgacacgggacttgggcctgttccgagcacctggaaaggcgcgtgcgagacgggaacgaatttcaccgcgtcgaattgtaacagaaagctgatcggagcgaggtttttctcgaagggtgttgaagccattcttggtcctattaatgaaaccgaggagtcgagatcagcgcgcgacgacgacggccacggcacccacacggccagcacagccgcggggtcggtggtatccgacgcgagcctcttcggctacgcgtccgggacagcacgtgggatggccacgcgcgctagagttgctgcatacaaggtgtgctggaagggaggatgcttcagctccgacattcttgccgctatcgagagggcaatattggacaacgtaaacgttctgtctctgtcgctcggtggtggcatgtcggattattacagagacagtgtcgctattggagctttttccgctatggagaatgggattttagtttcatgctccgctgggaacgcgggccccagtccctacagtctctccaatgtggctccatggataactaccgtgggcgctggtacactggatcgtgacttccccgcttacgttgcgctcgggaatggccttaacttctccggcgtttcgctctatcgcggtaacgctgtgccggattctcctctgccttttgtttatgcgggtaatgtgagtaacggcgctatgaatgggaacttgtgtatcacgggaacgttgtctcctgagaaagttgctgggaagattgttttgtgtgaccgtgggttaactgctagggttcagaaaggctccgtggtgaaatccgccggagcgttgggcatggtgctcagcaacaccgctgccaacggcgaggagctggtggcggatgctcatttgttacctgccaccgcggttgggcagaaagccggtgacgctattaagaagtatttgttttctgatgcgaaaccgacggtgaagattttgtttgaaggcacaaagttggggattcagccatctcctgtggtggcagcgtttagctctagaggacccaactcgatcaccccgcagatccttaagccagatcttatcgcgccaggtgtcaacatcctagccgggtggtccaaggcggtgggacccaccgggttacccgttgataacaggcgcgtggatttcaacatcatttctggcacgtccatgtcgtgccctcacgtgagcggcttagccgcgctgatcaagtcggctcaccctgattggagcccagccgcggtccgatcggctcttatgacaacggcttacacagtttacaaaaccggtgagaagctgcaagacagcgcaacgggaaagccctccacgccgttcgatcacggttccggacacgtggaccccgtcgctgccctcaatccaggactcgtctacgatctaacggtggatgattatttaggttttctctgcgcgttaaactactcagcttccgagatcaacacattggccaagagaaaattccagtgcgacgcgggcaagcagtacagtgtgaccgacctcaactacccttcgtttgcggtgttgtttgaatctgggggcgtggttaagcacacgcggactctcacgaacgtggggcccgcgggaacttacaaagcttcagtaacgtcagatatggcttccgtgaaaatctcggttgaaccgcaagtgctgagtttcaaggaaaatgaaaaaaaatcattcacggtcacattttcatcctcgggttcgccacagcaaagagtgaacgcttttggaagggtagaatggtccgatgggaagcacgtggttggaaccccaatttcgattaattggggttga

SEQ ID NO: 32753 - DNA, 570 bp, Glycine max
  Peptide Sequence Number=SeqID_149531
atgacggctccttctcaactcaatacctccacagaccaagatgcttctgctaactctgagagaagcattccaattctgatactgatagtaacgatgacgacatcaaacaagggccttgatttgattacgatgttaagcttacatgctttggaacttccttgttgtccaatcactttaaccttaatggatatagctgcaattactggtcttaaacctttagctcaagcccttcatttcgaagaagacatctgccttagcgaatttctacttgcttctatttataaggacactatcaaaaagagtaaagaattaactttctttcaagaatcgaagaaagctaccaagaccaagagtgatgatagagtaaagtttccaccaagatcacccaaattccaacaaccattaaagtctacttcctctcaaccttcaaagtccaaagtttcaaagggattagatgattatgatgaagacatgcctaccaattcttcctttaaactgacctcttttgctaagaccaagcgaaaggatgacaaaataatggacctctcttcctctcaagatccttcttaa

SEQ ID NO: 32754 - DNA, 186 bp, Glycine max
  Peptide Sequence Number=SeqID_149532
atgggagcaaagctacgttggtggtggagccctagcttagacaagaagtgggaggctgctcaaactcgtcgtcagaggagaagtggtcatcgaagaatgctaggtcaaagagattatcatgctgatcaaattgtcgaggtcgagggatgttccttctttagaatcttcgtcgatctccgttgttga

SEQ ID NO: 32755 - DNA, 1074 bp, Glycine max
  Peptide Sequence Number=SeqID_149533
atgggcgaccgcaacgggctcgcttcctttgtgaccttactgattatctgcctgatcgtgttcacgccgctggcaatcatcacctcgtcgctggtggtcgagatcaatacggtgtacaccaagctgcaaaccaattccgcgcagttcccgacggtgtttgcctcgctgctgcagcatctgccggagtgggcacaaacctggctggcggatcacgatctgaacaatgccgcacagattcagcaaaaactctccggctttgcgctgaagggcggacaatacatggcgggcagcgtgttcctgatcggtaaagggactttcaccttcaccgtgggctttggcgtgatgctttatctgctgtttttcctgttgaaagacggcgcctggctggtcgggctgattctcgaagcgctgccgctctccacctatgttaagcaccatctgctgatgaaatttgccgccgtatcgcgcgcgacggtcaagggcacggtggtggtggccgtggtgcagggggtgctgggtggctttgccttctggatcaccgacatcgacggcagcctgctgtggggtgcgctgatggcgttcctgtcgctgatcccggcagtcggctcggctatcgtctgggtgccagcggccatcttcttcttcgccaccggtgcgctgtggaaaggcctgttcctggtgggcttcttcgttatcgtggtcgggctggtggacaatatcctgcgtccgctgctggtcggcaaagataccaaaatgccggattacctgatcctgattgccacgctgggcggcatggaagtgtacggcatcaacggcttcgtgattggtcccttgatcgctgccctattcatcgcctgctggaatctgctctccggccgcgacaaccgggaaaacgtcgaagagatcgacgaagagtttatcgaagaggtacaacagctaaagacctgttgccgggccgctaccgctcactggcaggctcatccggagcggcgcgttaaagcgccgcttgtcttttcagcgcggccgccaggctgtcacgcgcgcaacgctgtcagcaccttttccgacctttga

SEQ ID NO: 32756 - DNA, 1032 bp, Glycine max
  Peptide Sequence Number=SeqID_149534
atgaggctactatcattgagtaataggaatcacaatatccagaacgatcaatatgatgttgagaacattgaggatgatgataatgttgaggttaggaaaagtaggaaaaataactattctccttttactatcctcgggtatgagtgggtgtctagggaggtcaacttttatgcttctcgttttcagatttgggaatccatagttgttcttaagaaagagattcccctaatgttgatgggggtttcaaaaccatatggcggtggtggttttgtcaatgatgatgtggctgttagtgatgatgtggctgttagtgttggcagacttgttcaaaatgaagggattattgatctagtaatgccatcctctgctacgtctaatcttcctccttctttatctcaagatagtaaccaaagtgcttcgcctttggctatgatgcagcgagaattaggggtgggtaagcgggttgatctgccccatataagatccgcccgcacaattgctaatgctgatgaaagaataaaagtcatgaagactcaattgaagagtatgaagatcaaagttgagaaaacaaaaacacttaagaaagatcttgctaatagtaaggagtttgtagccaagttgcaaacagatttcgataaacatgttgcttcattatctgctaagtctaaagagaataatactctgaatatcctggttgttgctttggacaaatctgtggcagatgttaaagccaaatttgctgacttttcttcacaatttgctgctgagcaaacaaagagcaaaactgctgaggaagagaagaaaattgctaaagacaaattgacatctgccaatgaagaggctcaatgtcaagtgatcgtgctgcttccagattttgattacaaaaaactggatgcgagttgcaatgtgcttgatggtgagattgttagagaatctcaactctgttatgacgaggaggaggaagaagaaaagaatgaagtagaatcaaatgcagttggatttaatgttgatgtaaccaacactacttattag

SEQ ID NO: 32757 - DNA, 231 bp, Glycine max
  Peptide Sequence Number=SeqID_149535
atggcacaaatggaggacataaggagggagaatgcagaagtcaagtgggagagcacaaaaggggaaactgctgtggaacaacccagaggtttcaacccctttcacgaccgtcgtgttgaacacgaagatcctgacaaacattctcatcccaaagatattgctattaaatgcggattgccgaataactccattgttcgcttcgacggtttttcccatgcttttgtcacataa

SEQ ID NO: 32758 - DNA, 942 bp, Glycine max
  Peptide Sequence Number=SeqID_149536
atgacaaacatcttttctcaggtgacttgccatatagaagctaaggagtcgatggcaaggaaattagcgatggaaaagaaagagagtgggtcaacatctggttcaggatcgggcattaagccctataggaaggagtttctaaagcctcgagggaattggaacaagagggagagacaagtcataaaagagggatctaccccttccaccgccaaccttagggactacattggcaccagctcaccaatagggaagcttaacaaacgtgatgtattgggacactttgttggcttgaaagtcccaaaggatttaatgatgccctatccaggggtgttggtcaactttgtaggagcggagatagaggtgaagttcccgctggatgatgggtcggtcggtgttatcagtgtgaaccaagaaattgctagcaagtgctatcaagaaagccttagatccatgaaaggactttacgaactgaccaagcaatacgaggaagtgaaggaagtagagattgtagaagggaaaaaggtaaatatcaacacgatcctttcacccctgcttgaagataacatgttgaaggtgctaatgcgtaacttaaacacttttgagtggagttcaagtgacatgccgaggatagatcctgatttcttatgccataaattggctttgaatccctcggcaaagtctataattcagaagagaaggaagttcggggaagaaaaaataaaagcgattactgaagaaattgataagttgatatttgccaaccatttgaaagcttccatctccagcccccgaattgcagaagtcgatggtaggtttgctcatcatagtatatttctcagtgtcagagaatgttattggcttggtcctagtgcaagtggtggtcgaacaacgtctgatatactttgtgagctaggtcttgcaaggcgtcgagtcacaatataa

SEQ ID NO: 32759 - DNA, 882 bp, Glycine max
  Peptide Sequence Number=SeqID_149537
atggagaaatttgatcaagcggttgtcgctattgtgactactactaagaacgcaggtgatgccattggcagatcaactcctctgatcatcgcctctttgaatattatggcggccaacccgggtgatgcaagctccattggagcttgtaggcctaggatcttcttcatcaatggattcctttgcttcttggaagatgaattgcagcggaatggagaaaggaagagagagaggagattccacttcaaggagaagatgagtctagaagaagctcaccaccataggaggccatggataagagcttggaggaagaaggagatgaatgaggggagagggagagaagagcaccaaattttgattgatgggcaatggcccattgaagaaatggaagacaacttgaaccccatggactttgggaatccccagaatgagagcagtttattctgggatgtggtttttcgtacctcgatccataaccatatgcacaacatacctaaagtcacccacattgatatggaaaagctgaactttgtgaactacgtaaaaggcccgcatgtagaggcaaatcgagtctgcaccattttgtgtgcagttgaagaccgagggaaggatttgttgaacaagaagatgcttgaaaatgataaagctcgacttactgttgaggtggaaaaattgaggaagcaaatggtggatgctgaggagaatcgggtggacaaggtaaagttcgacttgactatggtggacaccaaattggctcaacaaattgttgaaggttttaaggatgcaatagtacaagtgaagattgttgtcgaggacgtggatttcgatgtggtcgacccctccaaagaggttgtaaattatgaaattgtggaggttgtcgaatga

SEQ ID NO: 32760 - DNA, 798 bp, Glycine max
  Peptide Sequence Number=SeqID_149538
atggcttttgaagagctcgttggaatccttaaattccatgagcaaaagcttgctcaagataaaagaacaaagaaaaggaaatcattagccattaaggttcaaagactaaaatgcaactctgcatccaaagagtattcgttcaaagcctttgtcgcgaatgatgctttcgaagaagaatccgatgatgacgactttgatgatgagctaagtctgatcaggtttaatggatcattcaaaagatccttccacaagaaagagaaaagtctaatcatctgctatgagtgtaagaaactaacgcttcaagacctggatgattcctcatctgacgaagacaataaggaagaagccaacctatgtctgatggttgatgtgcccaccagtaaggtagaaccaacattggatatgagttcggaaaatgaggactctcaacttgaggacactgtcaactctgatggtgaagagcatgacgatctcaagaaagctcatcaaattcacatagttgattttgtcctggaaaccaacttgcctggtagtgtacaagatgcctctgtttgtgatgtagtcaaagtactgatggacaaaaaggaagaaagggtcaaatccttaaccatagctcttgaagatacagaagaaggacgtaaggaaatgcttgaacaaaaactcttacttcaaaaagaatgcacccttgctaatgatgaacttgataagattaaaaggaaaaactcaaatctttggacgaaatgtcagcattacaaaaaaatgtcttctaagctaaactatatgcctaagggatgtgag

SEQ ID NO: 32761 - DNA, 911 bp, Glycine max
  Peptide Sequence Number=SeqID_149539
acttagccgccattgaggctttcgtcgcatatcaccatagcaaggaaagtccagtggtggctatcttggcagatttgtttgacacctttgaccggagcgcgatcaattggtttcctcgttggaaggaaggcaagggaggagttcttttctcgtgtggggactaccctaatattccattgatagggactagggggtgcattaattataatcccacactcgccataagacaactagggtatcccatgaggggagcgccaaccgaagaaagtctctcgcctttccttgtgaggaatctaggcgcacaaagtctcaaggcgatacaaagagtccacaaggcgtggagaagtccgttgacgaaagacaaggagcttaggggcatccgtaatggcgtcatcggaggttatcatggatggctaagaattcacacactcgccaaggagaagttcaagtcagctgctacacatatccagaaggaatgcaccgagttacaagaggaaaacatggccactgcaaaagcccttgaacaagaaaccaaaagggcccacaaggaggaatatggccgagagaaattccgaggagcattgtggggtagcaacaatgagctcaaaaaggagtttggctcaaaaaggagagagatcggtcacgggagtttggctcaacacttggaagccacggagcaaagcattctagctatcatagggcaatacaaggaagaattgaaccagtccatggcccatgaacaaaagctagtggaggattttgcacaagtgtatgccaaaaaaaaagcaagagggagggtgattgatgcgttgcatcaagaagcgactatgtggatggataggttcgccttgaccttgaatggaagtcaagacctctcgcgtctgttagccaaagcaaaagccatgaccgaa

SEQ ID NO: 32762 - DNA, 603 bp, Glycine max
  Peptide Sequence Number=SeqID_149540
atgaagaaatccaatggaaaatggagaatgtgcattgatcacacaaatctaaacaaggcttgtccaaaggatgcatacctactacccaacattgaaagacttgttgatggtgcttgcaaatatcaaaagctaagttttcttgatgcttattcacgctacaaccaaatcaaaatgtacctgcctaatgaagacaaaatatcattcaacactgaagatgcaaacttctattacaaagtcatgtcatttaggctaaaaaatgttggaatgacctatcaaagaggtattggaaccaatccagataagtgtgaagcagtaatcataatgaggatccctcataacttgaaagagccactagatcacagtaaactccaaccatcccctcaaacaagtcatgagaaaacccaagcttactatgaagcacttatagcaagactgaagttagcaatagaggtcagtgtcaagaaaataaagtgcagaaacgactccaaactcatcaccgagcaagtcaacgaagtcttccaagctagagaaacacaaatgcaaaatattatcgtttggtcaagaaactattggaacactttgacaaccatgaactcattgtga

SEQ ID NO: 32763 - DNA, 426 bp, Glycine max
  Peptide Sequence Number=SeqID_149541
atggagttaaaatcggaagtcataaagggctatggttataagagtttgaggaccttggttactgatgaccaagtagatcttttgttggatctcgaaaagcagaagaagaggaagagagttaagaattcctcaaaaattgaattgggaggagtatctaaacctcttggtggaagtgattttgttggagacgaagttgttgttggtgtcaacacagggatcgcaccaataaagccatccttcactaccattaaggaaacaattgctagtactgatgaaaaattcaaagtaatgtttgagcagttgaagaccatgaaagttgagtctgaagaaaataaggctttgagtactcgggttgttacattagagaaagatgttattgacgttggtgccaaacttgaggaattgtcatttgatcttgttttttaa

SEQ ID NO: 32764 - DNA, 498 bp, Glycine max
  Peptide Sequence Number=SeqID_149542
atgtggatgccctcgacagcgtcgaggaggaggaaggcagtgcagacccttcaacggtgccttctcggtccacgggaacggcggctcacggatggcgatcggcttcaccttcgacgtctcggagtagctgaactggaactcgaacgatgcttcaacattgcggaagaggaagaagcgccgcaaccatggtctatacttttgcatcagagacttctgcttttccgtggtaatcctagtcttgaatcttatgggatattaaatgtgaaaatatattggtggatgcaagtggatcggtcaagcttgcagattttggattggcaaaggacatgccaagaatgtaatatgttgtgttgtgaagaaagtacaggccgacaccttggtcatggggctatggattctttaagagaatttaaagaatacaaaggatgctaccttgaagcccaagaatccatagtaaagaacttaaatgcatttggtgccaacactctcagagaatga

SEQ ID NO: 32765 - DNA, 417 bp, Glycine max
  Peptide Sequence Number=SeqID_149543
atggaagacagttcattgaaaaaggttactaagaattcctcaaacaactcggagtcaaacatcttgcatccttggttgagcacccttagatgcatggataggccgaagcagccaagcaaaaaactattttggagaagtgctaaagttgatgtctcgctaagcgagctcaatgcgcttagcgagtgtcatccgctaatcgaggcatcaacgcgcttagcggataagaggaatctggaagggaatctgtcacgcaggcacacgctcagcacgtcatcagctcgctcaacgagtcatttgtcaccttccaggcttagtgcgagtttggcacttagcgattattcacttactcacgccaagcgtgataatggcgctaagcgcgacgtcgaggtcaatgagccctttttaagcctggaatag

SEQ ID NO: 32766 - DNA, 330 bp, Glycine max
  Peptide Sequence Number=SeqID_149544
atgttgaattggaaagaaatcatagtaaatgaacaagtttctaaagtaaagcttaggcaaggttcggatacgaccttcaaagaattgtttgaagaaaacttaagtaaggttcggatacgacctttggagagttgcttgaaaaagcttgagcaaggttcatatactacctttggagagtcacttgaaaaagtcttgggaatgaactttctggctagatctttaagtttcttgattcgttctccgggatactacttgtttgtgtggatgcaaaatctaccggcaagtgctccgggtcgtcaagctcaagtactaaacaccgatgtctcgtga

SEQ ID NO: 32767 - DNA, 420 bp, Glycine max
  Peptide Sequence Number=SeqID_149545
atggcagagcgtggccatggaatgtattacatgccacagacatttgctcagtatccgacacagatgtatcagtatccttttcagggtcatcacactgatacttctgcaagccagcattcgttcggtggtgttgcagaaacacaagctcatttttcatggcccactatgaccccttcgcagcaatatcagggtccaattccaacacctaatgccccattaggaacacaatggaatgtacagggaccaatacctaatatgggtgacttattaggtattgatttgcgtcacgaattttcagcggaggctgacgaagaagaagcggggaggcatcggggcagaagaaatcctgatcgccaagcacgaagatgggatcgaccatgtggcacatccacaaggcatcacggacaccaaaatgaatga

SEQ ID NO: 32768 - DNA, 624 bp, Glycine max
  Peptide Sequence Number=SeqID_149546
atggagcccatgatgagcatgaagaagataacgaaagtcaatgcgggtgcagctgccgttaccagcaccgttgctgaggtggacctgactcccctctctggcctcaaccaaataaatcatccaacctcgaatatggtaggttggggaggcaaagagttgggaagtgtgggcggtccccattttgtgcaagttcaaaacgagcatcccttctcgccatatggcttacctccgaactatatgccacccaatgtggcgcatactcccggtgagaatatcaataactccaatcccatactcgttgagagccaacaacctcaatctaatcatgcacatgtctctcaacccatgggggagacacatgaaataccccaccacgatctagtcgacttcaagtctcgcctcggatacgctaccgagggacaagcagttggtggtgtgcctgacttcgataagtacaacgagactacttgccccaagaatcacttgaaactgtactgtcagaagatgggggcatacgcgaaagatgactgcttatgcatttcttccaagaaagccttattggggcagccgtcacctggtatactaacttggaaccttcccgagtccgttcttggaagaacctaa

SEQ ID NO: 32769 - DNA, 645 bp, Glycine max
  Peptide Sequence Number=SeqID_149547
atgtcaaaaaatcttacggaatacgcggtaattggtgttaagcagctcaattcgactggcaagaatccaaatgaactacctcaaaaccaaacttcacctcatgcaaggaacaacaggagaagaaggagcagaggtggagggagaaaatttgatcaaggagatattttgatggaacctattgtgactagtggtgttgaaaatggaaacaccatgtgtggtgaaaaagagatgagttaccttactttaagcaagtctttgagctttgctcctagacctagctatggacaagttagaagaaagtgcattgtgaaggctaaccacttctttccaaagttactagacaaggacttgaaccagtatgatgtcagtattacccctgaagtgtcttccaaagcaatgaacaagtccattatagtagaactagtgagactatataaagagtctgaccttgggatgaggcttccagcatatgatggcacaaaaagtttgtacattgcaaggacacttcccttttcaaggagaaattttaagataaaggttgtggatgataaggatggagttaatggctccaacattcaaattaagctcaatttccaactgacacttgcaccattttcaaaagggaaagagaatatagagtggtga

SEQ ID NO: 32770 - DNA, 423 bp, Glycine max
  Peptide Sequence Number=SeqID_149548
atggatttggtgatgattccattacaatccgacaacaagagctcctcattgttgaccttgatgtcctcctttcatgccttcatcacaaacatattgttcactaaaatgcatgcaatgatgtccacccttatggacctaatgggaggtagaaacattgttctggttgatgctataagctgtagaataccattggttagtgacatatcaagtataatatttggagcggatgctacccatcctagaaatggagaagactccaacccttcattactagatgtagtagcatctcaacactggcctgaactgaaaaaatgtgttggtttagtgtgtgctcaagctcatagacaagaactcatacaagattcctacaaaatgtggcataaccttgttcatgccttagtcagtggtggtatgatccagtaa

SEQ ID NO: 32771 - DNA, 496 bp, Glycine max
  Peptide Sequence Number=SeqID_149549
aaagaccaaggtcaaggcatcttaggggtgacaccttctatgcccaaagatgaggaggggaaggcaatagaaaagcaagcccctaaggctagtatgcaagagaaaactagctctataaagtgctttaaatgtcttggaagaggacacattacttctcaatgccccaccacaaaaaccatgattatgaggggccaagacatttatagtagccaagatgaggctactacttcaccttcctctagtgagagtgaagaagcaaaaggggaagaatctagtgaagaaatctacccccaagaagatggacaaccattagtggttaaagagaagtgtaaggagacacttgctagcattgccacacctcttgggcttgagtttattcctcaagtaaagaagttgttggatgagggtgttgaggaaaaaagcccaaagtttcaagaacctcgggatttgaggtcaaatccttttcaagggggagggaatgatgcaatcctacccc

SEQ ID NO: 32772 - DNA, 564 bp, Glycine max
  Peptide Sequence Number=SeqID_149550
tttgattactccaatcttgatgccaaccgtatggtctacaatgatcaggcagatatgaccgacagattgtttgccggttcattgacattcgattgtcgcatcatgcactacatcattgttcgtattctattacccagatcatcaaacttagctcaagcctctgaagaggatttaatatttatgtgggcttttctcattggtcgtccgatcgactgggcccatttgatcagataccgcatgcataaggcattgcgtacggtaacctcctttggctaccgtaaggacatggatgggaaatggttgaagaaggacatgcaacctccacaagacgaatgtactcgctctcctccacctcaacgagatgactcctcaactctcatgcatgaagttctttcggtgttacgaggcctccatacctatgttggtgagcactttgattccttggacggtcgtatcaatgccattgatgctcgctttgtaggcatggatacccgcatccctcagcttgaggaggatataagttatgttcatcagtgcttcgatcttccaccaccatcttcatag

SEQ ID NO: 32773 - DNA, 418 bp, Glycine max
  Peptide Sequence Number=SeqID_149551
atgagtttcgttaatgttcgatttttgcaggatgtgtggaaaaaggcacaggccatccagaagcaaaacaccgccccccacttgttgtctcgtgggggttatgaatatttagaacagaagttgatggttgagaagacaaagaaaaaactggaggaagttgctcaatttggaagcactgaggctgtgattgaccctccatctcccatcacacgacacgtgaagtggaagatggcccgcaccaagaaaactgggcagatgacgtctaaggcaacaaaggaaattgttgagaagattctaagtcattttcaattaagaattgcgttgcagggttcctttgtcccccataaacgtcaggatctcctgactactgccattgggcgaccagaacaccctggccgtgtgcgtgctgctggagccg

SEQ ID NO: 32774 - DNA, 294 bp, Glycine max
  Peptide Sequence Number=SeqID_149552
atggatgtaatgttgtttctttgctgtagtggtgaaattttgtcttgcacactttgggagaattactgtactcagttcctatcctatttgaatgaacgtggggatgatgggccgatggttattatattgacacatgccagaataaaagatgcacagggaagttatccagcttcagtgagcaattccttcaaggcgtcaaaactattgattaatgatcctatattggaaattcaagaatttaaagagaggtattttgcttatcatctttgctctgtggttgttaaattcgtgtga

SEQ ID NO: 32775 - DNA, 273 bp, Glycine max
  Peptide Sequence Number=SeqID_149553
atgggatacgtagctaaaacccaaaggaatagaggagcaatggggaaaaagtgggaactaagaaagagtagcaatatatgtatatacatcaagtatggccaaaatacatcatcaagcatggccaacaaaaacatatcatccaatgaaacatacccccccacacttattcccaaaacaattccaaagctccaaaattccttaagggtagggaaaaatcatggtttttcacttaaggcttgtaatgagcttcaaaacaaagaaaggggaacatag

SEQ ID NO: 32776 - DNA, 723 bp, Glycine max
  Peptide Sequence Number=SeqID_149554
atggcgtttctggtgcgcaaggacaacccgaagggcatccatacctggaacgatctggtgcgcgacgacgtgaagctggtgttcccgaacccgaaaacctccggcaacggccgttacacctatctggccgcctggggcgccgccagccaggccgacggcaacgacgcggccaagacccgcgccttcatgacccgctttctgaaaaacgtgctggtgttcgataccggcggtcgcggcgcgaccaccaccttcgtcgagcgcggcttgggcgacgtgctgatcagcttcgagtccgaagtgaacaacatccgcaagcagtacggtgaagacaagtacgaagtgatcgtgccgccggtcgatattctggcggagttcccggtggcctgggtcgacaaaaacgtcgagcgcaacggtaccgaacaggcggccaaagcctatctgaactatctctacagcccggcggcgcagcaggtgatcaccagcttctactaccgcgtgtatgaccagaaagctatggcggcggcgaaggggcaattcccggacacccaactgttccgcgtggaagaccagttcggcggctggccacagcctcggcagcagcctgttttatacctgtttgatcctgctgttgccgctcaccgcgctggtgatgcagctggcacagatgagcctggcgcaatactgggaagtgatttccaacccgcaggtggtggcggcgtataa

SEQ ID NO: 32777 - DNA, 219 bp, Glycine max
  Peptide Sequence Number=SeqID_149555
atgggtgccaagcacctcacgaggaccaaagaatggtcgcacgtcatcgagcaaaggtccccggacgaaattaggttctcacccaataggttccctcctacaaggtcaggacgaaagacaacgattgatacctcaaagccttacactggggcaatgaggggcactgtgcatgagcctcaagtgaacataggggccgatcaaaagttctcacccatcgat

SEQ ID NO: 32778 - DNA, 570 bp, Glycine max
  Peptide Sequence Number=SeqID_149556
atgaagagggactttggccaattctcgaagcttctgcatgaagcttcccagatacaaagagctattaatgttgctttggtgaaggaattttatgctaatctctacagctctgagggtccttcaccaaagcaacccagagttaaaggccacctggtgaagatagacgtagacagcctcaacacatttctagagattcttatagtcctagaggagggggagacattacccatctactctaggtactgtaggttacccacagaccacagagagattgaggttgctctctgcatacctgggagggggttcattttgaatgctgaaggccatctgaggaggattctcaagaaggatctgactaccttggcccaggtgtggagtgttctctcttactccaacctggcccctacatctcatacattagaccttacgatggacaaagctaggttgatctttggcctggtctctcatatggatatgaacatcggcgctctcatattaggacagatgacttccattgcccagtctaactcttttagacttgggtttcctgctttgattaccgccttatga

SEQ ID NO: 32779 - DNA, 1488 bp, Glycine max
  Peptide Sequence Number=SeqID_149557
atgacttgccaagttcgccctggcgaccacgccagaaggcattgttcccgcgctgctcaagcacctaaactcgctcgacgtcgacaccatgctcggcttctacgatccggctggcatgatcgtcgatgcgacgggcaagcctcatatcgggcgcgaggcgatcggcgccgaactggcgaaatatttcagcctcggactccagatgtcgatcacccagcgccacctcttcgtggccgacgatatcgcctcgcttatcctcgactggtcatatgtcggcgtcgctcgggacgggacggaggtgaacatggtcgccacagccaccgacatcgcccgccggggcgacgacggctgctggcgctatctgatcgacaatccgttcggcgccgcccgccgggatgtcgcttgatgacgggcgccgccgacaacgcggatgacgcccgatgggcgcgcatagcggcgcgtgatccgacggcggacggcgccttctggcgcggcgtgacgacgaccggaatctattgtcgtccgacctgcggcacgcgaaggcccaagcgggagaacgtacggttcttcgaccaacaggaagaggccgaggcggccggcttccgcccttgccggcgttgccggccggatgagggcacgccagccacacgcaacgtcgagctggtcgctgaagcgtgccggttgattgaagccgacgtaggcgtgccgtcggtctcggccctggcgcacgcgctgggcgtcagcgagggtcatctgcatcgtctcttccgcgcccggaccggtcttacccccagggcgtacggccaggaaaaacgcgcgcagcggatgcgcagcagcctcgcgctggggcggcggatcaccgagacgatctatgagactggatacgggtcaagcggccgcttctatgccgtaacccgcaagtccctgggcatgacgccgacccactaccaagcgggcggcgcgggcgagacgctgaggtttgcggtggggcaaacctcactgggcgcgatcgtcgtggcttccagcgacgctggcgtcgcggccattctgctgggagacgaccctgagaccttgctccgagacctgcaggagcgcttcgtccacgccaccctcatcggcggtgatcagtcctacgaagccctggtcgctcaggtggtcggcctagtggaagagcccgcgaccgcagagcccctgccgctggacgtgcgcggtacggctttccagcgccgcgtctggcgagtgcttcaggccgtgccgccagggtcggtaatctcctatgacgagatcgcccgccgggtcggtcgcccccgcgccatcggcgccgtcgcgagcgcctgcgccagcaacccgctagcggtggccattccctgtcaccgggtggtcaagagcgacggcgggtactggagctacacctggggtcttgatcggaaacgggcgctgctgctgcgcgaaggcgccgaaacccagtccgcatccgtcgccggctga

SEQ ID NO: 32780 - DNA, 321 bp, Glycine max
  Peptide Sequence Number=SeqID_149558
atgcacgaacagcgcttagcaatcaattcgtggggctatggactcgatggtggaggatgcatgaatgataatcaattcatggggctccgaataagatttgatggtggaagatgcacgaacagtgctaggcaattatttcgtggcgctccggactcgatgcgcttagcaatcaattcgtggggctatggactcgatggtggaggatgcatgaatgataatcaattcatggggctccgaataagatttgatggtggaagatgcacgaacagtgctaggcaattatttcgtggcgctccggactcgattgtggaggatgcatga

SEQ ID NO: 32781 - DNA, 900 bp, Glycine max
  Peptide Sequence Number=SeqID_149559
ccgagccgatgctcggctactgttcgctcttgatagcgtcgagccatgctcggctgctgttcgaccacccgtcgaccatggctcgacgctacagaaagcagccgggcgtgggctcggctctacagtgctggcatcacgccgcgtcgatggcctcggacaggcgctccaccgcgatcacttccatgcctttcaccgaaccgcccttcggcgcattggccttgggcacgatggcgcgcttgaagccatgggtggccgcctcacgcaggcggtcttcgccattgggcaccggccggatctcgccggacaggccgacttcgccgaaggcaatggtcttctccgccagcggccgatcctgcagcgaggacagcaccgccagcagcaccggcaggtcggccgcggtctcctgcacgcgaatgccaccgaccacattgacgaacacatcctgatcgccgaccagcacaccgccgtggcgatgcagcaccgccagcagcatggccagccggttctgctccaggccgaccgcgacacgacgcgggttcgacagcggcgacgcatcgaccagcgcctgcacctccaccagcagcggccgggtgccctcgcgggtgaccatcacacagctgcccggttgatgggtgctgccaccggacaggaagatcgccgacggattggagacttccttcaggcccttgtcgcccatcgcgaacacgcccagctcgttgactgcaccgaagcggttcttgaaggcgcgcagcaggcggaagcggctgccgctctcgccttcgaaatacagcaccgcatcgaccatgtgctcgagcacgcgcgggccggcgatgccgccctccttggtcacgtgaccgaccaggaacacggcggttccggtctccttggcaaagcgcacca

SEQ ID NO: 32782 - DNA, 201 bp, Glycine max
  Peptide Sequence Number=SeqID_149560
atggcgaggacgtgtagccctctcaaggcgaagacgtgtagtcctccgaaggtgaggacgtgtagtcctctgaaggtgaggacatgcagtcctctgaagattgattgtccttttgaaaaaggtgataattcatgtgaccttatcctatcttttgcaaatctctccgggaactccctcagagtgtatgttctgtttgattga

SEQ ID NO: 32783 - DNA, 207 bp, Glycine max
  Peptide Sequence Number=SeqID_149561
atggaacacttacttgttggtgatgaacaaaagcacaaaacggaatcaaaaaatgcgaaaaaggatgaccctagggctgcaaactcgtcaatcccgtgggggtggctcgcccaggcgagcccagttcgcccaggcgagctaacctgcacatttttttttgtttttgaggggaacattaaccatgtcccctcccttctcatggattag

SEQ ID NO: 32784 - DNA, 843 bp, Glycine max
  Peptide Sequence Number=SeqID_149562
atgcgtcactcggctgcggtcgaagatcttgggcaggtaggcctcgggccacttgcggatgccgggaatcgacgaaccctcggccggctgcgcgcccaccacctgcaccgccgggttgcgcgacttcaggtaggtggacacgcccatgatggtgccggtcgtgcccatggcgctgacgaagtgcgtgacgcggccttcggtctgcgtccagatttccggaccggtggtctcgatatgcgcgcgcggattgtcggggttggcaaactggtccagcaccacgccgcggccgtccgcctgcatttcggtggccagatcgcgggcgtattccatgccgcccttgtcggccggcgtcaggatcagctcggcgccataggccgtcatggccgcgcgccgttccaccgacaggttgtcgggcatgatcaggatcatgcggtagccacgcatggcggccgccatggccagcgcgatgccggtgttgccgctggtcgcctcgatcagcgtgtcgcccggcttgatgtcgccgcgctcctcggcatgcctgatcatggacagcgccggccgatccttgaccgaaccggcggggttattgccttccagcttggccaggatgacgttgcctcgggccgcaccggcggctccgggaatgcgctgcaggcgcaccagcggcgtattgccgacggtctgctcgatagtgggataggtagtagtcatgctgccgatcataaccccgcccggcgccgggcgccgccaaaagccgcgctcgtgccaggggttcacgccacggggcggcccccccctgccccaaggccggccaacgcgggaaggcctcctcgcgcctatccg

SEQ ID NO: 32785 - DNA, 651 bp, Glycine max
  Peptide Sequence Number=SeqID_149563
atgtccttgccatcagaggactacacgtcctcgccttcagagggccgcacgccctcgccttcagaggactacacgtcttcaacttcaaaggactacacatcctcgtcgtcaaagggtacatgtaccttcacctttgtagggctacacgcccccaccttcagaggactacacgtcctcgcctttaaaggactacacgtcctcccctttagaggactacacgtcctcgccatcagaggactacacgttcttcccttcagaggactacacgtcctccacttcagaggactacacgtcctccccttcagagggctacacgccctcgccttcagagggctagacgccctcgcctttagaggactacacgtcctcgccttcagagggctgcacgccctcgtctttagagggcttcacgtcctcaacttcagagggctacacgccctcgcctttagaggactacacatcctcccctttagagggctacacgcccccaccttcagaggactatacgccttcgccttcagaggactacacgtcctccccttcagaggactacacatcatccccttcagaggactacacgtcctccacttcaaaggagtacatgtcctccccttcagaggactacacatccttgccatcaaaggactacac

SEQ ID NO: 32786 - DNA, 174 bp, Glycine max
  Peptide Sequence Number=SeqID_149564
atggcatttggtggacctgcagctcacccaggcaagctgagacttagccatgaagcaattggctcacctaggcgagccagagactggtgtcgaacaacacaaaagatgtccataagcattcactacaagaaaaatgacctaagcctacggacgcctttttgctacagacattaa

SEQ ID NO: 32787 - DNA, 435 bp, Glycine max
  Peptide Sequence Number=SeqID_149565
atggctcttgggtcaaaaagggtgctcaacccgctgatgatgaaggcaacctaccaactaaagatagttcctctcttcttcgaaagcttttggacaagttcgatggtctttagacttttgttggtgacaagtttgatgccatggaattgcaagtcgacatgcggttcgatgccatggaatcaaggatcaccaaagtcgaagaaaatgtctccttcatccgtacttgctttgatccaccaccactacctccatcatcctcttagcttatttgttattattatgactaaggattgtcatcatcaaaaagggggagattgtagacaaaggatcaagctgaatgttttgatgatgccaaaggatcacatgtttctcaaagctttattcaagacaaagaaattaaagatattcaagatggatgatcaagacagtctctag

SEQ ID NO: 32788 - DNA, 297 bp, Glycine max
  Peptide Sequence Number=SeqID_149566
atggtcattcccaagttcaaggtaccgaactttgacaagtacaaggggactacttgccccaagaaccatctaaagatgtattgtcggaagatggggccatacgaaaaagatgggaaactgctaatacatttcttccaagaaagtcttactggggcagctgtcacctgtatcagtacaattctgatatggcttcggataggatgcaactatagagcatatgcaagagggggcacggatctttcaaagaatacgcccaaaggtggagggatctggcagcccaagtggttccctcaatga

SEQ ID NO: 32789 - DNA, 192 bp, Glycine max
  Peptide Sequence Number=SeqID_149567
atgcatagatctcccacaggtaatttagttcctctagacttagaaattgaagctacattgcaaaggaacagggccgagaggagaaggaaacttctgcaagatagaatagttgcatccattcttgaagacaagcctgctccagaacacaatgtctggttacaagtaatggaaggagatcaagaggttctaaaa

SEQ ID NO: 32790 - DNA, 980 bp, Glycine max
  Peptide Sequence Number=SeqID_149568
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcagtttcgagggatccagcggctttgttggcgaagtactctgatcctttggtctacacaggacctataagggtacgaactggccacgaaatattgcggatatcctcgtacttaatgcgaaacttcaactctgtgactgtgccattctttgtcctgcacggaactgctgataaggtgactgatccactggcctcacaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 32791 - DNA, 738 bp, Glycine max
  Peptide Sequence Number=SeqID_149569
atgtcttgcaaaccctttaagccttccattttgcatttggcaatatcacaagatgcgccccacttatatagcgaagaacagttgattcaattaaagaaattaagcaaactacttccaagtgctgaatcgaagccaaatacaaacacgactgataagagggtgaccaaaaaaagacaaattgaagagagacctaaagaagaaagagtcatgccagcaacgattaaaaaaccaagaaagataatcttggaacagaacggaccatcaccgtatttgtcaagaaggataatcttgggacatagcggaccatcaccagatttgccgccaagaaggataatcttggaacatagcgggccatcaccagatttgccaatgcaattcaagaaccgaatagctgagttgagtggtcatgatcttaaatatttgatgcacaagagactcttcttgtcagacgtgaagccgaacaacaatcgtctctccatgcccataaatgaaattatgtgtgaatttctcacacaagcggagattgaaaaattggatgaaagaaatggaagaaacggaaaaggacggctcgttggtctggaattgactgtgttagacccatgtctgagagaatttactttaccattgaagaagtggagcatgcaaaggactgacacctacaacctgggtttgcaggaagtcttagattcaaccgcagttgctgttcctagttttctggttgataaaaaggcatgctga

SEQ ID NO: 32792 - DNA, 1452 bp, Glycine max
  Peptide Sequence Number=SeqID_149570
atgggttgcttacactccaaaaccgcacatcttcactcccctgaagaccctcctactgccttaccagactccaaaaaacccgatccagggaatggtggtgatgatgttgatcaagagtgtcaggttccagcattcaaagagtatggcctgattgagcttagaagggccacaaatgagttcagcacagattacattgtttctgagagtggtgagaaagctcccaatgtggtctacagagggaagcttgagaacaatcgattagttgctgtgaaacgcttctccaaactctcttggcctgatgctcaacagttcatggcagaggcagctggagttgggaaagtgaggcacaagagactggtgaatctaattggttgttgtgctgaaggagatgaaaggctcttggtagctgagtacatgccaaatgatactttgtccaaacatctctttcactgggacaagcaaccattaccatgggaaatgcgtgtcagagttgcataccatgttgcccaggcactagatcattgtagcttggaaaaccgtaaaatatatcatgatctgaatgcatataggattctttttgatgaggatggtgatccacgcttatctagttttgggcttatgaaaaatagtcgagatgggaaaagctacagtactaatttagcttatactccacctgaatttttgcgaacaggcaggataatcccagagagtgtgatctacagttatggaactgttcttctggatcttctaagtggcaagcatattcctccaagccatgctttggacctaattagagggaaaaatgttttgttgttgatggactcttctctagaagggcaatatgcaaatgatgatgctacaaagttggttgagcttgcttcaaaatgtcttcagtttgaggccagagaacggcctgaaattaaatttcttcttactgctgttgcgcctcttcaaaagcagaaagaggtaacttctcatgtgttaatgggcttaactaaaaacacagcagtactaccaaccatgctttctcctcttggaaaggcttgtgcaaggatggatctcactgctgtgcatgatatattgttaaaaacaggttataaagatgaagaaggtgcagaaaatgagctttcattccaagaatggacacaacaagtgcaagatatcttgaacacaaaaaagtttggggatattgcattcagagacaaggatttcaaaaatgcaattgagtattactctaagttggtggttatgatgtctgttccttctgctactgtgtttgcaaggagagccttctcctacttgatgaacgatcaagcagaactggcattaagggatgccatgcaagcacaggctcttgctctctcaaagctgggaatggaaactgatgcacatgacatgcttaatgatggggctgcctttgaagctaagaggtctaacagctggcgcggttaa

SEQ ID NO: 32793 - DNA, 843 bp, Glycine max
  Peptide Sequence Number=SeqID_149571
atgagggacttgaaaactttaaaggaattggtggcaagcgttacagattggaagtcgcttgagaagatgtcttgcaaaccctttaagccttccattttgcatttggcaatatcacaagatgcgccccacttatatagcgaagaacagttgattcaattaaagaaattaagcaaactacttagtgctgaatcgaagccaaatacaaacaagactgataagagggtgaccaaaaaaagacaaattgaagagagacctaaagaagaaagagtcatgccagcaacgattaaaaaaccaagaaagataatcttggaacagaacggaccatcaccagatttgtcaagaaggataatcttgggacatagcggaccatcaccagatttgccaatgcaattcaagaaccgaatagctgagttgagtggtcatgatcttaaatatttgatgcacaagacactcttctggtcagacgtgaagccgaacaacaatcgtctctccatgcccataaatgaaattatgtgtgaatgtctgacagaagcggagattaaaaaattggatgaaagaaatggaagcaacggaaaaggacggctcgttggtctggaattgactgtgttagacccatgtctgagagaatttactttaccattgaagaagtggagcatgcaaaggactgacacctacaacctgggtttgcaggaagtcttagattcaaccgcagttgcttttccgttttacttttatcagaagttcacacatgtgcgcagaaggaagctggagaggaaccaaattggaattatatatgtgcagctagctgtggtgatgccaattttcaagtgtacaggtctctaa

SEQ ID NO: 32794 - DNA, 222 bp, Glycine max
  Peptide Sequence Number=SeqID_149572
atgctggcatctccggaaagggtgcaaatgaccacactggcctttgctcatcgatcacacttggggtcactgaatgacgaggtgcggataaccgtaaggtgtcccccgcaggctaccagctcttgggtcatgacaacaaaaggtggtgtggtcgacaaaagcgaggctcttgctcctacgtatcctccaatgaggaactcagacctacgtagttctggataa

SEQ ID NO: 32795 - DNA, 1098 bp, Glycine max
  Peptide Sequence Number=SeqID_149573
atggatgaatggagaagaaaaaacaccggctttggctccaaagagattcatcaatcatcagatacatcaaatgctgtccttagtcttctgaaaacctacggatgctccgaaagccagttctctgtcttgccaagaggaacctcttttgattctgaatcagatggaaaccaccataaaagtggcacctttactgtgtcttacctcattaactcatgtggggtgtccccaaaactggcaagggaactctccaacagggtcaatttgaaaaaccctgatggcccaaatgctgttcttgatcttctcaagaattatgggttctgcaaaacaaaacttgcaaaacttgttgggagacatcctttagtgcttgttgcagatgcagagaatacccttttgcctaaactcaagttctttcgttttattggggtctccgacgctggcatgcctaaaatcctgattgctaatagttctatcttgaagaggaacttggaaaaatgcctcatcccacgttatgagatcctaaagagtgtactttgtgatgatcgggaagttgttagagctttgagaaattcccctcttggttttatatatggtgacttagtgaatgccttggttccaaacattaaaattttgaagcaatgtggtgtggctcaggcatccatatcattactaataaccattgctctgtctgcagcgtatgtgaagcattccagatttgtggaagcagtcaaaacagttaaggaaattgggtttagtcctttgaaaaataattttgtcgtggctatttctgtgcttgtaactatgaggaaatcagtctgggattcaaggtttgaggtttaccagaggtggggctggaaccatgaaatgtctcttcgagcatttagaaagtttcctggttttatgatattttcaggggagacttttaccaagaaaatgagtttcctggtgaaggatatgggttggccatcagaagctattgctgaatatcctcaagttgtagcgtacagcttggagaagagaattatccctagattctcagtaatcaaaatcttgaaatcaaaaggtgtgctaacatgtacattagttccattatttgcataa

SEQ ID NO: 32796 - DNA, 428 bp, Glycine max
  Peptide Sequence Number=SeqID_149574
cttcaaattccgaatggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 32797 - DNA, 380 bp, Glycine max
  Peptide Sequence Number=SeqID_149575
ttgtttgcgggatcgcgcccgcaagacacccagtggacccgaagaagtccaacagggtcctagggtttccagctctgattacgggcctctgtcagttctacggagtgcccgtcacccctagcaagttcatcaggccccctattaaccgggctttcatcaagaagtactgcgcccccaggcaagcgcaaggcgagacaccacagcagcctagggatggccggcagcgggcaacaaacgcactgccaccacctctagagttcaccacaactcatccacaaaaaggagaaaggggttcagcccttctggtacttcgtaatcacttaaaattagtgaggaaaattgtttccgtgaagaaaatccaagccgaggagcttctgtaa

SEQ ID NO: 32798 - DNA, 1309 bp, Glycine max
  Peptide Sequence Number=SeqID_149576
gaacctcttctgattctgaatcagatttacaaccaccaaaaaggtggcacctttactgtgtcttacctcatcaactcatgtggggtgtccccaacactggccaggaaactctccaataaggtcaatttgaaaaccccacatggcccaaatgctgttcttgatcttctcaacaactatgggtttgacaaaatccaggttgcaaaacttgttgagaaacaccctttggtgcttcttgcggatgcagagaatacccttttgcctaaactcaagttcttacgttctattggggtttccaacactgacatgcctaagattttaattgctaaccatagcttgaagaggagcttgaaaaaattcttcatcccaagatatgagatcctcagacgtgtacttggtgatgatcaggaagtcgttagagctataacaagttcccgatttggtattaattatggtgacgcaatgaacttggttccaaacattgaggttttgaggcagtctggtgtgccccaagcttctatctctttcatgatgatccattgtgggactgtagcctactggaagcattccagatttgtggaagctgtcaacactgctaaggaaatcgggtttaatcctttgagaacaaattttattgtggccattgaaatgcttctgattagcagcaaagcagtatgggaatcaaggtttaaggtttatgagaggtggggctggaaccgtgaaatggctcttcaagcatttcgaaagtttcccaatgtaatgaggttgtcagaggaggcatttagcaagaaaatgaatttcctagtgaatgatatgggttggccatcagaagaaatcgctgagtatcctcaagttgtagcatacaacttagagaagaggattatccctagattctcggtaatcaaaatcttgaaatcaaaaggtttgcttgagaataatgtatcctttagttccattatatgcataactgaagaaaaatttctggaaaattttgtgatcagtcttcagaaagatttgcctgtcttaccagacctctatagaggaatctcttctgatgctgaatcagacgatgaaaaccaccacaaaggtgacacctttactgtgtcttacctcatcaactcatggggattgtccccaaaactagccagtgaactctccaatagggtcaatttgaaaaacccagatggcccaaatgctgttattaatcttctcaacaaatatgggtttgaaaaaacccatcttgcaaaacttgcggagataaagccctccgtcattgctgcaaatgcagagatacccttttgccgaaactcaa

SEQ ID NO: 32799 - DNA, 672 bp, Glycine max
  Peptide Sequence Number=SeqID_149577
atggctccaaagaaactctccacgaagaggtctagaagagacgccgcagcggaagggttcagtgccacccccgagtttgatagtcaccatttccagagcgccgagcaccagcagcgcttcgaggccatcaaaggatggtcgttccacagagagaggcacgttcagctcatggaggatgagtatacgaactttcaggaggagatagctcgcagacgttggacgtcgctggtgactcccatggctaagtttgaccttgaaatagtcctggagttctatgctaatgcttggcccacagaggagggagtgcgagacatgcgttcgtgggtgaggggtcagtggattccatttgacgtggatgccctcagccagttcctgggtgacccgctagttttggaggaaggccagcaatatgagttcagccagaggaggaacagggccgatgggttcgacgaggaggatttcacccggaccgctgcagggaggtgggtgcggatcatgtgcaccagcatgacaactttgacccagacgtggatgacactgctgctcaacaatgtcttgcctagcgatcataactccgatctccctctacctaagtgccatttggtgtatgccatcctaacacggataagcgtccacgtggcccaggtatgccaccctccaggcaccctctag

SEQ ID NO: 32800 - DNA, 1392 bp, Glycine max
  Peptide Sequence Number=SeqID_149578
atgtctggtgttcttctttgggtgagttgtggacccaaggagaaccctatctccattgttggtcttggcgggagaggtggcagaagccagaggaggtttggactgtgcaatgggatcagttttgcaagcttttcaccagcagtggcagacccttcaagatcctcagaggagagggtatatgaagtggtgttgaaacaagcagcactggtcaaggagcaggacaagggtacaaagagagcactgaatttggacaaaccaacaattgaaggtgatttaaccaatggggatctgttgagtgatgcttatgataggtgtggtgaagtctgtgctgaatatgccaagacattttatctaggcacacaattgatgacccaagagcgcagaaaagccatctgggccatatatgtgtggtgcagaagaacagatgaactagtggatggacctaatgcttctcacatcacaccaaaggccttggacaggtgggagcaaagattatctgatgttttcgaaggccggccttatgatatgtatgatgctgccctctcagatacagtctcaaagtacccagttgatatacagcccaacttcaagatggtatcaaagatcgtcgtagatctaatattgagtcaccctcaactgttcaaaaatctaccttgcagctttccaaagatgtccaattctaagtgtgaagaggttgtgttggacaatctttttaggttgagttggcctagatcaaattcaagaacaaggaaaatggtggtgctcaaagccacaaaacatccatttaaggacatgattgaagggatgaggcttgatctgagaaagtcaagatacaatagctttgatgaactctacctttactgctactatgtagcagggacagtgggccttatgagtgttccagtaatggggatagcaccagaatcaaaggctacaacagagagcgtttataatgctgcattggcacttggcatagctaatcaacttaccaacattctcagagacgttggagaagatgcaagaagaggaagagtatatcttccacaagatgaattggcacaagctggcctaacagatgatgacatttttagagggaaagttaccgacaagtggcgcaatttcatgaagggccaaatacagagagcaaggatgttttttgatgaggcagagaagggagtttcggagctcaactctgcaagcaggtggcctgtatgggcatctttgttgttgtatgggcaaatcttagattctattgaagctaatgactacaataacttcactaaaagagcttatgtaggaaaagttaagaagctcttatcactacctgctgcttatggaagagcacttctaggcccccaaaagttaaccaagatggttacaagaagtatgtaa

SEQ ID NO: 32801 - DNA, 966 bp, Glycine max
  Peptide Sequence Number=SeqID_149579
atgaaatacaagttatttggagcaaaaacagggctacatgccagtgaaataattttgggagcagccaactttggtacaagaaaaggctacggagccgatcccgaagagtcaaaaaagattttaacagcttatgcagaagcagggggtaattttatcgatatatcggatgtctatcaatttggagaggcagaagaaatcgtaggcaactatctacaggggcagcgaagtaactttataatctgctcaaaatatacccgaagtagtgacccccagcctgccatcagtaatttcgggaataaccgtaagtctatgcgacaggctgttgaacaaagtctaaaaagattgaagacggactacatcgatatttacatgccccattatgatgatggtgtaactccattggaagaaatcgctttgggacttcaagatctggtcagcgaagggaaaatagtgtatgcggggctcagtaatttcccagcatggaaggcttcggccattgcatcagcaacaaaactcacaggtttacagatagaatataatctattgcaacgtaccgcagaccgcgaactgatcccgatggcaacggaatttggtctgggcctgatgatgtactcgccactggctggcggactgctcaccgccaaatatagaaagggagaagccggtcgcatcagtcattcttctgaggctgcatatgctgaaaacgagaaaaccaaactgatcattgatgaactggtagcaatcgcagaaaaacaggaagcaacgcccggtcagatcgcttttgcatggaatttatcaaaagaggcatttcccttactgggagcacgcaatatcaatcaatttgagcaaagcctgaaagcggctgaaataaatttgacagccgatgagctgaccaaactagatgctttaagctccattagcctcgggtatccgcacgatctgctgaattctgtggggatcctctag

SEQ ID NO: 32802 - DNA, 276 bp, Glycine max
  Peptide Sequence Number=SeqID_149580
atgtgtaatcagttgcagcaaggcaggctaagtgtaatcgattaccaaaaagatagatctttcttaatcggtgctgatgtggttgcctcctttggttaccgcaaaaagcgtgatggctcttgggtaaaaaagggtgctcaaccaaatgatgatgaaggacacttactggttgaaggggactcttctctccttcagagtaatttggataggtttgatggacttcaaacctgtgttggtgagaggtttgactctttggaaagtcaagtgaacacatga

SEQ ID NO: 32803 - DNA, 1005 bp, Glycine max
  Peptide Sequence Number=SeqID_149581
atggcaacttcactcaagtgtggtggaataattgtggcatgcacatttgaccatcgcgtagcagatgcttattccacaaacatgttccttgtttcatgggccgatatggcccagcccaccaagcccaacaacaccctcgtcgtcactgtcgccccaaccgcttctcgccacccatgtttccgccgctccctccttagtcctcggcgtccaggttccattcacccttccctacaccacatgtacacccccatctccgagcttcctcctcctccatccatcgcctccgccgctctcctcagccgcatatactacgtcacggcggagcagctccacctcatgcaagtcttcgccgccacacgcacaaagctcgagtgtttctccgcattcttgtggaagatggttgcacgtgcggcttcgaaagagaaaaatggtaaaagggttgtggccaaaatgggcattgtggttgatggaaggaaaaggcttggcaatggtgacaaagagagtgaagcaatgatggagagttattttgggaatgtgctttccataccctttggcgggaaaccggtggaggagttggtagaggagccgctagggtttttggcggaagccgttcacgagtttttggcggccgccacaactgaggagcacttcttagggctaattgattgggtggaggctcaccggccggttcctggtataactaaaatttattgtaacaacgccgacgatggaccggcctttgtggtgtcctccggacaaagatttccggaggacaaagtggattttgggtgggggaaggttgtgtttgcctcataccattttccttggggtggtgaaactggttatgttatgccaatgccaagtcctttgagaaatggtgattggattcactactacaaaaagccttttttaagacacgcactttacgtcggttgtataaggaaccgctttaataagtggtgcggtggcatttttgaaattattggcttgcaaatggcattttag

SEQ ID NO: 32804 - DNA, 213 bp, Glycine max
  Peptide Sequence Number=SeqID_149582
atgtatgtaggttacgaggaaattatcatgaatccaattatttctgctgcttctgttattgctgctgggttggccgtagggcttgcttctattggacctggggttggtcaaggcactgctgcagggcaagctgtagaagggattgcacgacaaccggaggcagagggaaaaatacgagcattagcacttttatttgctaatccttttgtttaa

SEQ ID NO: 32805 - DNA, 213 bp, Glycine max
  Peptide Sequence Number=SeqID_149583
atgaaaatgagaacgcgtagccctttaaaggcgagggcgtgcagccctctacaggcgaggatgtgcagtcctctgatggcgaggacatacagtcctctaaagattgactgtccttttgaaaaaggtgataattcatgcaaccttatcctatcttttgcaaatctctctgggaactccctcagagtgtatattttgtttgatttagtcacttga

SEQ ID NO: 32806 - DNA, 366 bp, Glycine max
  Peptide Sequence Number=SeqID_149584
atggcgaccaactgtgcgagcacaaccagagggggaggctatcgcgcagctactgtgcataccaatgaggatcgcgcccacaagacacccagtggacccggaggagtccaacagggccctagggtctccagctctagttatggtcctctggatcgcgcccataagacacctagtggacccggagaagtccaacagggccctggggtttccagctctagttacgggcctctggatcgcgcccgcaagacacccagtggactcgaagaaagtcaacagggtcctggggtttccagctctgattatgggcctctatcagttctacggagtgcctgtcgcccccagcaaggtcctcaggccccctattaa

SEQ ID NO: 32807 - DNA, 204 bp, Glycine max
  Peptide Sequence Number=SeqID_149585
atgtcactaaaaatcacgaaggaggtaaaaaagcagttcgacgctggtttattggcggtagatcgataccctgagtgggtggctaacattgtgctggtccttaagaaggatggaaaggtacgaatgctacaatcaaataaagatggcaccaaaggatatggaaaagaccacgttcatcatcctctggggaacgttctactataa

SEQ ID NO: 32808 - DNA, 303 bp, Glycine max
  Peptide Sequence Number=SeqID_149586
atggttgtcatatatatgctattttttttaactagtgcaataaagacaataaccaattcttttcaaggcatgtctaatcaaggtgcacctaggtgggttgaacccaagagtaatgttcaaagtggagggtttgagtgcggatattatgtgatgcattggatgtggtgcatcgtgactgcgagtttgaaggatgactggcacaagtggttttttgatggatcaccgttagacgtagaggccatcacaacagttcggcagaaatgggcaacttactttttaacttttaggaaaagcagttgctaa

SEQ ID NO: 32809 - DNA, 936 bp, Glycine max
  Peptide Sequence Number=SeqID_149587
agaactgcacgtcctcgtcttcagagggctgcacgccctcaccttcagagggctcacgccctcgcctttagaggactacacgtcctcgtcttgaaaggcatgcacgccctcaccatcagaggactacacgtcatcacctttagagggctacacgttctcaccatcaaagggttgcacgctctctcctttagaggactagacgtcctcaccggtagaggactagatgtcctcacattcagaggactagaagtcattaccatcagagggctgcacgccctcacctctagaggactacacgtcctcatctttagaggaatgcacgtcctcgtcttcagagggtcgcacgccctcaccttcaaaggactagacgtcctcgccattagagggtggcacgccttcaccttaagaggactacacatcctcgccatcagagggttgtacgccctcacctttagaggactacacgtcctcacgttcagagggctacatgtcctcaccttcaaaggactacacgtcctcgccatcagagggctgcacgccctcaccttcagaggactacacgtcctcgcctttagaggactgcacgtccttgccatcagagggcggcacaccctcaccttcagagggctacacgccttcgcctttagaggactagacgtcctcgtcatcagaggactagaagtcctcgccatcagaggactagaagtccacgccatcagagggctgcacgcccttaccttcggaagactacacgtcctcgtatttagaggactgcacgtcctcgccttcagcgggcggcacgccctcaccttaaaaggactacacgccttcgccatcagagggctgcacgccctcactttcagaggactacacatcctcgcctttagagaacttcacgtcctagtcttcagaggactacacgtcctcgtcatctga

SEQ ID NO: 32810 - DNA, 243 bp, Glycine max
  Peptide Sequence Number=SeqID_149588
atgtcaaatgaagaattgaagttgcaggatccacgatgtcggatacaatgtcctgacatcctgcccgagaatactggagttgctgtacaatgcaagataaaaatttttcagaagaagatagatctcctccagcatcaaggagttgcagcccagaaacgcaaattgctatataatcatggaggctgcacgagttctgtaccaagtccgggattgaagagttattttgtgagttttgggacttga

SEQ ID NO: 32811 - DNA, 147 bp, Glycine max
  Peptide Sequence Number=SeqID_149589
atggtcaaatactgtgccaaatccaagacagggatgaatcaaggtacttggggacgggcacgaatggacgctaggcccatgatcaacatatcgatgtcccgcgtccagctctggacaagcgagaagcgctactgggaggcagcctag

SEQ ID NO: 32812 - DNA, 525 bp, Glycine max
  Peptide Sequence Number=SeqID_149590
atggccgcagttcggaggcgggtgtggcagttatcttcaattccaggtttcggggcttcgaaattggaagtgtcgtcgtcgttccaaagagcaattctcgatccatttcctgtttcggggaccagacacttttcccaagtggtgaaatccaacggcaaacactcgttccaaagagcaattcttgattcatttcctgtttcggggaccagacacttttcccaagtggtgaaatccaacggcaaacacctgttcctcgttgacaccttggcccttgttaggagactggaaggcgaaggagtgccctcaaagcaagccgaggcgataaccgctgccataactgaggttttgaatgacagtctcgaaaatgtgtctcagtcgttggtatcaaatggtgagatgcagaaaattgaaatgatgcaagaatccaacctgtctaagtttaaagcggaggtgcagagctcacagggcttggtactggtagtgaacatgctagggctgaatgaaagatttgtgtgttgcttataa

SEQ ID NO: 32813 - DNA, 315 bp, Glycine max
  Peptide Sequence Number=SeqID_149591
atggggaatcagaggatcctaaaacaaggcagcagattcctatttctaacaaaatctctcctaacaaaagaaatctgtgatgttcccacaaaattggcacacttgtcggggaaggctccaagggacaatcaaaggatcgttgaaagcgtcaattaccaattgagagtctatttccaaccaaaggttatgccaacccctttggtgagccctttcaatggctctaatatagcaacgaataactcagcaacaagagtgtttcatggagttagccatattacccttcttgaagcagctagtcgtcagtgcaaaggctga

SEQ ID NO: 32814 - DNA, 391 bp, Glycine max
  Peptide Sequence Number=SeqID_149592
atcaaacaaagctggtaagttgcttgctgaagtattgttaagaggataccagggaaataggcctgagacactcataggttactcacttggggcaagagttattttcaagtgtctacagtatttggctaaaactgaaaacggtgctgaactagtagaaaaagttgtgcttcttggagcacccatcccaatcaaggatgagaacggggaagcagctagaaagatggtagcaggaagatttgttaatgcttattcaaggaatgactggatgcttggagttgccttccgggccagccgtctactcactaaaggattagctggaatccaacctgtcgatattcccgggatccaaaatgccattcgtctaatccgtgggccacacaaaagatcttag

SEQ ID NO: 32815 - DNA, 480 bp, Glycine max
  Peptide Sequence Number=SeqID_149593
atgagtttcccatcgccagtcactttccaggcactgccaccggccaccgtcagagctcaagtgacctctctggccgacaaacccaccatcaggagcacccacaaacaatccacccaatgtcatcgatggcaccaccatcggacaccaggcgcgccctcacgcggatatcctaggctcaccaaacagtatcaacgccaaaagttttaccagcacgtccgaccgacacctaccccaaaagttaggggtcatttcatgtttatttggcggttctcctttgttttccttttccgtgcagcccttcttcgggaccgtcacactagtcttctcttcctctgcctcaaggtgtccccaatggacctttctgctttttcatgggtgaatcgtgcctatcatcattgccgaagaccaccacgacgtccatgtgcgcaaccaactcaaaacacagccgcaagcgaccccacacagggccctagtgcgtga

SEQ ID NO: 32816 - DNA, 384 bp, Glycine max
  Peptide Sequence Number=SeqID_149594
atggtaggatgtcttggggaaacaattgcaatcctcaagggacaccatttttctctcttacaacatgagactgagaagcttaggaatgatatagagaagatgcgtagtgagctgaggcatgagatagataaagtcactgctgggcagcgattagatttgaaccttgaaagggggagaataagggaggaattgtctaatcagaatgctgaaactaacaacctgacaaacaaacttgatagagtaagcaattatggatctgtctgggagatccattctttaagagcacaactggaagcagccaaatatgatgtcataaaatactgcataggaacacttgtttcgatctctgctgttggtcttgctgttttacgcatattgatgtaa

SEQ ID NO: 32817 - DNA, 498 bp, Glycine max
  Peptide Sequence Number=SeqID_149595
ggaccaacgttccttgggttcattgcaagaagcaggatttgcttcttggttgatcactggacacaaaagaccaacatcttttgggttcattgcaagaagtggatacaacttcttggttgttatcactggacacaagggaccaacttccttagggttcattgcaagaactgggcataacttcttggttgtaatcactggacacaaaggaggggattcctttgtggttcattgcttcgatagcagcatctctaacggttccattcctcaagattttcctctggttgctctcataaggtttccaaatgttagagagaaggagaagagattgaagctttcattccactgtctgcgtgcaatgagtatttcttcctccccatacattattttgcaaatatcaacggtgaaggttttgggtctctgcgggaaaggagaaggttatgatgcaaaggaaatttctatcacctccgacatttgtttgcaatttccaacggcgagaat

SEQ ID NO: 32818 - DNA, 327 bp, Glycine max
  Peptide Sequence Number=SeqID_149596
atgaccaaaactgtgccctcttatgtaagggtaaaggctaaagggatgatctacacaacaattgacatgttctacctcacagatgagcaactagcaaattcaccttctaaaaaagatggcatagatgaagccactgagaccacccttagaatgccacaagctgtcatggctactgggcaggttttatttcatcgtttctattgtaagaagtcatttgcacggttcaatgtcaaggatggaatgcaggagggagagttttcccatggagcatttagacttgtattccaaggtcagaagcttctcattctcacctttctttgcctatag

SEQ ID NO: 32819 - DNA, 471 bp, Glycine max
  Peptide Sequence Number=SeqID_149597
atggaagaaggattctccaccaacaaaccacctatgttcagaggaataaagtatgattactggaaggagcgtatgatagcccacttcgaatcaattcatatagacctatggtacgtggtggaaaacggagattatattccatatgatggtcatttgagctcagaatatgatgtagttgcagtgcgctctcttagaaaaagaatacacaaggtaacaatgttgagagccttaaagaatcttgattctatgtctcttgaggaaccagtcagtacccttaaggttcatgaacaagaaattcagcgggacgaaggactccaaagagaaaagtctctagctctcggtagtcaaaagaacaagaagacatcatcgtctagagaacatgccttgagaagttcatccaaagtgcttaaagtcgagatgattcatttgaagaagactcagatgaagatgagctcgcctttatctctctaa

SEQ ID NO: 32820 - DNA, 1236 bp, Glycine max
  Peptide Sequence Number=SeqID_149598
ggaaatgaaattcaaggtccgattcctggtggtattcgaaacctctcacttcttctaattcttgacttgtctttcaattcattctcatcttctatacctgattgcttatacggtcttcatcgtctcaagtctttggacctaagttccagcaacttgcatgggactatttctgatgccttgggaaatttgacttctcttgttgaacttgatttatcaattaatcaacttgaaggaaacattccaacttgtttgggtaatttgacttctcttgttgaacttcatttatcacgtaatcaacttgaaggaaacattccaacttctttgggtaatctctgcaacttaagggtgatagatttatcatatctcaaactcaaccaacaggttaatgaacttttagaaattcttgctccttgtatttcccatggactcacaacacttgtagttcagagttcacgactttcaggcaatctgacagatcatattggagcatttaaaaatattgatctgctagatttttccaacaactcaattggtggtgctcttcctagatcatttggaaaactttcatcattaagatatctcgatctctctatgaataaattcagtggaaatccatttgaaagtcttcgatcactctctaaattgttatctcttcatattgacggcaatctttttcacggagttgtcaaggaagatgatcttgcaaatcttacaagcttgacggagtttgtcgcatcggggaacaatttcactttaaaagtgggtcccaattggattcctaattttcaacttacctatttggaagtgacatcatggcagttaggtcccagctttccattgtggattcagtcacaaaaccaacttcaatatgttggactatctaacacggggattttcggttctattcccacacagatgtgggaagcactttctcaggtttcgtatttaaacctctctcgtaatcatatccatggtgagattgggactacattaaagaatccaatatctatccacgttattgatctaagctcaaatcacttgtgtggtaaattaccctatctttcaagagatgtgatttggttagatctttcgagcaattcattctctgaatccatgaatgactttttatgtaacgatcaggatgagccaatgcaattagaacttctgaatcttgcatcaaataatttgtcaggagagatacctgattgctggatgaattggacatctcttggggat

SEQ ID NO: 32821 - DNA, 420 bp, Glycine max
  Peptide Sequence Number=SeqID_149599
atgagatcattacagtccattgatttttcgaggaatcaactttctggtgaaatccctccaagcattgcaaatttgagctttctgagcatgctagacttgtcttacaatcatttgaagggaaatattccaacaggaactcaattggaaacctttgatgcctccagcttcatcggcaacaatctatgtggtccaccactgcccataaactgcagctccaatgggaaaacccatagttatgaaggaagtgatgggcatggagtgaattggttttttgtcagtatgacaattggatttattgtgggattctggatagtgattgctcctttgctgatttgtagatcatggcgagggagagtagctgaacgtaaagaggggaaggataggaggtgtggggaaatggaactaaggataaccaagtaa

SEQ ID NO: 32822 - DNA, 201 bp, Glycine max
  Peptide Sequence Number=SeqID_149600
atgttgggaaagagaaaaggcaaaagttgtgtgtgtctcagtcggagtggcacttgtgattatgaggtaggcggtgcagtggacggaaaaggacgtgtaggagacgcgcacggaagcaactgtcatgggaggagagggaacagatggtggcggtgggagaaaggagaaggaaagagtgctgtgaggacgcacgcaacttag

SEQ ID NO: 32823 - DNA, 516 bp, Glycine max
  Peptide Sequence Number=SeqID_149601
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaaaaataatcaagttattaatgactggacgaaaccaagaaataactcctcacgtgcgaaattatcgaaggccccctttaagatcaaacaattccatcgaattaagtatgattgtatgtgtgatagcatctag

SEQ ID NO: 32824 - DNA, 600 bp, Glycine max
  Peptide Sequence Number=SeqID_149602
atgtccaaatcttgtggatttgggatgaccggccctctcgatgagtcgatctcttgctttctcataagggtggaccttggaggactacacgtcctcgccttgagaggactacacgtcctcaccatcagagggctgcacgccctcacctccagaggactacatgtcttcgccttgagagggctgcacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttggagggctgcacgccctcacctccagaggactacatgtcttcgccttgagagggctgcacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgggtactacttaccctcaccgtcagaggactacacgtcctcgccttga

SEQ ID NO: 32825 - DNA, 1062 bp, Glycine max
  Peptide Sequence Number=SeqID_149603
atggctgatcaccagcgagaacgccgtggtcagcagcgccagcgccacctccagcacccacaccgggatgccggtcggcagcttgtcgatggtatggccggccacccatgccgccgcaccactggaatccattgcccagccgagtggaatcagcccggccatcatgaacaccgtcttccagttgatcgaggcataggcctcgtccatgcgcagcacgccggtcagcagcatgccggccacgccggtcatcagcgtcagcgccaccggcagcttgctggtcagcgcgatcaggatggtcagcgcgaagatcgccatcgcgatcttgaacttgtgcgggcgctgctcgccggtcgggtagtcggtcaccaccacgaagtcacggctgcgcgcggcctgcgccagatcggtccagatgctgtggaagaccagcatgtcgccggcgcgcagctgcacgtcgcgcacgtcctcgcggatcacctgcttgtcgcggttgatcgccagcaggctgatgccgcgctccttgcgcaggcgcaggtccgcggcgctcttgccgatcacgttcgaggtcggcggcaccaccgcctcggaaataccggcacggctcgggttgaacaggtcacccaggtgcttcaggcgcgaagacatgcgcaggaactggttctgcgcgaaatcgttgatctgctcgcgcgggcccatcgcaccgagcacgctgccgacccagatgcgcatttccgccggcggcgccaggcgggtgtcgttgccggttttcagggccagcagcagcggggcatcgtgcaggttctcggcctcgcccagggtcatgcccaccagcgggctttcggcactgaccaccagctcgaacacatcgccttcgatgccgtaggtcttggcgaagtagctctcggtgcgtgcgggcgtgaccccgtcgttgaccaggttctcttcctcgatcagcttgcggtcgccgtagtagcggaaatacagcagcgaggcgatcagcagggccacgccgatcggcagcggtgcgaacatgcgcagcggctcgatggtgggatcctctag

SEQ ID NO: 32826 - DNA, 447 bp, Glycine max
  Peptide Sequence Number=SeqID_149604
atggctccacctaaagaaattccgaccctcatttaccacagtggtcacattgtagacgatccagttcaaggatcgacgtaccaatgtacgaccccaatatttttttacgccagtcgttctattacgtttacacaattcattcgaaaaattaacaatcatcttcctactcgagcaactgaacaagtttctcaattgttatttcgtgtccctatttcaattcatctcggtcagacacgttttatttcggctcaactattcgacaatgatgatcttagaggcgcgatggaaacaattatccagaatccacaattgaattctgccgaattctatgctgttactgagcttatttctcaaccacaactatcgtctccacaaccctcatgtccacaactacaactaccgcatccacaacagttaccgtacaacaacatagacctcaataatcca

SEQ ID NO: 32827 - DNA, 1398 bp, Glycine max
  Peptide Sequence Number=SeqID_149605
atgcttgcactcgatcccgccgcgacggcttcgccctccccgcactccgctgatgatgacgccaccgcgttactgctgcaggtactggatatctacgcggcccgcgatctggtggtcatcctgagcgaggccggcggccgcgactggagcattacgcagcttaaccgtattcgcgcgggaaaaagtgccgcgcccgcgctgtcagcggcggaggtcgcccgtctgcaggcgctgctgccgtcgcgaccggcgcattatgacaatccccgctttcagtttatcgatctgtttgccggcatcgggggtattcgccgcggctttgagcagattggtggccagtgcgtattcaccagcgagtggaataaagaagcggtgcgcacctataaagccaatcactacagcgatcccgccctgcatcagttcaacagtgatatccggctgattacccagccggccggtttgccggatgagcaggcgatttatcagcatatcgataagacgattcccgaccatcaggtgctgctggccggctttccctgtcagcccttttcgctggccggcgtcagtaagaagaatgcgctgggtcgcgcgcacggttttgaatgtgaagcccagggcacgctgttttttgatgtggcgcgcatcctcgccgccaaaaaaccgccgtttttcgtgctggagaatgtgaagaacctcaagagccatgataaaggccgcacctttgccattattatggccacgctggatgagctgggttacgacgtcgctgacgcggctgacgactcatcgccggatgccaaagttgtcgatgcgcgtcacttcctgccacagcaccgcgagcgcatcgtgctggtggggatccggcgcgataccggcctgagcgagggtttttcgctgcgcgcgctggcggcgctctatccgcctgaagttccgccgctgcacagcctgctggagccggagccggcggcaaaatataccctgtcgcccacgctgtggcactatctctaccagtatgcgaagaagcataaagccaaaggcaacggttttggctttggcctcaacgatccgcgcaatccgcactgctgcgtgcgcacgctgtcagcgcgctactataaagacgggtcggaaatcctgatcgatcgcggctgggatcacgcgctgggcgaacaggattttcagcaggccgcgaacatggcgcgccgcccgcgccgtctgacgccgcgtgaatgtgcccgcctgatgggctttgaagcgccgggcgaagcgcgcttccgcattccggtctccgacacacaagcctacaaacagtttggtaactcggtggtggtgccggtgttcgccgccgtagcgaaactactgctgccgctgattgagcagcacgcgcgtcagcgccgctga

SEQ ID NO: 32828 - DNA, 780 bp, Glycine max
  Peptide Sequence Number=SeqID_149606
atggtcttgatgatctgtgttgtagtgatgtctcgcaaagaaaatctgatatctgagttacacaccagaaaaggaacatggaaaatagctgtgcgtatcactgatctttggcaagctcgaaagcaaaatagtaaacaaacaattgagatgaacctgaggattgttgacaaccaatctgaatacagagtcagcccaactccatatttggtttatttcctaaaaactacatctgtcaaggaaattcaccgtccagaaattccttctaatgtttatctcataactccttttactgatataatctctggcctcgcaccacgccatactttagtggatattgttggtgtcattgttaatctgatcgatgttaagacagttaatccccctcacaagatgacaatcagactcagggataacagtaactgtgacattctaataattgtttgggaggactatgctattcagctacatgatgctattgacaaaaaccttctgcttcaggaaccattggttgttatgttgaccttaggtaaaatcaaggatgctacagacaagtatcccttaagcgtgcaaaatatcaaatttggatctaaattgtatgtcaacactgatattacagagatacatgaattttgtcaaagtttatctgtgccattttattctggtgggatgatcaatgataaagatggttctcagtcccaatctagccagagtaatgtggtggaaaaatttctgcagaatgctcaagtggtcagtataggtcaaatcaacaatctcagacag

SEQ ID NO: 32829 - DNA, 570 bp, Glycine max
  Peptide Sequence Number=SeqID_149607
atgagatgcggagagtgtacgattactcttcaagatgtctttgtattattaggtcaccgtgttgatggagcaccattaattggtccaacaaatcttgattgggctgatttatataaagaattattaggagtcagaccacaggaaggtgaacttcaaggcagtgtcgttaaattaagttggttagctcaacatttttcacaattaaataaccctgacggtgacgtacaacaactgcaaaggtttacctgtgcatggatccttagattcataggagatgtcctatttgttgataaaagcagtagcaaagtttccctaagtgcagcacgtatgcatagggacctgccgtgcttgcttttttatatagagagatgtgcagcgccaccgattacaaaattaaatcaatcggaggaacgatgcacgactttggttccaaagaggactcctcctgtaatagaaaataaaccactcggacacaggtggctgcgacgtggaaatcagcatattagtaatgatgatctgatagtttttcatcgaaaattggatatcatgaaacgacatgagtttctgtga

SEQ ID NO: 32830 - DNA, 684 bp, Glycine max
  Peptide Sequence Number=SeqID_149608
atggacaattgtgccttttgcaatgctgatggtgacttcttgatagttccccaacaaggaagactccttatcactactgaatgtggaagattgaaagtttctccgggtgaaattgctataatacctcacggttttcgtttttctgtgaatctgcctgatggtccatcccgcggttatgttgctgaaatttttggtactcattttcaacttcctgatctgggaccaataggtgctaatggtcttgcttccccaagggatttccttgttcctagtgcttggtttgaagataaatcttatcctgggtacaccatagtgcagaagtttggtggtgaactctttgatgcagtacaagatttctctcccttcaatgttgttgcttggcatgtgttgaccgcaccaactgataaacctggagtggcattgcttgattttgtcattttcccacccagatggctggttgctgagcatactttccttcctccatattatcatcgcaattgcatgagtgaatttatgggccttattcatggtggctatgaggccaacgctgatggatttcttcccggtggtgcaagtctccataattgtatgactccccatggtcctgatacaaagtcatatgagactagtaagaaattcttacagtatcatataccgaggtttactcccaagtgcaaaatctag

SEQ ID NO: 32831 - DNA, 498 bp, Glycine max
  Peptide Sequence Number=SeqID_149609
atgggaggtaagggttcaagaggactgcatgttatcactccaagcctagaagaattgcaacatgctcatttgtatatactaaatagcagtaatggagttatgccatacatagttcatctcgaagctttagtcaaggaaaatacaatctttggtgatgataatgcttctaaaacactaaggaagttagcagatgggcctaaaagaaatgttataacttggccaggatatgatatcaacaaggttagtctaagcgttgaatctcaacattttgctactgtacatgatgacaatccccgtctagcatcaattccttactttggagtcattgaagaaatttgggagcttaattatgtaaaattcattgtctgtgttttcaagtgtaaatgggttgatagcaatatcggtgtacgaaccgacaattttggatttactttggtagatctaaagaagctcgcttatcggaatgagcctttcatcatggtagaacaagctaaatag

SEQ ID NO: 32832 - DNA, 105 bp, Glycine max
  Peptide Sequence Number=SeqID_149610
atggcgagcgagtttaacggttttcactctcatcgttcggagacattcaagcccgatgatgcacaagattcttctatgctgggcgggcacgatcaagttagatag

SEQ ID NO: 32833 - DNA, 330 bp, Glycine max
  Peptide Sequence Number=SeqID_149611
atgactaggtgtattgctttaaggaatcttgtgctgaaggacatcaagacacaacgctctgataggatgtggcattgggattatagtgtagtttacaaaagcaaaggtgaaaggaaagatattgagctggtagaggaggaacatgcacggattggtgttgatccttctagtgagacctccaataaatctgagaattataaggaggaagcacggaagaaaacacagaagcataaaccaaagagggtggagagtgtcatcgctgatgcagaagcctttggtgatgactggaaaattctgattgctctatgcattgtgaagctgaagcactag

SEQ ID NO: 32834 - DNA, 420 bp, Glycine max
  Peptide Sequence Number=SeqID_149612
atggaagcggtggcggaggggctatggggacttgcagagtaccatgggaagagaggggaaatagggaaagcagtgaagtgcctcgaagccatatgccaaagcgacgtgtcatttttccccgaggtgtacagcttgctcagcgagtgttaccatctcgtcggagctattctgccgcagaatcaggtcttgcacaagggacttgagctcactgcatccgtcggagaaagatcgatcgtggcacgtttggcgctgtatgtgttgaagaaaatcaggcttgcgcgacagactaaacaatgcagaagatctgctcatcaagagggttgctatgtttgcattgttactggatacgtgaagatggagacatgggattttgggcttgctaagacactaaaagcggatgatttggcttcttctatgtga

SEQ ID NO: 32835 - DNA, 450 bp, Glycine max
  Peptide Sequence Number=SeqID_149613
atgacatacattgtaagacgattttacgaaactgccttagaatgtactagggggaacgataatgacgacgagtttatatgtaaaaatgtcgttgttttcggcccatgtgttattggcgttttaaaagacaaaaaccctagcctagtgcttatcaccatcgctagaggagaaagagaaaggtgcgaaaatgagcggagcgaaggggaagaagaagggagggaagaagaagaaggattttctctggagaagttccttcaggagaggattaaggtcgacgacaaggccggtgcactcggcaattccatttccatcaccaaggacaagagcaacaacaccgtcacctccgacagcaacttctctaaacgatactctcttcgccatgctcctcttggacaacccatcccttgtgttcaggaatccttacaactcaagagaccctcggtcccttaa

SEQ ID NO: 32836 - DNA, 981 bp, Glycine max
  Peptide Sequence Number=SeqID_149614
atggtagaatcgtcaaagaagcgaaagggatcatcctccaccaccactgttgctggccatcgccatgatcaacgtctatggtacaactctcaattttcttctagaatcatcttagaccctaagtacctagacacatatttctttaatgatgagacatttgactgttatcaagtatttcaaaactctagattgattgattttatgtccttaaaattgccttactatcttgaactcgttaaagtcttttacagcaatttaaaaattcaggatggtattatttcttctgaggtgcatggtatttctatgatcattgatcaatctctgttcttttcattgactaaattacccagtcaaggtgcaccttttgagggcaccattgttgatgactggaagtttaattattctagtcatgatgttcgtcgtatggtttgtaatgacctggctgaaatgaccgatagattgctggccagatcattaacctttgattgtcgcatcatgaactatattatcgttagaattttgcttccccgttcttctaatttggctcaagcctctgaggaggacttgattttgatgtgggctttccttaccggtcgtcagatcgactgggctcacttgttatatcatcttgtgttgattaccacgcactttggctttttgatgttgccaaagggggagagaaatggggtggaattaaattgtcatcatcaaaaagggggagattgtagaagcaaagactttgcctttgaggttttgatgatgccatatgtttgtgatattttgatgccttatgaaaatgcgcttctcaagtttaattcaagacaaaaatccaagaatacaagatacaacattaaaaagatctctagtgttttaggaagggaattccaaattgaaactgtaaaaggtttgaccaagaaatttaagcaaaaatgtcttattcaagagatttactctctggtaatcgattaccagaggatgtaa

SEQ ID NO: 32837 - DNA, 219 bp, Glycine max
  Peptide Sequence Number=SeqID_149615
atgaggattctcttcatgggccaagggtgtcggtttcgggttaaactcccatattatttccacgaggcgtgcgcaacaatgatgatttggaaacaacgcgcaaaattagtcatgcatacagctaggtgggtacccaagcatccagcttatggcattatgatactaaggcttgggttttacgcaagtagactgttagtgcttagctttactaagctttaa

SEQ ID NO: 32838 - DNA, 555 bp, Glycine max
  Peptide Sequence Number=SeqID_149616
atgaatggggcggttgaggcgacaaacaaaaacatcaagaagatcattaagaaaatgaccgtgtcatacaaggattggcacgagatgctccctttcgcgctgcatggttatcgaacctcagtatgcacatcaactagggcaactctatttgctttggtatacgggatggaggccatgttgccgtttgaagtagaggtcccctctttaacaattctggcagaatccggattgaaggagtcagaatgggccccaacacgcttcaatcagctaaaccttatagaaggtaaaagattggcagccatgagccatgggcgactatatcaaagatgggtaaagaatgctttcgacaagaaggtacacccatgcaagttcaatgaaggggatcttgtcttgaagaaagtatcccaagcccaaaaagacaataggggaaagtgggccccaaattacgagggatctttcgttgtgaagaaaacctttttgggaggagcgttagtactagccagcatggacgatgaagaatttccttcacccatgaattctgatgtcgtcaaatga

SEQ ID NO: 32839 - DNA, 417 bp, Glycine max
  Peptide Sequence Number=SeqID_149617
atgataaactataataataatctaagtggatggtggcggtggaaggttgaagcaatctctgatgtaagtaatgtcgccttcaatctttgtgatcctagaatccatctctctgaatcgaatgtctacttgactctccaaggagtcaaatctctctccaacataggtctgaagactatcaaacctatccatgacactctgcataagagaagaatcctctcgagcgggcgagcaaccctcagcatcatgtggttgaacatccttctttatctaagagccatcatgctctttgcgataaccgaaggaggcgagcactgcggccccaatggaaaaggacttcttgatttgaacagaaggttcaaaatcaagaggtacctcgaaatggtgaagaaaaagagaaataagatgaggatagggtaa

SEQ ID NO: 32840 - DNA, 573 bp, Glycine max
  Peptide Sequence Number=SeqID_149618
atgcatgaacgacaatcaattcatggggctccgaataaaagtggagaatggagaattgcactaggcaatcacttcgcgtggctccagactcattggtggaggatgcatgaacgacaatcaatgcatggggctccgaatataagtggagaatggagaattgcactaggcaatcacttcgcgtggctccagactcattggtggaagatgcatgaacgacaatcaattcatggggctccgaataaaagtggagaatggacaattgcactaggcaatcacttcgcgtggctccagactcattggtggacgatgcatgaacaacaatcaattcatggggctccgaatataagtggagaatggagaattgcactaggcaatcacttcgcgtggctccagactcattggtggaagatgcatgaacgacaatcaattcatggggctccgaataaaagtggtgaatggacaattgcactaggcaatcactacgcgtggctccagacttattggtggaggatgcatgaacaacaatcaattcatggggttccgaataaaactggcgaatggagattgcactag

SEQ ID NO: 32841 - DNA, 507 bp, Glycine max
  Peptide Sequence Number=SeqID_149619
atgtgggatactctccaattaacccatgaaggaaccactgatgtaaaaagaaacatgagatggaactgcaacgccttaatcaaaataaagaaaatgacaaaaaagaagagaagtatagcccttaaagcctcatcatcagtgcaagaagaaaaaaaagaagaagattcagatgatgaagaatatttttcattctttgtgaagaaatttcagaaattcatcaagaaaagaagaattgacaggcgtcagaacttcaacaatggaagaaaatcacaagaagattctcaagtccttaggtgttacaaatgcaaccaaattggtcacatcaaggccaattttccttcaaatgaagattggcctgagaaaagtgaaaagaaaaggaatgatgaaagaaggaccaagaaagcctacattgcatgggatgacaatgattcatctgatggttcaaaaaaggagattaatcttctaaccaaggattatgaaagtgatgagaacatctctcaagaataa

SEQ ID NO: 32842 - DNA, 376 bp, Glycine max
  Peptide Sequence Number=SeqID_149620
atggctaagtttgaccccgagatagtcctagagttctatgctaatgcttggcccatagaggagggagtgcgagacatgcgttcatgggtgaggggtcagtggattccctttgacgcagatgccctcaaccagttcttgggtgacccgctagttttggaggcaggtcagcagtgtgagttcagccagaggaggaacagggccgacgggttcgacgaggaggccattgcccagcagttatgcacaccgcgcaatgtcttgcctagcgatcataactccgatctccctctgcctaagtgccagttggtgtatgccatcctgacacggatgagcggccatgtggcccaggtgattactaacgcaatctatttgtttgcag

SEQ ID NO: 32843 - DNA, 374 bp, Glycine max
  Peptide Sequence Number=SeqID_149621
atggaggaacaggcctcacaggattccatggaggaacaggcctcacaggattcctttgtcgcccatggacaacaccctggtcgtgtgcgtgctgctggagccaatgtcacgatcaaacaatactttggaccgactccaagaacctcccacacatcttcgtccattgctccgaaagacatggagcagttgacgcaaaaaatcagggaccagctggaggagtcgatcacagaaaaagtgactcgacaagtactcgcactacctcctgagcctgtggatggtcgttcagctactcatgtcagcacaaaggaaaatgttgtcatctggttttgttcgttgcataataggctagacttcctgaaaggaattattatcag

SEQ ID NO: 32844 - DNA, 735 bp, Glycine max
  Peptide Sequence Number=SeqID_149622
tgctggatctatgagcacttccctagtgtgcaccagtgcgccacagatgatacataccaggaggcgtccccacgtgcttcctggtggctgacgtcgaaggcgcatatgaagggaatcacaggagcaccttacagggcacgttgtgatgctttgaccgtcatggatgtgtcctggttgccatacactgagcatcggggggttagggcctttgagctaatttcatcattccagggtcagctgagatggggtcctatggtggtcacagctcgaccggagagggtggtacgacagtttggttacattcagagcatccctccaccgcctgttagtgctcgattgtcatatgatgatatagatgacaggtggatgcattttgcggagcacgtactacctatgggtgagctttgtctagtgcctgggcaagtatctgcggattacatagagtggtttttccgcatatctcacccattcatgataccgacccaggcaggtgaccagcccagagatgcaccagccgcagaccctgaggagtacatacagctgcccagcccccaggatgattatgacggctatgaggcgatcgcacagaggttggagcgtgtgctcaaccttaggatggtcactgcaggcatagagttatatgatattatgcaggattgtctcacgatcgccagaggaggtgccagtgcagatggaagtgtcagggctcgacagagacggtgcaaagagcattga

SEQ ID NO: 32845 - DNA, 316 bp, Glycine max
  Peptide Sequence Number=SeqID_149623
aattgcttggatgtcggggaagcttgggaggattgatggggacccggtgttgagagaaacgaggatatgggctacgtgggagtacgtgagctcagttggaggtgggcaacaggggatggtggtggtacctggagatatgtcgcgggggtcaggagaccttggggacgtcaggcgagctcctggcaatcaacagatgaaaggaacaaagaccacaaagcaaggaggcttgtgtggtggctggccagctatgaatcttgagactaagatggtctctggtaatcgattaccagggggtgtaatcaattaccaggcttga

SEQ ID NO: 32846 - DNA, 409 bp, Glycine max
  Peptide Sequence Number=SeqID_149624
atgtcttccagaaaaagaaagagcattggtgcaaggcccacagctcaatatgacacaagaagattccactcctttgaggcctggaccatatacacagacaatgtgctaggaagacatatactagctgagagaaaggtagaaatataccatatggagttggatgagttcaaggctgaattggagaggtgtaacttccataagcgcttcaccaatttagctgacagcagcattgacttagccttggtgaaggagttctacgccaacctccacagtcctgaagggccttccccaaaacaagtcagaatccgaggccacttgataaaaattgatgcagacagcctcaacaccttcctggagacacttgtggtactggctaagggagaatccttacccgcttactccagatact

SEQ ID NO: 32847 - DNA, 312 bp, Glycine max
  Peptide Sequence Number=SeqID_149625
atggtgtcgcaacctacccttcggcgggagggcgacgcgagactcgcgggatgcgtgttccatgaaaggaatacgcgcggagtcgccaccaacgtttatttgaggaaaacgtcggataaccactcgggtatttccgcccgtcagcatgactcaaaagtcagtatgacagatcttgcaagtgcggaagatgatgtaaatctccacgtgtcaacgggcttgtcggccgcgattaacgaagggtgcagaatgaccacattggccgctgcttgtcatcgggcccgccgcctctggatgacaaaagggtgcggataa

SEQ ID NO: 32848 - DNA, 168 bp, Glycine max
  Peptide Sequence Number=SeqID_149626
atggtttacaataatgccagcccgcatcaattagactttggaccttacacttcagggccctacaatgctcaatggaatgccccggggctcctccatgataagcacatgtcgcgttcgagtcatatccacagaaaaatggaggttgaggaaccttggctagggttatag

SEQ ID NO: 32849 - DNA, 102 bp, Glycine max
  Peptide Sequence Number=SeqID_149627
atggcgtatgtgggttttcactggtggagtgtcctcccttctttcattagaaaggacctcttccgtaatagatgcggttttcctttctacagttttagatag

SEQ ID NO: 32850 - DNA, 318 bp, Glycine max
  Peptide Sequence Number=SeqID_149628
atggtcaaatttggaggttgtcaaactcatgaaagacagcataaagggttttttttaccaatgcttataagaaaaaatcaagaaaaactgcacaaacgacaacatcgaaattcaatgacgaaagtggtgcaattgaaattcagcttcatttttcaaacatttataaaatcaaatcagctgaatttgggaaaaataatctgtgtcaaagacaattttggtagttgcataattttgtgggaattttctggtttaggtattttcatccacgatcatgatatcgacgctgcagaactatccggtttagctagtgggacatag

SEQ ID NO: 32851 - DNA, 2538 bp, Glycine max
  Peptide Sequence Number=SeqID_149629
atgaagcgtttaacccctgatgagatagcctcccagagagaacgggggttgtgctttacctgtgacgagaaataccacagaggtcacaagtgtgcctctagggtatttctcttccttgctgaaggagatgaaccctctgagactaatataagccttcctgacccgcaacctgaaccacccgacccaccttcgccccatactccatctgtcctaaatgacccggtccaggcccaaataagtttcaattcactagctggccacgtggccccggagacgctacgttttgtaggtactctcgctgaccggcaagtggtgctcctcgtcgacggcgggagcacccataacttcattcaggccgagcttgtctcccaacttggtcttccctgccaacccacccttcccctccgagtcatggtgggcaatggtcagaccttggaatgcaattccctttgctctgacgtcacggtgatcattcaatctgctcaattcgtggtcgatttgcacgtattgcccatctcaggggccaacattgtacttggggtgcagtggttaaaatccctaagtccagtccttacagattacaccactctcaccatgcaattcttccagcatgatcgcatggtcgagctgaaaggggataccgatgcccatctctggctcctctcttccccccaattccggcgactgtatcggcgccaaggagacggcgtttgcttccaaatcaccatgcttcctccagagtccgactctgtcgacacgacgtccttacctcgggagcttcaatctctattgcttaagtatgaggccctgttccaacaccaacaagcccttccaccccgacgcgacactgatcatcatatccacttactaccacagtcgtctccggtcaacgttcgtccctaccggtacccccattttcaaaaaagggaaattgagcttcaggtggacacgatgcttcagaagggcctgatccagcccagctcaagtcctttctcatccccggttctccttgtaaggaagcatgacgggtcttggcggttctgcgtcgactaccgagccttgaacgctgtcaccgtcaaagacagattttcgatcccgacgatcgatgaacttcttgacgaattagggggcacttgctatttctcgaaattagatttacttcagggctaccatcaaatcaggatgaatgaggccgatatcccaaagacggctttccggacccatcacggtcactatgaattcagagtgatgccgttcggattgtgtaatgctccctcttcctttcaatcaacgatgaacactctgtttgggcccttcttgagacgttttgtgatcgtcttttttgacgacattttagtgtatagcgcttctttccaggatcacctgcagcaccttgagcaaacgtttcaggtattgcttcagaaccaatttgtcctcaaattatcgaaatgttcttttgctcagacccaggtagagtacttggggcacatcgtctccaatcgtggagtggaacctgtagcttcgaagatatccgtgatccagcagtggccaccaccacgaacgaccaaagccttgcggagctttctcggcctcgcgggattctatcggaggtttatcagggggtatgccaccattgcggcacccttggtgaaagccacgacgagtgatcctcttcagtggacctcaataactcagaatgcttttgatcaactgaaggaagctttgtccactgcgccggttctctccttgctggattttaccaaaccttttacactcgagacggacgcttccggggttggaatgggagccgtgctatcccaacagggccaccctttggctttcttcagtaaaccatttactccgaaactcttgcggtcatcgacatatgttagggaactctgtgcgattacgacggcggtgaagaagtggcgccagtacttgctcggccatcacttcacgattatcatcgaccaccgcagtcttaaggagtttcttggtcaggccaccaacgcgctgtcacgcttaccagaccacaattcctcactaacacttctcctctcagtaccttgcttatcattcctcgaggaattgcgtgcccagctgaatcacagtgatgagtataatgactttcgccggaatattctcctgtatcctcaccagtactcggaatattctgttactcaagaccttgttctttataaagctcgcatctggcttccccgcgacttgcccattattcagacacttctacaagagttccactccactccaacgggtggccacgccggtgttgctaagaccactgcgcgcatccttaacaatttttattggcctaaactccgcgaagatgtgacgcgctttgtagctctttgccgagactgccaagtcaccaaatatgaatccaaaaaggctaccggactcttatgtcctttacccactcctcaccggccatgggacgacttgtccatggatttcatcgttggcctgccggcatacaaagggaacacaatgatcaatgatactagtagtcgtggatag

SEQ ID NO: 32852 - DNA, 321 bp, Glycine max
  Peptide Sequence Number=SeqID_149630
atggaggattgttgctgggtaagacggaggagagcatcctcaagcttatcggaagggttcgaggagttcgacatcaatgaaagcaccaatttgttagaggggaagaacaaagatgctgacttcgagggcagcaacctccagctaaaggggaaaaagagaataacgaaaggaaagtgtgtttccaattctgcccctgctacacgtaatccgctaggtgttgaggaaaaaagcccagagtttcaagaacctcgggatttgaggtcaaatccttttcaagggggagggaatgatgcaatcctaccccgcaagggcattggatag

SEQ ID NO: 32853 - DNA, 729 bp, Glycine max
  Peptide Sequence Number=SeqID_149631
atgtcgaactcctcgaacccttccgataagcttgaggatgctctcctccgtcttacccagcaacaatcctccatgaccgccaaaatcgatgaactcctcatgcgtctcccgcccctctttcaccataccccgtcctctaccacttcttcccaaccttcaccgtcccctgcatcagttcataaaatgaaattagacgttccccggtttgatgggtccgacccttccggttggatttttaaaattaatcagttttttgaataccacgataccccagcccatgaacgattaaccatagccttgttctatatggaggggagagctttagcctggtttcagtggatgaccagcaacggtcaactcacctcgtggccggtgtttctgcaggctttacaaacccgcttcgccccatcgcaatataaggaccccaccggcgcactctttaaactcacacagaagagcacagtgaatgcttacctagcggaatttgaggatcttgcgaaccatgtggtgggccttcctgctccctttctcttgcggtgctttatttcaggcctctcgctggaaattcgccgtgatgttcaggcgatgcaacccctgacgctttctcaggccgctgggtttgcgcgtctgcaggaggacaaattactcgatgtccatccctccttgcgtccacgacccccgtacccaccttcacccacaccttcccgcaaccccccttccttacaatga

SEQ ID NO: 32854 - DNA, 162 bp, Glycine max
  Peptide Sequence Number=SeqID_149632
atgagaagtgacttttcatcgaaagccatgagaagtgagtcttcaccaagtggcgtctccaatcatcacaccttgaaaaaggtatgtatgtcttcaacaccccaatcccaaccaatagggaagatgagatcattgctaaagcccgttagaaaacaagtatga

SEQ ID NO: 32855 - DNA, 315 bp, Glycine max
  Peptide Sequence Number=SeqID_149633
atggcaaatttatgttatgatgctccccttccatctttaaatcgtcaatccattggtcatttccctcctgaactctatgccaaactctcaaaattcaacttgataacaatgactttggtggaaataacattccagaatcttatggcaatatctcaaaattgtcaaaattcaaatacaaatggtaatgatgctgatgttgcacctgaattttctcctttgaaaattgttcaatttggaaatccttctcaagacactgttgacccaagagatggagactttggaggaagactatggagatggaaatgggaaaaatga

SEQ ID NO: 32856 - DNA, 294 bp, Glycine max
  Peptide Sequence Number=SeqID_149634
atggagactttggaggaagactatggagatggaaatgggaaaaatgaatcaagacaatttattgaggggttttaccacagttctcacaatgaagcttcattaattacagtattgcatctgctacaggctctcaagtggttgacaagtctccttcagttaggtaaggcttgcatgcgaggccatgtaaatacctttaatgataactatgagaagagtgcgactggtagtagagtttattatggtgttcattcgttaggattttctctgtttctcttgtacagttgcactttctaa

SEQ ID NO: 32857 - DNA, 732 bp, Glycine max
  Peptide Sequence Number=SeqID_149635
atggtgagccatgtagctaatgcagtatcacagtcaatggtgttttgcatctatgtcagtgatgacaaagtcattcacttcactagacgtggccaagaagtaggaaccggtactgcactagatcttctcctcattagttcaggaccagccaagtctcgagaaagttgccctacttgtatggcaccccaagaggaacacggggttatctcctcatgcctgaactgcttcctagctggtggggtcctgtatcggttcgagtatgccgttacccctgccctcttccttgcaaaagcccgcggtggaacatgtactcttgcagtctctgatagtgatgatatcgtcatccatcgagcaaaatacctgctcgaaaatggctttgggtgctataatgttttcaagaaaaactgtgaagactttgctatctattgcaaaaccgggctcctagaaatcggacaaagtggccaagcagtttccatcatagggggacctcttgctgctgctctatcctcgcccctccgtatggttactactaacgtttatggaatggcagcgacggcggttggagtctactgtgctagtaggtatatggcagacattggaatgaggcctaatgcggtgaaggtaccggttgaacagttaaccacaaggttggccactggcttgctgcaagtggttgaaccccaaattccaacgaatatttctcgtcaatctcctcagcttgttactcaatga

SEQ ID NO: 32858 - DNA, 1332 bp, Glycine max
  Peptide Sequence Number=SeqID_149636
atgacaaagtggtggaattacgtgaattacgttatatatgtgaggggtagagggtgtcacagggatgaactggaaaattttagacctgatcctatatgctcatgcaatacgcgatgcacatgtttagcacttaatattgtagctcaaagaaagcttgaggatagagcaattcagtttctcagaggattgaatgaacaatatggaaatgtgcgatcacatgtcctcctcatggatccactacctgaaatatcaaggatattttcctatgttgcagaacaggaaagacaaattggaagcaatttgatagctgctaataacatagacatgaaaggtagtttaattaatgcagtaaaattggcctgtaattattgtgggaagactggacatactgagaatgtttgctataagaaacatggagttccttcaaataacagtgaaaggaacaagtccagcagccatatgagtgggaaagtatgtacttattgtggaaaaatgggtcacactattgatgtatgctacaaaaagcatggattcccaccaggttacaggttttctaacccaaggagcagtgctaacagcttggtggcaggagatgatgcagtcaccaatgatcaaacacaacttttagagttcaaggagattcgtttttcacctgagcaatacaaagcattgcttgttttaatccaacaatcaactaatgggaactcaactaacatgtcatccaatcttaaacagatagcctcctgttctgttgacacaacaccagctcatggatgtgatcactcaagcaaagattgcttacccacgtctagtgaacatacagacaataattcagccacacctttacaccgttccacacaagatagaagacctcctacttaccttcacgactatcatgcatttctcacttcagctgctaatatcaattcagcttcagtgagccatcctctcgattattcagcttcagtgcgtcatcctctcaattttgtactatcttattcgcgtctatcatcatcccacagacattttattctttccatttctacatctattgagcctaagacatatgctgaagcatctcaacatggttgttggcttaaagcgatgcaagccgagttacaagctttacaaacgaataacacttggacccttacagacttaccagctaataagaaagctattaggtgtcgttgggtttataagattaagtatcatgctaatggctccgttgaacgatataaggctcaacttgtagccaaggggtatactcaaatggaaggattggatttccttgatactttttctccagttgcgaagctcacaacagtctga

SEQ ID NO: 32859 - DNA, 159 bp, Glycine max
  Peptide Sequence Number=SeqID_149637
atgggagagctgaaacttgagtgcgagatgttcaatcttcttcgcgaacttttcatcgaagaaagactccaagctagtgctccaagccctcctcaaactccccctgcacgcgaggataatgaagaagaagctacagtggttcacgaaacgacacactag

SEQ ID NO: 32860 - DNA, 270 bp, Glycine max
  Peptide Sequence Number=SeqID_149638
atggatcaaacatcaagtgggtgtggtgttcgtcagtttaagagttacctattgcacaaacaggaaaagtgtaagcataatggtgaatattattctctaataggttgttttcattggttagccatagcagattctcgcttgattatcatatattggatacagaagcacaaaagcaatgtgattgaaggaactagctctattagtaattttctatccaatgaaaatgggaattttctatccttctatggtgaggtggaagccaaagattga

SEQ ID NO: 32861 - DNA, 411 bp, Glycine max
  Peptide Sequence Number=SeqID_149639
ggtagcaaaggatcattaaattgtaaacatcatgagccacatgatgagggaagcagtatcaaatcaatgctttacaagcttttggtcaatctaaggagtggtgtcttcatgctgcaaattgatgcttttacaaaaataagcactgcagcttatttaaggcacaaattctgcagcatctgcaatatgtgggtggaaaaagggtgggagtggaaatttaaatggagaagacacttgtttgacagagagcttgagatggcagattgtttccgtaatgatgttgctggcagctgtattcagattcacaaaaaagatgagtggatctggaaaatagaccctactggacaatattcgataattaaaggagagactacaaacaaagacaaatttgaggaggagaagggtggcaattaa

SEQ ID NO: 32862 - DNA, 369 bp, Glycine max
  Peptide Sequence Number=SeqID_149640
atgaggtaccggttggtggaaaaggtagcctttgcacttgttaatactactttccatctctgtcaatattttcagtgccctaaaatcactactcggactaattgtcacatagccaaaatactacacaagcccaaattgctaggacaaatgatgggatggtcaatcaaactttcaaagtatgaaattgcctatgaattgagaggtactattcgggcacatgtgctagccgatttcaacaacgagttgcatcctttactgccacaattcaagcatgaatggtggacaatgcatgtggatggctcctctaactggcatgggagtggaactagtgttatcctggaaggacccaacgacgtgaccatggcataa

SEQ ID NO: 32863 - DNA, 312 bp, Glycine max
  Peptide Sequence Number=SeqID_149641
atgcatagccacaactgggtcaaggtttcagatattcaccccaacctttttgaaatgttccatgaagcatcatacttttcattagtcaagttcttccaattggaaggaagattcacctccatgatgctagggacaaagaggttcttaaactacaacaactgtcttcctaatgtgttgagagacagaggaatagtgttcagacacacgctcttattggtagctctaggcaagccaattgtggttgagttaacttctcctccctcaaacaagctagcctcaggttgtcgtgacccatgggcttcccgtaggtga

SEQ ID NO: 32864 - DNA, 258 bp, Glycine max
  Peptide Sequence Number=SeqID_149642
atggctccgagaaatctttatgcgaaaagatctaggagggacgccgcggctgaagggacatgcgccgcccccgagtttgctagccactgtttcaggagcactgagcagcaacagcgtttcaaggcaatcaaaggatggtcgttccaccgagagagatgcgtccagctcagggacgatgagtacaccgaatttcaggaagagatagctcgccggcgttggacgtcgctggtcacccccatggctaagtttgacccatag

SEQ ID NO: 32865 - DNA, 249 bp, Glycine max
  Peptide Sequence Number=SeqID_149643
atgccacccaccagacaccctctagacccggataagtctaatagggccctggggtttccagcgttgatcacgggcctctgccagtcattcggggttcccgtcacaccaactaagatgatccagccgccgatcacccaagccttcattgagaagtattgcacgcctaggcaggcgcagggtgatgcggtatctacaacacttggttcgccaacaggcggccaaccaccgggagcaggtgtagatacatga

SEQ ID NO: 32866 - DNA, 258 bp, Glycine max
  Peptide Sequence Number=SeqID_149644
atggacgctcatccgtgtcaggatggcatacatcagctgacacttcggcagcggaaggtcggagttatgatcattgggcaggacattgctgagcagcaacatcatccacatctgggtcaaggtggtcatgctggtgcgcatgatccgcacccgtctcccggtagtagttcgggcaaaatcctgacccggccttcctctaacactagcgggtcacctaggaactggctgagggcatctgtatcaaagggaatccactga

SEQ ID NO: 32867 - DNA, 346 bp, Glycine max
  Peptide Sequence Number=SeqID_149645
gtttcatccatctaaggttgcggcaaagtctatcactttgtccattaggcaacaatttggtcagccatggcctacatggggagcgattccaaaagatcatcaggaactttttttccagcattttaagagaaaattggtctggagacctgaggaagagaataaaattaaaaaagcttttaactcgaaagcctctcatagactttttgagatgtttaaggatgcccgaaatgaaaataaaaggccatattggattggagatcgcgtttggaatgatctgttatcacattggaatgcacttgagtatcgttccaagtgtgcacaggcaaaaaaaaaattgagcatctga

SEQ ID NO: 32868 - DNA, 126 bp, Glycine max
  Peptide Sequence Number=SeqID_149646
atgccccccccccccctttacaggataatgggctgccttgtagcgacgttctctgcttgtccaacgccaggaagggatgactatcggtcggtcgtgaccctatcctccatttgcgtccgttcctaa

SEQ ID NO: 32869 - DNA, 636 bp, Glycine max
  Peptide Sequence Number=SeqID_149647
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttggccccctcctcccccccgtgatcagttttgttgccaggattttgccaacttttggcttgcgccccgttggctaagtctgtgcctcggtggtggatcatcatgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 32870 - DNA, 390 bp, Glycine max
  Peptide Sequence Number=SeqID_149648
atggaaggaggggagaaccgggattcttatttcgtgtgggaaatttccaaatgttcccttgatggggacgcggggttgcatcaattacaatcccgtcctcactataagacaacttggttaccctatgagaggggcgccatcagaggaaggcctcatacctttcattacacgagggtccacaaggcatggggaatgtcggaaaaaaaggacaaggaacttagggggagtagcaatgggcccatcggcggctaccgtaggtggttgaaagcctacgcacaagatctggattggttcccgagtttgagcaccacttgggggatggagattgaaactctggaagaagacgaagaggtacaggccctcaagatagaacttgagaaagcccagaca

SEQ ID NO: 32871 - DNA, 912 bp, Glycine max
  Peptide Sequence Number=SeqID_149649
atgagattaaacctggaagcgctgctgattttggacgcgctggaccggcacggatctttcgccgccgcggccgccgcactgtttaaaaccccttcggcactcagctatatggtgcaaaagctggagaacgatctcgacatcaccctgctggaccgctccggccaccgggcgaagttcaccgataccggcaagctgatgctggaaaaaggccgggtgctgctgcgggcggcgcaagatctggagcagcaggcgcgctacgtggagaacggttgggaaagcgagatcacgctcgggatcgacgcctccttcccgtttgcccgcctgttgccgctgatcgacgagttctatcggcagcatcatcatacccggctgcgtttcagccacgaggtgctggccggctcctgggaatcgctggtttacggctgcgccgacattatcatcggcgccatctgcgagccgccgtcgcgggtgggttatgcgttcagccggctggggcagctggattacgtgttcgccgtcgcgccacagcatccgctggcggcgctgccggaaccgttgccgaaggatgagatccgtcagcaccgggcggtggtggtgcgcgatacctcgcgggtcaacgcgccgcagagcctgaacctgctggaagaacaggatacgctgacggtcttcggcttcgacgccaaactgcaggcgcagttggccgggctgggctgcggctatctgccgcgttctctggcggaaccttacctgaacagcggcgaactggtggcgaaacgcgttgaatctgagcgctgcagcgacgttgcctatttcggctggcgggaaagcgccagcggtctggcggccaagtggtggcgcgagcggctgcagcgttacgcggatgacggcgaggcttacccggcggcgcagtga

SEQ ID NO: 32872 - DNA, 546 bp, Glycine max
  Peptide Sequence Number=SeqID_149650
atggccttcggcgtggctaatattgatcgtcagcaactgaaaaacaacgttgttggtttggcgaaggcgggcaagattttcaacgtgccaacccttttcacctcggtagaaaccgaaagcttcagcggctatatctggccggaactgctggcggtacacccggaaatcaccccgattgaacgcacctcgatgaactcttgggaagacgcggccttcgttaaagccgtggaagccaccggccgcaaaaagctggtgatctccgcgctgtggaccgaagtgtgcctgaccttcccggcgctgatggcgctggaagccggctatgaagtgtatgtggtgaccgacacctccggcggcacctccgtcgatgcgcacgagcgttcgatcgatcgcatggtgcaggccggcgccgtgccggtgacctggcagcaggtgttgctggagtaccagcgcgactgggcgcgcaaagacacctacgacgcggtgatggcgctggtgcgcgagcacagcggcgcgtacggcatgggcgtcgactacgcttacaccatg

SEQ ID NO: 32873 - DNA, 363 bp, Glycine max
  Peptide Sequence Number=SeqID_149651
atgaggtggcacaaagatagaaaaattaaagatgggcaattgagacattcagctgattcaattacttggaaaactcttgactcaaaatatccatcttttgtggcagatccacgtaatgtaaggcttggattagctagtgatggttttaatccatttggaattatgagcccttcaaacagtatttggtcagtagttttagttccttataacttgccaccttggatgtgcatgaaagatccttttttcatgatgtcactacttattccaagtcttacgactcctagaaatgatactgatgtgtatttacaaccttcaattgaagagctgaaggaattatggggagaaaggtgtagtgacatatga

SEQ ID NO: 32874 - DNA, 315 bp, Glycine max
  Peptide Sequence Number=SeqID_149652
atgtggaacaaaggcatgaaaaggaatttttgtagtgatttaaaaatcattccacttccattacctggaaaggactttgacaatcgtcctctcatcacccctctaattatcctcaagactcgttgggtagacacagacaatggacctcgtttacaggtgctagtgcaatgggtcggtttaccaattgacgacacatcttgggaagattgggcttctttaaaagaggaatatcaccttgaggacaatgtgattttcgaagggaccgggagtgatagactagtcaacatgcatgaagcccaacacgaaaggccttag

SEQ ID NO: 32875 - DNA, 300 bp, Glycine max
  Peptide Sequence Number=SeqID_149653
atggttaaagatcaaggccagcccataatcccccttattaggaatggcatgccactggaatcccaggcgtgggagaagatgccttgtttgagaggaagcacgttttcatgcttccccaatgttgtttctggcaaccctcaattagagtttttttcaaccaatctcgaccaaggttgtgttcggccaacctcggctagggttgtgttcggccgatctcagttaggtttgtattcaatcgatctcagtcgaggcgattttcgaccatcttcatctatgattaatgttgccaacctcggttag

SEQ ID NO: 32876 - DNA, 246 bp, Glycine max
  Peptide Sequence Number=SeqID_149654
atggatgggatatttgagtttgtgatggtcatattgaaggggtcagtgccaatatcttttgagggtaacaaagaaccagctgcatatgctgagatagtttcaatgggtggtataaatccagaagtgaagaggaagctaattaataccattggcaccatattgcagtccaacctatctataccaagaacaagattttttctcaaagtctttgacacaacactattccgtactaaatccaaaatgtaa

SEQ ID NO: 32877 - DNA, 147 bp, Glycine max
  Peptide Sequence Number=SeqID_149655
atgccttgcctttacatctccaccaacataaacttagatggagttaacatcgatccaatcttttctcaagccaccactgcagtttccacaatcatcggcaagccagagaagcttatgaaatttggtctcaattctcaagacgtgtga

SEQ ID NO: 32878 - DNA, 543 bp, Glycine max
  Peptide Sequence Number=SeqID_149656
atgaacttcacggattgtgctacaatgctttattgtgacttccggcataccacggaacttcatgaatttcctaacgatgggtgccaagtacctcgaagtgtccgatatcgcatgcataaggcattgcgattacatgctccatttccatatccacacttagtcactctcttccttcaacactttaacatccctcttgattctgaaccttatcttccaatcaagagatccttcttaattggtgccgttgtgattgaatcttttggttaccgtaaagagcatgatggctcttgggtgaaaaaaggtgcacaacccattgatgaagaaggacacttaccagttggagaagattcctctcttcttcaaaagattttggacaggttcgatggtcttcaaacctttgttggtgaaaggtttgatgctttggagttacaagttgacatgcgattcgatgagatggattcaaggatcaccaaggtcgaaggagatgtctcttacatccacacaagctttgatctaccaccaccaccgccaccatcatcttag

SEQ ID NO: 32879 - DNA, 471 bp, Glycine max
  Peptide Sequence Number=SeqID_149657
atgaattcattgcctagcgctgttcatgtgtcctccaccttcgagtctggagccccgcgaattcattgcctagcgaagttcgccaattctccattctccacttttattcggagccccatgaatttattgcctagcgctgttcatgtgtcctccaccttcgagtctggagccccgcgaattgattgcctagcgctattcgccaattctccattctccacttttattcggagccccatgaatttattgcctagcgcttttcatgtatcctccaccttcgagtctggagccgcgcgaattgattgcctagcgctattcgccaattctccattctccacttttattcggagccccatgaattcattgcctagcgcttttcatgcatcctccacctacgagtctggaggcccgcgaattgattaccaagcactttcgccagttcttcattctccacttttattcggagccccatga

SEQ ID NO: 32880 - DNA, 456 bp, Glycine max
  Peptide Sequence Number=SeqID_149658
atgaaagatattgagctggtagaggaggaacaggcacggattggtgctgatccttctagtgggacctccaataaatctgagaattataaggaggaagcatggaagaaaacacagaagcataaaccaaagagggtggagagtgtcaacgctgatgcagaagcctttgctgaagcagtagaacatacgaacaaaagagatacaggccatcaaaatttggcattggacaataagacaggagattcaactatgctgaagatgggagattcagctaaagttgtgataaaacaagacatgaagggaagagagcataaatatgggtttaacaacaatgaacgtgagaagccagagaagaaaagagtggtggatgatgaaactggcaacaaacatcagctggatgaagtcctaaggaggcaaattgaaacaaaaaaccgatgcctcaataagagaaaaatgtag

SEQ ID NO: 32881 - DNA, 576 bp, Glycine max
  Peptide Sequence Number=SeqID_149659
atgccgacgctgtttctgatcatcctgctttccagcgtcgtacagcccaacttctggtggctattaggcatcaccgtcctgttcggctggatggcgctggtcggtgtggtaagggccgagtttctgcgcacccgtaatttcgactatattcgcgccgcgcaggcacttggcctccatcaccaccctcacctcactggattttctcggtttcgggttaccgttgggttccccatcgcttggcgaactgctgctgcagggcaagaacaacctgcaggcgccgtggttaggcatcgccgcctttctttccgtggccgtgctgctgtcgctgctgatttttattggcgaagccgacgagacgcgcaccgtggtcagcgacctgacgctgcagatccagcgcggcaagagcgtttcggcgctctccatcctgcggctgctgccttctccgccagtgagctacccgcaaggggatattctctttcacggccgttcgctgctgcacgccgacgaacagaccctgcgcggcattcgcggcaacaaaatcgcgatgatcttccaggagccgatggtgtcgcttaa

SEQ ID NO: 32882 - DNA, 141 bp, Glycine max
  Peptide Sequence Number=SeqID_149660
atgtctaccatcattttaggaagttttaggaataactgggaagcgtattttaacgatcctagaccattggacccagagagattaaaggcgttgcagatccaatgggcacagtattatctccgagttagagatcagacttag

SEQ ID NO: 32883 - DNA, 231 bp, Glycine max
  Peptide Sequence Number=SeqID_149661
atggaccgctcagtacgcattagtggattttggcttagcgtgtgcttttctcgctcagcaaatggactgatgcgctcatccttcttccagattcttcctcgcgctcagctgaggagtgttgcactcaacggatggctcgctaagtcagaagattggcttagcgagcggatgaaaatcagcacttcacaaactttcctaattaacctaaaattgagaggaaatggttattaa

SEQ ID NO: 32884 - DNA, 192 bp, Glycine max
  Peptide Sequence Number=SeqID_149662
atggcatcacgtggacctttttggacgagatcgctggcggtgatattgacaagcttaaaacctggtggcaattatccagatttgtcctttaacattgcacacataattggtgacaatgaagatgatgatggaagaaaaatccttagagagggaccacaattggataagatcaatggtggccaacaaggacag

SEQ ID NO: 32885 - DNA, 348 bp, Glycine max
  Peptide Sequence Number=SeqID_149663
atggggtttatccctagacccgtggtagccaatatgagttatatgcctgtcaatgttagtaatacatttgtcgctacctttgggggggcaagcgtgaaaaccttgtgtcgcaacctaccctttggcaggagggcgacgcgagggctcacgagcgcgtcttgcaagaaaggaaaatgtgcggagtcgccaccaacgtttattcaaggaaaacgtcgaaaaaaccgaaaaagacgtggtctacgaactttaagtgtgaaaggttcaggagttgtatttatgcacgaggaagggtgtttcccttgctcctacgtattcctcaattgtgataaggaaatcagacctacctag

SEQ ID NO: 32886 - DNA, 366 bp, Glycine max
  Peptide Sequence Number=SeqID_149664
atgacatcttttgatctgagagttcttctaatcttatcttgtaaagatttccctttctcttggcaaagaataaggggcccccatctaatgcaatcctaccccccaagggcattggatagaagactccaagaagattgggccagagatgcaatagaaggccctagggttctcatgagccttaggttgcatctccaatcacctttcctccttctccattccactgccattgatcttcaagaagtaaaggactccattgatgaagaagatccaaggcctacaagctctacatggagctacatcaccatctttgcattaaatgacacactcatctttgttgaaggagacaccatatccactgtcgcataa

SEQ ID NO: 32887 - DNA, 387 bp, Glycine max
  Peptide Sequence Number=SeqID_149665
atgcgtgccagagctagagtgataagtgaaatagaggaggtgcaagagcagatgaaggccgacatggaggccatgaaagagcaaatgaccacaatgatggaagccatgatgagaatgaaaagaatgatgaaggtcaatgcggctacagtcattgctgcaagtatcgccactgaggtggtcctaactcacccatctgacctcaatcaagtaaatcctacagtcgcggatatggtagggcagggaggcgaagtgttaagaagggagacacatgaattaccccgccacactgtagccaacttcgagcctcaccttggatatgccactgaggggcaggcatttggtggcatactgttcgaacccgacaagtgcactagatggcgcaagtag

SEQ ID NO: 32888 - DNA, 201 bp, Glycine max
  Peptide Sequence Number=SeqID_149666
atgaatataagagtgtctgtaattgctctcgttaaagcactagctagggaagggatgaatgatgagttgagtcggttattgcaaaacatattgaggagctgtaagctcaacgatgccaaggtagctaaagtacttgttgaggttaactttaaagaaggcaacatggatgttgttttgaatgtgctaactaaaatggcctag

SEQ ID NO: 32889 - DNA, 468 bp, Glycine max
  Peptide Sequence Number=SeqID_149667
atgatctacggagagaatgtgcacaaatattatgaagactttaaaatgagcaaacataacctttgggttaaatgtaaggaacacaaacgatctgtgaaattattgaatgataagctattaaaaaatcaagaatttaatggtcaacctcaagatgttgtcaaacttcatcacgaaattggaaccttaaaaactacattatccaaatttgtcagtggaacaaataatcttaacaaactattgggatactgtggaagttcctcagacaaattcggaaatagatatgatgggaagctatcacaaaaggacccaaaaagatttgtgtacctaagaaaaagattattcctattgcaaatgtccttaatagtaagaagtatacgtcgatcatggtacctagacagtggctgctcatggcatatgataggagaaaggtgtatgttcaaatgcttaactccctatcttggtggttaa

SEQ ID NO: 32890 - DNA, 850 bp, Glycine max
  Peptide Sequence Number=SeqID_149668
atgatgatgaagaaccttgtactcttcctatgtttgtgtttcttcactctcgttgtttccgaaacggactcgaacgacgtgaagattctgaacagcttcaaaagagggttgaataactcagagctcttaccatggcccgaagaaggaggagacccgtgcgggagccctccatggaaatacatcttctgcaacggcaacagagtcgctcagattcagaccaagaacctgggcctggtgggcccactccctccaaacctcaacgaactcaccatgctcgagaatctgggtttacagaacaacaaccttaacggtcctttaccctccttcaagggcttaaccaatctaaaatacatttttctcggtcacaacgacttcgattcgatccccgtagatttcttcgagggattgaagagtctcgaggtgttggctttggattacaacgaaaaactaaatgcaagtaatggcgggtggaacttcccggcaacgctggaggattcggcgcagctgaggaacttgagttgcatgagctgtaatctggtgggccccattccggggttctttggggacatggcgtcgctgtcggtgttgctgctgtcgggcaacaatttaaccggggagattccggcgacgttgaacgccgttccggcgttgcaggttctctggctgaacaaccagcgtggagagggactcggtgggaaaattgacgtcttggcgagtatggtttcgttgacgagtttgttgcttcgtgggaacagttttgaagggagtgtacctatgaacattggggatttggtttctttgaaggatttggatcttaatgggaatgagtttgttgggttgattgggagtg

SEQ ID NO: 32891 - DNA, 213 bp, Glycine max
  Peptide Sequence Number=SeqID_149669
atggggaaaggaggctcacggcggagccttccggaagaacattttccggaagaacacttcttccggaagactcccgaaaaacctcttccggaatctttccggaagaagtggttcatccggaagaattccagaagacgcgctcttccggaagaactttcaaattttcggaagacctttccgaaagaaccacttcttccggaagtgattttatga

SEQ ID NO: 32892 - DNA, 1974 bp, Glycine max
  Peptide Sequence Number=SeqID_149670
atgggtccgatcccggaatttgcagcgagtaaagtgagttatgagaacaatgaattttgtgaggcaaaggccggggttatgtgtgcttttgaagtgatggtgttgttggagtttcttggagggttggggtatccttggattttggttgattcttggagtggaaatgacccttgtcacgggccatggttggggataaggtgcaatggggacggaaaggtggacatgattattttggaaaagtttaatcttagtgggactttgagtccttctgttgccaagttagattctcttgttgagataaggttgggaggtaatgatattagtggtacgataccgagtaattggactagtttgaaatctttgacattgttggatctgagtgggaataacatttcgcgtcccttgccgagttttgggaaagggttgaagcttgtgattgatggggatcctcatggaagtgccccagaaggttctctttctctacccgggactggttcgtcgtctacaaagggtgaatctccttccactgataagcataatcctaatccatctgaagactctagtcccaatccaaagtctagtagttcttttgagtcgaataattcttccaatgggaaaaaaatagttccaattgtggttcctattgcaggtgttgcagctgccgcttttgtgctcattccgctttatgtgtattgtttcaggaagaaaaagggtgtctctgagggtccagggtcattggtgattcaccctagggatgcttctgatccggacaacgtgctgaagattgttgttgctaacaacagcagtcggagtgtttccacggtgactggaagtgggtctgggactatgactcgaagtggtgagtctcgtgtcattgaagctgggaaccttgtgatatcggttcaggttcttcgaaacgtgaccaagaattttgcacgggagaacgaggttggacgtggtgggtttggggtcgtttacaagggagaactggaagatgggactaagattgcggtgaaacgaatggaatccggtgtgattaccagcaaggctttggatgaatttcagtctgagattgcagttctatctaaagtccggcaccggcatttggtttctcttttgggttattcagttgaaggtaaagaaaggattctagtttatgagtatatgccacaaggggctctcagtatgcatctcttccattggaagagcttacaactggagccactgtcttggaagaggaggctcaacattgccttggatgttgctagaggaatggagtatcttcatagtctggctcatcagatcttcattcacagagatcttaagtcatcaaatattttacttggggatgactttagagcaaaagtctcagattttggattggtaaaacttgctcctgatggcaaaaaatctgtagtgacccgacttgctggtacatttggatacttggcaccagaatatgcagtgactggaaaagtcactaccaaagcagatgttttcagttttggcgttgtcctaatggagctgctaactggattaatggcacttgacgaggatagacccgaggaaacccaatacttggcgtcgtggttccggcatataaaatcagacaaggagaaactaatggctgctattgacccggccctcgacataaaggaagaaatgttcgatgtcgtctccattgttgctgagctagctgggcactgcactaccagagaaccaaaccaaaggccagatatgagtcatgctgtgaatgttctttcgccacttgttcaaaaatggaaaccattagatgatgacactgaggagtatgctggcgtagattacagtcttccccttaaccaaatggtgaaggagtggcaggagacagaaggaaaggacctgagctatgtggacctacaagacagtaagagtagtatccctgaaaggcctactgggttagccgagtcttttacttccattgatggccgatga

SEQ ID NO: 32893 - DNA, 796 bp, Glycine max
  Peptide Sequence Number=SeqID_149671
gaaaacagtggacgaggtttggtctgagatacacaaaggacaacaatctcagcaacaacaacagcaacagcaaaacaataacactaacaacaattgtggcggtggtagtaataataataatgtgcagaataccgaatctgcccctcgccaacctacctttggagagatgactttggaggatttcttggttaaagctggggtagttagggaacaaggtggaatggctgcaatgcctgccatgcctgctcaagcttcagcacatcaacatatgcagcagtatggcatgtatgcaaataacaaccctacaatgggggcttcttttgtcggtaggccggtaatggggatggcgggtggcgtcgatgtcggtggcggtggtggtgggaatgtggttgcaccgccttaccaggctgtgcctcagggtggtgttggtggtgcaattggggattcttctgggtatgctggaaatggaaagagggatgttgggtatccaccggcggcggtgccgccaccgggggtttgctttggagggagggtgttgaatggtggcggtggctatgcggcagtgagtaacatgggaatggtggcgccagtgagcccggtttcaccggaggggattggaaccggcgaaaactctggtggtcagttcgggatggacattagtgtattgagagggagaaagagggtgttggatggtcctgtggagaaggtggtagagagaaggcagaggaggatgatcaagaacagagaatcagcagccagatctagagcaagaaaacaggtagacataccttgttga

SEQ ID NO: 32894 - DNA, 447 bp, Glycine max
  misc_feature (418)..(418): n is a, c, g, or t
  Peptide Sequence Number=SeqID_149672
atgaagctcattgcaaatctagccaagtataagaaaaggggtgagggttgtgtgaaagattccaaatacttttctgggggtcaaagaacaaaggtggtcttgtcggaaatatatcagagaaagcgaagaaaaggggatggggatgcatcatgtaatgaggacaaggaggaagtaggtacaatgtttggggaattgtgtcaaagatccttgtggagttttatggatagggatctgatttctaaagaggagggaaatgacagtttcatgtctagccagagggaaggtatcagtaaacgtcacaaatgcaattacagtagatccttttccattatcatgagatctaagcagaagcaaaaaagattggcattgtggcagagtgtgaatgtctcggtggtgggtgtggcttgtcttgcaccgnttcagaatacatctaaggtgttgtggtag

SEQ ID NO: 32895 - DNA, 753 bp, Glycine max
  Peptide Sequence Number=SeqID_149673
atgaaggggctgcagccgggatcgccagcctataacaaactggtgggcgatatgcagcgccttgaccaggtgctgcgcgaattgcagccggtgctgaaaacgctcaacagtaagagcaacgcgctgggcgaaacagtgaaaaaagggctgattatcggtgctgtgctgctgctggcgggctgcagcagcaccatcgacaccacttattaccagctgcctgcgggcagcaatatggcgcgcgtcagcagtgacgcctccgccagccagccgatgatttgggttgaacaggtgagcgtgccggattatctcgccggcaacgggctggtttatcaaaccagcgacgtgaagtacgtgattgccgccaataatctgtgggccagtccgctcgaccagcagctgcagcagacactggtgagtaacctcgggcaggcgttgcccggccggctggtggccagtcagccgctgggtgacacgcacgatacgctcagcgtgcacgtcaccggcttccatggccgctatgacggcaaggtggtcgtaagcggtgaatggctgttacaacatcaaggccggcttatcaaacatggctttaatctgacgctgccgcagaccgaagatggctacgatgcgctggtgcgcacgctggcgctcggctggcagcaaacggcacagcaaatcgctaacagcgtgccagatatggcggtagcactgagggatttgtgtcgatttcacggcaaattgatgacattggcgtga

SEQ ID NO: 32896 - DNA, 294 bp, Glycine max
  Peptide Sequence Number=SeqID_149674
atgacgaaggatgtgatccacgatcacaactctatagcgtccaggctccactttccattttatttttcacttcctgtgtttctcacgctttctctctgcctctggatgtgttttccttcttcatttgcatggttatttatagaaaagagccaaaaggtgcaggcaaattcgcccaagcgatctaaactcacccaggtgaatttcttgcttagtgctgaaggcaccaattcgcccaggaaagttgtagcttgcccaggcgagttgaattacttatgcctgaagaaacttgattag

SEQ ID NO: 32897 - DNA, 698 bp, Glycine max
  Peptide Sequence Number=SeqID_149675
atggagtcaaacaatttttttcaagagcatttctcacagccagaggagctgagactagggttggaaggggttcggttcgattcacttaacgaggaaaataataaccatctcattgctccttttatagaggatgaaatcaaggaagaagttgatatagtaagggtggtgatggaaaaatttcctttacacggaagattttggaagagtgttaatgcctcgtttatatcattgatcccaaagaagaaggtagtgcacaaggtgatagatgaatctcaatctgtgtttgtggaagggcgaaacatgcttgatagcgttcttatggctaatgaaatcatcaacgatgtgaaagaatgtttggaatccttaatgatttatatgcttgttaatggaagtatgacaaaggaattcaaggcaaagaggttgaggcaaggtgacctttttgcgccattcctatttttggtggtggcagaaggactagaaggtttagtgcgagtagaaggagatttggtagcaagattcacaaggctactcaactgtgctacaatggtgttaccttttacgtttctaagtatattggttggggctgatccacgtatggatgcaacatggatattaatccttgaaaatcttaggaagaagttgactcctttgaaaatgccaagatgtgtggatacttctatcaagaacttgcaaaggac

SEQ ID NO: 32898 - DNA, 424 bp, Glycine max
  Peptide Sequence Number=SeqID_149676
tgttggtggggaagtagtgatggagaatgatgttggaaaaaagggcattgtggataagagtgctttgagctttgtatggttaagagagggtggccaggataatgggtggttcaatgaagggctcaagagagttgtggagggtggggggtggggaagacactttgttttggaaggaggcctagctaggggaggagatttaggaatggaggttcaattggagaagaatatatttggaatgggagaaaccgatgatggagtcattcatgaatcttattcaattggtagcaccaaggaaggaatccatactattcctagagagcaagtgaggaagttatgggtgattatacatcttgctacaatcttgtccttgtggttacatgggaacgaagttgtctttaaagaccaacaaccttgtggtcatgag

SEQ ID NO: 32899 - DNA, 462 bp, Glycine max
  Peptide Sequence Number=SeqID_149677
atgaagttggtaactctagtagacaaacacgtagaagaaaggtttcaaatgcgaaggtatttgttccttcgaattgtagatgcactgggcaatcatcatgagtacttccaaacaaggttcaatgcagctggtagaatgggtttttcaccattgcaaaaatgcattgtcgctcttcgtgtatgggcctacaaatcgcctgctgatagtgtagttgactatgttcaaattggtgcaaataatggcattaacgtcttaaatcgatctgatttgttaaatgacgttttgcaaggagaagtttcaacgatgcaatatacagtgaatggaaccaaatataatttggggtaccatctagcagatggaaaaaaagacaattattcacccaacaacaagaatccactagaaaggatgttgagcaggcttttggagtgctctaatctcgatttgcaattatacgtggtatga

SEQ ID NO: 32900 - DNA, 210 bp, Glycine max
  Peptide Sequence Number=SeqID_149678
atggaacaacaatactccttttcgacgctcattgtcgaggagacacaggccattgtcgaactagactattgcggcacgacagagggcgatgacgttgaagcggtcgcgggggcgttaggggctgagggagagaaaggcaaggagggggttggcaaagatggtgcatttgaagaaagcttggttttggaaggagtaggagggtgcgagtga

SEQ ID NO: 32901 - DNA, 450 bp, Glycine max
  Peptide Sequence Number=SeqID_149679
atggtgggaaatggacacgagttggagtgttaccaatggtttagggaagtccttcttcgggttcaggggcaagaattatgggtcaacttccatgtcctttctttatgtggcactaatcttgtcctctacgtcgagtggctgaaatcattaggcctgctgaagggagatcgtgacaatggcactggttccatcacggcagaccaacttcgttgtttagtgaagacagatgaggccagtgatttttttcaccttcgcattgagcccccttcaacccaaattcttcaatcgatgccacacacacctaaaataagggccctgattcgcaaatttgaacacctatttcaagctccgacatccttaccctctttccagaccacaaatcatgctattaacctccgttctaactcaaaaccggtgaatgttcgtccgtactgctacccctacttttag

SEQ ID NO: 32902 - DNA, 678 bp, Glycine max
  Peptide Sequence Number=SeqID_149680
ttggctgcaactaagatcgatggttctaactatgagagcaattcaagctcagtcgggaatgatggtgaactcggtaagggcggagaggctaccaacgatggggtcgagccgatcggtgagcgctatgaccttgtcaaagttgcaggttcccaagccgttgtgagagggaccaaggccacctctctgtcaatgcctccaagactagatcctcaagctcggcgtgtgtcgcgagcttaccaacgctataatggaagcattcatgaagatctgaatgatgagaagaaggaaaatagatctgattttgagaactttgaagatgaaagaagaacaagaattggatctttgaagaagaaagcgctcaacacatcctccaagttcaagcattcactggagaaaaaaagcagcagaaggaaaagcgatggttgtgttagctctgtttcgatcgaagatgttcggaatttcaaggagcagttcctgaaagtgaggaagtttgatattgaaagagcaaagcatatgtggaatgatatgctacaatggaggaaggagtttggtactgacactattatggaggaagctcctgaggagtttgatcagaccatatttgttgtacaaaaaaacaaaagcattggacctattgaggggcttgctctaaattttgtgaaggaccaacagaggtag

SEQ ID NO: 32903 - DNA, 477 bp, Glycine max
  Peptide Sequence Number=SeqID_149681
atgtacaaagcacacccaggtgccacacgcgaacctaaccctaccaatcaacgtgacttaaaaacagaccgaatcgccgtgatgctgctcggtgattcccttgaccacacctctaaggaacagcctgtgggcgaccacgaaccgggcacggaccagggtgtgggtcttggctccggtcgagaaccagtggctcgaccgaggccgaggagatggcgcgatcgtcgtcgccatcgaacgagagcacgatgtcaaggctctcgtaccggacgaagagcgcgatgttggggttcccaattaaggatgccctggacgtggaattttgccgttaactccgcgccggtgttggtttcgagggacttgacgttaagggatgttacatggaagcacgggaagtggggtgtgagggccatccataagaagacgcaacgagagagatcatggcgcagtagcttacgcgggagaggtggtctagggtga

SEQ ID NO: 32904 - DNA, 234 bp, Glycine max
  Peptide Sequence Number=SeqID_149682
atgggaagatctttccctagacttcaatgtcggccttccaccttatcagctgtggatgatattctatctgacagggaagttgtttttgcaagcttgaagaaaaagctcttaaagttccaagaacacatgaaggctttggcggatccccacaaaagagatgtaaattttgagccaggcgagtgggtcatggttaagctccgtccccaatccccattgtcaaatttcggcaactga

SEQ ID NO: 32905 - DNA, 624 bp, Glycine max
  Peptide Sequence Number=SeqID_149683
atggagattcagcacctgaacaaggtgcagtttgcaatggtaaggcaagaaatggaatctttgaaggagatgatgaatgaaattctggaaaaaagaagtgcagaacaaaccaagatttcgtttccagtgtatgatgggaatgtgtgtcaacagtggagagccaagtgcgagcaatatttcatgttggaggaagaaaacagaagtgcagacgaagtttcaagaggcaagagaagaatcattgtagcagagaagaaacacatcaccattgcaagaaccactagaatcatattcagtccaagtccaaaaaggtgtgaagtggagcattggaatcctggagaagaaaatggttccttttcagaaataatgagtccagtcctatacaacaaaatgggaaaaaggaaggaaaacaggaagctgcagaataagaacccgtacttcgtgttgttggttgtggctgagaggatgaagccattgccatacaggtcatggattcgccagaacagcgatgagggaggcaaaatacctagcttagttgacaggcctaaggccatggatttggaggacacgagaggaaggcctaaaagaagaactattcccccaattcacttaaaggattatgtctaa

SEQ ID NO: 32906 - DNA, 222 bp, Glycine max
  Peptide Sequence Number=SeqID_149684
atgaaatttggtttcatacaggtgagcataacattgattgcaactgggttcaagcgtcaagaggagagccaagggaggcctctgcaggtcagtcaactcactcaagcggatacaacctatggcaccaaccggcggtcttcctctttcgctgatggtggtttgtttgagataccagaattcctaaagaagaaaggaggaggttcacgctatccaagggcgtaa

SEQ ID NO: 32907 - DNA, 486 bp, Glycine max
  Peptide Sequence Number=SeqID_149685
atggaggcccgagacacacatcctttcacctaccatggggtgaaggccctccagataatgcacgtaagggagctgaagctaacatggttgcttagcatcttgcacacaccattacctaaagaaccaacaatacaccaactacaacgcaagtgtagagcttacataatagaattgtgttgggcatcattggaggttggtagagttatgggtggttacgccatactattgcaatcatgggtttggtaccgcatgccttttattgcaccaagtgtctcacaacacgaaacaacttatccactcgctaaaagaggatttgaagaacacctaccgaaacatgcatacagagacaaggagatttggtctacatgtattgcaattatttgttttccctttgtggaatggcatcaaacaaaccaggtcaagctacaatttggactacatcaagatatccttgttgatcccatgaatcttgatcgacttcactag

SEQ ID NO: 32908 - DNA, 291 bp, Glycine max
  Peptide Sequence Number=SeqID_149686
atgaccaagagcaagggcaaggatccacttgaaggacttggaggacctatgacaagggctagagcaaggaaagccaaggaagctgatgagaatcatgaaacaagccaaatacatttctctctgagttccttgttgaaccaatctcagacttatcaaggtaatccttgtggcgtctaccctgacttatcttccttcaccggaagtggcgtcatccaaacctccgtagcctgtatcaaacgatccactcctactcaggttcacatcatctggtatcagagcttcggctcttga

SEQ ID NO: 32909 - DNA, 390 bp, Glycine max
  Peptide Sequence Number=SeqID_149687
atgttggacttgaaatgtcatccaattccagaagctagtaacgaggatgatttagatgatgtacctgttgctggccatgaggaagatgttggtggtggagagaaaggtattaatgtggacattggtggtggtgaagagagagatgttggtcgtggtgaagagaaagatgttggtggtgatgaggaggaaaatgttggtaatcctgatgatggagatgacaatgatgaggataagtggtttacagacttctcttgtatgagaaaggaagttgaagttgaatatgaaatagatggttatcattcagaggagctcaaaaaccacattagtagtgattatgaagatgaggatgttcacaaagtttatcctcaacaaaatgacaaagggttatga

SEQ ID NO: 32910 - DNA, 501 bp, Glycine max
  Peptide Sequence Number=SeqID_149688
atggttacacaaaacaatgagagtgaaaattttttgctttgggaccgtgaatgtgctgaattgattggccaaacagctgatggtgtgaatagggtcaagattgaagatgatgatcttgatttgaatgcttcccctcaagcacttgacaaattgttgggtcatgtgcttgcttttaaggtcaggattcaatcaagattcaaaaatctagttgtacttaaatactcaaaagacctggatttgatcaatgctgttctggagatgctgcctgatagtgagacatgtttcaaaatagatccttccaatgttgattgcaatgatgctacgcatgctgaatgtcaatttctttctgccacagctgaccatgatccagttgcggggttacctttaacacccaaaaggcgaatgtcatctgatgaagccaatgatgagttagggagctctcaaatttcgccagcccagatattgtctaacaaattaacaagacattctcataggagctaa

SEQ ID NO: 32911 - DNA, 369 bp, Glycine max
  Peptide Sequence Number=SeqID_149689
atgaagatgaaagcaaacaaaacaagaaatggattgaaagtctcgaattggaacacttaccggttgaagaacgaagaacggatgaagaacgatgaagaacagaggaaaatctacatagatttgctcacggaaacgtctcgaaagcattacggaagcacttcgactcattttttcttcacggaaatgtgttttttacccaaaatagccgaaatgcatagcctaggggtcatgaacatttttttgaaacagcccccctcccctatttatagggaaaaagggaggcgcttgccgcccagaggcttcttgaggaagatttctaagcgcaccccaattactaagttcaccccccttttcgtactttacggaaaa

SEQ ID NO: 32912 - DNA, 322 bp, Glycine max
  Peptide Sequence Number=SeqID_149690
atgatcgaaagttttcaacaacaacaacaaatgtcagttctagaattgtacgtagaaaaggatgttgctggtggttctatgtttcatgttgcaaattctgttacgtcatgtggatgtaatgtatctcatcatgagtcggaactgccaagaaatataagcaatttacatgttggtgaagatgatgatgatgatgattatcttgcatctaactcatacgttgaagagtttttcgatgacgatgatagtgatgatggaatatctgatacagaagatgaagtcactgacatcgttgaactagtttcagttgttcacccaagcgaag

SEQ ID NO: 32913 - DNA, 447 bp, Glycine max
  Peptide Sequence Number=SeqID_149691
atgaaagaagggctgaatattattgagaagaaccaaacatgggaacttgtcagcctgcctcatgataagaaactcatagtgttaaaggggatttgtaaagtgaaggtgaatccaaatggtgaagtgatcaaacacaaggccagactagtggtgaagggatttctacaaaaacttggagttgactatggtgaggtttatgcacatgcggcaaagacaaaaatatctgcttccttgaatggaccattggacgaggaagtctatgcaatccaagtgtcaggttttgagatctttgatcaagaagagaaggttctcagattgaagaaggccttgtatggccttaagcaagctccacgtgcttggaacaaaagatttgacaactttctaagccaaataggctttgttgaatgcacatctgagcatggaatgtgtctaaaggtcttgaaaatg

SEQ ID NO: 32914 - DNA, 807 bp, Glycine max
  Peptide Sequence Number=SeqID_149692
atgtctgatcaagagtccattgttgattatttcagtcaggttcaaatgcttgttaattccatgaaggcttgcaaagaagagatgattgatcaacaagttgttgacaaggtggaagagctgcaaaaaattcttgaagcacacgatggatgcaagaagaaaggaaaaggaaaatggaaagagggaaagagcaatgaatcaacaaatggtcaagatcatggcaaaggaggaaagggaaaattgaatgatgaagcaaatcctactcatgatgataggttagattctaatccactgttgttgatggtcaccacaagcaaaagagactggtttgtaaggcttgatgaatcaacaaagaacaaagtcatattttttatgatagcacataaaggaatgaagagtaacctcctaagccttggtcaattgctagagaaaggatttgtgatgaaaatagaggataatgtgctaaaggtgtacgctagcaagaagagactagttctaaaggctcatttgtcaaagaacagaacctttaaggtgcgaattgatgttatggaacatgaatgtctagccacagtagtgagaaaaacatcatccattgttgcttatattctaaatagaagcccaactaagtggttaagtggaaagacaccagaagaagcatgggtaggcaccaaaccaaatgcgactcactttagagtgtttggctctatatgcttcagacatgtgcataatcaattaaagagaaagctaaatgacaaggatgagcaaatggttcttgtagggtatcactttactggtggctacaagttgtag

SEQ ID NO: 32915 - DNA, 522 bp, Glycine max
  Peptide Sequence Number=SeqID_149693
atggggtcgtttctaaaatatttgcaacatggggtacttttttacgtgggaatgattgcatgcaagacccaaaccgccattgtcaatggcgagtttggtatcaaagccatagggaaccgccagtcaaactggcgagttccaatagatgagagtgcagcaggtctagtctgccatggcagtgcagtgcagcatgcaggagcgcgtcgtcaaggccaaatcgccattaccattggcgatttgccttgcccacggatcaccaacatggctggcgggttgcttcaaaatattggttcttccattataaaagctgagctccgagagtgcacagctacgcttccttcgttcctttgcttccattgctttgctattgttcttcataagtttctcagtgcgttcttgttattttgttgttgtcttttgtttttgggttgtgatttgtttcactccttatacgtggtttgtctcgtcttctcgtcttcatattacgtgacttctctgtacttgtggtatattatgatttaa

SEQ ID NO: 32916 - DNA, 441 bp, Glycine max
  Peptide Sequence Number=SeqID_149694
atggggcaagaaaaggaagatgaatctcaatatttggagggattggtccttgactctcgatatggagaggaattagtcttagattgtcagtcagggaagtatagcggcaaagataacaacacacatggacaaactccatctgcttcaaaagtccacaacaaggttgaaattacattggattataatgctacaacagaaggaactagtgttgaaggggaagatagtggacgtgagaggttgaagaggcatagagtggaagtggctggaagagtttggattcctgacatatgggggcaagaggagctcttgaaggattggattgattgcacagcatttgatgctcctttggttccaagcagaatcgtgatggcacgaacggctttggttgaagaaggtagaagagccacatcgggtggattgagaatcgagaacaggtgttga

SEQ ID NO: 32917 - DNA, 354 bp, Glycine max
  Peptide Sequence Number=SeqID_149695
atggcggatgaaggatcttcttcttcacgtacaagaaaaacccagaatcatgatcccttgtccgagctttctgatggcactcgtacaacggttcagagccttatgttgttgaaacttggtggcaaatataatggtgatgatgtttcagggaagaggaagagagttgcgtccttaggtgaacaagaggttgatcaaatactaccaaataacgatataacttcagtgaaaaaatccaaaaagatatatgataatgatattgaagtggttgtcaatggcccaagaatgaagaaacaccgatctcttgcaaatatatataaggccacaaaacccatcattcatcctgcaaaagagtaa

SEQ ID NO: 32918 - DNA, 153 bp, Glycine max
  Peptide Sequence Number=SeqID_149696
atgattgcatgcaagacccaaaccgccattgccaatggcgagtttggtgtcaaccctaaatcgccagttctaatggcgatatgtagtagcatagggaaccgccagtcagactggcgagttccatggtacatgcctacgtcgcaggccagctag

SEQ ID NO: 32919 - DNA, 219 bp, Glycine max
  Peptide Sequence Number=SeqID_149697
atggatgcatcatacatgtgtgggttgtatgttgatgacaatcttcccttcctgattgcccttggaaaagtttatgaggggtcaacaattgtgcaccacatccctttaggcattgatatggtgaaggataaacaggtaccaaagggaccgacgaagcccgttgataggccaaaacctgatggcaatcccacataccaaatgacattgatgatcctataa

SEQ ID NO: 32920 - DNA, 141 bp, Glycine max
  Peptide Sequence Number=SeqID_149698
atgacgatagaggctgaagcagcgagggaggaacctatggtgaggagaggttgcagtggtgacggaggaacctacatgtgtggtgaccgcttttacttgccacgcgctatcgcgttacccgcagtggccggtcacgattga

SEQ ID NO: 32921 - DNA, 498 bp, Glycine max
  Peptide Sequence Number=SeqID_149699
atgagacctaaccgatgttggatgttacaaagaaagaatcgtttcggtttggtaactaaagaattcaaaaatggaattgatggcttcattcaagttgttgcaagagacccaacaattgttgatgcatcagggcgcattccttgtccatgtgccaaatgtaggaaccgttatagggagaagtcattttgggtggaaaaacatttgtatgaccacaaatttgtggatggttacataaattggacccttcatgatcatgttaaggagcatagaaatccatatgtggatatagttatggatgttgcttatgatgtattaaatccaaaagcggaagagattgaagaggatccaaatccgtcgacgtctaagttctataacttattaagtgatgttgatgaacctttatgggatggttgcaagaagcatatgaaattgtcaggagtaacacaactcctaaacttgaagtttgagtttaacatgagtgtgagttgttatgattga

SEQ ID NO: 32922 - DNA, 264 bp, Glycine max
  Peptide Sequence Number=SeqID_149700
atggaaaattcttggcctccacaacatttaagtaggacagatgtcttaagtcaagtgaatcaacttaatgaaatcactttagggttgaaatcatgcaaacaaaagcaacttggccatggacaagacaatgcaaaggcaagagaagatttgaaggtgatatgtaaacacttagagttgatagttaagaataagaagtttaaaaaaccaaaggcaacatatgtcttgaatcctagtaaaaaacgatggggtgtgcgagtggaataa

SEQ ID NO: 32923 - DNA, 597 bp, Glycine max
  Peptide Sequence Number=SeqID_149701
atgcccgaattatctcttcctcaggattcttactttctcggattcgacagttccacccaatcgttaaaggccacagtgttggactccaacctcaacatcgtagcctcagagcttgttcgtttcgattccgacttgccccattacaaaaccaaagatggggtatacagagacccttctggcaatggcagaatcgtttcacccactttgatgtggctggaagctcttgacctaatgcttcaaaagctttcaaaaccaaattttgattttgccaagtgtgtattggatcctaagaggccattgttggatcagcttgaaaatgctttttccattaaggaatccccaatttggatggattctagcaccactgctgagtgtagggctatagagaaggcttttgggggagccttggagttggttcatgtcacgggatctcatgcatatgagaggtttactggcccacagattaagaagatatttgatactcggccagaaatttatagcagcactgaaaggatctcgcttgttagttccttcatggcgcgtctcttctcgttggcgcttatgctgccattgatcattctgatggtgcaggcatga

SEQ ID NO: 32924 - DNA, 237 bp, Glycine max
  Peptide Sequence Number=SeqID_149702
atggaaacacaaaagatcaccaaaggagaatggaagaagtttccaaccatgacaacagaagaattgaagaagcttacgattaggaagggtgaagaattgaagattgccacaactacagagggaaaagaaatgaaagttaagctctgttgtgggatctccaacacacactacctcttgctgatgactgaacatctcgaacatgaagtttgcaagactagacatttgcagatggtttga

SEQ ID NO: 32925 - DNA, 480 bp, Glycine max
  Peptide Sequence Number=SeqID_149703
atggaaaaagaaacaaaatcatccatgacaaacgcaaaagatcaccaaaggagaatcaaagaatgttctgcggcaacagaagaagaattgaagaagcttacgatcaaaaaggagaagaatgctgcaactacagagggaaaagaagttaaactaaaagttaatggaaaggaaaatgcaaggacaaggatggatggttatgtgccttaccattctgctagaattgaatcatgccaggctgcttcacgtgacacttcaaagaagggtaagctgttcctagagatgttgaatgcttgtttggaccaaatccgcgccaactccatgcaacgtggagtcttcatgcgctgtgatgtcaactttgatgcatctacccaaggcaagaatctggactctataataggtcgggctgcacatattgaatttctggattctgacattttcgcaaggtttataatgtggtcattcccagatctttttcgatag

SEQ ID NO: 32926 - DNA, 903 bp, Glycine max
  Peptide Sequence Number=SeqID_149704
atgggctttggtggagttacttctctagatatgaaaaatgtcttgcttgttaaagcattattaacttctcgtgatatattgcttgaagaactacaaaaaaccagcaaagcaattaatgaatctttagatatttcagagtttgtgtcaataatgagtaatacgaagttattaaattttgtgctgcgagcaaatcaatttgcaataaatgttgaagttgtcggacaaggcaagccacaaaatggtcttaaggcaggaaatgaagctctggattttctggatgttgaaaaactccattccctgtctcagaatgaactgttggactgttttcattcattaggagatcaattgttatatttatggaaaatatttttaaagttccatagggataacaaaacaaagattttaggatttttatgtgattcatgggcgaaggaccggaaagctgaatggtcaatatggatgttatattctaaggtagagatgcctcatcattacataaacagtaagagtgaagagtcttcccatcgcggtgtacacagacgagtttccagtttgtggaagttacctgatgatcctcttcagacagcgactacacgtgctgaacttcatcgaaggagcattgaacaaatgcggattaacaaccgctcagttcaagacatgcagatatttggagatctcttgcatactccaattgtgattgttgaacatgtgatgaatgtaccccgtcattgtccaagtgcaaattcattactgaaacatattgggagtatagattcagatggcttaccaattggcctcagctctgatactataggcaagaaatttgcaccacaaactgtttggatctgtcataggattcagatgaaggttgttgagttctatactgaattgaaggttttgtga

SEQ ID NO: 32927 - DNA, 696 bp, Glycine max
  Peptide Sequence Number=SeqID_149705
atggatcctagcagtatatatggtgtatggaggatcgatgatacggataatagtttctcaacacagtcttttcggataaaatacgctaggcaggatgttcatttgtatatgatgatcgtgttcaacttatcctgtagtgaatttgtgggcatcttgtgggaatcaaattgtatcttgggtagcagacaacatttgagccacaacccaagacatatttattatgaattagttctcttggattttgggaatgggcctaactcaaccctacaaagccgacttggaaatgaatatggaactaattggctgggacttgagtatcagattgaggatttagctacaactgctgttattttaaaatttgagcttagatatgctcccgcaactgaggttggtgccgacatgcaagcttctccggatgattcccctgcagctatccatgaattccgaattcctcctaaagctcttataggattgcattcttattgtcctgtccattttgatgctttacatgcagtgcttgttgatgtaagtatacatgtcactctactgaaagctgcctcttactcatctgctttggagttgcccaggaagcatggattcagatatgaactctgttatgacattggtctgatacatgaacataacaaatttctaaaatttataggacatgacatggatgagatacaacatatataa

SEQ ID NO: 32928 - DNA, 2031 bp, Glycine max
  Peptide Sequence Number=SeqID_149706
atgacgtcttctaagaggcctaatgcggggccgaatgggagagggaaacgccggagatcttctggcggtttttcgtcgttgggtgtttctccggggagcgttgtgttccgtttgctctgtcatgcttctagaattggcggtgttattggcaaaggtggttccatcatatcgcaaattcgccaagaaactggcgtgaaacttaggatcgaggaagctgttcccgggtgtgatgaaagggttatcactatctcaggttctgaaaaagagactgaagaagataacactgaacagggaaaggaggttaatgataatgatgatggtggaagcgaggggaaggatcgggaggagaaggatgatggcgatggtaatgaagataaaagagaaaaagatgccgttcccgttgaagattcaaagagcgagaaggggaattcggctatttggaaggctatatcactagtttttgagaggatggttgagggagtagaggagacaactgaaggagatgaagaaagtaataaaccttcttccttttttttgaggctacttattcttactgctcaagttggttgtgttctaggaaagggtggtagtgtgataaagagaatggcagctgagagtggtgcacagattcggatccttcctaaagacaagcttccagcgtgtgcatcggcttctgatgagatagttcagatctcaggaagtgtagaagttgtcaggaaagctcttcaatctgtttctcaacaacttttggaaaatccgcctcgggatcatgattccctgtccgccaagtctactgggccgtcgtctcattcatttgggcaattcccaccacacaaccgttctttttctgctcaaggagaaccttttgctagtggtcctcatgatatttctgcttttcattctgccgctcctctgattcccaagtttcatgaagctgccatccacggtcgcatgaggcctttacaagaaatgcttacttttcgtttattgtgtcctgcggagagggtaggaaatataattggcaaaggtggagcaatcataaagaccgtgcagcaagagacagcaagtgagatcaaggttttagaagcccctccagattcagaggactgtgttattgttatatctggtccagcgcacccagaggatagaatatcccctgtgcaagaggctgtatttcgtgtgcaaactagaatagccaagcctatacctgatgccaaagaccatattatgttagcaaggtttctggtttcttccactcaaataggttgtcttcttggcaagggtggttccatcattactgaaatgaggaagaaatcaggggcccatatccgtatattaggaaaggataaggttccaaagtgtgcttcagaggatgaagaagtaattcaggtgaatggagaaattgaggcagtgcatgatgctctcttgcaaataaccactagattaaaacatcattgctttcgcgattcatatccatctgtcaattatccttcaaattctccatttctggatcaacttcctccattcccaccttatttaggaagaaggggactttcacctcctaggatgtattctgaccttggtcatccacatccacacgcgggctttcctcttgatgatcgccctcctttcttgaatagtatacatagaccaggccttcctcctcacatatctgaaaggaagccttggggtccacaggggatacttgaaggtggcatacccattggcttgccagactttccaggaggtcctcctagaagaatttcaggatttgcaggggggagccaaccaattatcacaagtaccactgttgaagttgttgttcctcgagcagtggtgcctgtaatatatggggaagatggtgaatgcctaaaacaaatacttcagatttctgatgcaaacattactattactgatccaaagcctggaactgtggaaactaaaattataatatctggaacccctgagcaaactcatgctgcccaaagtcttattcaggcatttgtcatgagtgagagggagtcagtttga

SEQ ID NO: 32929 - DNA, 273 bp, Glycine max
  Peptide Sequence Number=SeqID_149707
atgccacgctctgcgaaggtcaagtcggtggcaacattggaaactgtacgggagattggtgtctatattcagaggtttcacaatcttgacctttttaagcagggatggtatcggattaagattactgtgagatgggaggacagtgaaaatatgtctttcggaattccagctagtgttgttcaatatgaaggtaacttatcaaaattatgctctggtggggttgtgcgagtaaactcggtgggttatatgttataccctacccaggattcatga

SEQ ID NO: 32930 - DNA, 354 bp, Glycine max
  Peptide Sequence Number=SeqID_149708
atggcagctgcagggaattataaaataggtgcagcacattttcaatcattgtattgggttcaggtggtccctaatataatgggtgcaggacatttgctatcacagtgggtgtggttggtgatgtatgtagaggcttcgaggagaaagtactggtttattgtgatgggattattacccaattgcatgtggaattgtccagcaatcaactccatagaactcgctgcagatatatatgctgctgatgacaatatgacagaatacactaattgtttgacaaatggaattctagaggcatactcagggatcttagaaggatttaaaggttccccaaagacccaatttctaatgtcttaa

SEQ ID NO: 32931 - DNA, 480 bp, Glycine max
  Peptide Sequence Number=SeqID_149709
atggcacgcaaaccgaggcaggattttagcattcaaaaagttaaatttttttctctccttgtggctgagtatgagtcacatcaagagaaaaagtgggcccctttttgttccactcaaaatgggacaagtggcaaaaaaattcagaagctcttctcatctcccacgttgcttttcttctccctttctcatccaccattgttgcccattaaagctccaaactttgctcaccatttctactccaaattacaaaaggaagccattttcggagtcgtgaagcgcacctctacgttgtgggacttcaaatttcaggtttgggtagacttcttctcgcatgctaaacttgacataaaactggtagagatgatggggagagttaacctagggttaaatgtgagaatggtagtgatgacttgtgggaaagcttgggttgagcaaatgagaaaaatgagagacaaaggtgaaagcaagagccatttctag

SEQ ID NO: 32932 - DNA, 510 bp, Glycine max
  Peptide Sequence Number=SeqID_149710
atgaggttgagggaggaggtagcgtgtaaaaacgacgacgtttgtgagaaagaggaagtggtgatagagaatgacgtaaccgtggcccaaaatcattggtgtcccgtggtgaatgcggggttttcttcgcccaagagagtggttgtggttggttacgctcttactactaaaaagattaagagctttttgcagcctaagcttgaaggtttagctaggaacaagggaatactattcgtggctattgaccataataggcctctttcagatcaaggtccttttgatattgtcttgcataagttatcaggcaaagagtggcgccaggttcttgagttgaggtcgaggcctcaaggttcctgcaagttcatttctcctggctgcaaggatactaggatagaattctggctggttaagagagaaagtatgacttttcacttatcagttcttttcttaactccttatattccaatcctttatgctgtagtgtttgctgtacttgttaacgggatatag

SEQ ID NO: 32933 - DNA, 171 bp, Glycine max
  Peptide Sequence Number=SeqID_149711
atgcttaccgtgtgggtggaaatagctttgatggtcgcaacttggattgggcaaaatcagaagataaggcttatggtggtcgaaatcaacctccgtggcgacggagcagagagactgagggagcgaggtcgagcaaaggccccagagaattgttacaaccctgacaaataa

SEQ ID NO: 32934 - DNA, 324 bp, Glycine max
  Peptide Sequence Number=SeqID_149712
atggccgttgacttgaacttctctttgaccgctcaggcttgttcaagcttcgcttttagggcttgtacttcctcactttctttcggagcttcagcctcttcctctctcacgggggagccaatccaacccttgtgtccagactctcagctacttatgatagccgctgatgatcccattactgcttcccctaagatctttgtccttcctttgcaccgcatcccatgccttgtggactccttgaagtaccatcgcattggggtcactaaaaccccgtgcgatgaaaggcgtgatgctttccccaacgatgctcctctcatggggtag

SEQ ID NO: 32935 - DNA, 369 bp, Glycine max
  Peptide Sequence Number=SeqID_149713
atgtcgttggtttcaagcatgttcgggtgtggagtggtgatggcggcgtcgcaagcaatgggaattggaaggagaagcgatggtggattgacgatagtgtgttcgtctaggccgcagaagaaagcgacggcgcatcacatgaagactcggcctcggaagacgcaggcatgggatagaaaccgcaagcccaccgtctacgatccactccctcctcttcctcctgattggaccctcgttattcccgctgacgcttcttctgctccccagcttttctttcatgttttcatctcaaatcaaaccttcatcatttgttttggatcaataaatgtttctgaattctctctctttcgtacggttcgcatgcgttag

SEQ ID NO: 32936 - DNA, 840 bp, Glycine max
  Peptide Sequence Number=SeqID_149714
atgagagtggaatcaagatgccctctatgttctatgacttggagatttattgcagattataggctatcacatccagaagttactgttctggatcctccagatgccatacaacatttacgcaaccgtcagtacatgcttcaggctgttgcggatatgaacctttctgattcctatggcatcgttggtgttcctcggcaattagttattaagagagacgcattagccatcccagagttggtcaacaaagctggcttgactttaccccttgttgcaaagccactagttgccgatggaagtgcaaagtcccatgaattatcccttgcttatgagcatttttcccttcaaaatcttgaacctcctcttgttcttcaggagtttgttaaccatgaagcccatcatggtaaagtgaataacaagtgctactttatttttggcgtaggaggtgttcttttcaaggtttatatagttggtgatgctataaaggtcgttaggcggttttcattacctgatgtaagcaagtgggaactctcgaaagatgctgggatatatcgttttccaagggtttcttgtgctgcagcttctgcagatgatgctgatttggatcctactgttgctgagcttcctccaagacctttactagagaaactggctaaggaacttcgatggcgattgggtcttcgtctattcaacctggatattatccgtgagtatggaacaagaaatcacttttacgtcattgacataaactacttccctggatatggcaaaatgccagaatatgaacatatatttacagacttcctgttgagcttggggcaggggaagtacaagaaaaaatag

SEQ ID NO: 32937 - DNA, 320 bp, Glycine max
  Peptide Sequence Number=SeqID_149715
atggccgttgacttgaacttctctttgaccgctcaggcttgttcaagcttcgcttttagggcttgtacttcctcactttctttcggagcttcagcctcttcctctctcacgggggagccaatccaacccttgtgtccagactctcagctacttatgatagccgctgatgatcccattactgcttcccctaagatctttgtccttcctttgcaccgcatcccatgccttgtggactccttgaagtaccatcgcattggggtcactaaaaccccgtgcgatgaaaggcgtgatgctttccccaacgatgctcctctcatggg

SEQ ID NO: 32938 - DNA, 309 bp, Glycine max
  Peptide Sequence Number=SeqID_149716
atggcgaaaacaatgaagtcattcgaggataggattgaggccctaagggggtggcttttgcccgagatcgatccgattgacactgttgttgataacgagaaggtgtataaggttcagatggaggaggcactaccgctgtccaatagccacgagaaattggtttggccagttgtccgattgcaggagaggaatattgtcctcacgaggattaatcctgagggtttaagtttggggttttgggaattggtgaaatttgatgagaggcgaagcttgggggttttgggaataggtgaaatttgcttagagtga

SEQ ID NO: 32939 - DNA, 237 bp, Glycine max
  Peptide Sequence Number=SeqID_149717
atggataaagactacaaagtatttgtttggttgaacaatgtgaaaacatatttggacaaattgttgtatcttatttatcctctatcatctgaaatcgtcaaggcaaatagggtaatgatggaaaaagcatgggctggggcagcatacaatctgatgctttatatgctagctagtcattatctaggaagtgatcctaggtcatctggcaacgagcaacgatcaaccaaatcttcataa

SEQ ID NO: 32940 - DNA, 117 bp, Glycine max
  Peptide Sequence Number=SeqID_149718
atgacggcggcggagaagacgaactatagtaagtgcacccaactcgatctgaatgcgcgtgcagtgtgtttgagtactgaccacgagagcaagccagctgcagagttaataattagg

SEQ ID NO: 32941 - DNA, 279 bp, Glycine max
  Peptide Sequence Number=SeqID_149719
atggtttctaatagatcaaaatctgtgagatttcaagatgaacttgagacaaataagttaatggacaacaaagaaagtcacttgccgatggtgtcctttgatggagtgagcgataaacagaagggtggaaaggatgcaataggcaagtcctctgatggaagagaactttcaagggtctttactgaggattatgatgcagcagagatttcggtattggatcctatgggaaatagagtaaatacatggaacaaaatcttcttagctgcttgtttgctttag

SEQ ID NO: 32942 - DNA, 174 bp, Glycine max
  Peptide Sequence Number=SeqID_149720
atgtctcatcatcaaagaaagctatgtctagaaaatagagtagatgatcatggagatgacaaggaaggaggaactagtgctatgggtgcttcagatggtctgtggcatcgatggccagcaacaatagtggtagaggacattcccttttgcttctttgatgattctgccatttga

SEQ ID NO: 32943 - DNA, 1105 bp, Glycine max
  Peptide Sequence Number=SeqID_149721
aggactacccgtcctcacctttagagggctacacgccctcgccatcagggggctacacgtcttcatcttcaggggactacacgtcttcccctttagagggctacacgccctcgccttcgtaggactacacgtcctcacctttagagggctacatgccctcaccattagagggctacacgccctcaacttcagaggactacacgtcctcaccttgagagggctacacgccttcgccattggaggactacacgtcctccccttcaaaggactgcacgtcttcgcattcagaggactacacgtcgtcgccttcagaggactagacgtccttgcctttagagggctacacgccctcgccttcagaggactacacgtcctcaccttcaccttcagaggggtacaggtcctcaccttcatagggctacacgccctcgcctttagagaactacacaccctcaccttcaaaggactacacgtcctcgccttcagaggactacatgtcctcaccttgagagggctacacgccttcgcctttagaggactacatgtcctccccttcaaaggactgcacgtcctcgcattcagaggactacacgtcctcgccttcagaggactacacgtccttgcctttagagggctacacgccctcgccattagaggactacacgtcctcaccttcaccttcagaggggtacaggtcctcaccttcatagggctacacgccttcgcctttagaggactacacattctccgcttcaaaggactgcacgtcctcgtattccgaggactacacgtcctcgcctttacagggctgcacgccctcgccttcagaggactacacgtcctcaccttcaccttcagaggggtacaggacctcaccttcatagggctacatgccttcgcctttagaggactacacgtcctccccttcaaaggactgcatgtcctcgtattcagaggactacatgtcgtctccttcagaggactacacgcccttgcctttagagggctacactccctcgccttcagaggactacacgtcctggccttcaccttcagaggggtacaggtcctcaccttcatagggctacacgccctcgccttttga

SEQ ID NO: 32944 - DNA, 282 bp, Glycine max
  Peptide Sequence Number=SeqID_149722
atgggttttcacccaacaaaactcaatttcgtgcctagcgatgcggatgaggcgccactcgatgtttccatttgcctgcatgcctttggtattgtggggtgtggttcgtttagtggtgtcagtcttgcgaacgtgagggtgctgacgattggttcctgtgttgcctacctaccaaacggtattcgtgtggctagtcagacccattccatccaggcctctttgttggggacgctggaggatttcaaagtcccacacgtgaaccacgttagtcgtccatcataa

SEQ ID NO: 32945 - DNA, 372 bp, Glycine max
  Peptide Sequence Number=SeqID_149723
atggaggattgccttgagggtccgcacttaggcaatcatgaaacacagctccaaactcgaaagtggaggacacatgaacagcgcaaggcaataacattcatggggctccgaaaaagggggagaatggaggattgccttgagggttcgcacttaggcaatcatgaaacacagctccaaactcgaaagtggaggacacatgaacgaaaacgcaattcatggagctccgaaaaagggggagaatggaggattgccttgagggtctgcactcaggcaatcatgaaacacagctccaaactcgaaagcggaggacacatgaaccaaaacgcaattcatggagctccggaaaagggggagaatggaggattgccttga

SEQ ID NO: 32946 - DNA, 591 bp, Glycine max
  Peptide Sequence Number=SeqID_149724
atggaaccaaaattttgggataaaaatcctttcaaagccacggctaaggtgtttcctccaagattccacttcaaaccaacagcaatcaacaagacaagaacattttataagttcatcctaatagatacaaactcaatgtctattaagcacttcaaagatccgaatgaccaatcacttaatacccattctacaatacagatcttaaaggttttacaaccaagacactttggtcaaaatcttaatgaggttaaaaaattctcagttccttttgatccaagaggatatacatattgggattacatagatgcctggaacaaagtattttggcatcagaatagtaaattcaaacattcttggctcatctacttcaagaccaacacggtctataactttcaaaattggtttctccaatggtgggacttttttggaccaatacctgagatttttcctaagcaagttcaacagggatttgcctcattcaacaaaatgtatagtaagactgaaggcaacaagcaattcccatcactacaacgatatgcttttgtgaagtggtggaatcaatttgactcatccaaaactgaaccagactag

SEQ ID NO: 32947 - DNA, 822 bp, Glycine max
  Peptide Sequence Number=SeqID_149725
agaattcaagggactaaccgcttaagaattctttgtcctaacacattggagggtacatcctttggggttcaagtagagggtacatctacttgggttgttttactgagaacaactgagggtacatctcttgtggatcaattcaagtggagggtacatccatttggttgttcaaagagaacaaaggagggtacatcccttgtggatctttggcttgtaaaggattttacaaggttgaaagaaatctcaagaaccggtggttgcttggggactggatgtaggcacagggagattaaagatgtgccagaagtgatgttgggaaaaggacatctagttctggattcctataaccaaattcttacctcttcaccccgggtatgtccaaggttacctattttagacatgggaaggaagaagaatttcaaggcttatggaccaacagaaatgcatcgtatggacaaggtacaaatgattaaaaatctattcaagttggacacgttgttcaacaacaaagggaagcttacaaggatgtatcacttcagcaacatgtgtgctagcttcatcattgatcctacctatgatcattttcgtgctcgtcataagagactaccatttatcaccaataacactatatatgatctctataagcttgatgaagatacatttgaagatcgagtaagactgactcatgagtctcaagttattgaagcaattgccttagaaactggagcggtagaagaggttgcactcaagcaagctaaagaagaggtagcactaaagcagctaaattggatgccaactatgccaaaatcaatcaagttctaa

SEQ ID NO: 32948 - DNA, 219 bp, Glycine max
  Peptide Sequence Number=SeqID_149726
atgacagcacacacagcaaaatcaataagcaccaaggtagcagctggtgtttcgctaagcgaggcctatgcgcttagcgagagtcatgcgctaagcgaggtactcagcccgcttagcgagttgggagaatttggaggagaatctgagaagcacatgcgtgctcagctcgctcagcgaggcgttgtctcttcatgttctaagcgcgcccagctcgcttag

SEQ ID NO: 32949 - DNA, 264 bp, Glycine max
  Peptide Sequence Number=SeqID_149727
atggttgaaggttattatcatttgtatgctattggctatacgaatggggaagagtttcctgcaccctacagaggcagagatatcaccttagtgaagggagacagtgccaagggactttacaacaagacttttccttactttcatgttcttggccatgctttcggtaaagatttggccacatgggaaaatgatgaggaccttattattattgtggaaggaatggacaaagaagatgatacgaatgatgttgaagttgatacctaa

SEQ ID NO: 32950 - DNA, 709 bp, Glycine max
  Peptide Sequence Number=SeqID_149728
cggtttagtgaagaatgctatgggatgtccttgttgcatcagtactgctaccatagtgataactcatgcatcagtttccaagacaaatgacaaaatcatccttccacaaaagagaagtgagttgagaagcaatagaagcgtatctcttaacaagtttgtgatagaagctggtgaaaccaaggaatccacgtatgtccttctgggtggagggaacaggccaatctacaatagccttgatcttggattgttcgggttcaactcctttgccggaaatgatgtgccccaagacttcttatcaactgggcaacatgggaaaaatcctatggcaagcaaaggatatccacttcatggtcttcaaacaaaacttattgagaaggcacaggccttgatatctgacaacaatccaacctctagcagtataaacaccaccattgctaagagccagcttccaacaaaatatttgttttctttcaactctgataatctcccgtgccctccaaaatctactatcccaccttcctcttcaccgcagaaatgccccaaagacacgctcaagtttggtctcgctgatcttgaagcagcactgtgtttgtgcacagctattaaagccaatgtgttgggagctgtcaaggtcaaagtgcatgttgctgttagtttgcttgttaatgcttgtggaaagaaggttccatctggatttgtatgtgcttag

SEQ ID NO: 32951 - DNA, 309 bp, Glycine max
  Peptide Sequence Number=SeqID_149729
atgccttttacaggcttgaaaagtgcaagaaaacgaactgcgttttctgcgttttctggaaaacgtgatgaactcgctaagcgagttcatcaatactcattgtgtataaaggcattctcggaagaactcgctaagcgcacctaccacgctaagcgagttcatcctttgaggatgaacactcatcctcttgctgagctacttgtgcctttaaggagcttagcgcatatccttgcggcagatgttcagcttaacgggtgctgtccagctaagccaattttgcagaacctaaatttctgcaacttccgctaa

SEQ ID NO: 32952 - DNA, 712 bp, Glycine max
  Peptide Sequence Number=SeqID_149730
tgtattagaagatgtattactgacattcctcttgtggagattaagtttagacactaacggagcaccgctggattatctggaacttgatggcgttttctccgacgacgattccattgctgcgggggccaaaggagatgaaggcagggcagcggacgtagaagtggtagcgaccggagatgaaggcgccgaccttccaacgaacccttccgtcggctcggatggtgacgaggacattaccgtcactctggtcctggctgaggcggaggaaattgaacggcgcgacggggatgttggtaccataaacaaacggagaccaaacattgatctcattgtggccctggtaggtcggagggatggcggttcggtacgtgatctgctggctccggtagattacgtagatttcgaggcggtcgtagtaaacaccgatgttgtcgttcgggttgcgcgagatgagcgtgacctgaaaattcgaagtgaggaagttcggtatggtggcgttgaaggcgtagaccgtgacgtcttggagggtgaaggtgggtttggtgggtctaaggattgcccatatcaaaagaattgtgagcagcacgaggaagaggaacaccactatgcaccagaacacttgccggaagatcttcctcttcttccccttgtggtgctcgcactccgacatggaattgggaggttcggtgtggtggacgcttctgagaaataa

SEQ ID NO: 32953 - DNA, 963 bp, Glycine max
  Peptide Sequence Number=SeqID_149731
atgctactaggtttcaccgatttgattgccgctttcttcgagtattcttgggtgtggcagaaaaaagaagaaggaagaagagaagagaaagccatctatatctgcatagaagaattgcatctggcacgtgttactgaagagcagttggcggcactctttcttaactgtggccaggttgttgattgtcgtgtttgtggggaccctaattctattctccggtttgccttcattgagtttacagacgaagaaggtgcaagggctgctttgaacctgtctggaaccatgcttggatattacccgttgagagtgctaccttcaaaaactgctattgtccctgttaatccaacatttttgcccaggtctgaagatgaaagggagatgtgttcaagaacaatttattgcacaaatattgacaagaagggattgaggaaccaaatatggttaccgcaccgcttcggtgatgtgctagaaccaaccacatgcatatgcccatcaccgacaacatggattcagggaccaaaaagcctaggtttgcatactctatatgattggcgtgcatgcactatttatgatgcaatgttctatggaaattggattaagtgcgtggatttgggcaaagtttttggtcagaatcggcacagggtggagggaaaaaaactggtcaatactaaaggcatgttacgggctgcaagtatggtatcaatctggctaaaggacatttattggttgcatgttatgtgtttgatcaaatgtcaagatgatatttttggctatgaagggagatgtggcttgccaactaattttgattctatttactgctatgcattgggttatggtgctgcagccttccttcaaagtgggaagactgaagaatggactgttggtggaactgcactcacttcattgatggacgtggagaggagacatggtatacaatgttcaggatatttcaaaaagggctga

SEQ ID NO: 32954 - DNA, 157 bp, Glycine max
  Peptide Sequence Number=SeqID_149732
gtacattaataacaccttgacgatgcaacaagggagatgcacttccacaaaggaggcgtggcccctaacaccaccaggtgcagggcctgattgcacgaggctgccacagggtcacaatgatgaaagtggtggcacgacgcgaccttgccgaagttga

SEQ ID NO: 32955 - DNA, 573 bp, Glycine max
  Peptide Sequence Number=SeqID_149733
atgacaagctctcctgggccatgcaacagctgggcgtggatttcgccaccctgtccgaggtggctggtcatgcctgatgcggtcaagcacggcaagcagccccttaatcaaagccatttaccgattacccaacgccgctatccagagatcagtggtagcgtacttgcgtttgacttcggtgaaaaacgcataggcgtcgctatcggcgatacgctgctgaaactggcacatccgctactcacgatagaggccgaggaaaatgccgccaagtttgcacagatagaggctctgctcaatgaatggcaaccggcgctgttgatcgtaggcctgcctatgtccctggaaggtgaagcacatgcgatgacagcgctggcacaaaagtttgcccaacgtctggaaggccggtttaacctgccagtcatgatggtcgatgagcgcctatcatcggctgaagccgcacaatcattgcgtgaggcaggcatcaagggtcgcgcgcaaaaaccgttgctggaccaggtagccgcgcaaactatattacaatcttattttgatgcctatcacggacgtgtttag

SEQ ID NO: 32956 - DNA, 1254 bp, Glycine max
  misc_feature (1219)..(1219): n is a, c, g, or t
  Peptide Sequence Number=SeqID_149734
atggatgccagccagtcactggaccaggtcaaggacctttatatcagtgcaggcaaaatcgtcgccatcggtgaagcgcccgcaggctttaaagctgaccaaacactggatgccagtggcaaatgggtgttacccggactggtcgacttgtgtgcacgtctgcgcgaacctggtagcgagtacaaggcgacactcttaagcgaactacgcgccgccatggctggtggcgtcaccagcctggcctgcccgccagacaccgacccggtgctggatgagcctggcctggttgaaatgcttaaacacagggcaaaatcacaggcactggcgcatgtctatccgctgggggctgtcacacgccagctagaaggccagttactcactgaaatgtacgccttaactgccgccggctgtgtcggcttttcgcaggcagacaccgccattgtcgatacgcaagtcctatggcgcgcctttgaatatgccgcttcttttggctataccctgtttatgcgtgccgaggatccttacctagccaaaaatggtgtcgcccacgatggcgaagtagcttccagattaggcttgaagggcattccttctgcggcagaaagcatcgctttgcaaaccatgctgcgtattgcgcaagccactggcgtcaggttacatatcgcccgcgtctctaccgcagaatctgtggaattgatccgccaggccaaacaatccggcatgcaagtcacggcagatgtcagcatccagcatttgcacctgactgatatggacattggctttttcgatggcatggtaaatctgaaaccaccagtgcgcactcaacgcgaccgtgatgccctgcgcgcaggcttgatggatggtacgctggacgcagtttgctctgaccatacgccagttgacgatgacgccaaagctttaccatttgctgaagcgcatccaggcgcctccgcactggaactgttgttgccattgaccttgaagtgggcggcccaggccaaactggcgcccgtacaagccttacaaaaaatcacgcaaacccctgctgacatccttggaatcaaggcaggcaatttgcagctaaatagtaccgccgacgtcgtgatctacgacccggagatggagtggcgtgtggatggtcgcgtactcgtcagccagggcaagaatacgccttttgtgcatcatgcactcactggcaaagtcacagccacgctgacgnaaggaaatttgtcttccggggatcctctagagtga

SEQ ID NO: 32957 - DNA, 183 bp, Glycine max
  Peptide Sequence Number=SeqID_149735
atgaaggcattgggatggtggctgatagcggtaggcacgcttcgattagcttccgtgtggttcggtttcttcgacatttgggctcttcgtctcgccgtcttctccaacactacaactttcacaaggaaatgtcgttgttcctccttttgcgtctcacaagctatcagaatgtttccagaatag

SEQ ID NO: 32958 - DNA, 767 bp, Glycine max
  Peptide Sequence Number=SeqID_149736
taaaccatgttgaagcaattatccaacagaaatcagaggacaaaaggcttcaaggtaaaactaggatttataatatttactttgatcattgttgggatatgtgggttctttaccaactcagacagtactcactagacgaggaaaggtcggcaaaaagatttgaaaatctaaaggctggtcttgaaaccaaaaaacttggaagaaaagggttgcagccatggacaaattataaaccatacgagttgatggatgatacagaagaaaacgaacatgaaagggatgatgttgttgttatacatgatggggataaggttgaagaggaaaaatctgaggaagtagaagatcttattgatgaacaagacaaggagaaggaggagcaaaatgaagatgaagagggtcgtatgagcttattagaagacgaaggtgaagaagacacacatgcaacaagggaaaaacataacaaagagaatggtgcatccagagttctcatgagggtgacaaaaagtttaggttctgaatttgaatttggaggtttaagaaaagtaaaggaggaagaggtgggaaattcgaaaagggttggaacagaaaagcagaagaagaaaatcttggagccaagcaattcaagtcatcataaagtggtagacgatgttacagatgaacatggctcatttccaaatgtctcatttacaaaaggaatagatgatgtacttgattttggtgctggatcaaattctgattcgttacttaagacacatgaatttgattga

SEQ ID NO: 32959 - DNA, 954 bp, Glycine max
  Peptide Sequence Number=SeqID_149737
atgggtgaaatagaggaggaacaagagcggatgaaggcctacatagaggccatgaaagagcaaatggccacaatgatggaggccatgatgagcatgaagaagataatggaagtcaatgcaactatagttgccgctaccagcgctgttgctgagggaggcaaagagttgggaattacaggcggcccccattgtgtgcaaattcaaaacaagcatgccttcttgccatatgacttgcctcccaactatacaccacccaatgtggtgcccactcccgatgagaatgtcaataactccactcccatacttattaagtgccaacaacctcaatttgatcatgcacatatctctcaacccatgggggagacacatgaaataccccaccacaatctagctgacttcgagcctcacctcgaatacgccactatggggcaagtagttggtggtgtacccctgccaaacactttggagggccctcagtttcgcccacaaccactacccttgcattttgcggtgggaagagtccctcctactatggtggaaagggagaaattggatcatataaaggaaaggctcagggtcattgaaggaggtggagatcatgcttttgctgacattgcagagttatacctagtgcctgatatcatcattcctctgaaattcaaggtgtccgatttcgataagttcaaggggactacttgccccaagaatcacctgaaattgtactgtcggaagatgggggcgtacgcaaaagatgaaaaactgctaatgcatttcttccaagagagccttactagggcagccgtcacctggatcgaagtgggtctgaaaagaggcaaatttgattatcctgctttgataaatgagaagccaggggaaaatagagaggatgagaaggaggaaggaacccatgttgtgactgccattcctacatggccaaatttcccaccagcttaa

SEQ ID NO: 32960 - DNA, 2571 bp, Glycine max
  Peptide Sequence Number=SeqID_149738
atggctagatttcgtttccggcgcctccgattcctcgccatcttcgtcgtcgccgtcgtggtgttcgcgagtgacgaatcggagtcggagcgcgagctctcggtgaccgatttggattggaacctcttccaccaggactactccccgccggctccgccgccgccgccacctcacccgccgtcggtgtcgtgcgtggacgatctcggcggggtggggactctggacacgacgtgcaagatcgtgaacgacgtgaacctcacccgcgacgtgtacatagcagggaagggcaattttaacatcctccctggggtacggttccactgcgagattccagggtgcatggtaacggttaacgtcactggtaattttagtttaggtagcaactcgtcgattgtgaccggagcctttgagttcgaggcggagaatgctgtttttgggaacgagtcggtggtgaacacgacggggatggcgggggatcctccgccgcagacgagtgggacaccgcagggggttgagggaggtggcggagggcacggcgggaggggtgccagctgtctcgtcgacacgacgaagctcccggaggatgtttggggaggggatgcgtattcctgggcgtcgctgcagaaaccttatagttttgggagccgtggagggtcgacaagtaaggagagtgactatggggggttgggagggggccttgtgaggatggttgttcatcaaattgttgagatgaatgcaactgttttggccgatggggctgatggagggaccaaaggtggaggtggctctggaggcagcatctacatcaaggcttatagaatgttctttgttagcaactgtttatgtctatccatgttgttgcatttgggatgtggttgtctatgtatcattatcacaatgaatgagatgagcaggactggcaatgggattataagtgcttgtggaggtaatggttttgctggtggtggaggtggcagggtttcagttgatgtgttcagtaggcatgatgagcccaaaatatatgtgcatggtggtaagagccttggctgtcctgaaaatgcaggtgctgctgggactctttatgatgcagtccctcgaagccttatagttgataattataacatgacaactgatacagagacgcttctattggaatttccaaatcaacccctttggactaatgtttatgttcgaaataaggctagggccacagttccattgctttggagccgtgtacaggttttagtattttatgttgtcatgatcgttcttgccaaagttgcctccctcaaagaaagccaagtacaaggacaaataagtatcttgcagggtggggtgttgagctttgggctacgacactatgctacatcagagtttgagttattggctgaagaattgttgatgagtgattctgtgatgaaggtatatggagctctacgcatgtctgtaaaaatgttcttgatgtggaactcaaaaatgctcatagatggtggggaagatgtaactgtggcaacttctttactggaggctagtaatttgattgttctcaggggggcttctgtgatacattctaatgcaaaccttggagttcatggacaaggtctgcttaatttatcaggaccaggagattggattgaagcacagcgtttggttttatccctattttatagtattcatgttgggcctggatctgttttgcgtggtccactggagaatgcaacaactgatgatgttactccaaagctttactgtaacaatgaagattgcccctatgaattacttcatccccctgaagattgcaatgtgaactcatccttgtcattcacacttcagatctgcagagtcgaggacatccttgttgaaggccttataaaaggttctgtcgttcatttccacagggcgaggaccataagtgttgaatcttctggaacaatatctgcctctggaatgggctgtactggtggtttgggccgtggaaatactctaactaatggtattggcagtggtggtgggcatggtggtactggtggtgatgcattttataatgataatcatgttgaaggtggccgttcatatgggaatgcaaccctgccctgtgaacttggtagtggaagtggaattggcaactctactggttccacagctgggggtggtatcatagttgttggatcattagaacatcctttgtcgagtttgtccattcaaggttccgtaaatgctgatggagggaattttgaaccgcaaatcagaaatgaaaaatttgcaatttttgacaattttactggaggtcctgggggtggatctggtggcactatactaatgtttctacatatgctcaatattgggcaatcagctgtgctttctagtatgggaggatatagcagttctaatggaagtggtggtggaggtggtggaagaattcattttcattggtccgacattcccactggtgatgtttatctgccaattgctagcgtggaaggagacattcagatctgtatgattaaagagataagctcatctggaacaaggataggcatcctcaggagctggaaaaggtttaaaaattaa

SEQ ID NO: 32961 - DNA, 1011 bp, Glycine max
  Peptide Sequence Number=SeqID_149739
atggattcagaaagagcactgacccaggttcaggaaatagagcaagaaggtggtgtcggtggagggaccaacaagaagatggaggtaaaaaatgaaaccaataagaagaagaggagttcttatttccccaagtttggttgtttcagaatcgaacatgatgcttctgggagaggttttgatattgaggttgctgatgaatctggtcagcgtcccacccctacccacttgatcataatggttaatggccttgtaggcagcgcacagaattggaaatttgctgcaaagcagtttctgaaacggtatccaaaagatactattgtacattgcagtgaacgcaattcttccatgttgacatttgatggtgttgatgtaatgggagatagactagcagaggaggttatatcagttataaaacgtcacccaagtgttcagaaaatttcatttgtaggtcactctttaggtggcttggtggcaagatatgcaatagccaagctttatgggagagacatttctatggaactttctcaggggaatggacattgtgaaagtcaggtttcagatcaagaatgccatgatagaaaatatgaaggaaaaattgcaggactagagcccataaatttcattacctctgcaacgccacaccttggttctagagggcataaacaggttcctatgttttgtggattttactctctagagaaagcagtatctcgtgttgcaggagtttttggtaaaacgggaaaacatctttttttaactgatagtgacaatggaaaaccccctcttcttcttcagatggttcgtgattccgaagatattaaattccttacgtcatctatcaggcgtagaaaggagctccctaagcgccggcatctttcaagacatgagaagtacccgcatattgtaaatgtagaaacagaaaaatctacttctgttgttgctgatgaagttcatgatgaatccagagtgagtagtggatccagtaaacttgactttgaagctgataagtaa

SEQ ID NO: 32962 - DNA, 2089 bp, Glycine max
  Peptide Sequence Number=SeqID_149740
gggaggaaagggtaagggccagggtggctctggagcaaatgggactataactgggaaggcttgccccaaagggctgtacggtaccttttgtgaggttatgcattatttttttccagcctccatatggtggttggcttatgaagtccggcatgttgattacttttctgacagtgatgtactggaatgtccagctgggacttacaaaaacgttactggatctgataaatcactttgtcacagttgtcctgttaatgagcttcctcatcgtgctgtttatatttcagtccgaggtggtattactgaaaccccttgtccctaccaatgtgcttcagacagatatcttatgcctgactgctatacagcccttgaagagttaatttacacatttggtgggccttggctatttggtcttttccttattggtctcttgatcttgttggcactggtgcttagtgttgcaagaatgaaatttgttggggttgatgagttaccaggcccagcacccacccaacatggttctcaaatagaccactccttccctttcctagagtcactcaatgaggtgttggaaacaaacagagtcgaggagtcccagagtcatgttcacagaatgtactttatgggacctaatactttcagtgagccctggcatctgccacatacaccttcagagcaaataaaggatgttgtttatgagagtgaattcaatacatttgtggatgagattaatgctatagctgcttatcaatggtgggagggagcaatacatagcgttctttctgttcttgcttatccacttgcatggtcctggcaacagtggcgcaggagattgaagttgcaacgcttacgtgagtttgttcgatcagaatatgaccatgcttgccttcgttcttgccgatcacgggccctctatgaagggatcaaggtaaatgcaacttctgacttgatgctggcatatgtggacttctttcttggtggggatgaaaagagaatagaccttcctcctcgattgcatgaaaggttcccaatgtcattgccttttggaggtgatggaagttatatggctccattcacccttcacaatgataatatccttaccagcctcatgagtcagtctgtgcaacctacaacctggtatagattggttgctgggctgaatgcacaactgcggttagttcggcgtggacgactaagagtaacatttcgacctgtcctcggatggcttgagactcatgccaatcctgcattgagtgtccatggtgtgcgcattgaccttgcctggtttcatgctacaagtagtggctattgccactatgggctaatggtttatgctcttgaggaaggttatccagccactggaggaagtactgacggagctttaagaactgaggaaagatcacgggtccagagtgttaataaggaacatttggggcttgcaataagcagagctcatttaagccctgatggaaggattgaggataattatatgaggcgacaaatgcatggagctgctttagatgtaaacaatttgcagatgcttgacaagaagagagatatcttttatcttctctcttttatacttcagaatacaaaacctgttgggcatcaggatcttgttggtttagtaatctcaatgctgcttctaggagattttagtttagtattacttaccttgcttcagttgtattcaatttctttggtggatgtcttccttgtgttgtttatattacctttcggcattcttctcccatttcctgtcggaattaatgctctctttagtcatggaccaaggcgttctgcaggccttgcacgtctttatgctctgtggaatcttacatccttcatgaatgttgttgttgcatttctttgtggatatatacattacaactctcaatcgtcttccagtaaaagacacccgagcattcagccgtggagtatcatggatgaaagtgaatggtggattttcccagctggattggttttgtgtaaattattccagtctcaactcattaattggcatgttgccaatctggaaattcaagaccgttccttgtatagcaacgattttgagctgttctggcagtcatga

SEQ ID NO: 32963 - DNA, 5052 bp, Glycine max
  Peptide Sequence Number=SeqID_149741
atggatcctcaaaaagcattcagttctcctgatattaggctaagcataatcttacctaatagctcagaagctgttatggacactgtggaaatgaaagggtccaatggtgaaaatagtgtttctggtgatggtaacatacaacaattaagtgcttttaaagagaaagaagcaaatatccaagaagaacaactgcatgaaaggcgaagttctcgacttgaaaggctccggagtcgtaaaccagggaaagaggaatccaattcttcttgtggaaaggaccctaccaaggttgtcattcaatatctagagccatttatttctggtggattggggggtcaagatacaattgatagagataggacgacagtatcctgtttaggaaattctgaatattataatgtttctgcatttttaagagaaacttcaaacaattatggtgcttatcatatggggcacttgcttttagaagaagtcacaagacaaggtctcacatatcaggatgcttttgtcaaatttttggagttggaaaagttgacaaggcattggggaaaggagagaactgccgaatgtaatatttttcttgctgaactgtattatgactttggatcatgctcctccactggttctcaacaattagaatttatttctgagacgtcttatcatctttgtaagatcattgaatctgtagctttagattatccttttcacttgactcatgccttgaatgaaaattgtttttcgatagatagtatccaagagaccagtggaaaaacaataaatacctccactgagagcaattcaaatttagacatctcacttctgatgaaaaacagtcccctttggtctcgattcttctggctaagtgggagactgtctattgttgatggcaacagggcaaaagcatgtgaagaatattgtatcgctttgacacttttggcgaagagagaaaatgaagattctctatgttcagtcccccgcccacattgcaaggttgtaaaagagctaaactttgatagagttcttgatgaaattaatatattaaaggtcaatttcttgatggaaaagtctgtcattaagatgatggaacaagaaaagtttttggagtgtgtatccctgctttctccacttctattctccacacaggatgtctaccccaattcattctctttatccaagacagataaaagtgatgaaaagataacttccactgaactcatggctgtagatgttctaatggaagcatgtcaaaaggcgaatccaatggatgtagagatgtatttcaattgtcattatagaaagctgaaaatactaatgacaaagatgggtttaaatacatgtattacatcatttaaatcttctgatcaagcacctattttaagtgcgtctcctaattttgatattgattcaaaggaaagttctagcaagaactgtagtcacttggttgcggatgaagtgaaggcactctctgactgtatctcacaagtgaagaaaattatcgatcaacgtggagattctgatggcctttttgttccaacaagaagcatttgtcaaatgcaatctctgctgttgttaatcatgagccatgttgccaacatacttgccctcaacaaagcctcagcacaagtaatttctgatcaagctgaaagcagctgtttcgttgatgcagccattgttttctgcaaactccagcatctttgcccaacaacgcctatcaaaactcaagttgatttaattgttgcaacacatgacttgcttgctgaatatggcctttgctgtttgggtgaaggtggcaaaggtgaagaaggaacatttcttagatttgcaataaaacatctcttggccttggatacgaagcttaaatccagctttaaccataaagaatcaatgcaatgtgaggaagtgtccaaaaacagtcttgtcaatgtgtctgttgaagaatcaaaatcagacacattagacatccagatggattgcaccaaaattgatgaaattaattcagagaaaaaggatgtttatgaaggaataatatccaaaggcatttcatcttgcagagttcatgataaagactgtaaggaagtagagtgtgaaaatcatggaggtgctggcactggcagtaagttaattaagggtgaaagttcaatcaatcaattgattgaatgtgaagatgaactttctgaagatgaatgggaggaacttgagtctaaaattgactgtgccttagatcagtgctttttctgtttatatggattacatctaagatctgattcatcttatgaggatgatctagtggtgcacaaaaacacaagccgaggagattatcaaaccaaggaacaatgtgctgatgttttcaagtatgttcttccctatgcaaaggcatcttctaggactggactggtcaaacttcgtagagttttaagagctattaggaagcactttctgcagccaccagaggacctcttggcaggaaaccctattgataagttcctagatgatcctaatctatgtgaagataagctctcagaggaggctgggtctgatgggtttcttgaatctattactaagagaatgtttcctgatgtgggtggccttgctcagtataatgcaacattattgaggaggtctgagccatatttggaggtctactgtaacttgtattatttcttggctctgtctgaggaaatgagcgcaacagataagtggcctggatttgtgctgaccaaggaaggggaagaatttgttgaacaaaatgcaaagctcttcaaatatgatctcatgtacaatcctctgcgctttgaaagctggcagagacttggaaatatttatgatgaggaagtagatttgttactaaatgatggtagcaagcacgttaatgtagtagggtggaggaagaatgctactttatccgagagagtggaaacaagccgaaggaggagtagaaggtgtctactaatgagtttagctttggcaaagacatctgctcagcagtgtgagatacatgagttattggcattggtatactacgacagtcttcaaaatgtagtcccattttatgatcagagatctgctttgcccttaaaggatgcggcatggatgatgttttgtgagaactcaatgaaacattttaagaaagccttcacacttaagcaagattggttgcatgccttttacttgggtaaactcagcgaaaaacttggatattcacacgaaattgcattatcatattacaataaagctattgcttggaacacatcagctgttgatcctgtctacaggatgcatgcctcacgtttgaaattattatttaagtgtggaaaacagaatttggagattttgaaggttctctcagcaaattcctttaatcaatctgtaaaagaagctgtcacaagtatccttattggtattgatagctcatttttaaatacaaaggaaagatgtattgatgccaattttgtggaaacaaagcatgaagagttgctcaaattggatacagtatggtctatgcttttcaatgattgcctttctgctcttgaaacatgcgtagagggggatctcaaacatttccataaggccagatacatgctggctcaaggactgtacaaaagaggtgagagtggtgatatagagagggcaaaagatcatctatctttctgcttcaaatcttcacgctcatcatttacaataaatatgtgggaaattgatagcacggtaaaaaaaggaaggcgcaagacaccaggtactgctgggaacaaaaaatcccttgaggttaacttaccagaaagttctcgaaaatttattacgtgcattcggaagtatttgctgttttatctcaaactattggaagagactggagatagatgtattcttgaacgttcgtatgttgctcttcgtgcagataaacggttttcattatgtattgaagatcttatacccgtggctattggaaggtatctaaaggccctgattgcaactatgtgccattatcagactactgcctctggttcagtgagcagttctgacaatgtgctggagagaatgtttgcattgttcatggagcaagggagcttatggccagaaatatgcagcttgcctgaaattgaaggctcagatatgtcagagagtatcatatatggatatcttcatgaacatattgtattattggagaaaaatggaaaactggaaactcttgaagcaataaatgagaagattcggaagcgttctaagaacccaaagttctcagacagtaattatgccaaagttcgcaagcatgcttctgttgcttggtgtcgatctcttgtatacaatttggcacaaataactccattatcttgtgaattctcaaatgggattcaggtccttaatttgactgatggtgggatggataatagccagttgctctgtattgatttgcagccaaatgagttatggagtacagcttttgaagatccaactcatttagaaaagattgaaacaaaatggagcactattttatcaaaagtaaaagatattattatcaagaaagcttctgatgagaatttggaaactgcaaacactttgctcagagcttgctataatttttaccgggagagttcttctgtagtgcttacctctggactcaacttttatttgattccatctcaattagtaacacagacgccattcaacccaagtactgctggaattgaagcacttgatctgagcataccaaggaagcttctcttgtgggcctatgtgctatcccatggacgttgtgcaaatatctcaattgttgtaaagcattgtgaagaaatgtcgaagtcaaagatgaaaagaggaagtggaatgtcacctgcgttatcaaacacatctcctgcccctagttttccaggtagcggtagaaacggatcaaattctgccggaagcattgacgttgattctgcacatgccacaacagtggggtcggtttcacttgacattcagaaaaatctctttgcttctccccagttgcatcaatgcactagtaacgatgcagaacgaagcaatttgatagcacatgaaggagatccagagggagattga

SEQ ID NO: 32964 - DNA, 516 bp, Glycine max
  Peptide Sequence Number=SeqID_149742
atgtgcgacttcaaggcggaggatgaagggagtagtcttcgtgggaaagagatgtcgcaagtggattggggaagaatctacggcgaggaatttcatctttctcaaacttatcacgaagggcttctcaagttacaaacaaaagagtatgagatggctcgtgagctcttagaatctgtccttaaagatcctcttattgctaatgctcaggtggatagcagtgccagtgatggtcatctattgcaactcagacgtttctacagatttttggcattgaaaaaccttgccactgtttttctccagcaagactctacacattatgagaatgctctacgctgttaccttcaagctgtggagattgattctaaagattctgttgtctggaaccggctgggaacactgtcatgctcaatgggctcactgagtatttcacgttgggcatttgagcaaggcctcttgtgtagccctaataactgtaagcatctaatactcttagatcttaacaagtcatttttttga

SEQ ID NO: 32965 - DNA, 204 bp, Glycine max
  Peptide Sequence Number=SeqID_149743
atgtcacgatggatctggaccgtccgtgtgtatgatcgtggagatggacggtcgagattgaatctctttgtagaatttgagttgtgtgtgcgcgaagagaatgatgcttctggaatccagaggactcggtttaaccaggatgcggtgttcacagaaaaccggtgggcgcggttttaccggatactattagatctaaagtgttga

SEQ ID NO: 32966 - DNA, 1614 bp, Glycine max
  Peptide Sequence Number=SeqID_149744
atggcgtccaacgattccgattcgcagatgaagatcgtacatggcgatgctggttacatacttgaagacgttcctcacttcgccgactatattccaaatcttcctacatatccgaatccgcttcgatccaatcctgcttactcggttgttaagcagtatttcgtgcacatggacgacactgttcctcagaaggttgttgttcacaaggatagtccaagaggtgtacattttcgacgtgcagggcctcggcaaaaggtatactttaaatcggatgaagtgcatgcatgcattgtcacgtgtggtggactctgccctggcctcaacactgtcataagggaaattgtctgtggtctttcctacatgtatggtgttaacaaagtccttggcatagatgatttaggaaagaaagctggcattgctctgatgtgcttctctgtccctgacttctttggtggttatagaggcttttattccaaaaacaccattactttaacacctaaggtggtcaatgatatccataagcgtgggggtacgattcttgggacatcacgaggggggcatgatactggcaagatagttgacagcatccaggatcgaggaattaatcaggtttatattattggaggagatggaacacagagaggagcgactgtgatttacgagtactaccttttacagttaggctcaagcttgatggaagttagacggcggggtctgaaagtagcaattgctggaattcctaaaaccatagacaatgacatcccggttattgacaaatcttttggttttgatactgcggttgaggaggctcaacgtgccattaatgcagctcatgttgaagctgaaagtattgagaatggcattggtgttgtaaagctaatgggacgttacagtggttttattgcaatgtatgccactcttgctagcagagatgtggactgttgcttgattccagagtcacccttctaccttgaaggaaagggtggactttttgaatttattgagaaaaggctgaaagaaaatggacatatggtcatagtcatagccgagggagcaggacaagatcttcttacagaaagcatgcaagccatggatcagaaggatgcttctggaaacaaattacttcaagatgttggtttatggatatctcacaagattaaggatcactttgcaaggaaggataaaatgcccatcaatcttaaatatatagatccaacttacatgattcgggcaattccaagcaatgcatcagacaatgtctactgtacacttcttgctcagagtgcagtccatggtgcaatggcagggtatactggatttacagttggactggtcaatggcagacagacttatattccattcattagaatcaatgagaggcagaacaaggttgtgattactgacagaatgtgggcaagactcctttcttcaaccaaccagcctagctttttgagccctaaagatttagaagaagccaagaaagcagaatctccgacacaattgttggaagagaacaattgcaatgatgttggtgatgccgagaaagaacaacctcccaaagatgaacaagaatcaggaaaccacacagacaatggtatcaagacacaaaattag

SEQ ID NO: 32967 - DNA, 738 bp, Glycine max
  Peptide Sequence Number=SeqID_149745
agggctacatgccctcaccttcagaggactacacgtcctcgcctttagaggactacatgtcctcgccttcagaggactacacgtcctcgccttcagagggccacacgcccttgccttcagaagactacctatcctcgccttcaaaggactacacgtcctcgccatcagagggttgcacactctcgccttcagagggctgcacacccatgccttcagagggatgcacgcccttgcctttagaggcgtacacatcctcactttcagagggctccacatttgcgccttaagagaatttaagtttccttttatcagttcagttcctgggccaccccctaatcctggaggagggccaactatgcgagcacaactagaggaggaggctgtcgtacaaccactatgcatactggggcaagatttcacccgtgccgttacaaagaaacgagtgcggatcatgggtcgcgcccacaagacacccagtggacccggagaagtccaacagggccctagggtttccagctcgggttacgggcctctatcagtcctacagggtgcccgtcccccccagcaagggatcgcgcctgcaagacacccagtggacccagagaagttcaatagggtcttggggtttctagctgcaggcacagggcgagacaccacaacagcctggggatggctgacagcgggcaacaggcacaccgccaccacctctagagttcacctcagctcatccataaaaag

SEQ ID NO: 32968 - DNA, 3066 bp, Glycine max
  Peptide Sequence Number=SeqID_149746
atgtccaaactacccctcttcatgctgaaatttccttttcatttcctcttattgctcagtgtcatagtaccctttcaagtattttcacaatcagaaaataccgaacaaacagtcctactctccctcaaacgtgaattgggggacccaccgtcgctccgatcatgggaaccgtcaccgtcggcgccgtgcgactgggcggagattcgctgcgataacggctccgtcacgaggctcctcctctcccgcaaaaacatcaccaccaacaccaagaacctctcttccacaatctgcaacctcaaacacctcttcaagctcgacctctccagcaacttcatctccggcgagttcccgacaacgctgtacaactgctccgacctccggcacctcgacctgtcggacaactacctcgccggacaaattcccgccgacgtcgaccgcctcaaaacgctcactcaccttaacctcggcagcaactacttctccggcgagatcatgccgtcgatcggaaacctgccggagctgcaaactctcctcctctacaaaaacaacttcaacggaaccatccgcggggaaatcggaaacttgtccaatctcgaaatcttgggtttggcttataacccaaagctcaaaggcgcgaaaatcccgttggagtttgccaagttaagaaaactgaggatcatgtggatgacgcagtgtaacttgatcggagagattccagaatatttcgggaatattctcacgaatctggaacggttggatttgtcgaggaacaatctaacagggagcattcctcggagtttgttctcgctgaagaagttgaagttcttatacttgtactataacagtttgtcgggtgtaatacctagtcctacgatgcagggtttgaatttaaccgaacttgatttctctaagaacaatttgacgggttccatacccggagagcttggaaacttgaagagtttggttaccttgcacttgtattcgaattacttgtctggtgagattccaacaagtttaagcctacttcctagtcttgagtatttcagggttttcaacaatggtttgagtggaacactgcctccagatctaggcttgcattcgaggattgttgcggttgaggtttcagagaatcatctcagtggtgagttgccgcagcatttgtgtgcaagtggtgctctcattggttttgttgctttttctaacaattttagcggggttttgcctcaatggattgggaattgtccttctctcgacacgattcaggtttttaataataatttctctggggaggtacctttgggtttgtggacttcgaggaacatttcctccttggttctgagcaacaactccttttctgggcctcttccgagtaaagtattttggaatacaaaaaggattgagatagcgaacaacaagttctccggaaggatatctattgggattacttcggcggcaaatttggtgtattttgatgcgagaaacaacatgctttccggtgaaattccgagggaattgacgcatctttctcaacttagtactctcatgcttgatggtaaccaactttctggtgcccttccatctgagattatttcatggaaatcactgagtactatgacactctcaagaaacaaactctctggcaaaatccctattgctatgaccgctcttcctagcttggcttacttggacttgtcccaaaatgacatatcaggtgaaatcccacctcagtttgatagattgaggtttgtttttctcaacttgtcttccaaccaaatatatgggaaaatctctgatgagtttaataaccacgcatttgaaaacagtttcttgaacaatcctcatctgtgtgcttacaatccaaacgtcaaccttcctaactgcttgaccaaaaccatgccacactctagcaattcatcttcaaaatcacttgccctgattttggttgtcatcatcgttgtgttgttgaccatagcctccttggtcttctatatgttgaaaacgcaatggggcaaacggcactgcaagcataataagattgaaacgtggagggtcacctcattccagaggcttgatctcacggaaataaatttcctctcaagtttgacagacaataacctcataggaagtggagggtttgggaaagtttaccggattgcttcaaatcgtccaggtgagtattttgcggtgaagaagatttggaatcgcaaggatatggatggcaagttggagaaagagtttatggctgaggttgagatcctgggtaatattcggcactcgaatatagtgaagcttttgtgttgttatgctagtgaagactccaaacttcttgtttatgaatacatggaaaatcagagcctggacaaatggcttcatggaaagaagaaaacgtcaccttctaggttgagttggccaacgaggttgaatattgccattgggactgcacaaggtctgtgttacatgcaccatgattgctcacccccggtcatccaccgagatgtcaagtctagcaatatactgttggactcagagttcagagctaaaatagcagattttggtctcgccaagatgttggcaaagcttggtgaaccacacaccatgtctgctctagcaggctcttttggctacattccaccagaatacgcctactcaacaaagattaacgagaaggttgatgtatatagctttggggttgtgctcttagaacttgtgacaggaagaaatcctaataaagcaggcgaccatgcatgcagcctagttgaatgggcgtgggagcattttagtgaagggaagagcattactgatgcattcgacgaggatatcaaagatccatgttatgcagaacagatgacgagtgtcttcaaattagctctcctttgcacaagctcgttgccctcaactaggccttccacgaaggagattttgcaagttcttcatcggtgttgccattcaggttctacacgtagaagagtgggaaacgaatttaatatcacccctcttcttggtgatacaaggtacatctatagttacaaggagagtaatgctgcaagcaataactcatcttggtga

SEQ ID NO: 32969 - DNA, 1497 bp, Glycine max
  Peptide Sequence Number=SeqID_149747
atgagcaagaagaagagtacgattgattttgggattaatgataccagacttagcacaagtgcacataggattgacatttggagcgatgtcatcattgaagtacttgactctggaatttggccaaaatctaagagcttcaatgacaaaggattcagtccaccacctagtaaagggaagggcacctaccaaacttctaaaaatttcacatgcaatagtaaaatcattggagctaagatttacaaagctggtggattttttagtgatgatgatccaaaatctgtgagggatatagatggtcatggcactcatggaacaccaagaggtgccacgacaaaagcacgcattgttgtgtataaagtgtgttggtttgatggttgttctgatgcagacatacttgctgcatttgatgatgcaattgcagatggggttgacataataacagtttctcttggagggttcagtgatgaaaacttctttagagatgtaatagccattggagcatttcatgctatgaaaaatggagtattgacagttgttttatctgatgacactgtgccaattcccgcgaacaaagcacaattaggtgaatggtataatactaatgtggggcctttagatcaaagaaagagcaccgtggacccagcattggtgactgctgaagaaggcgctaaggttgtaaaggtgatgcaagatggcagtggggaattcaagaccatcactgatgccattaaaagtatacctagtgggaacactaagcgtgtaattatttacattggagctggaaattataatgagaaaatcaaaattgagaagacaaagccttttgtcaccttgtatggggtaccagagaaaatgccaaacttgacttttgggggcactgcacaacaatatggcactgttgatagtgctacattgattgttgaatcagattattttgtggcagctaacatcatgatctcgaacactgcaccgagacctgatccaaaaacgccaggaggtcaagcagtggcattgcgtatttcgggtgacaaagcagcattttataattgcaagatgtatggattccaggacacaatttgcgatgataggaatagacattttttcaaagactgcttaattcaaggcaccatggattatatttttggaagtgggaagtcactatatgtgagtactgagttaagaacgcttggcgacaatgggattactgttatagtggcacaagcaaggaaaagcgagacagaggacaatgcctactcatttgtacattgtgacgttactggaactgggactggcactttcttggggagagcatggatgtctcatcctagagtggtctttgcatacagcaacatgagtgacattaactcgggacctggtgcagaccccaaagggcgtgctactataactaagcaactaagtgaaacggaggtcaaaccttacataacacttgcgatgattgaaggctccaaatggctacttcctcctccaactcccaag

SEQ ID NO: 32970 - DNA, 2263 bp, Glycine max
  Peptide Sequence Number=SeqID_149748
atgcagattcgcaaagtggcattatcgcttctgctgttaggcgcagcagcgggcgcggcccaggcggaagatctcaccggtaccctgaaaaagattaacgatagcggcgtgattgtcgttgggcatcgcgagtcatccgttccgttttcttactacgacaaccagcagaaagtggtgggctactcacaggactactccaacgccatcgttgccgccatcaaagcgaaactgaataagccggatctgcaggtcaaaatgctgccgatcacctcgcaaaaccgtatcccgctgctgcaaaacggcacctacgatttcgagtgtggctcgaccaccaacaacgtagagcgtcagcagcaggcggcgttctctgacaccatcttcatcatcggtacgcgtctgctggtgaagaaaggtggcgatatcaaagacttcgccgatctgaaaggcaaaaccgtggtcgtcacctcgggcaccacctctgagattctgctgcgcaagctgaatgacgagaagaaaatggatatgcgcatcatcagcgcgaaagatcacggtgactcgttccgcacgctggaaaccggtcgcgcagtggctttcatgatggatgacgcgctgctggccggtgaacgtgccaaggcgaagaaaccagataactgggaaatcacgggtacgccgcagtccaaagaagcctacggctgcatgctgcgtaaagacgatgcgccgtttaaacagctgatggatgacaccatcgccaaagcacagacgtcgggtgaagccaccaaatggttcgatacctggttcaaacagccaattccgccgaagaacctgaacctgaacttcgagctgtcttcggacaggcaggcgctacagactgtaacaggccgttcccctgaaacaggacacaagacaccgctcaacaatcttatgggtagcctcgctaccctttttttaccggagctcgttatgggtatcgattggaactggggcatctttttacagcaggctccgttcggcaatacgacttacctcggctggctgtggtccggatttcaggtgaccgtcgcggtctcctgctgcgcctggattatcgccttcctggtaggttccttctttggcattctgcgtaccgtgcctaatcgctggctgtccacgattggcacctgctacgtggagctgtttcgtaatatcccgctgatcgtgcagttcttcttctggtatctggtggcgccagaactggtcggggagaagctcggcatgtggtttaaggctgaactggacccgaacatccagtttttcctctcttcaaccatttgtctcggtctgttcaccgccgcacgcgtgtgtgagcaggtgcgcgccgcgattcagtcgctgccgcgcggccagaaaaacgccggtctggcgatgggcctgacgctgccacagacctaccgctacgtgctgctgcctaacgcttaccgcgtgattgtgccgccgatgacctcggaaatgcttaacctggtgaagaactccgccatcgcctctaccatcggtctggtcgacctggcggcgcaggcgggcaagctgctggattactcggcgcatgcctatgaatctttcaccgctatcaccctggcctacgtcggtattaacctgttcgattccgcccagcctgccctatctgctgaacggcatgatcattacgctgaaaatcacggcggtggcggtggtgtttggcattatctggggcaccattctggcggtgatgcgcttgtccgcgttcgccccggtccgctggttcgccaaactgtacgtgaacctgttccgctcggtgccgctggtgatggtgctgctgtggttctatctggtggtccccagcttcctgcagcaggtgcttgggctgtcgccaaaaaccgatatccgcctgatctccgccatggtggcgtttgcgctcatctcgcgcggccaatcttccgccgcgctggcgctgggcatgacccactggcaatccatgcggctggtgatcctgccgcaggcgttccgcgccatggtgccgctgctgctgacccagggcatcgtgctgttccaggatacctcgctggtttacgtattgagcctggccgacttcttccgcaccgccctcgccgcctgggcgctggtaagctattcgaagaaaaggactgtttgatgatatccctgaaaaatgtttccaagtggtacggtcactttcaagtgttgaccgattgcaccaccgaagtgaaaaaaggcgaagtggtcgtcgtctgcg

SEQ ID NO: 32971 - DNA, 1272 bp, Glycine max
  Peptide Sequence Number=SeqID_149749
ctgtacgttgataccgcgccggtgcgcggccagatcccggacattgaaccggatcagatccatctggcgatcaaagagagtcgcgtgctggagcagacggctgacagcgtgccggagtacggtaaagcggtaaacatcaagaccaagcgcggcgtgattaaaccgcgtacgccaaaccaggcgcagtacatcgccaatattctcgatcacgacatcacgttcggcattgggccggccgggaccgggaaaacctatctggcggtcgccgccgcggtggatgcgctggagcggcaggagattcgccgtattctgctgacgcgtccggcggtcgaagccggcgaaaagctcggcttcctgcccggcgatctcagtcagaaagtcgatccttacctgcgtccgctgtatgacgccctgtttgaaatgctgggcttcgagcgcgtcgagaagctgatggagcgcaacgtgattgaagtcgcgccgctggcctacatgcgcggccgtacgctgaacgacgcatttgtgattctcgatgagagccagaacaccaccatcgaacagatgaagatgttcctgacgcgtatcggcttcaactccaaagcggtgattaccggtgacgtgacgcagattgacctgccgcgcagcaccaaatccggtctgcgccacgccattgaagtgctggccaatgtggaagagatcagcttcaactttttccacagcgaagacgtggtgcgtcatccggtggtcgcacgcattgttaatgcttatgaagcctgggaagaagcggaccagaaacgccgtgataaactggcggaagagcatttgcagctggcgtgtgccgatgaaaacggcctgcccgcagcagcggcgtttcagcgctggctggaggcggcggtcacgccgtttcagccagagagcgaagtcacgatacggctggtcgatgaagcggagagtcatgagcttaatctgacttatcgcggcaaagataagccgactaacgtgctgtcgttcccgtttgaagcaccgccgggcattgagctgccgctgctgggcgacctgattatttgtcgtcaggttgttgagcaggaagcggccgaacagggcaaaagccctgaagcgcactgggcacacatggtggttcacggcacgctgcatctgctgggttatgaccatattgaagacgaggaagctgaagagatggaagcgctcgagaccgagataatgcttgctcttggctatcccgatccgtacatttcggaaaaagaagacgtctga

SEQ ID NO: 32972 - DNA, 237 bp, Glycine max
  Peptide Sequence Number=SeqID_149750
atgccgccaaacgtcgcaatgctgacgtacacccagttgatgccgctgccgaacaggccaaagccccaggcaaaaccgatgcctgccgcctgcgcgctgcggcgatccagcaacagcagctgcaaaccggccagagagagcagggcggcgggccagaaatcatacggggaaaaggaaagggtgcccgcggcacccagaattaatgccagcagcaggcgaacccgctgctgcgagtag

SEQ ID NO: 32973 - DNA, 1308 bp, Glycine max
  Peptide Sequence Number=SeqID_149751
gaagctgaccagctccggcgtatcacgataaacgtcgatgatgtcgtcggtgaactcaatcggatggctggtggtgaaacgaatccggtcaattccgtcaattgcggccaccagacgcagcagttcggcaaaggtacaaatctggtcgtcaaaggtcgcgccgcgataggcgttgacgttctgccccagcagattcacttcacgcacgccctgcgctgcgagctgggcaacttccagcaggatgtcatcgcagggacggctcacttcctcgccgcgcgtataaggcaccacgcagaaagtgcaatatttattgcagccttccatgatcgagacaaaagcagtcggaccttcagcacgcggctccggcaggcgatcaaacttttcgatttccgggaacgagacgtcaacaatcggactcttgctgccgcgcacctgattaatcatctccggcagacggtgcagcgtctgcgggccaaaaacgatgtccacgcactgcgcgcgctggcgaattttatcgccctcctgcgaagccacacagccgcccacgccaataatcagctcaggattcttcgccttcagcttcttccagcgtcccagcaagtgaaacactttttcctgcgccttctcacggatggagcaggtattcagcagcagtacgtctgcgtcttcggcttcctccgtcagggtatagccgtgcgtgctgttcaggcgcgtattgtaatgctttggcgcgggtgtgaccagcatgcccgtcatacttcgcacgccaggcacgttggctgcgcgcggctcctccggtcacttactgatgtaagctcccgggatgatccttgcttgccgccttcctggcgcacgaattatttagggcatgatgcccggttatacttcgcgcggctgagccgtctgaagcacaaggattcacagtttgatgtggtggtagtgggcggcggcatggtcggtgccgcgctggcctgtggtctggcgcagcagcagtttcgcgtggcggtgattgaacgtgccgagccggccgcgtttgacgccagcctggcgccggatatacgtatctccgccattggcgatgcgcagcgcgccctaccgcaagctggaaacctgggaatggcaaagcgcacacgtcaccttcgacgcggctgcactgggcattccggagctgggctatatggtggaaaacagcgtgctgcagcgcgcgctgtgggagcagatgcaacaggatggcgtaacgctgctgtgtccggcttcactgcaggcgctgcaggcgcacagcggcggctggcagctacagctggatga

SEQ ID NO: 32974 - DNA, 471 bp, Glycine max
  Peptide Sequence Number=SeqID_149752
atgtggggagattcgaggggtacacctgtggaccacgagccaccacataaggaagctgatgtgagatttcacctcacacttgtaacccaacacatctccccctcaagtgtgagtctccccctcgagcggaagtctctatcatccacaagtatagtcattttggccacctgcggtacttgcaccgttgctccatctccggggcacgttgcaccgccatcttacttgtctgagccgagactcaacaatcttggttctggtggcatcgtcgaggccgaggcagtggagcatgatgacctcgtgacagaactcgggcgccaagggaagatacatccagggatccttaacaaccaactcacagaaaaccccgatcacactggtcacaacctgaggatcagaactttcaagattctcaaccaaatgcttgaagcaaaccctaatcgcgccaggatgagaataatagaggaagtgtga

SEQ ID NO: 32975 - DNA, 909 bp, Glycine max
  Peptide Sequence Number=SeqID_149753
gggacgaatttgatacttaagccattacctaaggtggtttcttttctgtttgaacttcgtggtcaacatcaccatcacgcattcacgcattcacgctacacgctctccctcactacattaactcaccacgttccacactgtactcaacaaacaaacttcaagtcagttcgcacaatgtcccatctaaacggcgcgtactacggcccctccgttccgccgccgaaatcctaccaccgcccctcccgcggcggccgcgacggctgctgctgcggctgcctgagctgcttctgcggctgcatcttcgactgcatcctgggcctcatctgcaagatcctcaccacaatcctcatcatcgtagcaatactcggctttctcttctggttcatcgtgcgccccaacgtgctcaaattccacgttaccgacgcgtccctcacgcgcttcgactacaccaccaacaacactctccactacgacctcgccctcaacgtctcgatccgcaacccgaaccgcagggtcggcgtctactacgaccacatcgaagcgcacgcgctgtaccaggatgttttgttcgggaaccagacattagggccgttcttccagcaccacaagaacaccaccttcgtgaatccccttttcaagggccagcgcgtgacgccactcgccgggaaccaggtcgaggtgtttgacaaggagaagggttcgggtgtttacaccatcgatttgaagctctttatggtggttcggttcaagttcttgctgttcaagagtgcgagcgtgaagcccaagattcggtgtgcgttgcacgtgccgctgaaatcgcgtaacgcaacaacaactatctcccccgatgctgcgtttcaacccacagagtgcggttgggattacgggaaaaaatggtggatccattag

SEQ ID NO: 32976 - DNA, 234 bp, Glycine max
  Peptide Sequence Number=SeqID_149754
atgaaagcaaaatgcaaccaaaggggttgctcgcccaggcaagctaacctgccatttttcttttacgccgtcatgagtatggccctctacaggccggcgttctcttactcgaacccactcaaggatactaggcggccttgcagcggcattttccgcttgtccagagtcgggaagggacgacgatttgtcggtcgtgaccctagcctttatttgcatccgtccctaagtacctga

SEQ ID NO: 32977 - DNA, 1095 bp, Glycine max
  Peptide Sequence Number=SeqID_149755
atgcacgtgttttgcggattaattcaatatgggaagcttgctgggcttacagtgggctacactataacttcgtctacaagcttggtggctataaagaaggccatttgctttcacaaaagaggccaccaagcttattgcaggttttcaaataatccctttatgctcggttttgggatgttgcaaattttattgtctcaaatcccaaacttccacaagttaacatgcctttcaaccgttgctgctattacctctttttgttatgcattaattggaagcgggctttctctggcagtagttgtctcaggtaaaggagaaacaacccgtgtatttggaaacaaagtagggccaggactatctgaagcagataaaatgtggagggttttcagtgctttgggaaacattgcacttgcttgctcttatgctactgttgtgtatgatataatggacacgttgaagtcatatccaccagaatgcaagcagatgaaaaaggccaatgtgttaggaatcacaacaatgacaatacttttcctgctatgtggtagccttggctatgctgctttcggagatgacaccccgggaaacatcctcactggctttggattttacgagccattctggttggttgcccttgggaatgtgtgcattgtaatccacatgattggagcatatcaggtgcttgcccaaccactatttcgtataattgagatgggtgcaaacatggcatggccaggttcagatttcataaacaaggaatacccaaccaaaataggctccctaacattcagtttcaacttgtttaggctaatttggaggacaatatacgtggcagtggtcacaatcattgccatggtgatgccgtttttcaacgagtttcttgccctgcttggagcaattgggttttggcctctcatcgtctttttccctatacaaatgcacattgctcagaaacagatcaaaagattatcatttaaatggtgtctgctccagctattgagctttgtgtgcttccttgtttcggtagtcgccgcagttggttccattcgtggaattagcaagaatatcaaaaaatacaaacttttcatgtataaacaatag

SEQ ID NO: 32978 - DNA, 198 bp, Glycine max
  Peptide Sequence Number=SeqID_149756
atgtcacctaatgttgtcagagaaaaaaaagctgatgacgttcatgctaatcgcaaatggctaccccacccagctctccttctcctcctcctcctcctcctcctactgattgttgctcgtgataagctcgatgtcacatatgagaattggaagcaagtccctgctgctcagaaggatttgatatgggaggatatttag

SEQ ID NO: 32979 - DNA, 915 bp, Glycine max
  Peptide Sequence Number=SeqID_149757
atgaaggactctctctcggggaaataccccacgaattgggacgctgcaggggaagtagtaccaatatgcggcttcaccggagtcacctgcaacaccaaaggtgaagttatcaacctcgacctctcaggtttgtcatcactctctggaaagttcccaccagatatatgctcttacctcccacaattacgcgttctccgcctcggccacaccaggctcaagttccccatagacaccatcctcaactgttcccacttggaagagcttaacatgaaccacatgtccttaaccggcaccctcccagatttttcttccttgaaaaaatccatcaggattctcgacttgtcctacaacagcttcacaggccagttccccatgtcggttttcaacctcaccaacctcgaggagcttaacttcaacgaaaacggaggcttcaatctgtggcagttacctacggatatcgacaggttgaaaaaacttaagtttatggtgctcacaacgtgcatggtgcatggccaaatccctgcctccatagggaacataacatccctcatcgatcttgagctgagtgggaatttcctcacgggacaaattcccaaagagcttggtcagctgaagaatttacagcaacttgagctttactataactaccacctcgttgggaacataccagaggagttggggaacctcacggagctcgtggatttggatatgtcggtgaacaagttcaccgggagcatccctgcgtcggtgtgcaagcttccgaagcttcaagtgttgcagctctacaacaacagcctcaccggagaaatcccaggtgagattgaaaactcaacagctatgagaatgttgtctctctacgacaacttcctcgtaggacatgttcccgcgaaactgggacagttctctgggatggtg

SEQ ID NO: 32980 - DNA, 270 bp, Glycine max
  Peptide Sequence Number=SeqID_149758
atgttgtgggatggtatcactctcatcttgggtagtgaggtagtttttgtggatgtagatgggttgggttgggtggtgattctcatgtttatgggtcttgccttgaagtcaagttgcttcttgcaattgaagaaacctcaggctggtttcaatgtttgtttttcatctaagaaagttataatctccatgaaacaacacactctcgtggctgctatcaggaccatggaagtagcgggactctttgcaacattcaccaaattgaaaaaataa

SEQ ID NO: 32981 - DNA, 1743 bp, Glycine max
  Peptide Sequence Number=SeqID_149759
atggtgctgttgaggtttagagtcagcaacaaccgtttggaggggtccattcccgctggactcctcggtttgccacacgtttcaatcattgatttgagtagcaacaactttaccggtccggttcctgagattaacggaaattctagaaatttatctgagctgttcctccagaggaacaagatttcaggtgtcataaatcccacaatatcaaaagccattaacttggtcaagattgatttcagctataaccttttgtctggtccaatccctgccgaaattggcaacctcagaaagcttaatttgcttatgttgcaagggaacaagctgagttcttccatccccggttcactatcttcattggagtctctcaaccttcttgatctctccaataatcttttaactggaagcatccctgaaagcctctctgtgctgttaccaaactctattaacttctcacacaacctgctttcgggtccaattcctcccaaactgatcaaagggggtttggtggaaagctttgcagggaatccaggtttgtgtgttttacctgtgtatgctaattcatcggatcaaaagtttcctatgtgtgcaagtgcccactacaagagtaagaagataaacacaatctggatagcaggggtgtcagtggttttgatctttattggctctgccttgtttctcaaacgttggtgcagcaaagacactgctgcagtcgaacatgaggacacgctgtcttcttcgtacttctattatgatgttaagagcttccacaagatctcttttgaccaaagggagataattgagtccttggtggacaagaacataatgggacatggagggtctgggactgtgtacaagattgagttgaagagtggtgatattgttgcagtgaagaggctgtggagtcactcgtcgaaggattcggctccggaggatcggttatttgtggacaaggcattgaaagcagaggtggagaccctgggaagcgtaagacacaagaacattgtgaaactgtactgctgcttctcaagttatgacttcagcttgttggtttatgagtacatgccaaatggtaatctttgggattccctgcataaaggttggatccttttggattggcctactcgttatagaattgcactggggattgcacagggtttggcatacctccatcatgatttgcttcttcctattatccaccgagatatcaagtcaactaatatcctgttggatgttgattaccagcccaaggttgcagactttgggattgccaaggttttgcaagcaagaggagggaaggattccacaacaactgttattgcaggaacatatggttacttagccccagaatttgcatattcatcaagggccaccaccaagtgcgatgtctacagttttggggtgattttgatggaactgttaactgggaagaagcccgttgaggcagaatttggagaaaacagaaacattgttttctgggtttccaacaaagtagaaggcaaggaaggggctagaccaagtgaggtattagatccaaagttgtcgtgttcattcaaggaagacatggtcaaagtgttgcggattgctattcgctgcacctacaaagccccaacaagtagaccaaccatgaaggaggttgtccagcttctgattgaggcagagccacgaggttccgattcttgcaagttgtcaaccaaagatgtatcaaatgtcaccgtaataaagaaaccatacgagttataa

SEQ ID NO: 32982 - DNA, 231 bp, Glycine max
  Peptide Sequence Number=SeqID_149760
atgggtgccaagtacctcgaagcggtcaagcaaaggttgcatgccatcaaacaatggtccccggacgaaattagggagtctactaaattaccaacatctagggaactacatgatcataagatgccattgttggaaggctcaaatccaattaacaagaggtcatacagtcctgttgtgttggttgggcaaaaggatgggtcatggagactattggacaagtggcctcaataa

SEQ ID NO: 32983 - DNA, 174 bp, Glycine max
  Peptide Sequence Number=SeqID_149761
atgtggtccaagaatgtcagggagcatttgaaaggagcaatgagcatgctcctccccttcggttcagtagtttatgagcacaataacatgctcatgaaaagtgcaatgcaagagctcatgaagaagaatcacttgactacagtgttttggccaacaccttgtgaaagaaactaa

SEQ ID NO: 32984 - DNA, 618 bp, Glycine max
  Peptide Sequence Number=SeqID_149762
atggcattcaaagcaggaatccagagcgggaaagtgggccataaacgttcagatcccagttgtcaaaccagggttaagcaaaccctaaaaatgagagagtgcatttcaatccacattggtcaggccggtatccaggtcggaaacgcctgctgggaactctattgccttgaacacggcattcagcccgatgggcagatgccgagtgacaagaccgttggaggaggagacgacgccttcaacacattcttcagcgagaccggcgccggaaagcacgtgcctcgcgccgtcttcgtggatcttgagcccaccgtgatcgacgaagtccgaaccggcgcgtaccggcagctcttccacccggagcagctgatcagcggcaaggaagacgccgccaacaacttcgcgcgtggccactacaccatcggaaaggagatcgtcgatctctgcctcgacaggatccgaaaactcgccgacaactgcactggtctccagggcttccttgtcttcaacgccgtcggtggcggcaccggttccggcttgggctcgcttctcttggagcgtctctccgttgactacgggaaaaagtcaaagctcggtttcaccgtttatccttcgcctcag

SEQ ID NO: 32985 - DNA, 307 bp, Glycine max
  Peptide Sequence Number=SeqID_149763
atgactgaagttctttcagagttacggggcctttgcacctatgttggtgaacgattcgattccttggatggtcgctttgaaggcatggatacccgcatcacccagcttgaagaggatgtgacttatcttcgtcgcaaggactttgcctttgatgttttgatgatgccatatgatcatgatgttttgatgccttatgaaaatgcgcttctcaagtttaattcaagacaaaaatccaagaatacaagatacaacatcaagaagatttctagtgttttaggaagggaattccaaactgaaacagcaaaag

SEQ ID NO: 32986 - DNA, 1920 bp, Glycine max
  Peptide Sequence Number=SeqID_149764
atggccattatcaacgacctgcgcagctccgttgccactgacagtgccaccgtcactcagcagcatggcttcgaatacgatatcggtaccagcctgctgtacaaaaccgcggcgtctctgacggcaacggccgccggcggcaacgcgacgggcaccgtcaacaccggcgcatctcaccaaattagcaatgccgaaacggcagtgttgacggatgtgcaactgaacgccaatgccgccagcatcgtgaacctgaagttcgccgaccacctggcgaatctgaccatcaacggcaccagtgcagcaacggtcaacctgtctgacaacggggttaaccctggtgtcgatattaccgttaacaatggcaacgtgattctgaacgccagttccggaaatgatgatgtcatcgtgacgtcgacggccaacatcgccacaggcaccggcgactttaaccttggcaacggcaacgactcgctgaaatgggcggggaatgcggcaaccggcgcagccaacaccgtcggcgccggcatctccgctaatggcggcgcgggtacggactccatctccgccaacttcatcaccaaaaccgtggtgaccaaccaaaacgccctgggcgttcgtaccagcaccgtgaccagcaacgcccacaacttctcgaacttcgagcagatcgacctgaccggctatatcggcaagtccgtcggtacgctgattacgacgccgctgatcggttcaccgactaccaccagcgtgacaacgccaaacaacacctttgactttggcctgaccaacggcacgtccacggtcgaaggcactacgggcggcacggttacgcagaacgcggcggccaccaatctgggcactcaggggtttgtggtctccggtctggctaacgtcaacgtcatcaacgccgccggcggcaacgccgcacagttggcagtgaaaggggacgcgaccgctgccagcacgctgaactttaccttcgtccagaatgccaccaatcacttcgacatcaacttcgatgcggtgagttccgccaatgtgaacgccggtgccatcaccctcaacagcagcagcagcctgattggcggtactgcattgagtacagttaacgtagcctcgggcggtaccggcagctttgacaatattctgtcattggccggcaccaatgcgcaggttcagaccatcaacgtgaccggtgatcacgcgctagatctgacggtgggcagcggtttcagcaacgtgcgtgatatcaatgcgtccaccaataccgcggggctgaatctcgactccagccatggcggtaccggtgacggtatcatcattcagttgctgaacattctgccgctgagcgttgtcaccaccaacctgttggcaccggtgttgacggcgttgggcctgaacggttaccaaatgaccgtagaaggttccagtgcggccgatactctgggcgtgattggcaacaccacgctgaccggcggcgcaggtgccaacacctacgacatcaaggccagtaacacgcaggcgggtgtgaccatcaaggactttaatagcctcaaggactcgattgtcgacgtgaaccatggcggcctgactatctccgatgacgccagcggcaccgcggtagcgaactacggtacgcgttctgccgacacgttggatgcattgttggggacactggtgggcggtttgaccaatggcgttatcggcctgctgggcggtattcttggcctggatagcagcaactcgctgacgtcgaaagtgggtgtggcatccgttgtattcagcggtggcggtaacactgccagctcttacgtgattatcgacaacaacgataaccactcgctggacctcaacgataccgtggtatacctgactgggcaaaaccaccagcaattggtggatacgttgcactacgcgtaa

SEQ ID NO: 32987 - DNA, 489 bp, Glycine max
  Peptide Sequence Number=SeqID_149765
atggacaagcagaaggtgaaggcaatagaagagtggggagtccccgtgaccgagctacgatcagttcttggccttttgaactcgtcgggcaagtgtcagcgagcctttgaggacttgaagagggccgtgacggaggaacctgtattgaggttgccagactatactgtacctttcgaagtgcacactgaagcatcagactatgccattggaagagtattggtccaggagggacacccagtagcatatgagagccggaagctcaacgagacagaaaggcgcgggaatcttaaagagaagataccgcagctgattgtccaactagcggaagcaagtcgggaactggagctggagcgaaagaagaaggagctcgcagacgagacagtgcgaagagatgagatgattaagtctgcttcacgcttggctacccgcatcaagaacgcagtggaacggaagaaagaaagaacaggagctattcttgaggattgctga

SEQ ID NO: 32988 - DNA, 147 bp, Glycine max
  Peptide Sequence Number=SeqID_149766
atgactggacaggatgacatagagaagttggtatctaagttagaagataaggtgtgcgtatttagtcctccacctccaaattgtagacgaatcattgttgcaacaaatattgctgaaacttccttgactgttgatggtgtagtgtaa

SEQ ID NO: 32989 - DNA, 195 bp, Glycine max
  Peptide Sequence Number=SeqID_149767
atggccttaacagctgaatcacttccttatagctcaagaagtagagatgtgtcagagttcaatttgagagaatgggcacactgcaagcaagttcaagctataacagttgggaatgcttatctccagaatggtcttgctttaaattcaaagtggaatgaatcagaaaggtatgtatgcaaccctctctcaggggag

SEQ ID NO: 32990 - DNA, 780 bp, Glycine max
  Peptide Sequence Number=SeqID_149768
atgtgtgttccttcatcaccctattctgttgttgctctcgcaataaataaagatgagtttaccacacttaaagcgggtctgagaagagtaaaattctttgctgattatgtatcaactggaagagccaagaaggcaagctccaaagatgaaggaagtgatggtaggagctccaacagaagtgaagattttgaaaataggtatacatcgaacgtggattcactggataatgatgctgcaattaagtcagaggtgaatgaggaggattcttgtgtgagacattcattgagttatgagactctggcctctggaaactatgtaggaggatcaccatattcaggttcaactattaatggtaaagatgagtgctggatctactatagtagccaaaagtctgattatgggggtgcacatgttgagaattataatacatgtgatcaggttgagcatcagaattcaaaacaccgaatcctttcttggaggaaaaggaaacttcactttagatcttccaaggtgaaaggggagctacttctgaaaaaacacggagaagagggtggacatgatattgactatgatcgtaggttgctgagctcttctgatgattacactagtggaaagatactagggaaagcatcgggtggaggagttataccagttagtgcagttcttgcagacaaagatgtgatgatttgtatacaaccgggacagcatggaagccctttatttgtcagatcatgtgaagacacagaactctcctttctgttggaacctggaatcttatag

SEQ ID NO: 32991 - DNA, 252 bp, Glycine max
  Peptide Sequence Number=SeqID_149769
atgctggcggaggcgctgttcatggagcacgacctgaacttccatcgcggagggaaaccaacgacggcagcaacggtatcgtcagggaggagaagcaaagtgtcgtcggaaggggtgcaagcattcccgagaggtgtcaccagagttgttgagagaggtggtgaatgcattgacaaagaggagggaaaattaagaggaaaaagatcttatgtcactagagttgttgagagaggtgttgaattgattcactaa

SEQ ID NO: 32992 - DNA, 258 bp, Glycine max
  Peptide Sequence Number=SeqID_149770
atgcacgacacttttaccttgttttgcatggctccttgtctggttggattgccctctgaaattttttatgccgataagcttatgtccccagagtttcaaccttctatagagcagctgattcattttcttcctacaactcgtcaaatcttgatgttttcagcaacatttcctgttactgtaaaggatttcaaggatagaaattttttgaagcccgttgaaggcatgggatttgaggatctctctaaatatgggtcataa

SEQ ID NO: 32993 - DNA, 939 bp, Glycine max
  Peptide Sequence Number=SeqID_149771
atggagttgtttctgcttgtgctgtgtccgtcgtctttgcttcttagattgaggccagttcggctggggcggcgagatgtggtttgtcctagctgtaatttgggatttgttcatgaacttaatgatattgtccatgttaatccttttgacctctttggaatggacaacaatgaagaacgagatcaaaggcttggactaatggaaacattctctgcctttatgaggcatcaaatggcagatagggggcgaagccatgacatcagggtgcgaacagattcaaatcctgaacacagtgcaagttttgctcctctgttgatctttggtggccacataccttttagattgtccagacatggtggctttgaagctctatttaatggggctccaggaatcggtctgacacagggtaacacaggcgattattttatcggtcctggactagaagaactgtttgaacagctttcagctaacaacaggcaaggtcccctgccggcatcaaggtcctcgatcgatgcaatgcctaccatcaagatcgtgcagaggcatcttcgatcagattcgcattgtccggtgtgcaaagataaatttgaactgggatccaaagcaagacaaatgccatgcaaccatttatatcactcagattgtattgttccatggttggtgcagcataactcctgccccgtttgccgccaagaactgccgccacaaggattgagtagtagtaacggtggcgccaatggtagaagtagaagtgcaagggtaagtagtagtggtagggagagccatggaaggagaaatccattttcctttttgtggccttttcgttcttctcattctagcagtaatgatgaagcaacaggaagcagcacaccaacaccaactatccctgagaatagccatcatcatcatgctgggtattctgggtggccatttgaatga

SEQ ID NO: 32994 - DNA, 195 bp, Glycine max
  Peptide Sequence Number=SeqID_149772
atggtagacgcctttcaccgaagattctattcagtagcccgcaaagtaacctatatggagcttgcggcgactaagcatatgcggggtaaaccttttgagacctacttggctaggacagagagcctaagggacataggcggaaagactacgggaaggcttgtttgccggccggcgattaatgctttcctatcttga

SEQ ID NO: 32995 - DNA, 426 bp, Glycine max
  Peptide Sequence Number=SeqID_149773
atgtggagcccactgaaagtgaggacgcgtagccctctaaaggcgagggcgtgtagccctctgaagtcgaggaagtgtcaccttttgaaggcgagggcgtgcagcccacggaaagtgagggcgtgcagccctctgaaggcgagggcgtgtagccctctgaaggcgaagatgtgcaaccctctaacggcgagggcattcagccctctgaaggtgagggcgtgtagccctcaaaaggtgaggacgtgtagccctctgaaagtgagaaagagcagccctccgaaggtgaggacgtgtagtcctttgaaggtgaaggcgtgcagctctctgaaggcgagggtgtgtagccctctgaaggcgagagcgtgcagccctttgaaggtgagaaagtgtagtcctctgaaggcgagggcgtgcagccctctaaag

SEQ ID NO: 32996 - DNA, 216 bp, Glycine max
  Peptide Sequence Number=SeqID_149774
atgttaaccaataagtattgtggatctttggagccaatgcctatgcctgcagggagtggtggtattgcccatgcattgtttgtctccaaagattgtagaattcccaacattcgaatccaaacccgtcaacttgagaaccttttggacaagaggattattgtggcagttgaatcttgggatcgtcagtctcgatatccatcaggccattatgtgtga

SEQ ID NO: 32997 - DNA, 195 bp, Glycine max
  Peptide Sequence Number=SeqID_149775
ttacacacactccagtcacacacttcttcctctctctatttctctaactctgaccatgcaattggcattggtctcattgcattctctatagaaatgacgaacaaggtcaaaggaaaaggcaaggaggttgccggaaaaggttatgccggcaagcgcaagggcgcctttgacgacgacaagaccggtggcggctga

SEQ ID NO: 32998 - DNA, 213 bp, Glycine max
  Peptide Sequence Number=SeqID_149776
atggagaaaataattataatgtttgttttaaaggctgaggtaaccatcacgaagcttaatgaggagaggcgcaggaacactcaagaaaaagatttactgctgcggcaggaggaactaaacaatttgttgttcagaatttctcaaatttctccattgggtgttcattcatggcttttggaagatgcaataagcaataaatatttacttatctga

SEQ ID NO: 32999 - DNA, 299 bp, Glycine max
  Peptide Sequence Number=SeqID_149777
atggataagtttgacgtggcctggccaggagcccaaccttctccttctagagggggtggggcctccgcagcccaggagcctgaaccagaggaaccagcagcagcagtagagggggaggttgagctcactccccctaagcccttctattttgatgcaggtgtacacatggctcaggaggaggagactgccacaaccctgattctagagccatccccagcacctatacctgatgatgccataccatctgcaccagcacctgagttagagcagcctatctctcagattcaccagctgctcaa

SEQ ID NO: 33000 - DNA, 363 bp, Glycine max
  Peptide Sequence Number=SeqID_149778
atggttaatgaggagtgtaaggaggtaagtgtctcctccaaaaggttacctaagaaggaaagtcattttgcaataaagacaaacattaaagaaacttcccttcttagacaacctccacatcttctcctttgtaaaaggaaacttgttagcactaccatacctctggagcttgaggttaattctcaagtaaaggagttgttggataagggtttggttcataagagcttaaattgttgtgctttgttggtgcccaaaatagtgatcaagggggtcccacgaatccaagagaataaaggtgttgagggaagaaggccagagtttcaagaatatctggatttgaggtcaaatcctttacaagggtaa

SEQ ID NO: 33001 - DNA, 630 bp, Glycine max
  Peptide Sequence Number=SeqID_149779
atgttggggaaatacccgagactctacagcatttcagaacagcaacatcatgaggtacaacaaatggggtcagctgcggaaggggtttgggaatggagtttcagacggagaaggaacctgttgaaaagtgaactagaaatggcatcaaacttcatgcaagtggggaatatacagccaaaagtgcatatggtttgccaagttgggagggtcagatttatggaagatgaaagtgcccagcaaggttcagcactttgtatggagactggttcaggacaggaggatgcgtcacacattttctttcagtgcccaaaggtgttgcctatgtggtgggaatgtctatcttgggtacaaatcaaatcttttttcccagcagatccagcacatcatttcttacaacatccagactgtcatctgcctgggctaattcagaataggtggcataccttgtgggcttctctcacctggtgtatatggtatcaaaggaacaaattgggcttttcaggcgaagcatttgatggacagagagtcttggaacaagctctatttttttgctggctgtggttaaaaaatttcgagagaaacttcaatatacctttccattactggtccagcaacattaagactggttga

SEQ ID NO: 33002 - DNA, 1252 bp, Glycine max
  Peptide Sequence Number=SeqID_149780
tggcacaaatgagcctgaaattattcaacttctagtaatagttgaggacacaggtataggaattcctacagatgcacaaagccgcatattcacaccttttatgcaggctgacagttccacctcccgaacatatggtggaactggaataggactgagcattagtagatgtctagttgatctcatgggaggagaaattggatttgtaagtgagcctggaattggaagtactttttcctttactggaactttcagaaaaggagaaagcacgtctctggatgcaatgcggcagaataatcattttggttcagagttccaagaattgagaacattagtggtagatagaagaaaaatccgagctgaggtcacaaaatatcatctgcagagattgggaatgtccgtggatgtaacttacagtctgaattctgcatgctcttgtctatctaatgtgtgtaacatgagtatgttggccatgattcttattgacaaggatgcttgggataaagaatatcatatcttatacacaatcaagaaacgtagacagaatggcatcaaaggggatccattgaatttaccaaagatttttctcctagctacccaccttagctccaatgaacaggatgagctcaagtcagttggtgtcatagatgatatattaatgaagcctctatggtttagttctttgattcagtgttacagagaatcccttggcactgaaaacaagcgagtaaataggaaaaaagtatccaaactcgggaatttattaattgacaaacaaattttggtggttgatgataatgcagtgaacagaagagttgcaaaaggtgttctacagaaatatggggctaaagtgactgctgtggagagtggcagggctgctctaaagatgcttgagctgccgcataattttgatgcttgtttcatggatctccaaatgccagaaatggatggttttgaagcgacgaggaaaatccgttgtctggagagtgaggtaaatgagaaaattgcatgtgggcaagcatctgcagagatgtttggtaacatctcttattggcacattccgatactagcaatgacagcagattcaactcagtcttccaatgaagagtgcataaagtgtggaatgaatgactatgtgtcaaagccgtttgaagaagagcagctctacatggcaatggcacgtttcttcaagccagagaccatgagtgtcttccaacccattgagtcaaagactaatcccgctcacgatacatga

SEQ ID NO: 33003 - DNA, 432 bp, Glycine max
  Peptide Sequence Number=SeqID_149781
atggcaacattcatgctgaagttggtgcttcctctacttttcctgtccatgattcctccaaaaacagcgtatgcggagtttgagcaatggtgtgtagcagatgagcagaccacggattctgagttgcaggcagccttggattgggcttgtgggaaagggggtgcagattgtagcaaaatccaagtaaaccaaccatgctatttaccaaacacattgaaaggccatgcttcttatgccttcaacagctactatcagaagttcaagcacagtggaggttcttgctacttcagaggtgcttccataacaacagaagtggatcctagtagtatggtagtactacttgttccggaccaagccaatctcggaggccgaacccaaataaacttggtcccactcccacaagtggtccttgataccttttggtctaactag

SEQ ID NO: 33004 - DNA, 1845 bp, Glycine max
  Peptide Sequence Number=SeqID_149782
atgaacagtaacaaagtcgtgctctttgtcctatgtcttactaagtttataatgcagattttatccaactgtattgatgaaagaagacttcaaatgctgctaggcagcggcatggttagcactccacagttaatgtgtccggagaatcaggagttacaaaaggagcatacatgtgttgtagacactgtagaacctatagaacaatgcccaattcttgatgattatgtccagacaaggctcgaattatcattcccattgaaaaattatgtatcattggccttgcgctctgcactttcaactgatttgaacactgtgcaatcatgggaactgagggtatctgcaattcggtatcatgtgagttcatctaatttaattaaaggatgctggtgggtcattggaattataatgtcctacttctgtttactatggaggagtcaaaagcagaagctagttcaggggcatccaggtgcacaacaaaagcagttgaaacattttccaaggggtccttcaaggggtactgggaggtggaggaaaaagttactagttatatttgtgtcacttggaattatcgggtccttttggttattttggcacctgaatacgggcattatgcagagaagagaagaaacactagcaaatatgtgtgatgagagagcccgtatgctgcaagatcagtttaatgtgagcatgaaccatgttcatgctctggctatccttgtatctacctttcaccatggtaaacatccttctgcaattgaccagaaaatttttggagaatatacagagagtacagcatttgaaagaccacttactagtggtgttgcttatgctttgaaagttctccactctgataggatgcattttgagaagcagcatgggtggacaattaagaaaatggaaactgagaatgaggcattagtccaagattgtattcctgaaaaattggatccagcacccattcaagatgaatatgcaccagtgatatttgctcaagaaacagtttcccatattgtatctattgacatgatgtcagggaaggaggaccatgagaatattttgagagcaagggcatctggaaagggggttctgacatccccttttaaactactaaagtccaatcacctgggtgttgtacttacatttgctgtctataacactaatcttcctttagatgctacaccggagcagcgtaccgaagctactgtggggtatctgggtgcatcttatgatgttccatcactggtggacaagcttctgcaccaacttgccagtaaacaaaccattgttgtaaatgtttatgacacaactaatgcatctgcaccaatcacaatgtatggtacagatgttgctgacactggcctactacacataagcagcctagattttggggatccgctacgaaaacatgagatgcactgcaggttcaagcagaggcctccattaccttggacagcaatcaatgcatcagtgggggtgtttgttattactttgcttctgggtcatattttttatgcagcaattaatagaatagcaaaagttgaggctgactatcgtcaaatgagagagctgaaagttcgtgctgaagctgcagatgtggcaaaatctcagtttcttgcaacagtttcacatgagatcaggactccaatgaatggtgttttaggtatgctgcaaatgttgatggatactgagcttgatgaaaaccagatggactgtgcccaaaccgcccacaagagtggtaaagatcttatctcagtcataagtgaggttctcgatcaggctaagattgaggcaggaaagcttgaacttgaagctgtagcctttgatccacgagctattcttgatgaa

SEQ ID NO: 33005 - DNA, 1575 bp, Glycine max
  Peptide Sequence Number=SeqID_149783
atggcaggaaaagggatacaccaaggaagtatggctctacaatccagattttttcagtttgatagcactatctatgaccgtattattttcagtttgagtgaagttcatcgcttccagattgtggaagtcgacgacgatacaacaactgaaggcaaaaaggatgatcaagatgataagactgagaaaaagaagaaaactaaaactgttgttgagcggtattgggattgggagctgacaaatgagacccaaccaatctggcttcgtaatcctaaagaagtcactaaggaggagtacaatgaattctacaagaaaacttttaatgaatacctggagccattagcatcatcacactttaccacagagggtgaggtagaatttagatctatactttatgttcctgccttcgctccctctggaaaggatgacataatcaatcccaagaccaagaatataagactttttgtgaagagagtgttcatttcagatgattttgatggagaactgtttccccgatacttaagctttgtcaaaggtgttgttgactcaaatgaccttccactcaatgtgtcacgtgaaattcttcaagagagccgcgtagtgcggattatgaggaaacgtctagttcgtaaagcttttgacatgattctgggaatatccatgagtgagaacagagaggactacgagaagttctgggagaactttggcaaacacttgaaattgggttgcattgaagaccgtgagaatcacaaacgtattgctccattgcttcgttttttctcatcccaaagtgatgaagaactgatcggtttggatgaatatgttgagaacatgaaacctgatcaaaaggatatttattacattgctgctgacagtgtgactagtgcaaagaacacacctttcttggagaaacttgcagagaaggatcttgaagttctgtttttggtagatccaatagatgaagttgctattcaaaatcttaaatcatacaaggaaaagaattttgttgacattagcaaggaagacttggatctaggtgataagaatgaggaaaaggaaaaggaaatgaagcaggaatttggccaaacatgtgactggatcaagaaacgattgggagataaagttgcaagtgtgcaaatttcaaaccgacttagctcttcaccttgtgttctggtctctggtaaatttggttggtctgcaaacatggaaaggttgatgaaggcacaatctatgggtgatgcatccagtttggaattcatgaggagcagaagggtgtttgagatcaaccctgaccattctattatcaggaacttggatgctgcatttaaaacaaattctgacgatgaagatgccctcagagctatcgatcttttgtatgatgctgctttggtttccagtggttttacgcctgataatccagcacaacttggagggaagatatatgagatgatgggtatggctctcactggtaaatggtctacacctggtcagttccagtccacggtaaaccagccccataccccagaaattgtagaagctgaggtggttgaaccaactgaggctggtggtcagaagtga

SEQ ID NO: 33006 - DNA, 1704 bp, Glycine max
  Peptide Sequence Number=SeqID_149784
atgctccctccacaacagcagtcacgggttggaggactacaaacctctctatctctagtttcttcagatccccgcctttctcccgaggagcctagatcaaactctgacaatctccgtgaatctcctactgaaagtgccagttctcgagaaacttggcctactgctgatgcaattgctgcaaagaagatggaaaatggaaaagcagaaatggattgccctgatcagtcagttattcgctgtgtttctagtgcagacaaaattagtcttcaggacattgcaagagaacgagttgatataatatgtgagaaaatgcatcatctacctgacgaatttcttgaagagctgaaaaatggacttcgagttatccttgagggagggaatggctcacagcatagagaggaatttttcattttgcaaaagcttgttcagagtagatctgatttaacagccaagacattgataagagcacatcgtgtacagctagaaatccttgttgcaataaattctggaattcagggatttttacatcctagcatcagtctatcacagacatcgctgattgaaatatttgtgtacaagagatgcagaaacatagcttgccaaaaccaacttcctgctgaagattgtacctgtgagacgtgcgccaatggcaatggtttctgcaatctttgcatgtgtgttatctgcagcaagtttgactttgaagtaaatacatgccgctggattggatgtgatttgtgttctcattggactcacacagactgtgccatacgtgagcaacttatttgtatgggcccttctgcaaagaatggagcagggccaagtgaaatcgttttcaggtgtcaagcatgcaacagaacttcagaacttctgggttgggttaaagatgtcttccagcattgtgcaccatcatgggatggagaggccttgatgagggaacttgatttcgtcagtaggatctttcatggtagtaaagacccgcgggggaggaaactttattggaagtgtgatgatctcaaggaaaaattgaaaagtggaaaagtggaatctaaggcagcatgcagggcaatattgatggttttccaagagcttgagctggactctccaaagagcctggaaaatgcagaaagtggaaggctaattgctccccaggaggcatgcaatagaattgctgaagtggtccatgaggctataagaaagatggaaatagtagctgatgaaaagatgagaatgttcaagaaggctcgcttggcttttgatgcttgtgaacgtgaattagcagacaaggccagagaggcaggagaactgaaaatggacaggcaaaaaaagaagttacagattgaagaactggagagaattgtgaggcttaaaaatgcagaagctgatatgttccagttgaaggctaacgaggctaaaagagaggcagagcggctccagaggattgctcttgccaagtcagataaatcagaggaagaatatactagcaactatttgaagcaaaaattaagtgaggctgaagctgagaagcaatatctgtatgagaagatcaaattgcaggaaacttctcgtgtatcacagagcagtagtggggttgacccctcttcaatgctggtgtattccaaaatccatgatcttctctacagtgttcctcccaaggcagacggtcaatctaatgagtgccaccctttcagaacaaacccatga

SEQ ID NO: 33007 - DNA, 375 bp, Glycine max
  Peptide Sequence Number=SeqID_149785
atgggtaggcaaggtaatgatcctagtcctactaccactgtgaactcctccattgctcttcttcaagaaaggtttagacagttggagaaggtgaaagaaagaagagaggggaaacaacttcttaaactcttgtcatctgagagcacctcatcatcacaaaactctcaacaacaacaacaaccaaggttggtagctccacataggccaactctccatgactctctttctcttggcctcaacttcacaagcaagcaaggcgatcatcacaacaccatcaacatgaaatcacctccatcctccaatttatggccacatggagcatcaacatcaagaaattttgatacctcggacgttgatacttctcttcatctgtaa

SEQ ID NO: 33008 - DNA, 264 bp, Glycine max
  Peptide Sequence Number=SeqID_149786
atgaaaaaatcagtgtataattttaaatctattgttcaaattcaaaatcttgtggttgcgacaacattagtggtgattgtggtaacaatgataaaggtggtggtggtggtgatatggacgatggtgatagcaatgtcaatgacgatagtggtgacaaccaattatgtcaatgataacaatgatgatggtgacgatagtgtgagggtggtaatgaaggaggtgatattgatagtagtggcggtaacaatgacaatagagtgctag

SEQ ID NO: 33009 - DNA, 309 bp, Glycine max
  Peptide Sequence Number=SeqID_149787
atggaactccttttctctctcaggagtgacactaacagtactttcaattccaaggaacaacaacatatctgccagagttttcaacatccaagcttgaaagcgctcactgaacttctcacaagcattccacagataaggatatgctgctatggcctcttgccaatcccacattggaaaacgtttattgagatcgttcaaacgatggataaagtggaggtggttcttgagaatgagcacatgatcgatgtggtggttctcattattgcttcaccccgtgccagaacagaagaacatacagtatttaactga

SEQ ID NO: 33010 - DNA, 225 bp, Glycine max
  Peptide Sequence Number=SeqID_149788
atggctggagtcatccagaacttgattgtcaagacgtccattcctaaacatgtgatatgtttaaatataaggagacatgaaattggcttgtctgaaaggggagcagaaggtgcgacggccatggtgggcaccggcttgcctatctacagtgttcttaaaggttgcaaaatccaacagacaatcaagagttgtttccttgaagctggaaccatgataatacaataa

SEQ ID NO: 33011 - DNA, 3642 bp, Glycine max
  Peptide Sequence Number=SeqID_149789
atgaagacgttacgaaagagcaatgttcgctctcgcagagagcaaggtcgcgattccacggtggtagattctccggtcactcctgctcgaacctctttccacgataacgccgttcccaatcgcccgaccaccggcactcccgttccttgggctccccgcttatccgttcttgccagggttcctcaggtcaacagaactggaaaaggcgacgacacagatcctaccaaacctgttttcgtcggcgagtttccgcaagtggttcgtgatgagcagagcattttgctacacaatcgaattcctgtgtttgagattatgatgtattgcaatgcagctgaagatcgcgtgtgtggtggaattgacaagagcacatcccttgcttggattatttgtgggaacagggtctacctatggtgttatttgtcgcccgcatcctccgtgaaatgtgctgtcctcgagattcctttgaatgatgctgatgttggcagaaatcatgctggtagttggttgctttgtgttgttaattgtgatgccacgtctgtgggaacgaataaagttgcaaaacagtgcaactctgctgctgtggttttgtgcaattgtcggactcgggctgttatatactggccggacatctattctcagttgcatgctccggtcactagtcttgtgtcttctgacgagctggaggctgttttgactcctgataggaaagcgtccttcaacaggcagcggcgacaaagtaagctgggaagtagtttgagtggattgcacacatttaactctatgattgcttctgctgatcccagttgtaagtttgtatgtgttgcccttgcgtgcagctcgagtgatgaactttggcagtttaaatgcactcctactggcattcatcgaaggaaagtatatgaaaatattatgcatttcccactccaacagggtgaatcaggtcaaattgtgagcaatattgggtaccctagatctctgatgtggcattttcctcattattctatccaggaatcaagtcggcaattcttggtattgacagaccatgagatacagtgtttcagagtagagtttggttctgatatacctatttcaaagctttggtctcaggcaattgttggaacagatgctgaggtcggcattaagaaggatctggctggtcaaaagagaatctggcctcttgatatgcaagtagatgatcatggtaaagtcattaccattcttgttgcaaccttttgcaatgaccggattagcagttcaagctacatgcagtattctctcctgatcatgcaatataaatcagggatgggtttagagactacaaatgacagggttttggagaaaaaagcccctattgaggtgataatgccaaaagctagagttgaagacgaagacttcttgttttccatgaggcttcggatagggggcaagccttcaggatctgcagtcataatatctggggatggaacagcaactgtctcccattattatagaaactctacacaactctatcagtttgatttaccctatgatgctgggaaagtgctagatgcttctatccttccttctgcagatgattatgaagaaggtgcatgggttgtattaacagagaaagcaggaatatgggcaataccagagaaagctgtcatacttggaggagtggaaccacctgagagaagcttatctcgtaaaggcagttcaaatgaaagatctgcacaagaagagataagaaatcttacatttgcaggtaattttgctcctagaagggctagctctgaagcatggagtgctggagacaaacagaggatggttttgagtgggattgcacgtcgaactgcactagatgaagaatcagaagctttattgaataatcttttcaatgaatttttaacatctggccaaattgacaggtctcttgaaaagctagaaacttctggacatgcattgcaaattattttggagcatggtgaaaagttatctgcaatgattcagctgagggaactgcaaaatctgattagccaaaatcgatcaactaatgttgactcctcaaattctagcttggatattcagacgtcaggtgctctttgggacatgatacaattagttggtgagagagctcgtcggaatactgtccttttgatggatagagataatgctgaagtgttctacagtaaggtttcagatcttgaagatctcttttactgcttagatgcagagttagaatatgttataagaccagagcatccattaggaatccagattcagagggcatgcaaactctctactgcatgtgttaccataattaggacatgcttcaactataaaaatgagaaccgattatggtatccaccacctgaaggtttaacaccttggtattgcaaacctgttgtacggactggtatttggagtgttgcttctgtcctgcttcacttgttaaatgaaatatctggacttgataaaacagcaaaattagatctgtacaatcatttagaagccctagctgaagttctacttgaggcatattctggtgctgttacagctaaaaatgagtgtggagaagaacacaaaggtctgttaaatgaatattgggagaggcgagatagccttcttgaatctctctatcaaaaagttaaagaatttgaagatactcgcaaggattcgattgaaggagctggagagcagaatgaagaggccttaatgaagcatgaaagcctgggacctaatgggggatttagttactatgtctttaagaaactccatgaaagcagacaattttctcaacttttaaggttaggggaagaatttcctgatgagctatccattttcctgagggagcatccagatcttctttggcttcatgatttgttccttcatcaattttcctctgcttcagaaacacttcatgcattggctctcttacaaaacatgcaatctacttctgttgctgaagaggaaggagaacaggagtatatgaagatgaaactaaaattgactgacagaaaaaatcttttatttctctctaaggttgctgcctttgcagctggtaacgaagctggtactcaagtcaaggtggaccgcattgaggctgatttgaagattctaaaattacaggaggaagtaatgaaacgtcatccttccattgaagatcagctgcttcatcctgaagacttgattaaattgtgcctggaaggtgaagatcgagaactctcgttgtgggcgtttgacgtgtttgcatggactagttccctgtttcggaagatccacagaaaacttttggaggattgttggaagaaagctgctagtcaggacgattggagtaaattccatgattcatacatagctgaaggatggagtgaccaggaaatcctgcaaaacttaaaaaatactatacttttccaggcttcaagtaggtgttatggacctcaaagtgaaacatttgaagaagggtttggccaagtattttccttgagacaagaaaacatggagacttctattttgggggatatgggtagttcagttgaaacaatattgatgcagcacaaggattttccagttgcaggcaaacttatgctaatggcaatcatgctaggcagcgagcatagtagtgacatcagaattgaagaaggaccttccccaatggaatag

SEQ ID NO: 33012 - DNA, 1326 bp, Glycine max
  Peptide Sequence Number=SeqID_149790
atggaagcaaacaaggaggaagcacttaaagcgatagagattgctgaaaagcgatttgctctgagagactttgccggtgcaaaaaactatgctgtaaaggctaaaacactctgtccaggattggagggtatatctcaaatggtggccacatttgaagtttacgttgcttctgaggtcaaacataatggtgatctagattactattcgattcttggattaaaaccttttgcagataaggaggctgtgaagaaacagtacaagaagttggcagtgttgcttcacccagataagaacaaatgtgtgggagctgatgaggcatttaagcttgtttctgaggcttggacttggctatcagatagtgctatgcgcagttcttatgatctcaagagaaatgtgcagctgggtggggctaaccagacaaatttgtctcctgcccatgctacagggactgcaggttataccaaatgttccaatttgccaaccccttgtggtaggcttgacaccttttggacaatctgcacctcttgtaaggttcagtatgagtatctgcgcaagtatgtgaataaaagactctcttgtaagaactgtcgtggcacttttgttgctgttgaaactggggcggccccagcaaatggttcgtttccatattgtccttggtcatatgtggcaggaaatgggtatggaagtcattcatttgatggagttacatatgttccaactagtgccccctatttcaatgggaatggggtcacagggtaccattctggacatggttatgagtacgttccaaatgtttcatttcagtggggctctgctggagttgtcaaccaaaatggatcaactaccttacctgctgattctgttcatcgggccaatggaaatgtgaagaggggaaggccaaaagtcaagttgggagctgataagaggcatcacgtgatagagactatggtcaatacaaattcagatgtaccattctcctgtagtgaaccacaggaagataaactaagtagacctgacaagaaacagaaagttgttgtgggagccagtttcagaaatggctatgaagaaaagggttcaaaatgtgcttcagagttgatagtggctaacggaaatgatagcatgggacatggccaaaagccttcctgcacagtcgaagttcaaaccaaacagtgttccatggcaccagcatttgacgcaagaaaattattgattgagaaagccaggaaagaaatcaggaagaaactggaggagatgaagttgtcgtctgcagcagcagctgctgcagctctgaatgagaaagaaaaatcacaagctgaagttggtaaa

SEQ ID NO: 33013 - DNA, 438 bp, Glycine max
  Peptide Sequence Number=SeqID_149791
atggtgcagcagcagcagcaccgcgtagagcaagagaaacgaccacggttcttcataaacgacaacattgacattctcagggaaatccttaaacgcctcgacggtccctcgctgggagtggcggcgtgccaacgacgactcgctgtgggagcacctgtgcttccgccacgtgtcgtctccgccaccggcgtcggtgaaggcggtggtggtggcgctgggcgggtacaagaggctgtacatggtgtgcgtgagaccggtgctgagtcgactcggagactcggagcgggtgaggaagcgagtgtggactcggcacgagctacgagaggctcgggagtggaaggatccccagcgacgcgtccgcatcgtccctcatgttcctctgcaactccgtcaacgtctgatctcatctcatcacatcacacttttgcttttctttga

SEQ ID NO: 33014 - DNA, 1097 bp, Glycine max
  Peptide Sequence Number=SeqID_149792
gtttgttccacgtggcgagaggtgtcgcggtcggatctgctgtggcagcggctcacgagacgcatctggagacgcacctatcaactgagggccacgtggcagctggagtacatgtattggcatcggacggccaggaacttctcgacagggagacacaggtttttcgaccaagcagtgttcgacccttcggatcatcaccaccatctgctctgtcgctgcctcgccctgtccgacactcacctggcgtgcggcttcgtcgacggctccgtgcgtctcttcgacctcgaaacccgagcccacgtcaccaccttcttgtctctacacggccacctctttgggcccttctcgcgctccgtctcgggcatcgttataatcaactccagcatcaccttcgccaggctggatggggatatttacgtgacgtggtcaacaacggggtgttggttgggttcgcgggaacggggcggtggtgggttggcctctacgcgggaatagcgggccgggcttttcagatatgggacgcgcgcagtgaagagcgcgtgttcgttggtgggtctttgacggatccagaaacggttatggggtggcacatgctgacggagctagttgaagccgtgggtcgcgtgcgcgtgacggagcgtgagtatgtggtggcgtgcacggcttcgaggatggtttgtttcagttttcggaacccggaggtgttgttgcgggacgtggggtccacgatggggttcgtggtgagttcgctggacgcgagtcaggaggcctatgtagtgttggagaggaacggcgtgggaacggttcggcgagcgagcacgtatgagcggttgagccggtttcggttaaaccggttatgggttcgggggttgtgggcctgcatgaaccttggctacgtcttaacctattcgcctgcgccttctccttcgccttccttgagggtttgggacattgagcaagccataggacgcttgtgtgtcactcttggggtcagagctggatacgttaatagcttggtggcaaatgacagacacgtctctatctcttccaatgacaataacattaacttattggattttggtgtacaggatccttag

SEQ ID NO: 33015 - DNA, 1005 bp, Glycine max
  Peptide Sequence Number=SeqID_149793
atgggttttagaattagcggttcctcctcttcatcatgcttttgtttgcaacgtacgcttcttcctccgttaacagcaatagccacttccactcgtggcttcaagaggaggagtaattgcataccgagttgttcagtatcttatcgcaagtttgttgagtttgctttggatgaaaccacactccacactcacttgatcccttcgcctttacaggaaaagtacaatttcatgaattccaaggatggtaaaggaactcttagtatgctatcatttgaaggtgccaaaattaggcttctacgaagtttgatcattgagacagaaacaatgcaggttttggattttactgtctttccaaaagcagaatatgacatacccatattttgtgctaactttttcacctctgctaaaacaaacattgttgtgttggaccttaaccccttgcatgatatcatcaatcagcatgagtacaaggagaagtactttaaaagcttaattcctctcggccttaaatatgctgagctttttccatggggagggaagctcacaagtgagtccataaattttttttcaccaattgtcatctggacaaagtttacctcaaacccagaaaaatatgatattctgtattccgcatttagggaatattacaaggtatggttgaaattgatatgcaaagcagataaagagacagatgaatctcagattttccacaacctcgaagcacaacatagatatctaacatggagagttgaaaaggatccaggacaaggtgttttgaagaagctgattggtgacacacttgccaaggatatgctgagaagctttctctttaatggagttgatgaactaggaagcaaaacattcaatgattattttccacgctactgctgtcaagagggaactctaaataaaaaaggcaatgttattgggaagtcctttgaaaatcgcccatggaatgctagaggagaatttattggtaacagattttcaaattggcctgtctaa

SEQ ID NO: 33016 - DNA, 276 bp, Glycine max
  Peptide Sequence Number=SeqID_149794
atgtcttctacttcttcttcgtcgtcgtcatcatcatcatctacttcttcttcaactccatatgacgctgttgcccctgatatccctggccctagtacgaggagaaccggtggtagtggtcaatttgaagcttcttcctcctctcaacgtcaacgtgctatgaacgaggtcttgcctgaacctttacttgaagctttggccacccaacttgcccttgatgctgccaactacaatggtcgtctttctgctgcttctgcccttgccattttatttcag

SEQ ID NO: 33017 - DNA, 1371 bp, Glycine max
  Peptide Sequence Number=SeqID_149795
atgaccagaaaggtttcgaatttctccgatctgatccaaagggtcaccacctcctgcttcctccactcattcgccgacgatagggaggaggaataccacagcgactcatttggaaacaaaccccaagacgaacaaggttattacggtgaagaaaagatggtgatgggtttgaaggtaatttcaagagaggaaaagaaattgaagcagatgagggcgttaatggaggaggtgttcgaagcggtatcggcaatgaagagtgcgtacgtgagcttgcaggaagcacactgcacgtgggacccacagagcttgagggaggctgacgtggcagtggtggcgcagctgaagaagcttgctctgttgagggacgggttccatgggagtgtgagtactgttgaagaagatgagggtagaagaaggagaggagggaatgcgccctacgagacagtgatgaagaaggaagtgaaggccaaggacttgcacaaagtgaagcttgggtgtgttgctaccctcacaagtcatgaaaacaaagctcggaggcctcacccttacacaaagagaaagcttggttgcaatagtcaaatgcaagaggcagggtttgtagcagcaccatccccagaagtcttggaagcaacaatggctcaagtaaaggaagcatcaaagtccttcacatctctactcttgtcgctcatgcaggatgcaaaatgggacatggctgccgcagttcgttccatcgaagcagcttctgacaaatactataataatcctgccacctccaccactacggtctcaactcttcacgccaagtacgcccttgaatcctacatcttccgcaaaatgttccaaggattcgaccacgagagtttctacatggacaataacaccctctcctccctcctcaaccctgctcagtttcgccgcgattgcttcagccaataccacgacatgaagtccacggacccttctgagctcctcggagttttaccaacgtgccattttggcaaattctgctccaacaagtacctttcggttgtgcaccccaaaatggaggagtcactgtttggtgatttggtgcagcacagtctagtctctgaggggaaccatccaaggactcggttttacaaagagtttttgggggtggcaaagggagtgtggttgcttcatttgctagcgttctcgtttgatcctctgccaagtaagtttgaggcaagtagtggagctgagtttcaccctcgttacatggagactgtggtcaaatttgctggcgggagggtgccacctggaacggttgttggtttctcagttagtcccgggtttaagtttcgaaatggctctgttgtaaaggctagagtttatttgatggccagaaactga

SEQ ID NO: 33018 - DNA, 795 bp, Glycine max
  Peptide Sequence Number=SeqID_149796
atggtgatggaagttgttctgggagaagcgtcagaggtgaagaatgtggtagaggccatagagttggtggagacgggcgttgccaaattcgttttctcaagcagagggttgtcattgaaagccatggacagcagagagtgtgcaatgatggagatcctcatcccctccgatgctttcgctcactatcgctgcgacaacgtcttctccgtaggcctcagtctcgaccaaatgctccagctcctccaccgagcccacgattctgacatcgtctccctcacagccctagaaggccaagaccacgtcaccttcacattccaatgccctagcaacctgagtttttctgatcatcggatgaatctgatgatggatatcgacaatgggcccctgctcgatattcacgaggatgccgagtaccatgccattgttgagttgccttcacctgtctttacaacaatctgctgtcacatcgattctctttccaacattcctataatttccattattgtcacaagggatactcctatcttgttggtcgccgctggagattttggtctctgcatgcacttgcctcgtggaggcactgtgatagagatgactcaatgtgtgagcctggcatttgaaataaggtatctgaacctggtcatggcggcaatgtcgttgtctgatacactcaccatccgcttgtcaatggagctgccggaggctgtgtttgagtacaaaattgctgctgagaagggttatgttcgctttcacttgccgattgcttttaacgcatcttatctgttagatgattag

SEQ ID NO: 33019 - DNA, 399 bp, Glycine max
  Peptide Sequence Number=SeqID_149797
atgcgaaaagcagtgcaatcggtgataacaaaaatcaaggcgaggcagatcctagatagcagaggaattccaaccgtcgaagtcgacttgcacactaacaaaggcgtgttccgcgcttccgttcccagcggcaactccaccagcatgtatgaagctgttgagttacgcgacggtgacaaaggagtgtatctcggaaatggcgtggccaaagctgttaaaaatatcaatgacaagatatctgaggcgttgattggtatggatcctacgcttcagtcgcagattgatcaggccatgattgacctcgacaaaactgagaagaagcttttcttagttacgttgatggatacaattgggatagtgcttgctaggttgctactcggaaacaactctaggtggtga

SEQ ID NO: 33020 - DNA, 216 bp, Glycine max
  Peptide Sequence Number=SeqID_149798
atgagaagcggagaaaagccaattgagagaaagagagaagaggaagtgtccaatggagccaaaggaaatgaaataaggctgcttggtagagtgaaggaactgccacgtcaagccacgggggaaatcaccttggacgtgaaactttcacaaccacccagttctgacgtgccggtgatcctttctccgacctctaactcatatccctacaaagagtga

SEQ ID NO: 33021 - DNA, 1077 bp, Glycine max
  Peptide Sequence Number=SeqID_149799
atggtgtgtaggcatttcaatgcagtcagtggggttgtggatgccgctgcacgctctttacgaatgatttatcaatcaaatctagctccaaagtatgacttttttaaagaacaagacatgcaatttcttctttcactattaaaaagtgggaatgaaaatcttactggactaggtgcaagcattgttattcattcttgtgagaaaagagatgaacaaaatatgttatgctgtgctggtgctttagaaacacttattagccttcttgatggttctctaagccaacgagattctagtttagagtctcttgctgcaattcttaaaaacaatccagaagttgtctataaatttgtggaccttcaaaatggaagagttttgagttcgaattcatcttcttgctatctgcaagacataggaatcaaagccaaattgatacatattttacttgagctccttgatgaatctggtcaagttggagacagtgcttcctttgccttttcaagtttagttgcagaaaaagaagatttgcagaagttagcatttgaggcaaatgctattgataagttcaacagtcacttgcaaaattgtgctttacatcccaaacgtcttgaagggatatttctagccttagctgatctttgctcaaaattggagtgctgcaggtctaagtttctttcattgcaggttgctgcccttggtgctattagcaacatagtgatcgactttacaccacagaagtcaacattcatggaatgtggaggtgttaaggagcttatccaattgacaaagtctatggattcatctttacggttaaatgctgtattggccttgaggaacatggtatttcttgcggacaaaatgtgtaaggaaggaatttttaaggagttgacagtgtcttctgtagctagccttatctgcgatcccgagccttctgttcaagaacaagctctggcccttgtgtgcaattttgttgatggatgtatagattgtgttgaatatgcttttgctgaagatggtatcatactggatgctgttgcaaggcaattgaaaaaatcttcaaaaattgaaattgggatacag

SEQ ID NO: 33022 - DNA, 378 bp, Glycine max
  misc_feature (284)..(284): n is a, c, g, or t
  Peptide Sequence Number=SeqID_149800
atgaagctagattctaatggtggtgttgagtcaataaggagatccattattgctctgaaaacagatcccctcaagctcgtttggagcagattcgcaagcaagctgatgatcatggctctttggctcgtgtatgcttcctatgcacgcaagctcaagctggagagctcaaagcttgcctcttttcagcaatcagtgcttcgccaggtggtcggggacgcaaaggagtcctttgataaccagctcaagactcagaagttgaaagatacaatttttgcagtgaatgnacagttaaccaaggcaaagaagcagggagctaattccaaagagcttgcattgtctctccatgaggttgatggaagagaggattgcccatcctga

SEQ ID NO: 33023 - DNA, 573 bp, Glycine max
  Peptide Sequence Number=SeqID_149801
atggtggtggcatggtaccagagcccctatgtccttgtcatatttctaacaattaccactgtaaatcagttgcataaaatgtttatggtgggcaacagccaacaggagatccactttcatcattttttcttacttgtatggttcaatgaagtcatttttgagattaatatctatacttttagattacttcattttgagagcatggttatctcaaagggaaatgggatgtacttactcagcaatattgcgagtggaaatgagtctcatagagaagctatcatgcagctactcttttcaaaagcagaaaatgtgtctcactctttcttctaccagtttctgcagagcaatgacagttgtttacgcacatctgctgtttgggtcatagtaaatctaacttttcctgcaagtcctggggtatttggtagggttgtaaaactgcgtaatgtaggcattgtttctcaaatcaagaagatggtcaacgatccttgcatggatgttaagcttcgtgcaagacaagcacttgggcagattattacttttggtgataggctcaactgcgaagtagtcttttag

SEQ ID NO: 33024 - DNA, 138 bp, Glycine max
  Peptide Sequence Number=SeqID_149802
atggacacgtgcctcacattgctgtcaattctaggacgctgtggtccccaccctgaggccacgcgttcaccggattctgctagtcaactatggttgcatgttggaatatcacctggtgctgtttggttgtgtgactaa

SEQ ID NO: 33025 - DNA, 903 bp, Glycine max
  Peptide Sequence Number=SeqID_149803
atgcaatctaaatctgaaactgcaaatcaactgaggtctgatccacattcctttacacctaacaatgcttattctgaaccctggtggcgaggtattcagtacaatcctgtcccccaagcaatgttaggagtgaatgcatctaattcatcttcacttgaacgccctaatggtgattcggaatccagtgaagaggatgatgatgccactaaagaatcacaacccactgctcctaatcaatcaggaaattatggacaggaccaccaagcgatgcaacattcttcatcatctgcacctttggcaggtgcttcaaatctttattataggggcatgttgggatacactccttttataggaatgccccatgccagaatggctttgccccttgagatggctcaagagcctgtttatgtgaatgccaaacaataccaaggaattctgagacgaagacaggctcgtgctaaagcagagcttgaaaagaaattaataaaagtcagaaagccatatcttcatgaatcccggcatcagcatgctataagaagagcacgaggtaatggagggcgttttgcaaagaaaactgaagttgaggcttcaaaccacatgaacaaggaaaaggatatgggtactggccaggtcccattgtcacggtcaattagttcatctggttttggatcactaccctctgactctgctgagacctggaattctcctagtgtgcaacaagatgcaagaggatctcaagtgcatgagagatttgaagaacgcaactatgcaaatgttttgcagtcatcatctactttttgtttgcactcgggtgaaagagtggaggaaggggactgttcaggtcaacaacggggaagcatcttgtcagagcacacctcacagaggcgtcttgctattcagtaa

SEQ ID NO: 33026 - DNA, 2271 bp, Glycine max
  Peptide Sequence Number=SeqID_149804
atgactgtagggtcaggaatatctgttgcagatgggaacttgatggtgttggggtacaaagtgctgagccatgtccatgacaaggttcttcttacccctgcacgtggtggtgctttgctcaatggggcattcatcggggttcaatcccatcacaagggtagccgcacagtcttcccaattggcaagcttcaggggctgagatttatgtgtgtcttccggttcaagatgtggtggatgacgcagagaatgggcacttgcggacaagaaatccccattgagacgcagttcttgcttgttgaagcacacagtggctctgatactgaaggaggagaagaccaaggtgctgctacctatgcagttttcttaccccttctcgaaggagatttcagagcagttcttcaggggaatgatcaaaacgagattgaaatctgtgtggaaagtggttgtcctgctgtggaggaatttgatgggactcatttggtttatattggggctgggtccgacccttttgaagtcataacaaattctgtcaagactgttgagaaacacttacagacctttgcacatcgcgagcgaaagaagatgccagatatgttgaactggtttggatggtgtacatgggatgctttctacactaatgtcacttcagagaatgtgaagcaaggattacagaggtgcttcgagaaaggtggaattcctgctaagtttgttataattgatgatggatggcaatctgttggcatggaccccaatggtgttgagtggaaatctgatagttcagccaactttgcaaatcgcttaactaacatcaaagagaatcacaaattccagaaagatggcaaagaaggtcaacgggtagaggacccagctttgggacttggtcatattaccaatcaaatcaaactagagcataatataaagcatgtatatgtgtggcatgcaataacaggatattggggtggtgttagacccggggttccgggcatggagcactacgagtcaaagatggtcttccctgtctcatctcctggagttgagtctaatcaaccagatgaagctttgacaacaattgccatcaatgggcttggccttgtgaatcctgagaaagtttttcacttttatgatgaactccactcatatttggcatcttctggtattgatggtgtcaaagttgatgttcagaatatccttgaaactcttggagcaggacatggtgggagggtgaaacttgcaaggaaataccaccaggcattggaggcatcaattgctaggaacttccctgacaacggaatcatttgttgcatgagtcacaacactgatggattatacagcgccaagcgttcagctgttattagggcatcagatgacttctggccaagagaccctgcatcccacacgattcacattgcatcagtggcttacaatactattttcctgggtgaatttatgcagccagactgggatatgtttcatagcttacatccaatggctgaatatcatggtgcggcacgagctgtaggaggatgtccaatttatgtcagtgacaagcccggacaccatgactttgatcttttgaagaagcttgcactacctgatggttctatattaagggctaaacttccaggaagaccaacaaaggattgcttatttaccgatcctgccagagatggaaagagtcttctgaagatttggaacatgaatgatttttctggagttattgcggtattcaattgccaaggagctgggtggtgcaaagttgacaagaagaaccttatccacgatgagaatccgggcactgtcacaggtttcgttagagctaaagatgttgactatttatccaggatagtagatgataaatggacaggagatgccattatttattcccaccttggtggagaagtggtttaccttccaaaggatgcatccatcccagttaccttgaaaaccagagaatatgaagttttcacaatagttcctgtgaaggaattgagcaatggtgtcaaattttctcctattggtttaataaagatgttcaattcaggaggggctgtcaaagagtttagttggggatctaatgaaagtacaaatgtagccgtaaaagttcccggttgtggccaatttggtgcttattcatcagctcggcctaagttgataacagttgatttagaagaggtagaattcaagtatgaggaagaatctggattggtgactattgatttgagagtacccgagaaagagttataccaatggagcatttctattgatttttga

SEQ ID NO: 33027 - DNA, 525 bp, Glycine max
  Peptide Sequence Number=SeqID_149805
atgggtgaggaggaaatagatgattctcccttgattcaaggttttccttccggcgacgtgccatttaggagaactggtaatgtagagagggcagtagcacatataataactggtgtgataggggcaggggtgctgtctctagcatggtctgtggcacagttagggtggattgctggtccttttatcatcatagtctttgcaggaacaacctttctttcagcaaaccttctttctgactgctacagattccctcatcctctctatggcaacattaggtgcccctcctacattgatgctgtcaaggagactcaaggcaaaaggtgtgtggagtgctggtgcatgcgagcttatatggtgccaccacggcctatgtcattacatctgccaccagcatcagacgttattcctattgagctaaaagacacagatccaacctgctacataggccagagtttaagagaaattctggttcaacgaggtggtccatctgagtctgagaggcaaccgcagaatatctttacctag

SEQ ID NO: 33028 - DNA, 502 bp, Glycine max
  Peptide Sequence Number=SeqID_149806
tatttctccttcttctttctttcgctccgttcctcattcttacaattctgagttcatcaggtacgttttgccatcgttcagcattgggttatttgatcttctcgtctcgtctcgtctcgtcatttatctggatctggatttcttaacttcaaactgcattcaacactctgtctttactacaatggctgcgctttcgctcacgtctttgcctatgggtactaaatcggctgttgacttaatggagtctttatctgaggttcatttttctggatttcacattgatggcttagagcaaagaaaggctggcacagagcaaccaaccacttcaacaactgacatgtataaacaaccttttgtgataggtgttgctggtggagcagcatccggtaagacatcagtttgtgatatgattgttcagcagcttcatgatcaacgagtcgtacttgttaatcaggtattcaattcttgcaaagtaccaatcatctatctcattttggtgtag

SEQ ID NO: 33029 - DNA, 1074 bp, Glycine max
  Peptide Sequence Number=SeqID_149807
atgagtatggttggtgaaaccactgcaaattttacatgtcagagtgttactcaaattgtgttatatgcatatgagcattccaaagaagcttttgatactgagcaattgctacgtgtcatggacaagttgaagcgtggccaagcagtagatattccaaactatgactttaagggttacaagaatgatgtttttccagcaagacgggtaaacccagcggatgttattattttggaaggtatccttgtttttcatgatccacgagtgcgagcattgatgaatatgaagatatttgttgacacagatgctgatgttcgtctggctagaagaattaagcgtgatactgctgacaatgctcgtgatattggagctgtgcttgatcagtattctaaatttgtgaagccggcttttgatgactttattcttcccaccaagaagtatgctgatatcattataccccgtggaagagataatcatgtggctattgatttgattgtacaacatattcgcacgaagcttggtcagcatgacatgtgtaaaatatatcgtaacttatatgtcattcagtctacttttcaggttgtagaacatggcctagggcatcttccatttacagaaaagcaagtaaccactccaactgcatcggtatacagtggtgtggatttctgcaagaggttgtgtggtgtctctatcatccggagtggggagagtatggaaaatgctctacgagcatgctgcaaaggtatcaagattgggaaaattcttattcatagagaaggtgacaatggtcaacagctaatatatgagaagttgcctaatgacatctcagataggcatgtattactgttggatcccatcttaggcacagtacctaatgttttgcatatatgcatgctctcatattgccaggcacctcaaggtgttcatgtggtctgtaaaagatttccgagaataaaaatcgtgacatctgagattgagattggtttgaatgaagcattccgtgtcatacctggcatgggtgagtttggggaccggtactttggaacagacgatgatgaccagcaagcttcacagtag

SEQ ID NO: 33030 - DNA, 936 bp, Glycine max
  Peptide Sequence Number=SeqID_149808
atggctaattttcttgtagaatctatgatgttagccattccaaaatcacatttcaggaagaaaacaacatgccaggataatgaaggcacaaaaatagatgcccctcaaagttctgtcacctttgtttatcaaaccaaagtagcagaattattacgaagtataacaatttcatggtgcaaggatcctacagatcatttcctttccatgagcgtcgacaacactttggaagagaacaagtacacctgcaagattgatttggaatctggacagtcttggggtaaaaagggtctcaaatcatttgaaataacgggtgcaagagtagacattttttgggattttcgacgtgcaaaattctctgccacgggtccacagccttactcaggctattatgttgccttggtttacaagaaagaggttcttttgttgttgggagatttggagaaggatgcttatgaaagaaccaaatcaaaaccatccctagatgaggctgccttgttgtgcaagagagacaatgtgtatgggaagaaaatgttttgtaccagagccatattggaggatggtaagacagaacatgatgttgtgattgaggcttccctttgtgggcctggtgatccagaaatgtggattagcatagatgggatgttggcaagtagaataatgaacttgcattggagatttagagggaatgaaatattgatggtgaataatttgcctgtgcaaatcttttgggatgtgcatgattggcttttcaccaatgaccttggtttaggccctgctttctttgttttcaagccagtctttttggaaactactagtgattctaatagcatagaatgcctagaaagaagtgggggtagcaacaaacgtgaattactagaggagaattcatccacccaaggtttttgtcattatctgtatgcttggagaacaatttga

SEQ ID NO: 33031 - DNA, 1113 bp, Glycine max
  Peptide Sequence Number=SeqID_149809
atgtcaggaccccatatcggaaaacaaaagttggacaaaaacaaaaacagggagaggagaaacgaacgaaaaatgggtaacccttgctttggtttcgcggcaaacatcgtcttcaaaatctcttcccacctcccctctcgcgttttttcaattccccagaccatttggaagtctcagattgtgtgcttgaagagcagagactttagttcttctgttcctgttagatacatttccagcacatcctgcatggtcaaaatacttgaaactgcactgccagtgaaaagcctgggatattgcagctgtcctgatgttaatgtgctcaagataaatggtggaaaagacgtgcatgcaacaattgcacattgtgaaatttctcaagaaccgaaagaaatttgccctgacttattatttgatgacatcgaacaaggatgcaggggaactacgtcactactacctataggttcttttgatcaaatggaagaggttggagagttgacaatccatgagggaggagattcctgtgacgaggaattgatacaaattaataaatttacaagtgatgtcgaggaagctgctattaaattacttgcatctagggcactcacagcacttgagttgagaaagaaattgcttggaaagagattctctcctgatgaagtggaggcagtgataaacaagttccagaaaagagggttcatcaatgacaggttgtatgctgaaacattttctcagtctagatggacttcatcaagttgggggccaaggcggatcaaacaaatgcccccaaagacactagggatgcacaaaagcagtgcttgcttaaaggcactgttcaagaaaggagttagtcaagctgatgccgagaaggcagttgaagtggtctttaaggacaatgattgtgccgaagatctcaaatcagttattgggttgtcaaaacattccatggatcatctttatactcaggcctcaaagcaatggttcagaggtcagaatgtacccaaggagacaaggaaatcaagaattgttcgctggcttcagtaccgtggctttgactggaatgtcattaactttatactaaagaaattagacaggcaggaccagaattctccatag

SEQ ID NO: 33032 - DNA, 270 bp, Glycine max
  Peptide Sequence Number=SeqID_149810
atggacgctggaattttgcccctgagggcgttgtcggcgaggttcaggactgtcagacgtgagagtttgctgacatcggcagggatctcgccggagagcttgttgccaatgaggtccaagatgcggagggagggaagcgcattgactcaggtggagatctccccggcaatgtctttccaatcaacgacgacgagggtggtgacggtgtcgatgccgcagattgccgctgatgccgtaccagttgaggcagtagttggagcccgtccataa

SEQ ID NO: 33033 - DNA, 3135 bp, Glycine max
  Peptide Sequence Number=SeqID_149811
caaggccaggctctattagcatggaagaacagtttaaacagtactttagatgcactagcatcttggaatccttccaagccaagcccatgcaattggtttggggtgcactgcaacttacaaggagaggtggttgagataaacctcaagtcagtgaacttgcaaggttcactaccttcaaattttcaacctctcaggtccttgaagactcttgtcctctcaacagccaacatcacaggcaggattccaaaggaaattggagactataaggagctcattgttattgatctcagtggcaattctctcttgggtgaaatcccacaggaaatttgcaggctgagcaaactgcagactttagctctgcatgccaactttcttgaaggaaacattccatccaacataggaagtttatcaagtcttgtgaacttgacactctatgacaacaaactgagtggtgaaattccaaagagtattggctcattaactgcgctccaagtgttgagagcaggagggaacacaaaccttaagggtgaggtgccatgggacattggaaactgcaccaacttggtggtgttaggccttgcagaaaccagcatttctgggagtcttccttcttcaatagggaagctgaaaagaattcaaaccatagccatttacacaactcttctttcaggccctatcccagaagagatagggaagtgcagtgagttgcagaacctgtacttgtatcagaactcaatctctggttcaatcccaagtcaaattggagagctcagcaagcttcagaatcttctactgtggcaaaacaatatagtaggtacaatcccagaagagcttggaagctgcacacagattgaagtcatagatttgtccgaaaatcttctcacaggtagcataccaaccagttttggtaagctatcaaatctgcaagggcttcaactgagtgtcaataagctttcaggcattatacctcctgaaatcacaaattgcacttccctgactcaactggaagttgacaacaatgacatatctggggagattcctcctcttattggcaacttgagaagcttgactctcttctttgcatggcagaacaagctcacaggaaaaatcccagacagtctttcacggtgccaagaccttcaggaatttgatctctcttacaacaatttaactggtttaatacccaaacaactttttgggctgaggaacctcactaaactgctgcttctttccaatgatttgtcaggctttataccacctgagataggtaactgcacaagcctctataggttgaggctaaatcacaatagacttgcaggtaccattccaactgagatcaccaacttgaagaatttgaactttctggatgtgagcagcaatcatcttgtaggggagattcctccaacactatccagatgccaaaatcttgagtttcttgacctccactcaaatagtctcattggctcaattccagacaatctgcccaaaaacctgcagttaattgacctcacagacaacaggctaacaggtgaactaagtcattccattggttcattaactgaattaaccaaactcagcttgggaaagaatcaactcagtggaagcatcccggcagagatcctatcttgctccaagttacaacttctggacttgggaagcaatagtttctctggacaaattcccgaggaagttgctcaaattccttcactagaaatctttctcaaccttagttgtaaccagttttccggtgaaatcccatctcagttctccagtcttaaaaaacttggagtgcttgacctctcccacaacaagctctcagggaacttagatgctctctctgaccttcagaaccttgtttcactgaatgtttccttcaataacttctctggagaattgcctaacacaccattcttccggagactccctctcaacgatctcacaggaaatgatggtgtctacattgttggtggtgttgcaactccagctgacagaaaggaagccaagggtcatgccagattggctatgaagattataatgtccattctcttatgcaccactgcagtactagtacttctcacaatccatgtcttgatccgtgctcatgttgctagcaaaatactcaatggaaacaacaattgggtgataactttgtatcagaagtttgagttctctattgatgacattgtccggaacttgacatcatccaatgtgattggcaccggaagctctggagttgtgtacaaggtcacagttccaaatggacaaacactggcagttaaaaagatgtggtcaacagcagagtcaggagcatttacttctgaaattcaagcactgggttcaattaggcacaagaacatcatcaagcttctgggttggggatccagcaagaacatgaaactgctgttttatgagtacctccctaatggaagcctgagctcattaatccatggttcaggaaagggaaaatcagaatgggagaccagatatgatgttatgttaggagtggctcatgcacttgcatatttgcacaatgattgtgtgccttccatattgcatggagatgtcaaagccatgaatgttttgttaggtcctggctatcagccttaccttgctgattttggcctagcaacaattgcaagtgaaaatggtgattatactaattccaagtcagttcaaagaacctaccttgctggatcctatggatacatggctccagaacatgcatctatgcaacggatcactgagaagagtgatgtgtacagttttggtgtggtcctacttgaggtcctgacaggaaggcaccccctagacccaacacttccagggggtgcacacttggttcagtgggttaggaaccacttagctagcaaaggagacccttatgacattcttgacccaaagctgagagggagaactgattctactgtgcatgaaatgctacaaactctagccgtgtcatttctatgtgtcagcaaccgagctgaggaccgtccaacaatgaaggacattgttggaatgctcaaggaaattcgacctgttgagtccgcaaccacaaatccagatgtgtcaaaggaagttttaacagtgcatacttctccagcacctcctatgaatggtgtttcacatggaacttaa

SEQ ID NO: 33034 - DNA, 324 bp, Glycine max
  Peptide Sequence Number=SeqID_149812
atgcgcgggattctcgctggaaaagccctcgcctacctggaaggcatgctgaagaagaaatctggcaaccagaacgccaccattgcaaactacttcgacatggccatcgatgtaggagtcggtggcatcttcacggcgatgctcttctccaccaaagaccactgctgcccgattttctccgccgatgacactggatgttccggctcggtgtcgtcgacgacgacgggttttgagaaagcgatgaagaaagtgttcacgacggagaatggtggtgggagtttgactcaaggacactctaaaattgattctgatttcgtgctatga

SEQ ID NO: 33035 - DNA, 2061 bp, Glycine max
  Peptide Sequence Number=SeqID_149813
atggagaaggaaagagaagatgagattgaggacatgtcaatgtcacctccatctattggctccatgcagattgcagggagcaatggctttggtcacagcatggagttcatgtctcaggcataccttccaaatatgtacacagagattgacataaaagttcaggattcaagtttcaaccaagatccccccctccccatttatctcaagtttgaagatgtagagttcagggtaatagatagccaatcggcttccaataaccctgtgaagacaatgatgtcaaaagtaggcacccaacaccacgtggaggaagatagatacaagaaaattttgaagagtatcacaggaagcattggccctggtgaaattcttgctttgatgggtccttctggtagtgggaaaacaaccttgttgagagttgtagggggaagattaattgacaatgtgaaggggaagataacttataatgatattcgatttaatccagctgtcaagaggaggattggatttgtgacacaagaggatgtacttttcccacaacttacagtagaggaaacattaatcttctctgcattcttaaggttgccaagcaatatgagcaagcaacaaaaatattctagagtggagaacactgtcaaggatctaagccttgaaagatgccgccacacaaaaataggtggaggatatctcaaaggtatatctggaggagaaaggaagcgaaccagcataggctatgaaatccttgttgatccttcactgctgctacttgatgaaccaacttcaggccttgattccacttcagcaaacagactccttctaactcttcaggggcttgccaagggtggaaggaccataatcacgacaattcaccagccatccagcagaatctttcacatgtttgacaaacttcttctgatatcagaaggctatcccatttactatgggaaggctaaggactcaatgcagtacttttcatccttgaggttcatccccgaaataccaatgaatcctgcagagttcttgcttgacttggcaactggacaagtgaataacataagcgttccactagatattttgaaagatcaagaatctgctgactcttcaaaagctgttatcaactatctacaagtcaagtacaaagacacactggagccaaaagaaaaaggcgagaatcatggagcagcaaacacaccagaacatcttcagctagcaattcaggttaaaaaggactggacagtgagttggtgcgaccaattcgttattctttataagagaacattcagagcaagaagcaaggactattttgataaattaagactagttcaagcccttggcattgcacttttgttgggtttactttggtggaaatcttctatcaatacagaggctcaagttagagatcaggttggtttaatgttctatatctgtatattctggacatcttcatgtatttttggagcagtctatgtctttccatttgaaaaggtatacttggtgaaagaaaggaaagcagacatgtatagactgagtgtgtactatgctagcagcactctgtgtgacatggtggcgcatgttttctaccctacttttttcatggtaatcttgtacttcatggccggatttaagaggactgttgcttgcttcttcctgactttgttcgcggtgtggttaatagctataacaagtcaaggggcaggagaactatttggagctgcagttatgagcattcaaagagcagggatggttgcttctttgattctaatgttattccttctcacaggtggctactatgtccagcacgtaccgaagatgatgcagtggttgaagtatttgtcattcgtgtactatggattcagacttcttctaaaagtgcagtattcaggagagcaaccatatgagtgtgaaagcgaaggagggtgcaggacactacagagttcaccatcatttgacactgtaaacttggaaggaggcttaactgaagcatgggttctggtagtcatggctctatgcttccgcgtcttagcttacttctgtctccgcagacgaattgacatttgcaattag

SEQ ID NO: 33036 - DNA, 849 bp, Glycine max
  Peptide Sequence Number=SeqID_149814
atgaattctaggtgcttccttgttcatccacaacaagagtatagcatggttccattttcttcaaattctgccacagaagatagagtggctagtgctcgaaacaggcctccgcgtgtcacccctccttcctttttggttaggatagccatgagaatatctagagcaagatggtttacctttttaagaagagtttttcattaccaaaatggatcaaggtccaaccttggctccaaccctttcaattctagcacttggatgatgttggagtttattgccttgattctccaaataaccattacaacattcactttggccatttccaagagggagagacctatttggcctatgaggatttgggtttctggttatgatattggctgtgttcttaatctgcttctactttatggacgctaccgtcaaatttatctaactcaaggagattctctcagcctttccgatatagagcagcagagaaacaatgaagaaaccaggatgtcacacttgatgaataaatgccggacttcgcttgagcttttcttcgccatatgcaccctcctcggctacaacatgaacatggcctcttccaataaaggagcttctaatgatcaaatttcacaacttccaagttggagacataaagaagctggagccaagttagagcttggcaatgcctctgaaggcagtgaaaaattgatcaatgaagacccagaatgttgtatctgcttggccaagtacaaagacgaagaggaagttagacaattgccatgttcccatatgttccacctaaaatgtgtggatcaatggctaaaaattatatcatgttgccctatttgcaaacaaggattatag

SEQ ID NO: 33037 - DNA, 1905 bp, Glycine max
  Peptide Sequence Number=SeqID_149815
atgttccgatccgcatccctccgaaaacccacctccgatcctccgccgccgccgtcaaatgccgaccaaaaagtcaacccctccggcgactctcagtctcaggcgcaggcgcgcctcgccctctacatcgccatggcccacgccggcctcgccatggccattctcgtcctcttctctctctacaaactccttcagcagtacctcaaaccccttcaatgggccgttctctgttccatccctctcagactcattcaccaaaccaccgtttccttttggtctcaccctctcaaactaggcctccttcacaccctcctcgcacttcccctctcggtcttcacgctcttctttactacccttgttgagattcgtgaagcttctctcagaacccttctcaggaagccaaagccaaagcctgagaatgacaatgacaacacaacaaagaagcgtagcgggttttccaccgtgcttcgtttgctcttgtcctttggagtgtttgttgctgcttacgagaggcttggtgccgttgggtctttgtcacttctaggattagcctttgttttcagttccaagaatgtggatttcaatttctcacttttctgcccctctggtggtgcgtttttcactagagggatattgaagaggttgaaaacagttgtggctgtcgggctgattgttggcatgattgttgggttcttgagtggggttatattcttctcgtacaagattggcggtgaagggaaagaggcagtgatttcgctcaaggttcgagtggaagagaacaattacgctgacagaatcggtttgaagaagtggatggaggagaatgatgttgctgggatggtggttaagcacactagtcagttctatgagacggtttctgatcagattgatgggttggcaatgcagtacaatatgactgaatttgtgacggttatcaagcagtttgtgattactgctcctgctagtgctaactcttcttcaacagattcgttaatggtgccttcaccgtacacggaaaagctcttgagtttgaagggtaggcttaggaatagggagtggggggaaatttttgcagaacttgatacccttttccaagagtttataatcactagggaggatttggttgagagggcaaaagggtatgcggttaaagggatggatgttggtcaacgtgttttggctagtggtacaagtgtgcttgggagtggtgcaaagtttgtgatctccattttgaattccatagtctctggtgctgcggaggtattcaattttgtgtctcagacaatggtgtttttctgggttttgtattatcttatcacatcagagtcaggtggggtaacagaacaagggatgcacatggttccattgtccgactcggctagggtcaggtgtgttgaggtgttggataaggcaatttcaggagttcttttggccactgctgagattgcattcttccaagggtgcctgacttggcttttgtttaggctgtacagaatacatttcttgtatgtgtcaactgtcattgccttccttagccctttgctaccaatatttccatcttggcttgcaacaattccagcagcaatacagctagtgctagaaggcagatacgtagtggccattttcttgtctgttgctcacctctccctcatggattatggtgcaactgaaattcttcaagatgtgcctggacacagtgcatatcttgctggactgagcatcattgggggaatggctttgtttccatcagctctagagggagctattttggggccattgataactacagtcatgattgctctgaaggatttatatgctgaatttgttttggacgaacctgatgacaagttgaagatgtctgccactacattgttctttgtcattctatcagtggagcttgtctag

SEQ ID NO: 33038 - DNA, 1677 bp, Glycine max
  Peptide Sequence Number=SeqID_149816
atgaagagaaagaagcatcacactgagaaatccagaataataggactccttgttgcgagtttccttcgaggtcggctcctccaccgcactctcatcatcgccatctccgcttgccttcttctgctcttcgccctattctctctgttcgctccgtccacgctaaataaaatcaatcttcagactactcagaacaatgaccaagtcagatcacgattccatgattcggtgtttcaggttccggcgggtggaggtagtttcaggcgtgatttatggagttcaactcactcacgcctcttctatggctgcagtaatgccggtgtcaattttgcaaaggcaaatgccaaaacgaatccagatcgatacttgctaatttccaccagtggaggtttaaatcaacagagaacagggataattgatgctgtggtggctgcatatcttttgaatgctactcttgttgttccagagttggatcatacatctttctggaaggacacaagcaacttttctgaactatttgatacagagtggtttataacatttctccggaatgacgtgagaattgtaaaagagcttccggaaatgggagggaacttcgtggctccatatacggtgcgtgttccaagaaaatgcacccccaagtgctatgaggatcgtgttttacccgtgctggtcaggaagcgtgctgttcggttaactaagtttgactatagacttgctaatatgttggatgaagatcttcaaaggctgaggtgcagggttaattaccatgctctcaaatttacggattccattcaggggatgggtaaattgttggttgagcggatgaaaataaaaagcaaacatttcattgctctacatttgaggtttgaaccggatatgcttgcattctctggttgctattacggcggtggagaaaaagagaaaaaggaacttggcgaaattaggaaacggtggaaaaatttacatgcaagtaatcctgagaaagttcgaagacatggaagatgcccacttacaccagaggaagtgggtcttatgctaagagcactagattttggaagtgaagttctgttgtacgtggcatctggcgaaatatatggaggtgaggaaacgatagctcccctgaaggctcttttcccaaacttccattcaaaggagaccatagctaccaaggaggagttggcgccatttgtgtcattttcttctcgcatggctgcactagatttcatagtttgtgctgagagtgacgtatttgttacaaacaacaacgggaacatggcgaaaattttagctggaagaaggaggtacttgggtcataaagtcaccatccggccaaatgcaaagaagttgaacctgttattcatgaacagaaataataggacgtgggaggaatttgcctctcgagttagaactttccaggtagggtttatgggagaaccaaatgagttgaggcccggcagtggtgagtttactgagaacccatcagcttgcatatgtcaaaaaaactctgctgggggaatttcctaccccctaaatcatagcaatattaccgagtttcaagagcagcaggagtggtcgtctgaggtagataataatctcaatggaactaaaattgattcactccctcttataatgaccacggaccaattagctgaagtgcaagaattcttctccgattaa

SEQ ID NO: 33039 - DNA, 1650 bp, Glycine max
  Peptide Sequence Number=SeqID_149817
atggaggctacccatttcaccacctctcaatatcaatatcatattgatggaggcttcaccagaagacccttcatgcgcatgcgcaagcgtagccatatcagttacggttatggcccccacttcctgcgccgaagcctctacgtgccgttcatagcacttggtcccaaagccaaagccaaagccgaagccgaagccgaagccgaagcctcttccttctcttctgtggatgtgagacgagagcttatatcgctgactctgcctgcccttgccagtcaggcaattgaccccttagcacagttgatggaaaccgcctacattggtcgacttggcactgttgaattggcttctgccggcgtttccatatccatctttaacatcatttctaagctttttaatatcccccttctaagtgttgctacttcctttgttgccgaggacattgccaaggcttcctccactgcagatgccaaaacaaaacaacaactctcctctgtctccactgctttgctattggcactcgtccttggcttttttgaggctttagctttatatctgggatctggagcatttctacatttaattggtgtttctactcaaaatccaacatatgttcccgcacgacactttctctctttaagagctgttggcgctcctgctgttgtactttctttgtctcttcaaggcattttccgcggttttaaggatacaaaaactcctgttatatgtctaggcaattatgatctgtgggctgttacaggtggtttccttcttggaagaacactttctgttctttcaaccatgacattggggacatcaatggctgctcgacatggtccagtagctatggcggcacatcagatatgtatgcaagtgtggttggctgtttcccttcttacagatgcattggctgcatctggtcaggcccttattgcaagttctgtatccagacatgaatacaaagttgcgaaggaagttactagtttggtattaaggaacctgattgtgcctttccagattggactggtaatgggtatttgcttgactgcaattctgggtgcatcgtttggatctttagccaccatttttactcaggacactgaagtcttgcaggtgatcagaactctggcgttgtttgttagtgcttctcaaccatttaatgcactggcctatatttttgatggtctccattatggtgtttctgatttccgatatgctgctttctccatgatgtttgtgggagcagtctcctctgcattcttggtatttgcacctccactttttggccttcagggcgtatggctgggcttaggtctcttcatggctcttcgtgcggcagctggtgctgtcaggtgtaagcaagctagtagtgttttggacgtggaagttggggacttcataccagaagttgcatggttcaagattgttggatctatcttacaaagtgatgagaaatttattgcagagattgaaggggctctcgacgacgccaggaacgacctcggtgttctcgcgaagcgtagagatcgaggtccctcacacccccacccaccggagtcctcaaaccacccgaatccagcacctcctccggcacacgcctcatcgcctccatcacctgctccaccacctcatccccctggtcgaggcatgtag

SEQ ID NO: 33040 - DNA, 1425 bp, Glycine max
  Peptide Sequence Number=SeqID_149818
atgaaaagtaggcaggttgatggtaatacgactgtggatggcattgattatcacttaactgaaacttttggacaaggtctatatgaatcatgtaaggatgtaaagtttgggacaatgaatacaagggccatagattttgttggggctggagctagcaattttaaagagtgggctgaatttcttggtcagaaagttcctcctggttttcctggttctccgtattctatactttttaagacagccattcttgactcttctcctatgaaacttatgaatgcatctgtatattcatgtaatgacacttcgctgggctgctcttgtggtgattgtccttcatcacctgtttgctcgggttcagaaccttctccacccagaaaagatccctgctccattggaattggatctctaaaggtcagatgtgtagatttttcaatagctatcttgtacattgtattggtttttgtgttgtttgggtgggcattgctgcaaaggacaagaggaaggaggagacttggatccagtgcggaacccttattggatgatatggttggtgaagggagtagttttgctaacctcccaaaggatggaactcatcctgcagaggtgcaatggatagatcctcaagggcagaatgtggtgcaattttcttttgttcaaggatgcctgtccagcttttacaggacatatggaaggtgggccgctagaaaacccacaattgttctttgttcctcattggcaattgttgttttgctttgtttgggtctgcttcgttttgaggtggagacccggcctgagaagttatgggttggtcccgggagtaaggcagctgaagagaaagagttttttgatagccaccttgctccattctacagaatagaacaggtacaatatccagtagtggacctcctgtcagtcactgaccctgcatgcatggtaaacattagtgcaagcctcaagaacataataggagatagacctcggacatcactcataatagcgacaatccctgaatctaagcatggcaagccaccaagtatcataactgaagaaaatattgaattgcttttcgaaatacaggaaaaggttgatggaattcgtgcaaattattctggttttttagtatctctgagtgacatttgcttgaagcctttaggcgatgactgtgccactcaaagcattttgcagtattttcaaatggaccctgacaattatgacaactatggaggtgttgaacatgctgagtattgttttcagcattacacttccactgaaacatgctttagtgcatttaaggctccccttgaaccaactactgccttaggagggttttctggaaacaattattctgagcagtacaagaggtactgtacaaaatacacatcagcaccaagatatgcagaagtatggcaacctaatacaagttaa

SEQ ID NO: 33041 - DNA, 2373 bp, Glycine max
  Peptide Sequence Number=SeqID_149819
atgagcggcggtggtgggtcttcgagttgtgctagggttccgatcccaaacaatgtacgcaaaatcatccaggacatccgtgagatcaccggcaagcagcacaccgacgacgaaatctacgccatcctccgtgaatgctccatggatcccaatgagaccgctcagaagcttctctatttaggccaggttgcagttcacacttcacttcattttttcagtgcttgtagggttttgtttgtgggacgaggaattagctataatacttttcatgaggtgagaaggagacgtgaccgaaagaaggagggattgagcagcagggcttctgatgagcctaggttaaagcaaggtggacaagggagggggggaaggggtgcttctgggggatattcctctaactttcctgatggtggtggtgggaggaaccaagctaatcgaagggaaaatggagtcaatcacactgcagagagaagtcatgctttgtttactcagccagtttcacagaaaactaagactaatacaacatctcaagctacaagagtttcagctgttgcaccccatggtgctgcaaatcaatccaatgggaaatcaggtcatgattctgctggccaatctcccatagttagtgtacctaaaagtacttcagctgctaaggacactggccatcaagaaaatgtccaacctcaagcagctgttgttgcagcagcatcctcccctagtcaaacctctggctcagttactaccactgaccaaggaaagtctgtgtcaagttctgatcaacttcaaacttctgtatccaatgtccattcctctttggatcttgtagtagcatcatctgtctcccggaatcctggtgtgagtggtgcaattagtagggaagttgggagcaactggatatctgccggaccaaatcatgttaaaggaaataaagttggtcatgaagttaatgatttatcggcatccaagaatgaaaaatatgggtccatgaattcaacgagcaaaacaaatgccccacagaagtcaaataaagttgaaaataatcatttatctgaaccatcacaactttcatctccatccccaaatgattcattgaggccatcttgcagttctggtagccaaccatctctagctaatatcgcagaggtttcaacttcagaagtttgtgtgcaatcttcagcagagttgagacatgttactttcccaaaccatttccaagtacccaaggctttaaaaagtggtctgacatttggaagctttgatacttttggcccaagtgaaaaatccaacagtggagctggtggtgacaataacgcttctcctgcccttgaattgagtgacgaaactgcaacttcaagcaaccaaaatgcatcattgactgcacaaggagatcatcttgactatccacattcttcaccatattggattgaaaagacaccagctacaaaaggcaatcctataactggtactgacacaaaggttgatcagccaaagaaggaggttttgttggctcctgaaggtcaacaaattccaactgttcaaactgctcaaaactatggtttgaatttcatgtccaccatgttaggcactcagcaagttcaatttgagggaactgaacctcagtcacaagatgcatctcactttcctaactttgttaatgcaagttctcaggctgtgtcccctagcccaactccacccctgcagagttctatacctgtgactccacagtcggtttctattttcaggccaccataccctgctaatttcttcccatatggccactattaccctccaatttatgtgtctcctatacaccaatttttaaaccacaatggtttccctcaacaaccatcagctggcaacatgtatctaccagcagctgctgggatcaaattccctgtccctcaattcaaggctggagcaaacacaggaaacacagctcatattggaattccttctggatcatttatcactccacctgtaggatatgcgccaggtcaaacagttaataccggaagctccactggaaatcaagatcttgcagtgtctcagttaaaggaaagccagatctatacaacaggacagctgagtgaaggctctgctgtgtggatacctgctccaggccaagacatgtccagtttgcaagttaattctctgtataaccttacccctcagggacaacatctcacctttcccccaacacaggctgctcatggggcatttgctggtatctttcaagcagggcagacagtagcttcaccttccacccttttgcaacagtctcaggctgtggctgggcctgttgaaaatgtaggccccccttcaggatcttatcagccacctcagcctgcacagatcaattggaactctaatttttag

SEQ ID NO: 33042 - DNA, 231 bp, Glycine max
  Peptide Sequence Number=SeqID_149820
atggatctgagttttttttttatggttaaaggtagagagagtgaagttttagggtatgaattttttggtattatcaattgctcacccaattttgggttgggagttgcagttggctggtggtcatcgcgatggttcgagtatctagtggagtctcccattgtgagaagggagaacatgacaagagtcgaagaagatgaatggggtgaggcagcggggccaagagtggattga

SEQ ID NO: 33043 - DNA, 171 bp, Glycine max
  Peptide Sequence Number=SeqID_149821
atggagcatccaaatgaaggaggcccttgctggttagagatcaccttggtggtttcattggagatcttgcccgtcatctttgccttggagacagctaagcgtaaaggctgggatatccagtcgtttgagaatccaccctttggtcccttggagtctccgtatccgatgtga

SEQ ID NO: 33044 - DNA, 2283 bp, Glycine max
  Peptide Sequence Number=SeqID_149822
atggctggagtagtcgacaatcatcagcacgactcagaacttgacatacctgatgaaagtgatgaggtggatgactctcctattgagcaagtgaggctgacagttccaacaacggacgaccctacacaggcagcactgacattcagaacatggactctggggttggcctcatgcatcatcctctcttttgtgaaccaattcttcggctacagaaccaaccctctctccatttcctccgtctctgcacagattgtgtctctcccagttgggaaactcatggcagcaacacttcccaccaaaccaatacgtgtaccgttgaccaagtggtctttctccttgaaccctggccccttcaatgtcaaggaacatgcactcatcaccatctttgccagcgctggatccagtggtgtttatgccatcaacattatcactattgttaaggctttctaccacaggaatatccatccacttgccgcttttctcttggcactttccacccagatgcttggttatggatgggctgggattttcaggagattccttgtggattccccgtacatgtggtggccttcaaaccttgtccaagtgtctctattcagggcatttcatgaaaaggagaaaaggcctaaaggaggaaacacaaggctgcaattctttttcctggtgtttgtatcaagctttgcctattacgttattccagcttactttttccaagcaataacaacaatctcctttgtttgcttgatttggaaaaactccatcactgctcaacaaattggttcgggcatgagaggccttggcattggttcatttggcttggactggaacactgtggctggcttcttggggagtcctttggctgttcctggctttgccatcatcaacattctggttggatttgtgctgttcatgtatgttctggttcccatctcctattggaacaacttgtatgatgccaagaagttccccatcatcagttctcacacatttgattcctccggtgcaacatataacgtcactcgtgttttgaatgctaaaacttttgacattgatatggatagttataaaaattacagcaagctctatctcagtatcacatttgcatacgactatggattgagctttgcaactctgactgctactattgcgcatgttgcactcttccatggaaaaatgattcttcagctgtggaagaagacaagatcagcactaaaaggacaagaagctggagatgtgcacacgagaattatgaagagaaactatgaacaagtaccagaatggtggtttgtcagcattttgcttctaatgattgttgtagccttgataacttgtgaaggctttggcaagcagctccaattgccatggtggggagtcctaatgtctctagtaattgcgttagttttcactttgccaattggtgtcattcaagcaacaacaaacatgctttcaaaaggttgtgtcctttttcatggtttgcagcaagtcggactcaacgtgattacagagttaataattgggtacatttacccaggaaggccacttgcaaatgtagccttcaagacctacgggtacatcagcatgtcacaggcactcgggttccttcaagacttcaaattaggccactatatgaaaattcctccaaaatctatgttcgcggtgcagttggtaggcaccatagttgcttcaggtgtgtactttggcacagcatggtggcttctgacgactattccagacatatgtgatgatgcaaacttgccagcaggtagtccatggacatgtcctggtgacgaagtgttttacaatgcttcaataatatggggaatagtaggaccacaaagaatgtttaccaaggatgggatttaccctgggatgaattggtttttcctcattggtctacttgctcctgttccagtttggatgctttctcgcaaattccccaatcacaagtggattgagctcataaacatgcccttaataatagctggtagtggtggcatcccaccagccagatccgtcaactacattacttggggaatggtgggaatcttgttcaatttctacgtttacaataagttcaaggcatggtgggctagacacaattacatcctctcagctgctttagatgctggtgttgctttcatgggtgtcattctctattttgcccttcaatattatgatatttttggtccaacatggtggggtcaagatgctgatgaccactgtcctttggccaaatgccccacagctccgggcataatttctcatggatgtcctgttctctga

SEQ ID NO: 33045 - DNA, 1278 bp, Glycine max
  Peptide Sequence Number=SeqID_149823
atggctagtaacagagagagagaagaagcgctgacatttacaatcccttcgtcctcttcccattcttcccccatcaccgtctccgaccaactagacagttacctcgctgaccccagaagcgcctccggaagcttccagaacgacggccttctctccgccggagaagccgccgccgccgccgatcccgacttcggtttctcccgccccgatttccgccagagcccccttgctggcaccgtggagttctaccaacgccacgtcttcctttgctacaagaaccctcgcgtctggccaccgcgcatagaagccgccgagttcgaccgcttgccaaggttgctccatgccgccgttgttgcaaggaagagtcacatgaaaaaggagactcggttaacgatatgtgagggtcatgatgggactgagacatctaatggggatgtgttgatctttcctgacatggttagatacaggagattaacgcattttgatgttgaaacgtttgttgaggaggttcttgtgaaggatggggaatggcttcccggaacgcctgaggcgttgagaggttcgtatgtttttgtgtgttcgcatggatcccgtgatcgcagatgtggggtttgtggacctgttttggtcagtagattcagggaggagatagagttgcattgtcttcaagggaaagtgtttgtaagcccatgttcacacattggagcaagtcagtatgcaggaaatgtcattgtatttggacctatcatgaatggagaagtcactggccactggtatggctatgttaccccggatgatgtaccttcattgcttcaacatcatatcataaaaggggagattttagatccattatggaggggtcagatgggtttatcagtagatgaacagaagaaaaagcaagaacagcggcttctgctgaatgacttaagaaacttagaagacaacactcaagattttgttagctgctgccaatcaagtggagttggctgctgccaatctaacggaggagactcttttttccgtcagaatcatgtgttattggaaaggagaatggaccccgatgttattgagtcagaggcaaagctctcagcagatagtaagagcagtgagactgtgatttctcggatcaatagtggtaaaggagcttcacgcaagtttctatccatgacaacttggctggatggctgggagcaagaagatacttatgcagctcttgctgttgtctgtgctgctgtgtcagttgccattgcctataactgctacaaacaactgagataa

SEQ ID NO: 33046 - DNA, 786 bp, Glycine max
  Peptide Sequence Number=SeqID_149824
atgggcagcaacggtttgaggtacgagatcgaacaaaacgcttacataaaactcgtccttcactccctcaaacacccaacctccgccgtcaacggcgtcttgatcggtcgcatctccgcttccaacgacgtcgtcgagatcgccgatgccgtccctctcttccactctcacatcccccttcttccccaattggagatatctctcatcatgatagaggaatatttttctgctaaagggttgaacatagtgggctattttcacgcgaatgagagatctgatgacagtgagcttggtagtgtggcgaagaatattggtgaccacatttgccgctactttccccaagccgccgttctattgttagataacaagaagctcgatgctttgaaaaagagcaaggaccgtagtgccataatgcagtttgttgcttttgcattggacagtagcagtttgcttatgttgctttatgttagggatacatctaagaactggaagttggttcagtcagatgggaacaatcgattttctctcaaagagccatcagcaaatctagtcttgttggactatattgcatccgagaagtggaatgacgttgtagattttgatgaccatcttgatgacataagcaaggcttttcaactgatcccagcccttttgtctccgtttttgccctatttactttgcaagtggaggatattgaggcttattctggtgcatattctggatcctcatcgaagaacatttagggactatattttgacttttgaccctaggaaagttgcttcatga

SEQ ID NO: 33047 - DNA, 417 bp, Glycine max
  Peptide Sequence Number=SeqID_149825
atggagaaagtcgtaccaatgattaaatcgattggtctttctccatcgcatagcaaattcaccgttactgttgttagtctaatatgtagcattgttactgagttcatcacctctaatgctgctactgccacccttcttgtcccacttctttatcacatagcaggaactatgcatgtgcaccctcttattcttataatccctggaggaatagcaaccgagtttgctttctggcttccaacttcaacaccatcaaatgtagttggctttgccactggacacatagaaattaaagacatgttcaaagttggcgtaccactcaaagttgttgggattgttgtgctgtctcttctcatgccatcactgggaactattgtttttggaacaaacaatgatactcacaataagggacatcattga

SEQ ID NO: 33048 - DNA, 684 bp, Glycine max
  Peptide Sequence Number=SeqID_149826
atgggagaggaagaagaaggtgcgagacaacaagagtctcatgttgatgttagtttgtttgagacaaaagaagcaagattccgaggagtttacaaggtatttgcatctacaatatttgcagcaatatgtttgatttgggtgtaccgagtggcaaacatccccacagttgcaagtgggagatggacttggattagtgttatggtgtcagagttatgttttggaatatactggatcatcactcaatctgttcgttggaaaatcgtatatcaaacgcctttcaaacacaggctcttacaaagatcgatatcctccactgactccctcaaccttaatgctattttcgtcattctatatgatgaggagagtttaccagcagtggacatttttgtgtgcacggctgacccaacacttgagccaccatgcatggtgatgaatacggtattatcagcaatggcgtacaattatcctgcgaataaattgagtgtgtatctctctgacgatggaggctcagagctcacattctatgctctcttaaaagcctccattttctccaaacattggttacctttctgtagaagattcaatgttgaacctaggtcaccagaggctttcttcgctgcccataattgtagcaatagtagcactgagtatagccaagcatggttcatttatcaaggtcactga

SEQ ID NO: 33049 - DNA, 303 bp, Glycine max
  Peptide Sequence Number=SeqID_149827
atgaaaagtgagattgaatcagccgtagcaaggggcgaggttccagataatgcgatgaatcagcacagaggattctcagaatggaatccaaaaataacaaagcagaatcatcaacctatcgtgcagataataattgatggaagagacactaatgctgtagatgaagacggatttcaactgccaagagtcgtatacatggcacgcgaaaaacgacacaactaccctcaccacttcaaagctggagcggttaatgcattggtgagtaatactcacagcattccattaacaatgtatgctaattaa

SEQ ID NO: 33050 - DNA, 408 bp, Glycine max
  Peptide Sequence Number=SeqID_149828
atgaaactttcaggcggtggcaatcgtttgctgaaaacccagaagctgaattcagaggtttctcctcacagagctgtgtcagcggtgagattgatgcggattgagcttggtggtgcttttgctgaccttctcaacgagaaagggaaaggttctggtgaaaacgagatgggatatgttcaaagaacgcttggctttcgcactcgggaattgaatcaccatgatcttagattggtcacagacattgttgggggtacgattcgctggagaagatatcttgatcatcttatcagttcactatgtcatgataaagatatatctagcatggaacctcttctcttacagattctaagaattggcttctatgagattgtcaaattagatatgccaccttatgctgtcgttgatgag

SEQ ID NO: 33051 - DNA, 159 bp, Glycine max
  Peptide Sequence Number=SeqID_149829
atggttctatggggaagcttcaatggcttcgagggagaagaagaagaagaagaagaaggtgcagttttctggggttctgcggggaaaggtaaacccatatacagcacccgcgccatgcttagattcttagcagtttgtttggctttgctctttggataa

SEQ ID NO: 33052 - DNA, 1137 bp, Glycine max
  Peptide Sequence Number=SeqID_149830
atgcagaacgtgaagcttgctaaatttgctctcagacctggggctggcaacatggtcaatggaattctccgaaagctagttgtgctgaaggagaaggaaagtcttcctttgcccaaagtggagggtgatgaccgtgctcaagcacgtgctttggcaactctgtactcacatccagtttggatggtaaggagatggacaaagtatcttggccaggaagaagccattaaattgatgatatggaacaacagtgaacccagtttcagcttaaggctagtgaatatttcttccatttttctgtgctccacccagagtagcatagcaaaccgtgcaagaggtttttcaagagatgaccttgtgacacagcttaatgcattgaaggtcccacacaaactttcaccgcatttggatgaatttgttcgtatcaaaactgggttgcagattattattcaagctggtcttctcaaaaagggtttatgttcagttcaggatgagagtgcagtgtgtcacacatccttgattgcaggtctggtagtttctgttgtggatcctcaacctggtgaaactatcattgattgctgtgctgctcctggtggaaagaccctctacatggcctctcatttaagtggccaaggtaaggtatttgcaattgatgtaaatagtggtaggttgagaattcttaaagagacagcaaagttgcaccaagtggatggtgtcattactgccatccatgctgatcttcgtacattacctgatagtggacagcttaagagtaacaaagttttgttggacgctccatgctctggacttggtgttctttccaagagagcggacttgcgttggaacaagaatctggaggatatggaacaactgaaggaattacaggatgagctcctggatgcagcatccaaattggtaaaacctgggggagtattagtttacagtacatgctccatagatcctgaagagaatgacgacagggtagtggcatttcttgcaagacattcggatttccacattgatccagtagacagatatgttcctcctgattttgagacaagcagtggtttctttttctccaacccagttaaacattcactagatggctcctttgcagctcgtttagtacgtgatttatag

SEQ ID NO: 33053 - DNA, 168 bp, Glycine max
  Peptide Sequence Number=SeqID_149831
atgtatggtctcatccaaatacatgatggtgttattgttcataatggacaagaagagagagagcacaacccgggaatggttaaaggagtctttgcctttgttgggagtgtgctctctcttcctctgtcatcatcacattcacatgccttttctttccagccaaagtag

SEQ ID NO: 33054 - DNA, 192 bp, Glycine max
  Peptide Sequence Number=SeqID_149832
atggaacatggaaattctttctttcatcatgctcagtgcgaaaaatcaatctctgctgtgatccctcccatagttccaaacccaacaatggagacaattatgggtggtgatggttctagcagcagcagtgtcaatgtttactgtgatcaccctgctgcttgctttaatcgtgacaactccttcgggaattga

SEQ ID NO: 33055 - DNA, 384 bp, Glycine max
  Peptide Sequence Number=SeqID_149833
atgtttggatttggtgaagtcgatccatgcagtgatggtgttgccgctcttgaggtcgaggcgggcatcgaactcgacggcgacgaaggagagggagaggaagaggaagaaggcgaggccgtcatggatgttccactgccaccggatgaattggctttagatttgattaataatgaaccctcccctggaaacacgagaaagtatgttcctgtctgtactcttgcaagagatgcgttgaattcaaatggctactgcataattggaggttacttgtctcctgtgaatgatgcatacaagaaaaagggcctaatatctgctgaacatcgaattcaattatatcaattagcctgcaaaatttcagattttgtaatggttgatccataa

SEQ ID NO: 33056 - DNA, 840 bp, Glycine max
  Peptide Sequence Number=SeqID_149834
atgtcaatctcagcaagttcaggggattttgagattctccctgccacagatgatgcccatggaggagtcattatagatttgaaggagccaatggactctgaaatttttgttactttgcttagaacgtcgctctcacaatggaagaaacaggagaaatgcggtgtttggatcaagttacctacagcactagttaatcttgttgaaactgcagttaaggagggtttcggttaccaccatgctgaaccaaactatctaatgctagtttattggattattcctgaaacaagctgcacaatccctccaaatgcatcccaccgtgtaagggtcggtggtcttgtcttaaatgataacaaagaggtgcttgtagtccaggaaaaaagaggtatattccatgaaactggcctttggaagatacctaccggaatagttgaagcgggtgaggagctttcagccgcagttgttagagaagcaaaagaagagacaggaattgatacagaatttgtggaattactggcattcaggcacgcacataattcattctttgggaaatcagaactatatttcctttgcatgttgcgtcctctttctactgacatcaaaaagcaagatttggaaattgatgctgccaagtggatgccgtttgaggaatatgctgcccgtcctattacagaacccttcaagtatgaaattgagttatgcttagcaaagttagaaaggagctatgctggattctctccacgacctatctcatcatattacaaggaggaattgagttatctatatttaaatagccatgacttggacaaatcttcgaaatcattcgaggtctttaggtcttag

SEQ ID NO: 33057 - DNA, 234 bp, Glycine max
  Peptide Sequence Number=SeqID_149835
atgaggttgagctgtgttgctaatcctgatagtgctgagagaccctccatgagaagagtgctgcagattctcaacaatgtggctgcaccacttgttgtgctgaaagtgaagccaacactcaccttctcttctgacctgcctctgcttctcactattgaggacattgtttcagaggcggatgaagaagagttcggtaccagcagccagtctatgtgcgagatcaaaattcactaa

SEQ ID NO: 33058 - DNA, 663 bp, Glycine max
  Peptide Sequence Number=SeqID_149836
atggtgaaagtaatttctgaatcctctccttcccttcttacactactgattgctcttctatctaccttgtttcttgtcacactggcaaagaaaaaagggtccctacatgaaaatcttgtccaagataaccagcagaaattggagttacaaccttcattagaagatgttactatccaacaaaatgaaactgctgagaggcaagctgaagcacactcagagtcttcattttcattagattgtgaaagcagaaatatcatggatacaagttttgtactcagtgctgagaagtattatgagcaaaaagctgatccacaatcagatacttcacttccatcagatagtgaaagcactactagctcaaccatggatgaagaaagtattaagattcatcacaatacagatcaaaatcttgatatatctgatagcttggtctttgattatgatgttgatgaggaggaggaggatggcttgattgaaatcaagcttccaaacaactactttttagagttcttgccagaatccattttcaagcaacaaggtctcacggagctctgggcagaaattaatgagatgaatgaggatgaaaatttaattgagattgatatttccaagggatccacaaagcatcaagatttgagattggagaaggagttggtttgctga

SEQ ID NO: 33059 - DNA, 1167 bp, Glycine max
  Peptide Sequence Number=SeqID_149837
atggcttatggatgttcatttacattccttccttatttgactgatgttgctagtttgaactgttttgcaactgaatcaggtcctatattgctgatccttgtttctaaattcctctgcatggccaacaatggtgcaaaggatcccttgctgtcaggatcacttgatgcgactcaaaagactaaacagcagttattaaacaagagaaggctcctccgttctagaagtgctcctcacgcagagcttgttcctacagagacaaattgcaatgaatcaattcctcgtactgcatccatatttcagaatttgcatccaagttttaaaagaatggctatctaccttgcagtctatttaggtgtaggtgctttaatcttctaccttgtcagaaaccagattaaggggcagaaaacagatggaattcttgatgctttatacttcacaattgtgacaatgaccactgttggatatggagaccttgtgccaaatagccaccttgcaaaactacttgcatgtgcttttgttttctctgggatggcattgattggactaattgtaagcaaagcagcagactacttagttgagaaacaagaacttttgctagttaaagccatgcgcatgcaccaaaaaattggttcaactgaaattttaagggaggttgagaccaataaaacaagatacaaattatttctagtcttttcccttcttttgattctcatcatcgtggggacaatttttttggtcacagttgagaaattggatgttatagatgcattctactgtgtttgttctacaattacaacactgggttatggggatcaaagtttctcaactcaagcaggaagaatatttgctgtgttttggatattgacaggtactattactttagctcagcttttcgtctacattgctgaactaaacactgaaatcagacaaaaggaacttgtcaagtgggtacttacaaggaaagtgaccaatttagatttggaggctgcagatcttgatgaggatgggactgttggggctgcggaattcgttatttataagctcaaagagatggggaagattagtcaagaagatatatcacttgtgatgcaggagtttgaacagcttgatgttgatgattctggcacactatcaacttcggatataacacttgctcagtcatcttag

SEQ ID NO: 33060 - DNA, 165 bp, Glycine max
  Peptide Sequence Number=SeqID_149838
atggcctatgacacgaaacatcttcgtgtcccagagatacaatggcttggagcttttccttctgattctgagagatattttgttccgaatcagtgtctccttccattgactgctgaagcatgctggacatttatgtgtcaagctctatacaagcaactggactag

SEQ ID NO: 33061 - DNA, 291 bp, Glycine max
  Peptide Sequence Number=SeqID_149839
atggagggaaagaggacgaggttccagtcggagtcacagccacagagcaattcactcgagctttgctcgcagacctcaccaacggacgctcaccgctcattctcatcgatcgcttcagaagctactgcaccctttccaactccaactggttcgattctaatcccaaccaatcaccgtttcacctcttcgtttctaacacaaatgtttcgcaatgcagcttttgtgcctccgatttgccgtgcggaaaggaacttctcacgcttcgcaggaaatcccacgcccacagactag

SEQ ID NO: 33062 - DNA, 285 bp, Glycine max
  Peptide Sequence Number=SeqID_149840
atggagatcccagagaaggtggtcaagttcagataccattttctcggggcaatgctcttctctctcgtgatcatggccccaagattcatgaccctcttgacctatttttggccactcttcctctccacagctctagtccttgcccttgtcttcttcttcgccaagacttctcctttacactctgccgacgctacttcctccctccacaacgccggggaagccctccttgattacgtcgccggccaccatgacctgcccctggatactcgccacaattccgactaa

SEQ ID NO: 33063 - DNA, 1335 bp, Glycine max
  Peptide Sequence Number=SeqID_149841
atgaaaggattacgacattacattgtaagttggaacattggcattgacactggcacagtagcagagtacataattaaggagcactgtgtctaccttattagtcggaattgtggcgagtatccaggggcagaggaagagtggccaaaaataggtcaagagggtcatgaatcttggggccatgatcacgagagagaagagcattgccccgagaaaatggtatctgaacttgaccaccttctctgggatctccatggaaattatgtgagtgaggaagaagaacaacaaatcaagcaagaaggtggacgccataggcaacactcctttgatgattcggatcaacagcctctccgccgttgccaaattctcggcaagtgcgagttcttaaaccccggaggcagcgtcaatgaccgtgttgctgttcatattattcaagaggctctggaatctgaccagctacgtccagatggaattgtcactgaagggagtgctggaagcactgccattagcattgccactattgctcctgcgtatggatgcaggacccacgtggttattccggatgatgctgccattgagaaaagtgagaccggtgtccattacccacaaagaccattttgtcaaatcgcaagaagacgggcatctgaagcaaatgagtttgcattgaagcgtacaaattcacaacaattgaatggcaaggaggacaccgagaaaataaatggttatgaatctgatggatgcagttacagctctctgtttcctgaagattgccaaggtggcttttttgctgatcagtttgagaacctagcgaacttcagggcccattatgaggcagcaggcactggtggtactgtggctggtgtttcaaagtttcttcaggaaaagaatccaaacatcaagtgcttcctcgtagatcctcctggctctggtttgtttaatagggtaactagggcggtgatgtacaccaaagaggaggcagatggaagaagacttaagaatccatttgacactataacggaaggaattggaattaacaggataacaaggaattttgcaatggcaaaacttgatggggcctttagaggcaccgatagggaggctgttgaaatgtctaggtttcttttgaagaacgatggtctcttccttgggagttcttctgcaatgaactgtgttggagcagtaagagtagcgcaagcaattggccctggtcacacaattgtaaccattctctgcgacagtggaatgagacatttgagcaaattctatgatgctgaatacttgtctctgcttggtttgacaccgaaagcaactggtttggagctcttaggcatcaaatga

SEQ ID NO: 33064 - DNA, 396 bp, Glycine max
  Peptide Sequence Number=SeqID_149842
atgtccttgggaattcttcgatcccgagcgatttcattggcatcgaagcgattcctctgcaccaatgccgcttccgcttcccctcctcttccccctcctccttccgccgcctctcccagccgctggagcttcctcaaatacgccctcgtcggcgctctcaccggaggcactgtctttgccggttacgcctcttacgcttacagcttggacgaaatagaacagaaaacgaggtcgctccgtgaatcggccaagtacactgctggtgatggagtcactgctcttgatgtcagtattgactacttcttaggctttcttcgctttcaatcttctttgttaattctgtgttttgatctcattggctggattgttagaatcatattggctgaattggattga

SEQ ID NO: 33065 - DNA, 729 bp, Glycine max
  Peptide Sequence Number=SeqID_149843
atgactcacaacctaaaagctcattactatcttgttaagcttactcaattactcgtttcagtgtccgtgtgttccttcatcttctctccttcttccttgcttgttttcctacattacttcaaattctatttctctacattccctttccaactctatacacacaacatagacaagaactccatgtttctactttgcaatggtatccttgtttttgttggtataactaaatctctctccggctctagttgttgtgatgataataagccttctacgtatgttaaagatgatggttcacaatctcggttttcggttattgaagccaacgagctaatgttggagatagtagaaactgaagaacaaactagtgatcctgatgaacagaacactgtagttgagcaagtaatagaaatagaaaattgtgctgaagaagaagtacaagaaaacattgaaaagatcattttggtagatgaaggagaagaaaaaggaagtagcttggttttgaaggaagagaagaaggaggagctagatgaagaaactgagctattggatgtaggtgatgaagaggaagataaagggtcagaaactgattacattctgattgaagaaagaatagaagaggaagaagaaagctgtatgttgagcacagaggagttgaacaaaaagtttgaagatttcattagaaagatgaaggaagatctaagaattgaagctcaaaggcaattagtcatg

SEQ ID NO: 33066 - DNA, 567 bp, Glycine max
  Peptide Sequence Number=SeqID_149844
atgcattggatctcttattgccttgcttctcgctggaggtccttacatattatagagcgagatacaggttggcagacttttaaaagacctggagttgatgccttcttggaacatttagctcagttctatgaaatagtggtttacacagatgaacaaaatatgtttgtagaccctgttatagaaaggctggatactaagcattgcattagatacaggctatcaaggccggctactaagtatcaggatgggaaacacttcagagacctctcaaaactaaacagaaatccaggaaaagttctttatttaagtggccatgctttggaaagttgcctacaacctgagaactgtctccctattaaggcttggcagcagcaagatatagatgacacagctcttttggattttataccatttcttgagtttgttgcccgtagtagtccacctgatataagaccagtgctagcctcttaccaaggatgtgatattccaagtgagttcatcaggcgttccaaagagcatcaaaggagaatgcaagaacaaaagaatcgtggtcgcttctggaaatga

SEQ ID NO: 33067 - DNA, 696 bp, Glycine max
  Peptide Sequence Number=SeqID_149845
atggggttggtgtcttccagagttgtgttcttgtttgttgtttcggttttggtgatttgggctcaggtggatttagcagaaggtggtggtgttaggaattacattagttgggaagatttgcaggtggatgaacaaaggttggccgtgaattcccataacaatgttcgagttattattgttaaccagaatggtgggggacattcaaaaactgttcaaggtgctgtcaatatggttcctgataataatactcaaagggtcaaaatttacatttatccaggaatttacagagaaaaagtgtatgtgcctgtcaccaagccttatgtatcatttatagggaaaacaaatcaaacagcaagtcctgttattacttggaacagcaagtcatctgacataggcccaaatggcacagcattgggcacctatgcttcagcaacagtaggagtggactcaaattatttctgtgcaaccggggtcacttttgagaactcagtgattacatcggctggtggaaaagggatgcaaggagtggcactgagggtaagcagtccaaaagcaatgttctatcgagtgaggattaaggggtcacaggacactctcttggacaacataggaaatcattacttctttaagtgtcacatcataggaaaagttgattttatctgtggcagagcaaaatcactctatgaggtaatataa

SEQ ID NO: 33068 - DNA, 699 bp, Glycine max
  Peptide Sequence Number=SeqID_149846
atgaatgcgagaggggcaaatataacggcgaacgcgaaagcactaaagaataatataacggcgaatgcgaacgcactaaatataacggagatagcgaatgccatacccatcatcacaaatagtactaaggcatcagacaaaggctcagatggccaagaaatgggcacggttagtacagcaactgtatgggtagaatctgatttcttctgcgcaactgctcttacaattgagaatttggtagataaagatgcagataaacgtcaagcagtagcattgcgtgtagacggtgataaagctgtattttatcgagttaagcttgtgggggagcaggacactctcttggatagcacaggaatccattatttctaccgaagttacattcaaggatccgttgattttatatgtggcaacgcaaaatcattgttccatgagtgtgtactagactctgtagctgagttttggggagcaattgcagctcatcacagggattcagaagatgaagatacagggttttcgtttgttaattgcacaatcaaaggaagtggtagtgtttttcttggtagagcatggggcaagtatgcaacaacaacatattcctactgtcacatggatgatgttatttttcctttgggatggagcgattggggtgatccatctagacaagggtatcataccaattaccaactctcacttaaatga

SEQ ID NO: 33069 - DNA, 804 bp, Glycine max
  Peptide Sequence Number=SeqID_149847
atggcgggttatgccactacttcacttcctctcttccagctcaaacttggcgtcattcattctactctctctttgttgtctattagtttaaatagtccaaacgggtttgaggatgaagttcaagccttgaagcctcaaggcacaatattggccatgagctcttcatatcaccctcaacttgatggccagattgagaatcttaatgagatctttgagatgtatctaaagtgctttgtatttgaacatcctaagaaagtttttggtagacctccaccatcggtgatgcactatgaggctcaacaatatatgaagatgcaagctgataagaaaagaagagatttgcaatttaaggttggtgatttggttttagttaagctacaaccctataggcaacattcagtggctttgaggaagcatcagaagctaggcatgcgctattttggtccatttcgagtgattaaaagaattggtacagtagcatataaagtaaagttgtctgagtctgctaaaatacatcctgtatttcatgttgctcttcagaaaccatttcatggcaaaagtcctccaccatatcttccttttccattaacttctagtgaactgggaccaacgctttgcccatggaaggacaaggttgtttttgatggaaaaggtaatgcaacatgcataaagaaggaagaagagttggcgcgaaattctattagaagggagggacacgtggctcacgatccgcaaagtaagggagataggcgtagcacaaggttaaggagggagaacataaggctggaggattacacgttttag

SEQ ID NO: 33070 - DNA, 1353 bp, Glycine max
  Peptide Sequence Number=SeqID_149848
atggtgcatatgaagggtgtcgttgagacaattgaagggttttctcttgctgatctgtatccttccattggacttcttcaagttcttactgggattaagactagagttgagaagatccaacgaggaatggatacgatactcgagaacattgttagggatcacagaaacaaaactttggacacacaggctattggtgaagaaaatggggaatatctagttgatgttcttttaaggcttccctgtctgacagtgtgttgtcaaagcaaccattttgaaagtaagttaaaaggctgcttgttgctgaacaggctggagaggatacaaacttgttacaatgaatttgttagacggacattttcagtgaagaacccaagggtgatggagaaagtgcaaattgaggtaagaagggtctttaatggaaaaggatacgtggatgaaacaagtattcatgaactaaaatacttgagatcagttatcaaagaaactctgcgtttacatccaccttctccattgatgctttcaagggaatgcagtaagagatgtgagattaatgggtatgagatacaaatcaaaagcaaagtcatagttaatgcatgggcaattgggagggatcctaaatattggattgaggctgagaaatttagtcctgagaggttcattgattgctcaattgattacgaaggtggtgagtttcagtttattccatatggagctggaaggaggatatgccctggcatcaattttggcattgttaatgttgaattctcacttgcaaatttgcttttccattttgactggaaaatggctcaagggaatgggcctgaggaacttgatatgactgaatcctttggcttaaaaaacttatatcatttctttaccaataaagtgttggatacaacttgcacaaaggcccatgcagctggcatagtacgtgaaggtagtgcacagcaccagatcgtgcctttagaggataggaacagctgcttggtcctcgaactccaagctctaacattatggttcaaattggaattggaaaataagatcataaacctagatgatgatgatgctgggtgtacatcaaaagcattgcatggaaagaaagccatttctcaaactattgcagaaaatgaacatccatgttcatcggatgcaatcaggcacaaaagcatttttacagaagcacaaaggattgaagcaatcaaaagaaaatgtttatatgatatgcagagttctacttcctcatcttcttctgatgattcatttgagtttgacggaagtaatccccctaagagaagaaaaactgcgctggatagttctggattaaactctttgccaaggtacatggagcaatga

SEQ ID NO: 33071 - DNA, 1527 bp, Glycine max
  Peptide Sequence Number=SeqID_149849
atggagatggagcttcacatttccttatctacaatccttcctttcttcatcttagtgttcatgctaataatcaacatagtttggagatcaaaaaccaagaattcaaactccaagttgccaccaggaccaaggaagctacctctcatcggaaacatacaccaccttggaactctgcctcatagatccctagcaagattggcaaatcaatatggtcctctcatgcatatgcagcttggtgagctatcctgcataatggtatcttcccccgaaatggcgaaagaagtgatgaagacacatgatatcatctttgcaaataggccttatgtgcttgctgctgatgttatcacttatggctctaagggcatgaccttcagcccgcaaggaacttattggaggcagatgagaaagatttgcaccatggaactgctagcaccaaagcgtgttgactccttcagatcaatcagggaacaagagttgtcaatttttgtcaaagagatgtctttgagtgaagggtcacctatcaatctcagtgagaagattagttcattggcatatgggctaatatcacggattgcttttggtaaaaaatccaaagaccaagaggcttatatagaatttatgaagggtgtcactgatacagtttcagggttctctcttgctgatctgtatccttccattggacttcttcaagttcttactgggattaggcctagagttgagaaaatccgtcgaggaatggataggataattgataacattgttagggatcacagagacaaaaattcggacacacagcctgttgttggtgaagaaaatggggaagatctagttgatgttcttttaaggcttcagaagaatggtaacctccaacaccccttatctgacactgttgtcaaagcaaccattatggacatattcagtgctggaagcgagacgacttcaacaacgatggagtgggcaatgtcagaacttgtgaagaacccaaggatgatggagaaagcacaaattgaggtaagaagagtctttgatccaaaaggatacgtggatgaaacaagtattcatgaactgaaatacttgagatcagttatcaaggaaactttgcgtttgcatacacctgttccattgctgcttccaagggaatgcagtgagagatgtgagattaatgggtatgagataccagccaagagcaaagtcatagttaatgcatgggcaattgggagggatcctaactattggattgaagctgagaagtttagtcctgaaaggttcattgattgctcaattgattacaaaggtggtgagtttcagtttattccatttggagctggaaggaggatatgccctggcatcaatcttggcattgttaatgttgaattctcacttgcaaatttgcttttccatttcgattggaagatggctccagggaatagtccccaagaacttgatatgactgaatcctttggcttgtcactaaaaagaaaacaggatttgcagttgattcctatcacttaccacacagctgcataa

SEQ ID NO: 33072 - DNA, 2601 bp, Glycine max
  Peptide Sequence Number=SeqID_149850
atgtatggaaaagttaaagttaattcctttgtggatgatgcctcccattcccaagacaatgcattgaaatcggagggcatgagaaagacggtgcacgatgtatgccgggtgttggacacttatccttggggagctgcccttgaggatgccctcaacacgtttgatgaaatgcctcaaccagagttggttgttggagtgatcaggaggttgaaggatgtgagggtggcattgcattattttaggtgggtagagaggaaaactaaacaactgcatagccctgaagcctacaatgcacttctcatgcttatggcgaggaccagaaatttggagtacttggaacagattcttgaagaaatgagtatggctggatttggaccctctaataatacttgtatcgaaatggttgctagttttgtcaagtcacggaagctaagagaagctttcggtgttattgaaacaatgaggaagttcaagtttcgccctgcttattcggcttatacaacgctgattggtgctctctctgcagctcacgaagctgatcccatgctgactctcttgcgtcaaatgcaggaaataggttatgaagtaaccgtacatttgtttaccacacttatttgtgtgtttgcaagggaaggccgtgttgatgccgctctatccttgctggatgagatgaagagtaactcatttaatgctgaccttgtcctctataatgtatgcatagactgttttggaaaagttggtaaggtggatatggcctggaaattctttcatgaattgaaatcacaagggttggtacctgacgacgtgacatttactagcatgataggggttctttgcaaggctgagagggtggatgaagctgtagagttgtttgaagaacttgacagcaacaagagtgttccttgtgtttacgcttataataccatgataatgggttatggttcagttgggaaatttaatgaagcatacagcttacttgagaggcaaaagagaaagggatgtatacccagtgtaattgcatataattgcatcctgacttgccttggaagaaagggaaaagttgaggaagcattgagaatccttgaagcaatgaaaatggatgcagctcccaatcttacatcctacaatattttaattgacatgctttgtaaggcaggagaacttgaagctgctctgaaagttcaggactccatgaaagaggctggcttattccctaatatcattaccgtaaatattatgatcgatcgactgtgtaaagctcaaagacttgatgaagcttgctccatatttttaggattggatcataaagtttgcacccctgactcagtaacattttgttcactcattgatggcttgggcagacacggcaaggtgaatgatgcctatatgctttatgaaaagatgttagattctggtcagactccaaatgcagtggtgtatacatcccttattaggaactttttcaagtgtggtaggaaggaagatggtcacaaaatctataaagagatgatgcataggggctgttctcctgatctgatgctccttaataattacatggattgtgttttcaaagctggtgaaattgagaaaggtagggctttgtttgaagaaataaaggctcagggtttaactcctgatgttcggagttattcaattttaattcatggtcttgtgaaaggaggtttctcaaaagacacatacaagttgttttatgaaatgaaggaacaaggactgcatttggacacccgtgcttacaacatagttattgatgggttctgcaagtctggtaaggtcaacaaagcttaccaactgctggaggaaatgaagacaaagggtctccagcctactgttgtaacttatggttctgtcattgatggacttgctaaaattgacaggctggatgaagcatatatgttatttgaagaagcaaaatcaaaagctgttgatttgaatgttgtggtctatagtagtcttattgatgggtttgggaaggtgggaaggattgatgaagcatatttaattttggaggagttgatgcagaaaggtctgactccaaatacatacacatggaattgcttactagatgcattagtgaaagctgaggaaattgatgaagctcttgtctgcttccagaacatgaaaaacttgaaatgccctccgaacgaagtaacttacagcattatggtaaatggtctttgtaaggttagaaaatttaataaggcctttgtgttttggcaagaaatgcagaaacaagggttaaaacccaatactatcacatacaccaccatgatttcaggacttgcaagggttggaaacgttctagaggcaaaagacctctttgagagatttaagtcaagtggtggcatacctgattccgcatgttataatgctatgatagaaggattaagcaatgccaataaggcaatggatgcatatatactttttgaggaaactcgacttaaaggttgtcgtatatatagcaaaacatgtgttgttcttttagatgcgttgcataaggcagactgccttgagcaggcagcgattgttggtgctgtcttaagggaaatggcaaagtctcaacatgctacaagattgtcttga

SEQ ID NO: 33073 - DNA, 1440 bp, Glycine max
  Peptide Sequence Number=SeqID_149851
atggtgatggagcttcaaagccagaacaaccctttctctattcacttgattaccttctttttgtttctcttgttcctgttattcaaattagttaagaaatcgagttccaacaacaccagcaaattacctccaggaccaaagacactacctctcatagggaacctacaccagcttgttggttcaaagagtcatcactgctttaaaaaattggcagacaagtatggtcctctaatgcacctaaaactgggagaggtatccaacatcatagtcacttcaaaagaattggcacaagagattatgagaactcaggatctcaactttgcagatagaccaaaccttgtatccacaaaaatagtttcctacaacgccaccagcatttccttcgccccacatggagactattggaggcaactgcgaaagttgtgcacagtggagctattaacatcaaagagagtgcaatcttttcggtccataagagaagacgaggtgtctgagcttgttcagaaaatacgtgcaggtgcaagtgaagaagggtccgttttcaatctctctcagcacatttaccctatgacttatgcgattgcggcacgagcttcttttggtaagaagagtaaataccaagaaatgttcatatcgttgattaaggaacagttgagtctcataggagggttctctcttgctgatctctacccttctattggactactccaaatcatggccaaggccaaagttgaaaaagtccacagagaggttgatagggtgttgcaagacatcatcgaccaacacaagaacaggaaaagcaccgaccgtgaagcagtggaagatctggacatgtttattggtggtggtgaaacatcatcttccactgtggaatggtcaatgtcagaaatggtaaggaacccttgggcgatggaaaaagcacaagctgaggtaagaaaggtgtttgatagcaaaggatatgtgaatgaggcagagttgcaccaattgacatacttaaagtgcatcatcagagaagctatgaggttacatccacctgtgccattgttaattcctagagtaaatagagagaggtgcaaaatcaatggatatgagataccagctaagaccagggtctttatcaatgcttgggcaattggaagggatcccaagtattggactgaagctgaaagtttcaaacctgagaggtttcttaatagctctattgattttaagggcacaaactatgaatttatcccatttggtgctggaaggagaatctgcccaggcatttcatttgctacacctaacattgagctgccacttgctcatttgctttaccattttgattggaagcttcccaacaatatgaagaatgaagaacttgacatgactgagtcatatggggctacagcaagaagagcaaaagacctatgcttgattcccattaccgttcgaccttaa

SEQ ID NO: 33074 - DNA, 2352 bp, Glycine max
  Peptide Sequence Number=SeqID_149852
atggggtgtgccagctccaagctggaagatctccccgcagtggccctgtgccgggagcggtgtggtttcctggacgaagcaattcaccagcgctatgcactcgccgccgctcacatcgcttacataaattctctcaagtcaattggtcactccttacaccttttcattcagcaagacatggattctcctccttccccctcttcctccccttctccccctcacaaactcgcccaacacctccccccctcctctccttctccctccgattccctcggctcccacctccacttccactccgactccgacgacctcccctccctccaccattcccctcaatcctcctctcctattcctatcgcttcttacttcaccggtccagatcatcaccctccccatcttcatatgaatttcatgcagaacaaggcctctccttccattgtctacgagcagatgcctttgagtccccaaaccatgtacgttggagagtcctcctcttcctccttttacccttaccagtatcccccttacccctacccctacgatccctattctgtcggagtaccctcttcctcgcctcctcctcagcagcgccttcccgtttccaagcctcccccgcctccgccctctcctcctcgctcctccccttgggactttctcaatttcttcgataacagcgacgacaagtactattcccaaactccttaccctgccaccgccaccgccacccccagccgcgattccagggaggtcagagaggaggaggggatccccgatttggaagacgaggattaccaccatcacgaagtcgtcaagcaggttcatggggatcagaagcttgtccagcctaagcacgaaccccctccctcctcccaccacaagccggacgaggaagacgaagatgatgatgatgatgatgatgatgatgatgatgatgatgatgatgaagatgaggtagaatacgaggtgcacgtagtggataagaaagtagttgatggtgataataatgatgggaacaaggccaaggagcacgccgcattgcgtacccggagacctggttcccggaatccacttgaggttgccaaagagattcagattctatttcagagggcttccgattctggtgcccaaatcgccaagatccttgaggtcggcaagcttccccacaatagaaagcacgcagcttatcaagcttcttcgaagatgttacaagttgttgctccctcattgtcccttgtctcctcccaaccttctacttccaaagatgccgaatccgcctccgctgctaacatggattttgatgttgatctaacaaccggggggcgcaatctttcctctacgctgcagaagctccttctttgggagaagaaactctttaacgaagttaaggcagaggaaaagatgcgtgttatgcatgataggaagtgtcgcaagctgaagcgtttggatgataggggtgctgattttcataaagttgattcaactcgaactttggttaggaatctgtccacaaaaattagaatggcaattcaggtggttgataagatttctatgactataaacaagataagggatgaagaactgtggccacagctgaaggaattaatccaggggttgactagaatgtggaaatccatgcttgaatgtcatcatgatcagtgtgaagcaattagagaagccagaatactgggttccattggatccaggaagaagagcagtgatagtcatctccaggcaaccaagcagcttgaacatgagcttatcaattggacattccaattctctggctggataagtgcccagaaaggttatgttagagcattgaataattggctgttgaaatgtctcctgtatgaacctgaagaaactccggatggcatagtccccttttcccctggtaggattggggctccgcaaatatttgtaatatgtaatcagtggtcccaagctttggatagaatatctgaaaaggaagttgttgattccatgcatgtatttaccatgagtgtgcttcagatatgggaacaagataagctagaaatgcataggcaggtgatgcagaataaggatctagagagaaaggtgagaaatatggatagagatgaccagaagctgcagaagcaaattcaagcgttagagcgaaaggtggttctggtatctggagaaggtaaaggtctctcagtttctgagaatatcatatatcagagtgacaaaagcagcagtctacaggctagcttacagtgcatttttgaggccatggagagatttactgatgaaactgtgagagcttatgaggagttgctacaacggagcaaagaagaaagtgctgcccggaatcacgagagagtctcatag

SEQ ID NO: 33075 - DNA, 1029 bp, Glycine max
  Peptide Sequence Number=SeqID_149853
atgggttgttgccaatcatcgatgttgctgagagtgggagagagggagactcaccctgaaaaggagaaggaaagggaaaaggaaaaagagcaagcgtacggaaaccaccagaggcagtctgagggaggagagggcgacggcgagaaagaggtggttgatttctcgttctcggagttctcgctggcggagctgaaggcggccaccaacaatttcagctctgagtatatcgtgtcagagagtggggagaaggcacccaatctggtgtacaagggtcgcctccagaaccagagccgttggattgctgtgaagaagttcagcaagtctgcttggcctgatcccaagcaattcgtcgaagaggcttccggcgttggtaagttgcgccatccaaggctcgctaatttgatcggttactgctgcgacggcgatgagaggcttctcgttgccgagtacatgcctaatgacactcttgccaagcatctcttccactgggaaactcagactattgagtgggccatgcggttgcgagtggctctgtacatcgcacaggctttgcactattgcagttctgaggggcgtcccttgtaccatgacttgaatgcttaccgtgttctcttcgaccaggaaggtgatcctcgtctctcttgctttggttttatgaagaacagcagggatggcaagagttatagcaccaatcttgcttacacacctcctgaatatttaagaaacggaagggtcacgcctgaaagtgtcatttacagctttggaaccgttcttctagacctcctcagtggcaagcacatccctcccagtcatgcacttgatatgatacaggggaaaaacaatatgctcttaatggattcacatttagagggaaagttttcaacagaagaggcaacagtagtggttaatcttgcctctaaatgtttgcaatatgaacctagggagcggcctgatacaaaggatttggtcacaacacttgccccattgcatacaaaacccgatgtacaaatcccttctctaacttcataa

SEQ ID NO: 33076 - DNA, 3756 bp, Glycine max
  Peptide Sequence Number=SeqID_149854
atgttgtcactttccaacgtacacctttccactgccgttctgctcaaacccattttccttcatggcttgtccggtttcctccaccttctgttgctcgtggcggttgtgctgtcatgggtttggaggaaattcacagcaggtcccggggatgagtctaagaagaaacccaacaactccctcttcaaaacgaccgttttttcttctcttgctctttccgctttcaatttcctcctctgtttcattaactacttctactggtatacaagtggctggtcagaagaaaagctcgtgacccttctggatttggcgctaaaaacgcttgcttggggggttgtttgcgtctgcttgcaaaaggggttcttcagttccggccaaagaaggttctcgttcttcttcagagcctggttcactttctacctctctgtttcttgctattgcatcgtggtggacattgttgttatgtctgggagacgcgtttctctgccaacacagtacttggtttctgatgcggtgtccacttgtgttggttttttcttctgttacgtggggtattttgtgaaaaacgaggttcatgttgataacgacattcaggaacctcttttgaatgcggattccttggagtcaaaagagaccaagggtggggacacagttacccctttctcaaatgctggaattttgagcattcttaccttctcttgggtgggtcctcttatagccgttggtaataagaagaccctggaccttgaggatgttcctcaactagacagcagagatagtgtaattggtgcttttccaactttcagagagaaagttgaggctgattgtggtggaattaatagtgtcaccacactgaagttggtgaaatcgttaataatttcagcatggaaggagattcttatcacagcttttcttgtattgttaaaaactttggcttcttatgttggtccatatctcattgatggttttgttcagtacctcgatggacaacggctgtatgaaaaccaggggtattttttggtttctgcatttttctttgcaaagcttgtggagtgcctgacccaaaggcattggttcttcaggttgcagcaagttggactcagaatccgagcgctgctggtaacgatgatttataacaaggctctgaccctttcttgtcaatcaaagcagggtcacacttctggggaaataatcaatttcatgactgttgatgctgaaagagttggtgtcttcagttggtatatgcatgatttgtggatggtggctctgcaagttacactagccttgttgattttgtataaaaaccttgggctggcttcaattgctgcttttgttgcaactgttgctattatgttggcaaatgttccattgggatcattgcaagagaagtttcaaaagaagttgatggagtcaaaagatacaagaatgaaagccacatctgagattctaaggaacatgaggatcctcaaactacaaggatgggaaatgaagtttctatcaaaaataaccgagctcaggaaaaatgagcaaggttggctaaaaaaatatgtttatactgcagctgtgaccacatttgtgttttggggttcccccacatttgtatctgtggttacttttggtacctgtatgcttatggggatcccccttgaatcagggaagatcttgtctgcacttgcaacatttcggattcttcaagagcccatttacggtcttccagatacaatttcgatgatagcacaaactaaagtttctcttgataggattgtgtcattccttcgtcttgatgacttacgatctgatgttgtagagaagcttccttggggcagttccgatacagcaattgaagtagttgatggaaacttctcttgggatttatcttcccctagtccaactttgcaaaatataaatcttaaagtttttcatgggatgagggttgctgtttgtggtactgttggatcaggcaagtctactttactttcttgtgtattgggagaagtaccaaagatatcaggcatccttaaggtttgcggaacaaaagcctatgttgctcaatctccatggatacaaagcggcaagatagaggataatatattgtttggtgaacgcatggatagggataggtatgagaaggtacttgaagcgtgctccctgaagaaggatctggagattttatcatttggtgatcagacaattataggagaacgtggaataaatttgagtggtggacagaagcaaagaatacaaattgcacgtgcactttaccaagatgctgatatatatctatttgatgaccctttcagtgctgtggatgctcacacaggatctcacctctttaaggaatgcttgctaggccttttatgttcaaagacagtggtttatgtcactcatcaagtggagttcttacctgctgctgaccttatattggtcatgaaagatgggaaaattactcaatgtggaaaatataccgatcttcttaatagtggtgctgattttatggaacttgttggtgcacacaaaaaagctttgtctacactagattcattggatggagcggcagtatctaatgaaataagtgtgttggaacaagatgtaaacgtctccgacacgcatggttttaaagaaaaagaggctagcaaagatgagcaaaatggtcaaacagacaataaaagtgaactacaaggccagcttgttcaggaagaagaaagagagaaaggtaaagttgggttttcagtctattggaaatgtatcacaacagcatatggaggagctcttgtaccattcatattgttggctcagattctttttcaagctcttcaaattggaagtaattattggatggcttgggcgactcccatctcagaggatgtgcagccacctgttgaaggaacgactcttatagcagtctatgttggtttggccattggaagttctttctgcatccttgccagagcgatacttcttgtcacagctggttataaaacagctactatactcttcaataaaatgcacttctgcattttccgtgctccaatgtcatttttcgattccactccaagtggacgaatccttaacagagcttcaactgatcaaagtgcattggatacagacattccttatcaaattgcatcgtttgccttcattttgatccagcttctgggaattataggagtgatgtctcaagctgcatggcaggttttcattgtctttatacctgtgatagcaatcagcatcttgtatcagcaatattatattccatcagcccgagaactatcacgcttagttggagtctgcaaagccccaatcattcaacactttgctgaaacaatttctggtacttcaactattagaagctttgatcagcagtcaagatttcaggaaacaaatatgaaactgactgatggatattctcggccaaagttcaatattgctggtgccatggaatggttgtgtttccgcttggatatgttgtcttctatcacatttgccttttccttaatattcttaatatctattccacagggattcatagatccaggccttgctggtttagctgttacatatggacttaatttgaacatggtacaagcttggatgatatggaatctctgcaatatggagaacaaaattatatcagtagaaagaatacttcagtatacttgtattccttgtgagccttcccttgttgtagacgataatcggccagatccttcttggccttcatatggcgaggttgatatacaagatttgaaggtagtttga

SEQ ID NO: 33077 - DNA, 3061 bp, Glycine max
  Peptide Sequence Number=SeqID_149855
tggggctgacctagtccttggggtccagtggttacgggccttgggcccggttactactgattacaccgccctctccatgtcttttacacacttgggccttcccatcaccctctttgcagacgtcccggttacaccccccctagcctcggcccaccagcttcgccggatgcttcgaacacaggtcgtcgcggccctgttccagctaggccctgctccttcttccccactttctaccacccccaccttactcccggccacagaacccccaccccttgcccttcaccctcttctaaccaaattccaccacctcttccaggagccaacccagttaccgccagcccgacttatttcccaccacattcacctcaccccaggggccaaaccagtcaccgttaagccttatcgttacccacatagccagaaaaccgaactcgagaagcaagtccagactatgctagattccggtttgattcgactgagccatagcccattctcatcccccgtcctcctcgttaaaaaaaaggatggcagctggcgctgttgtatcgattatcgcgcccttaactccattaccatcaagcacagttttcccatgcccaccattgatgagctgctggacgagcttggtgcggcttcgtgtttctctaagttggacttgcgccagggatttcaccaaatccgcatggcagaggaggacatccacaaaaccgccttccgcactcattccggccactatgaatactgcgtgatgcccttcgggctgtgtaacgccccagcaaagttccaggcaactatgaatgaaatgctcaaaccatttttacgcaaattcgttgcggtgttttttgacgacatcttggtctacagctcatcttgggacgatcatcttcttcatctcgaggctgtcttctccaccctggcccgtgattccttctacctccgcgagtccaaatgcgtctttgctaagacccgattacagtatttgggccacattctctctgccacaggagtttccccagatccctccaaaatttcggctatcgtggattggccaaccctcactaccaccaccgctctccgtggtttccttagtctgaccggcttctaccgccgtttcatccgaggttatgccccattggctgccccactaaactcattactccgtaaagacggcttccattggactgacgactcccaacgcgccttcgacaccctcaaacaggtaatgatttcggcccccgttcttattccgccggatttcacgattccattttgcttggaaacagatgcttcaggggtcgccgtcggcgcggttttatcacaaaatgctcatccaattgcgtattttagcaagactctctgccccaggctgcaacgttcttccacctatgtccgggaactccatgccatcacttccgccgtccgtaaatggcgtcgctacctcctcggccatcctttcaccattattaccgatcatcagagtctgaaggacttgatgaatcaagtaatccagactcccgaacaacagcagtacctggtcaaactcttgggctactcttacaccatccaataccggcctagctccggcaatgcagccgcagacgctctttctcgagtcacccccgccggccaatgcctgatcctttccgttcctcttctcgactgcatggccgatatccaccattcagtacagcaatccccggcttaccacgaattacttgccacactccaccagcaacccgaggcccaccctgactattccatcaattccggccgcatctcctttcgcggcaagctgtggttgccccctgacaacccgttcatccccatgctccttgaagaattccactccaccccactgggtggacacatgggtgaaaagaagacgctgcgccgcctccgtgactctttctactgggatcacatgcaccgtgacgtccaccgcttcgtttctcagtgccggatttgccagcaaattaaatatgaggcccgtaaacccgctggtttgctccaacctctgccaattccctctggcctgtgggaggacttgtcgcttgatttcatcaccggccttccgccgtcgcacggcttcaccaccatcctcgtggtggtcgaccgctattctaagggtacccacctcggcgcacttcccccaaagtactctgcttataaggttgcctgtctattcttcgacattgtctgcaagttgcacggctttccccgcagtttggtctccgacagagacccaatcttcctcagttcattctggcgcgaactatttcgcatttgtggcaccaaactccgctatagcactgcgtaccaccctgaatctgacggccagacggaggtccttaatagaactctggagcagtatctccgctcgttcgttcatgacaagcctgccctctggcactcctttctccctttggccgaatggagttacaatatgtccactcactccgggaccggcctctcaccgtacgagatcacgtacggaaagcctcccccagctttccccccatacaccacgggcacctcgtcagtggaagctgcagactccctcttgtccacccgccaagctctgcacactaagttgcaaagtcgtctattgaaagcgcagatggcaatgaagaaccacgctgaccgccaccgtcgggatgtccatttccagccaggtgacttagtctatgtccgcctcaagccatatcggcaactctccatgcgcccccattattccaagcttgccaagagattctacggtccttatccgatcacggaatgtgtcggacctgtggcctaccgcctccagctccccgcggattccaaaatccatcctgttttccacgtgtccctcttaaaaccccatcacggccagcctcctcctgtggacgacccccttccacctacacaggttgatcatcaccctctcgtcgagcccctctctttcctagattggaaactggacaccaccacggacccaccgtcacgctcggtcctggactgggacgctcttcgttcactttacaacctcggggacgaggttgagtttccaggggagggtgtt

SEQ ID NO: 33078 - DNA, 626 bp, Glycine max
  Peptide Sequence Number=SeqID_149856
atggccctgtccaagcttcaagaagataaacttctggaccgccgccgtactcaccgccaccatttcccgattaacaccacccctcactatccccccaaccccccaccttcctcctcagcctcggctacaaacaaaccccccgttcgccgcctcacccctgaagaactagccctgaaaagagataaggggttgtgctaccactgcgacgagagatggtctccggggcatcgttgcaatccccgcattcatcttctcatcgcggccgaggaccccgacccacccctcaccacagagccacctgattcccctccaccaacctcgttgcccctccaccatgacgactcccctcccctgctaagtctgaatgccttatccggcatgcccgccccggaaaccttccgcgtttacggcaccgttcgctgtcatcaactcaccatcctcgtggacggtggcagtacgcacaattttgtgcaactgcgcgtggcgaagttcctcggcctccgatcgactccggtgaccccccttcctgttatggtgggcgacggtggcgtcatccattgtgaccgccgctaccctcaggtctccatcaccattcaggggcaccatttcaccactgatctcttcgg

SEQ ID NO: 33079 - DNA, 5250 bp, Glycine max
  Peptide Sequence Number=SeqID_149857
atgggggactttggagatggaaatttggttaaactctgggaggacaggtggatccgaatactgattctaatcttattccttggagtagcggaacctgttgctacaaaaattctttccattccccttcgaaggagatacaataatgtgaaatctgactattttcatgctcttggtactctcaagcttcatccatccagtttggatgttgatccaatttgttctagatctggacaattcatgtgttgcttctatgtgaagagtcttatagagcatgcatggtttgcttctcctctagggagaagattgaatattgtagatgagcccaatgacttgataattaagagaatgcccggggaaaatatgtatgactgtcataggagaaaaagaatagggaaattcacagcaggtgccagggacgagtctaaggagaaacccaacaacacccttatcaaaatgaccgtgttttgttcgcttggtgtttccgctttcaatttcatcttctgtttgcttaactacttatactggtataaaggtggctggtcagaagaaaagctctgcatgacccttttggatttggcgctgaaaacgcttgcttggggagttaaaaaaggttctcgttcttcttcagagcctggtgcgctttctacctctttgtttcttgctattgcatcgtggtggacattgttgttatgtctgggagacgcgtttctctgccaacacagtacttggtttctggtgtccacttgtgttggtttgttcttctgttacgtggggtattttgtgaaaaacgaggttcatgttgataacggcattcaggaacctcttttgaattctgattccttggagtcaaaagagaccaagggtggggacacagttacccctttctcatatgctggaattttgagcattcttaccttctcttgggtaggtcctcttatagccgttggtaatcagaagaccctggaccttgaggatgttcctcaactagacagcagagatagtgtaattggtacttttccaactttcagagagaaagttgaggctgattgtggtggaattaatagtgtcaccacactgaagttggtgaagtcgttaataatttcagcatggaaggagattcttatcacagcttttcttgtattgttaaacactttggcttcttatgttggtccatatctcattgatggttttgttcagtacctcgatggacaacggctgtatgaaaaccaggggtattttttggtttctgcatttttctttgcaaagcttgtggagtgcctgaccgaattgcataggtcctttaggttgcagcaagttggactccgaatccgagcacttcttgtcacgatgatctataataaggctcttaccctttcttgtcaatcaaagcaggaccacacttctggggaaataatcaatttcatgactgttgatgcggaaagagttggtgttttcagttggtttatccatgatttgtggatggtggctctgcaagttacattagccctgttgattttgtataaaaaccttgggctggcttcaattgctgcttttgttgcaacagttgttattatgttggcaaatgctccattgggatcattgcaagagaagtttcaaaagaagttgatggagtcaaaagatacaagaatgaaggccacatctgagattctaaggaacatgaggatcctcaaactacaaggatgggaaatgaagtttctatcaaaaataaccgaactcaggaaaaatgaacaaggttggctaaaaaaaaatgtttatactggagccgtgaccgcatttgtgttttggggatcccccacatttgtatccgtggttacttttggtacctgtatgcttatggggatcccccttgaatcaggaaagatcttgtctgcacttgcaacgttccagattcttcaacggcccatttaccgtcttccagatacaatttcaacgatagcacaaacgaaagtttctcttgataggattgtgtcattccttcgtcttgacgacttacagtctgatgttgtagagaagcttccttggggcagttctgatacagcgattgaagtagttggtggaaacttctcctgggatttatcttcccctaatccaactttgcaaaatataaatcttaaagtttttaatgggatgagggttgctgtctgtggtactgttggatcaggcaagtctactttactttcttgtgtattgggagaagtaccaaggatatcaggcatccttaagatttgcggaacaaaggcctatgttgctcaatcaccatggatacaaagcggcaagatagaggataatatattgtttggtgaacgcatggatagggaaaggtatgagaaggtacttgaagcatgttccctgaagaaggatctggagattttatcatttggtgatcagacaattataggagaacgtggaataaatttgagtggtggacagaagcaaagaatacaaattgcacgtgcactttaccaagatgttgatatatatctatttgatgatccttttagtgctgtggatgctcacacaggatctcacctctttaaggaatgcttgctaggccttttatgttcaaagacagtggtttatgtcactcatcaagtggagttcttacctgctgctgaccttatattggttatgaaagatgggaaaattactcaatgtggaaagtatgctgatctgcttaatagtggtgctgattttatggaactagttggtgcacacaaaaaagctttgtctgccctagattcattggatggagcgacagtatataatgaaataagtgtgttggaacaagatgtaaacgtctctgacacgcatggttttaaagaaaaagaggctagcaaagatgagcaaaatggtcaaacagacaataaaagtgaactccaaggccagcttgttcaggaagaagaaagagagaaaggtaaagttgggttttcagtctattggaaatgtatcacaacagcatatggaggagctcttgtaccattcatattgttggctcagattctttttcaagctcttcaaattggaagtaattattggatggcttgggcgactcccatctcagcagatgtggagccacatgttgaaggaacgactcttatagttgtctatgttggtttggccattggaagttccttctgtgtccttgccagagaatcacttcttgccacagctggttataaaacagctactatactcttcaataaaatgaacttctgcattttccgtgctccaatgtcatttttcgattccactccaagtggacgaatccttaacagagcttcaactgatcaaagtgcattggatacaaacattccttatcaaattgcatcatttgccttcattatggtccaacttctgggaattatagcagtgatgtctcaggttgcatggcaggttttcgttgtctttatacctgtggtagcagtcagcatttggtatcagcaatattatattgcatcagcccgagaactatcacgtttagttgcagtctgcaaagccccaatcattcaacactttgctgaaacaatttctggcacttcaactattagaagctttgatcagaaatcaagatttcaggaaacaaatatgaaattgactgatggatattctaggccaaagttcaatattgctggtgccatggaatggttgtgcttccgcttggatatgttgtcttctatcacatttgccttttccttaatattcttaatatctattccacagggattcatagatccaggccttgctggtttagctgttacatatggacttaatttgaacatgatacaagcttggatgatatggaatctctgcaatatggagaacaaaattatatcagtagaaagaatacttcagtatacttgtattccttgtgagcctccccttgttgtagatgaaaatcggccagattcttcctggccctcatatggcgaggttgatatacaagatttgcaggaattgttaaagaggggaatcatccttgctgcaactgtttgtgggttattggtgtttggatgttcacgagttttcgccgttgaaggggttgtgaatgcaggatatggtgtctttggacagagcattcttttgcttaggaatacatggcctaaagtgttgcaagttcttcgtatatttaaggagcaaggtttggtgctggcagtgcttttgggcctttcagcttttttctcaatggcagagacttcaatcactactctttggccttggaaggttcgtgagttggctgaaaaggagtctgaaaacggtgtcttcagactactccgaagtgatgttactcggttccttaccacaatacttattggcacaacggtggtcaatattggggcaactgctcttgtcactgaagcagcaactgctatgtttggtgaagctggtgtcagtgcagcaacaggagtgatgactgttgccattttgcttctcactgaaatcactccaaaaagcatagctgttcataacgccacagaggtggctcggtttgtggccagtggcatggctttccctggtgttgtatcctgtaggaagaattgttacttatctttcaatggggatgctgaaattgcttggcctaaaaggaagaagccatatgtaactgaagatgagctaaaattgatgctaagaggtgcagaattaagtggggcaatagaggaggaagaacaggatatgattgaaaatgtgttagagataaaagacacacatgtcagagaggttatgacacctcttgttgatgttgttgcaattgatgcaagttcaagcctggtagactttcatcacttgtgggtcacacatcagtactcaaggtattttgaagatttccagcaacgtgttgataatataatgggtatagcatatgcaatggatctgctggattatgttcaaaagggtgagttgctagaaagtactacggttggagatatggctcacaaacctgcttattttgtacctgattcaatgtctgtttggaatcttcttagagagttcagaatcaggaaggttcacatggcggttgttcttaacgagtatggtggaactgtggggattgtaacactcgaagatgttgttgaggaaattgttggtgaaatatttgatgaaaatgactcaaaggaggagatacagaaaaaaactggttacattgtaatgcgagctgagggtgtttttgatgtggatgcaaacacatccattgatcagctctctgaagatttgaacatcaagatgccagag

SEQ ID NO: 33080 - DNA, 2904 bp, Glycine max
  Peptide Sequence Number=SeqID_149858
atgtttcctcaactagacagcagagatagtgtaattggtgcttttccaactttcagagagaaagttgaggctgattgtggtggaattaatagtgtcaccacactgaagttggtgaagtcgttaataatttcagcatggaaggagattcttatcacagcttttcttgtattgttaaaaactttggcttcttatgttggtccatatctcattgacggttttgttcagtacctcggtggacaacggctgtatgaaaaccaggggtattttttggtttctgcatttttctttgcaaagcttgtggagtgcctgacccgaaggcattggttctttaggttgcagcaagttggactccgaatccgagcgctgcttgtcacaatgatctataataaggctctgaccctttcttgtcaatcaaagcagggtcacacttctggggaaataatcaatttcatgactgttgatgctgaaagagttggtgtcttcagttggtatatgcatgatttgtggatggtggttctgcaagttacgctagccttgttgattttgtataaaaaccttggcctggcttcaattgctgcttttgttgcaactgttattattatgttggcaaatgttccattgggatcattgcaagagaagtttcaaaagaagttgatggagtcaaaagatacaagaatgaaggccacatctgagattctaaggaacatgaggatcctcaaactacaaggatgggaaatgaagtttctattgaaaataaccgagctcaggaaaaacgagcaagggatcccccttgaatcagggaagatcttgtctgcacttgcaacatttcggactcttcaagagcccatttacaatcttccagatacaatttcgatgatagcacaaactaaagtttctcttgataggattgtgtcattccttcgtcttgatgacttacggtctgatgttgtagagaagcttccttggggcagttccgatacagcaattgaagtagttgatggaaacttctcttgggatttatcttcccctagtccaactttgcaaaatataaatcttaaagtttttcatgggatgagggttgctgtgtgtggtactgttggatcaggcaagtctactttactttcttgtgtattgggagaagtgccaaagatatcaggcatccttaaggtttgcggaacaaaagcctatgttgctcaatcttcatggatacaaagcggcaagatagaggataatatattgtttggtgaatgcatggatagggaaaggtatgagaaggtacttgaagcctgctccctgaagaaggatctggagattttatcatttggtgatcagacaattataggagaacgtggaataaatttgagtggtggacagaagcaaagaatacaaattgcacgtgcactttaccaagatgctgatatatatctatttgatgaccctttcagtgctgtggatgctcacacaggatctcacctctttaaggaatgcttgctaggccttttatgttcaaagacagtggtttatgtcactcatcaagtggagttcttacctgctgctgaccttatattggtcatgaaagatgggaaaattactcaatgtggaaaatatacagatctgcttaatagtggtgctgattttatggaacttgttggtgcacacaaaaaagctttgtctacactagattcattggatggagcggcggtatctaatgaaataagtgtgttggaacaagatgtaaacctctctggtgcacatggttttaaagaaaaaaaggatagcaaagatgagcaaaacggtaaaacagacgataaaagtgaaccacaaggccagcttgttcaggaagaagaaagagagaaaggtaaagttgggttttcagtctattggaaatgtatcacaacagcatatggtggagctcttgtaccattcatattgttggctcagattctttttcaagctcttcaaattggaagtaattattggatggtttgggcgactcccatctcagaggatgtgcagccacctgttgaaggaacgactcttatagcagtctatgttggtttggccattggaagttctttctgcatccttgccagagcaatacttcttgtaacagctggttataaaacagctactatactcttcaataaaatgcacttctgcattttccgtgctccaatgtcatttttcgattccactccaagtggacgaatccttaacagagcttcgaccgatcaaagtgcattggatacagacattccttatcaaattgcatcatttgccttcattttgatccagcttctgggaattatagcagtgatgtctcaagctgcatggcaggttttcgttgtctttatacctgtgatagcaatcagcgtcttgtatcagcaatattatattccatcagcccgagaactatcacgcttagttggagtctgcaaagccccaatcattcaacactttgctgaaacaatttctggtactacaactattagaagctttgatcagcagtcaagatttcaggaaacaaatatgaaactgactgatggatattctcggccaatgttcaatattgctggtgccgtggaatggttgtgtttccgtttggatatgttgtcttctatcacatttgccttttccttaatattcttaatatctattccacagggattcatagatccaggccttgctggtttagctgttacatatggacttaatttgaacattgtacaaggttggatgatatggaatctctgcaatatggagaacaaaattatatcagtagaaagaatacttcagtatacttgtattccttgtgagccttcccttgttgtagacgataatcggccagatccttcttggccttcatatggcgaggttgatatacaagatttgaaggtagtttga

SEQ ID NO: 33081 - DNA, 234 bp, Glycine max
  Peptide Sequence Number=SeqID_149859
atggagcagcaaaagatcgtaattgaggtgccactccactgtgagaggtgcaagaagaagattatgaccatatgcactatggcagatggtgtcacttcggttacttttcaaagggaagagaaagaaaaagtggttattataggagaaggaatagatgcagctggggtagcagcatgtttgaggaagaaggtgaacaagtatgctaggctagttagtgtggccaatgatacatga

SEQ ID NO: 33082 - DNA, 433 bp, Glycine max
  Peptide Sequence Number=SeqID_149860
cattggatacattccaaggacaggtgagtgcatcaaagtagttcttgaaagggaagatgaagatgataacaatgagtccaatgctgaccagcaggatcagaaggagaagaaccagagtttcaaacttgagtactatttctcaagctacactaaagatgtcaatgcgattttcttcaaaaagcttgatcaacaaatactagctggaaatgccagaaaggtgagcgctgttcggtttgaacacataaataataatgatgaaatgttggagactaaagtaactcgcatgatccccaaaatcatgaaaagaaaatggaggagtgatgcaaactcagacaatgatgcagaatatgacggagatacatttgcaaagacaccacaggatgacatttctagtgaatatttagttgatcaggaaaattctaacagaggttaa

SEQ ID NO: 33083 - DNA, 1671 bp, Glycine max
  Peptide Sequence Number=SeqID_149861
atggctgctattctgcctctctatccttataatccattgctatacttttcgactccttcgagttttcgttctcaattttggattttggagagaaggcgtttgggttctgcaagtttgaagaatttggtgaaacttgcagcacattccaatccgaggattctcaagagcaacaggaagtcaaagtatggagaggcactgttgttctacgacagcgacgaagaaatggacgacgacgtcagcgacgacgacgaggatgatgattggctttctgatgaggaattttctgagcctgctaacttagatgttaataacaacaagagatttaagtcaaagacaactaaaggaaaagatagacaacaggaatgggagtggggtttgagatcttttgacaacaaacaaagcattagattgcctaggagtgagagagtggcatcgttacaacgaaatgagagtggaaagcatagtagaaatgtaaaagataaaaaatatccccggttatccgaagagattcctttggatgtgaaatggttaccacttcttgattacttgagcacttttggaatgaaagaatcacactttgtccaaatgtatgagagacgcatgcaatcacttcaaattaatccacaaattcttgagtatacagtggagaacaatttgaagtctcgtgttgctttcttgaggggtctgggcatacctaattctagaatagggcaaatcattgctgctgctccatccttgttttcttatagtgttgagaattcgttaaaaccaacagttagatatttaattgaggaagttggcatcaaggagaaagatttgggtaaggtcattcagcttagtccccaaattcttgtgcagagaattgacatttcatggaatactcgttctatgtttcttaccaaagagttgggtgcacccagagatagcattgtgaagatggtgacaaaacatccccaacttctccattacagcatagatgatggattacttccaagaataaatttcctaaggagcataggaatgaaaaattcagacatcgtgaaagttttgacaagcctaacacaggtgctttctctgtccttggaggagaatctaaagcccaaatatttgtacttggttaatgaacttaacaatgaagtgcaatccttgaccaaatacccgatgtatcttagcttatctttagaccagagaattcgtcctcgtcataggttcttggtttccctaaagaaagctccaaaaggaccatttccacttggatctctagttccaactgatgaatgtttttgccaacagtgggctggaactactgtgcaagacttctctgacgttcaagagcttgctcctgctcttcctgttcaattagttgtaggtaaagcaacatctctgtctacattttggacagaagatcttgcaaaggttcaatgtttcttaggaattgaggtggcaaaatccaagaatgaaactcccatggatcctaatgccaagctctatcatttaaggggagccattggttggaatactggactatcttactattactcatccaaatatctcttttacagtcaatgtgtcacactagagttgtgggatactctgttgcagattgagcaggatctccctactgacaggatatcacttctggctactgcattcttattggtgataccatga

SEQ ID NO: 33084 - DNA, 1260 bp, Glycine max
  Peptide Sequence Number=SeqID_149862
atggattctccctacacaagaatagtctttgagaaaattcagaaatttgagccagagcatgctagaaaaataattggctatctcttctttcaaggtcatggagaacaagaaatggctaaattggcttcatgccccgactattttatctgtgaagtggtagttcaggccaaaaaggaactccaaaggttggctgctaaaccagatatgctcccgatttctcgtactgtcaaccctcaacaaggtttaagtgatttatcagtaatctcccctagaactcctacttcaccaaactttcagatgcctcctccctattgggatccacaatctgctgcaaacatcaatccagactttatgggaatgaattacttggattctattgtagaacttcagaagcagacacagatgctcactttggagaatcaaatagatgctgtaaaaactgggactggaggaatcgccaacgatcactatggcttagacgcttctgctgccaatttgggtgggagaaggttttctgaatttccaatgaagatgtgtcactatttcaacaaaggattctgtaagcatggaactagctgcagattctatcatgggcaagttgtccctgagaatttctctcagatgcatgcaaatgatgctattggtgaggatcaggtgatttccccagggtcactggctcagttagagtctgaaattattgagctcctaagagcaaaaggcggtccaatgtcaattgcttccctgccaatggcatactacgataaatataaaaaggtactgcaagcagatggttatttaactgagagtcagaggcatggtaagtctggctatagtttgacaaagcttcttgcacgactgaaaaatagtattcagctaataggcagacctcatgggcagcattcagtggttctggcagaagattctcccacacaaatgcaaaagggagattttgctcgaaatatcagtgcttcataccaaatatatctgacgttcccagctgacagcactttcacagaggatgatgtctcaaactacttcaacacttttggacctgttgcagatgtcagaattccaaaccagcagagaaggatgtttggatttgtgacatttgttcattcagaaactgtcaaaagtgttttggataaggggaatccccattgtgttcggggttctcgggtgcttgtgaaaccttaccgggagaaggcaaaggttaatgaaaggactacattcggggttctagagttagcaaaacttgattaa

SEQ ID NO: 33085 - DNA, 492 bp, Glycine max
  Peptide Sequence Number=SeqID_149863
atgtgctgcaagtttcaccaaattcttcaaacttgcagaacccaaacgccttctctccaaaatccaaaattgagaacgaaaactcgaaggagtcgaaaaaatgcaagaagaagaagggtgggtgctgtgcctgtgaatgtggatgatgtaaccacagtacttgacccagctccagtgcaagtcacatggcaaattgtggttggagctatagggattgaatttagcaaaagaattatagctcaaaaaagatgtgaggtgtgtggagggtcagggcttgttcttagggaaaaggaaaaggactatctccgctgcccagaatgtggtatgattgcattcacttcttcgtcctctcatatcatgtactcaataaagcgggtttcttccttggcaatccttgaaaagattcttctcctgttaatttctacagcattgtataaaaagccatacttcaacaatgacaactttattttagcagagattcgctgtttgtga

SEQ ID NO: 33086 - DNA, 792 bp, Glycine max
  Peptide Sequence Number=SeqID_149864
atggacgccgccgccaccaactccggcgaaccccgcccgagctcggagcttcagacaactggggaatccgaggatccgaatcgaagcgggtcgggacagaattcgacggcgaggtataagctgatgtcgccggcgaagcttccgatctcgaggtcgccgtgcatcacgattcctccggggctcagtccgacgtcgtttctggaatcccctgttcttctttccaacatgaaggtggaggcttcaccaactacagggtccctccgcaagctccaacaaacagtacatggttctatggcttctgctgcctctgctacatttccagtaaccactgcctgcttcaataccaatactgttgatgccagaaaatcaagtttctttgagttcaaaccactcaatagatcgaataaggttcctgcagacttcaacaatcatgtaagtaaacagtctactcaagtagaaggtccaggaaaagctcaatcatttgcttcctcaccattagttgaaagtgagataacagttccttctaatgaattaagcctatcatcacctgtacaaatggttagttctagtgctagtgctcctgttgatgttgatttggatgaaattaaccacaaaggcaacacagctactgggcttcaagcatcacatgttgaggttagaggcagtggactttctgttgcagctgagaaaacatctgatgatggatacaattggcgaaaatatgggcaaaagcttgttaaaggaagtgaatttcctcgcagttattacaaatgtacacatcctaactgtgag

SEQ ID NO: 33087 - DNA, 423 bp, Glycine max
  Peptide Sequence Number=SeqID_149865
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgactgggtttggggacccacccaggttcaagctgggcaagacatggagaacaacttggtcaaggtctcaaagtcgtaccccattaccaaggcactggctgacacccaggagtcaaccttggccaagctgaagaagcagggcatcaaggtcggctga

SEQ ID NO: 33088 - DNA, 832 bp, Glycine max
  Peptide Sequence Number=SeqID_149866
cgcccaatacgcaaaccgcctctccccgcgcgttggccgattcattaatgcagctggcacgacaggtttcccgactggaaagcgggcaggaacaaaagctggtaccgggccccccctcgaggtcgacggtatcgataagcttgatcacgtcgctaagattgcccgccttcgtttccctgaggttgcggtgcctccgcaggtcgctgaccagttcgtcgagatgtcgaagattgccgactccatgattggcaaggctgagaagactcttgccgatcgcgacgcggaggccgccgaatctctggcgtctgaggactccaagatggatgatctgcgacgcgatcagttccgtctgttactgggcgacgactggacttacggggtggagagcgccgtcgacaccgctttgttgggccgctactacgagcgtatcgccgatcacgccgtggccgtcggttcccgtgtcatctacatcgtcactggtgagggccccgctggtgaagactggccgagcgccccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 33089 - DNA, 145 bp, Glycine max
  Peptide Sequence Number=SeqID_149867
atgacatacactccatacgacgtatgttcgtgcccaaaagctagtgccaaagaccctggaaggtcagtgcacagtgccccccacgaacatacacaacatccaacgtatgaacgcggccaaaagctagtgccaaagaccctggaag

SEQ ID NO: 33090 - DNA, 737 bp, Glycine max
  Peptide Sequence Number=SeqID_149868
tcaacggcctgaccgttgctgcccgtaacgccaacgacggtatctctctggcgcagaccgctgaaggcgcgctgtccgagatcaacaacaacctgcagcgtgtgcgtgacctgaccgtgcaggcgcagaacagctccaactcggcttcagacatcgactccatccaggctgaagttaaccagcgtatggaagagatcaaccgcgtaacgtcgcagaccgacttcaacggtatcaaagtactgaacaccggttctggttccaaagattacagtttccaggttggctctaaagatgctgaaaccatcgctatcaccattagttccagtgatggttataacctggcgaaagcgggcaccggtacgggcactgctcttaacacccgcgccatggcttccggaacagatttagtcaatggttctgcacgtacaactgctgcaattggttttgacgtactgaaaggtaaagtgaccggtggtgcatctggcgccgcttctggtaccacgccactggcagacatcgatgcagcgatcaaatctgttgactcgcagcgcagcctgctgggtgcctcacagaaccgctttgagtcgaccatcaccaacctgaacaataccgtgaacaacctgtcagctgcgcgcagccgtattcaggattctgactacgcgacagaagtgtcgaacatgtcgcgcgcgcagatcctgcagcaggcaggttcttctgtgctggcgcaggccaaccag

SEQ ID NO: 33091 - DNA, 147 bp, Glycine max
  Peptide Sequence Number=SeqID_149869
atggtttctattgctagtgctgcaaatgtatatgctcaagtgaatagtatccttatgctgaatgtgacaaattttaaggtctgcaaggaagccatagaaattgttctcggctgtatggatttggatttggcactgagaacggaatga

SEQ ID NO: 33092 - DNA, 694 bp, Glycine max
  Peptide Sequence Number=SeqID_149870
atgcattcacagacgataacttttgtttctgaaaaggacaatagacccttgccaaaagtatctgtctttggaaaagatggaagcatcctagcctattcagatattgatggtaaaatagacaaaaaagcattggatccctctcaggaaaaatttcaattggtttacgacaatttttccgtagcaacactatcctacacagaaattgaccacgacattataaaactcaatgatcggataaaggaaattgagacagtcgtgatcaaaaataataaaccggctaaatacattttcatcaaaggaaatttcaactcttatgttacggttaataataagcttaatgcatatgcggatggaataattacctatatttttgacaataaaagtaaaaagctgaaaagtacaaatgttcagcagtacagaatctatcgtctggaagatcctaaaaatgaaaaaaaacaaacttcatcatgggattatgggaactcgctgaatcttcctaagcttaagcacttgggaaatccagaagattataaaacaaaaattactgaaataaaagaattaaaaggagacaggaaagaccagatcgaaatttccggcggtgttttacaggagaaagaattcgcatttcttggattccggttttatgatatcaggacaatccttaatctcacatttgaaaagggatcatcaaaag

SEQ ID NO: 33093 - DNA, 195 bp, Glycine max
  Peptide Sequence Number=SeqID_149871
atgaggaatgccttgcgcttagatagcatgaaaaagcccttcgataatatgtatgaaatgccaccgaggaagctctccgcaaagagatctaggagggacgccacgaccgaaggaaccagcgccgctcctgagtttgacagccatcaaaggatggtcgttccaccgagagggacgcatccagctcagggacgatga

SEQ ID NO: 33094 - DNA, 420 bp, Glycine max
  Peptide Sequence Number=SeqID_149872
atgacaatgatagtagacacattaccagtattctactatggaaaatggtgggctacgcaccttcaaagctttccagatttggtcttcgccagtgaaaggatcgatgtgggtccgaaaagaggcaaatttgatcatcctactaggacgactgagaaaactggggcaaatgaagagggtgagaaagagggagaaacccatgctgtgactgccattcctatacggccaagtttcccaccaacccaacaatgtcattactcagccaataacaaacctcctccttacccaccgcccagttatccacaaaggccatccctaaatcaaccacaaagtctgtctaccgcacttccaatgacgaagaccacctttagcacaaaccaaaaaacaccaacaaaaaggaattttgcagcaaaaagcctgtag

SEQ ID NO: 33095 - DNA, 129 bp, Glycine max
  Peptide Sequence Number=SeqID_149873
gtgaagaaccatgtttccccagagccagaggtggaggacgccggagttgcttcgttggcgaatccaaaggcgttaagggtcatgtcgtcaccttctactcttacttcctcatgtccaaagtgtgactga

SEQ ID NO: 33096 - DNA, 288 bp, Glycine max
  Peptide Sequence Number=SeqID_149874
atgtttcattctgcaaattctcttacatcatgtggaaataatttatctaataatgaggcgcaaccgccaagaaatgtgagcaatttacatggtgatgaagatgatgatgatgattatcttgtgtctaactcatacgttgaagagtctttagacgaagatgatagtgttgacggtatctctgatacagacgatgaagtcaccgacatgattcaaccagtaagaattgttcacccagcagaagtaagaattgttcaccctaaccctaagcccctaacccctaaaccctaa

SEQ ID NO: 33097 - DNA, 483 bp, Glycine max
  Peptide Sequence Number=SeqID_149875
atgtataaaacagttcgcccccctgttggtgaatcgaacagggagatgcctctttctgaattaaaaagtaaatatagaaaaatttcatctctggagaaggctcagtctggttgggaagaagaatataaagtttcatcaaaacagtgcatgcatggtcccaactgcaagattggcaacttttgtacagttggtagaagactacaggaagtaaatgtcttgggtggcctcatccttcctgtttggggagccgtagaaaaggctctttcaaagcagaaaactaactgcaaaacaaaatctgtacaggcccgcctaagccataggaggctacgtgttgtacgcattgaaactactgtggatacgcaacgtattgttgggcttcttgttcctaatgctgctgtggaaactgtgcttcaaggttctctctctctaaaagacttaagtaccacatcaagtagtttattctattcaacatgggactcctaa

SEQ ID NO: 33098 - DNA, 426 bp, Glycine max
  Peptide Sequence Number=SeqID_149876
atgcgaaagtcacaagttcaattcgtaagcccaatccgtatcagttttacgaaaggacaacaccccctaattgcaaaggtgcagataggaaatggtagagagaaggagttggttatagtttcaactttggattgtccatttttgtacatcctagtgttgaagatgcgattaagtctcgtgaaattcatatcccttcagctttgcgccatcatggacacaagcatgacgataaagctgttgatgataggaacattgaacttccacgtgagcactaaagtaaagaataggtcattgccactttcacttcatggtaattttgggaaagatactagccctaaagcaagtgagaagcttgagagaggtctcacccaacaaccaagattctatttcagtgatgataagttctcatctggtgcagacaaataa

SEQ ID NO: 33099 - DNA, 1374 bp, Glycine max
  Peptide Sequence Number=SeqID_149877
atggcccatcaaaagcagaaagttgtcgctcttgatgcacctactcccaagagagccaagaaggctcaacttgtagctgaacctcgtgcgaagagtcagtcctcctcctcatcagatggtgaatccactaatgacactccaattatacccctccacaagtctgcactaaccactttgccacatccacctccctctcctttacacttggaaaggttcagaagggaaactccaagggagccattaacggatgaacaacgtttctctcaagatgctatagtccattttcctcctccaacttggactcgtccagttcaatccactattgccaagatgcctcctaattggctggcacttggcacttggcactcattaaccggaactattcagcaaacaaagcaaagacccttcacaagaagtggaacctcccaaggttcagttcgaaaagaagacatccaactctctgatgaagatcactcatcccttggaaagttacatgaaaaaatgtacttggatgatcaagccacaacgtacccttctagtctgcatatatctagggcaactgacatcatgatggttgctgatcgggaccttctggagtcaaatagtgtggatggattcccaaaaagcttccacctttgggcaatgatggaagtgatattgttgttccatgaaacgttgttcaagtgttacaacctgccaagacgtatcactttgatgatgcttgtgtctgcttcacaagagatgatgatagctactccttcatccaacgtcttctttagcttctttccattccataaggggaacttacaacttgaggctcaacagaagatgaaagttgtttttggttctgctactgttgagagtgttgcaaaagaagctattgagaaagaagctaacgccattgttcaagctgaggcatttgccaaagttgtggacgacagtgttgtcgacgacactaatgtcataaacgagactagtgaagcatccaatgcaactatggccaatgaagttgaaccacttattccaaatcttgcatcaataaagacacttcttgagataagggcaaaaatggtgttgatgtcgttattgtatattccacaagttctggccccactcctctcaattatgcacaacctgctgccatcactcaatgccactataagacagttttccaaccttgacgtcgtcctcttacagaacattcaacaagctcaattgtcaatgcttggagctattgctccccctacacctacacctataccaccctttatacctgcttctcttgaacctccaccacaacccttggctccgataccaccaccaccttcatcctctccaccaccttcccaacctcggccaccaccaacctcttaa

SEQ ID NO: 33100 - DNA, 1050 bp, Glycine max
  Peptide Sequence Number=SeqID_149878
atgccgctatggtgggaattgatgtcttggttaaacatagtgtgtgtattcctggaaactccgagggaccatctcctccaacaccattactgcaatctgaaggatattaggttacagcgatggcagatttggtggatctccctgacatggtgtatttggcaccgtagaaattggattgttttctcaaatgacagcttcaaaggtcacaaattgatggacgatgctttattcttctgctggacatggcttaaaaatttggaaaaaggatttgatatcccattccattactggtccagcaaaatcagggatgggttttgtgctcgggggggattagcttatagatattttgtggctgggtgcctagcttacagtcagatctatggttgcctaattcttgctatgttggctggaccttcgttaagtgcttataattatgatagtgcctatggaaagaaggctctgacgattatgtacaaaggaataatggagcaggattctctgcctgtggtacctccgggatgttcatctcacagaccagatacaattcaagattttattgtgcaggcaaaagctgctcttgtatctgttggaatagtaagggacactcttggtaatggtaaatctggtcgtattattgattcagatatgcacgaagttggacggttcctcaaccggattttgggactacctcctgatattcagaatgggttgtttgagttatttgtgagtatcttggatcttcttgttcggaatgctcgcattgaaggtaaccttgacacgggcattgttgatttgaaagctaatgtaattgaactacaagggactccaaagactgttcatgttgatcaattgactggggcctcaacaattctgtttacattcatcttagatcgtgggatcacatgggagttggcaagtacaatgctgaatgaaaagcagaaggatgggcttggttcagccaatgatggcttctatgagtccaagagggagtggttgggaagacgtcatttcattttagcatttgaaaggagtttccttaatccaacttga

SEQ ID NO: 33101 - DNA, 1059 bp, Glycine max
  Peptide Sequence Number=SeqID_149879
atggctgctcaaaacaactcgtttattacttctccttttcctaattccatttctcacaagcttgattatttgaccttcctgctatggcgccaacaggttgaacctgttatcaaatctcatcgtcttcagtattttgtggcaaatccacaaattccacttctatttctcactaaagcagattgcacagctggaattgaaaatcctgcatatgaagcttgtgaacaacaggatcaagttcttattagatggcttcaatcgacgctttcaacttcgattttatcttgtgttttgggatgtgttaattcttatgaacgcctccctgttgttaggctgttagtccttgctaatagcacctccctcctccttgctgttaattgtctgtactcagttcggagaatatctggtgatagagttccgattcatcatgaggagtatgttgatgtgttgcttgaaggacttctgttcgattatgcgtcgatgatctcattcattgaaagcaagaagcgtacaccgtcaattgtggagattgaagccttactttacggctattcgcactccaattcgtacaaatctagagattctggtagttctcaaggagggtatggccacgacgatggtagtcgtggtggttttgctaatcgtggtgccgaccgtcatagtgatggctctggcagaggtctcatgagttttcagcctcatgaatcactcactttctttgatccagcaaaacagcaaccaattccctacttgtctggttctgtcggaacctccaatacttggattaatcccaattccaagtctggaactgttgctccagcatcatgcttactaattcctcttctcatggaaatggacatgctagctccacctggattccagattctggaaaatgttgatggctttatcaacaagttcaaagcaaggttgttagctaagggtttccatcaagtccatggtttcgattttcatgagacattatcccccgtgctggatatgaacaatgcctttctaaatgggattcttgaggagtcagtatttatgacacaacctcctggttga

SEQ ID NO: 33102 - DNA, 288 bp, Glycine max
  Peptide Sequence Number=SeqID_149880
atggtgggtgccctaattagacctgaaatcaactttgccgtcaataaagtctgtcagtttatggataaacctctagactctcattgggcaatggttaagaggattttaagtcatactacacatatggagattgatgtcttcttcattaggcaaaaggttttggccaaacaactttttatcttgcacattccagctcttgatcaatgggcagatgtgctgaccaagcctctttcttcagctcgatttgaatttcttaggggcaaacacaatgtgaagagttttttgtga

SEQ ID NO: 33103 - DNA, 573 bp, Glycine max
  Peptide Sequence Number=SeqID_149881
atggaaggtaatgtaaatattttggaaatcccaaaaattgagggatatcatcttgtaggcatatcaatgagggtggttgtggtggagctcgtgggagagggtgtggcagatttgctgatgttcagtgtcagatttgtcgcaaatttgggcacgaagcctctcattgctggtacagaaatgatgcaagctactcctccaagccctctcaaccaaatcccaaacacttcatcaaacagctggtatccagattctggagcatctcaccatgtttcccgaaacattcagcaagtcactccttttgagggtccagaccaaattaccattggtaatggtcaagggcttcctattgattcctcgggttattcaaaatttgcttcccctcttaatcccaatgtttctcttcgtcttacaaatttgctccagcctttgcagaagcctgctgcttgtgtttccaagtcttcagttaatactgttgtctctaattcttctgtcaatgtggcttccacatctagtctaggaggagactcaaaatttgagtgtgtagacttagaggaagtggaagaggaactttga

SEQ ID NO: 33104 - DNA, 356 bp, Glycine max
  Peptide Sequence Number=SeqID_149882
atggcttccgctgctcctcctccccctcctccgccagggaacagtggctctctgttaggttcttcggcggttatcactgcaaaggagttttcgcactccatttcacaggaacttaacaattccaattatctcctttggtgtcaacagcttgaacctgttctcaaagaacatcgtctttttcatcttgtcactaaaccgcatattccacctcaatatctcaccattgccgatcatgatgctggtgttgtttcatctgagtttttgctttgggagcaaaggatcagttccttttgccgtggcttcaatccactatttctggtgaggtgcttggggcttgtcggttgcaaaactgcatg

SEQ ID NO: 33105 - DNA, 1044 bp, Glycine max
  Peptide Sequence Number=SeqID_149883
atgtggtttctgagttattgcagtctaatttcacaggatcgactacctgaagctcgtgttgtttattgctcagcaactggagcatctgaacctcgcaatatgggttatatggttcgacttggtctttggggagatgggacttcattcattgatttccgtgaatttctaggagctcttgacagagggggtgttggagctcttgaattagttgccatggacatgaaagcaaggggtatgtatttatgtcggactcttagctatgagggtgcagagtttgaagttatcgaggcaccattagaagataaaatgatgcgtttctttagacacatgtgtatgtctgctaaagtccctgctgctgtgagactagcgcataaagcattagttgaagaaaaatgtgtagtcattggtcttcagagtactggagaagcaaggacagaggaagctgtgacaaaatatggttctgaacttgatgactttgtttctggacctcgagaattactgcttaaatttgtggaagaaaattacccattaccggaaaaacctgaacttctcccaggagaggatggggtaaaagaacttcaacggaagaggcattctgcaactcctggtgtttcagtaaaaggaagggttagaaaagtagccaagtggcaacctcctagtgatgctgaaagtgatgaagaatctgaatctgactctggcattgaatctactgactctgatgatgagtttcaaatatgtgaaatttgcactacagaggaggaaaggaaaaaattgctacagtgttcctgctgcggtaaattagtccattccacatgcctgatgccaccaattggtgatatagttcctgaagagtggtcatgccatttgtgtaaggagaaaacagatgaatatcttcaagctagacaggcctacatagccgaacttcagaagaggtatgatgcagccttggaacgaaagacaaaaatattagagataattcgttctttggatcttccaaataatcctttggatgatattgttgaccaggtagtgaacattgcttga

SEQ ID NO: 33106 - DNA, 162 bp, Glycine max
  Peptide Sequence Number=SeqID_149884
atgaggctaggttggcaagacaataatgatgttgtgttgaagacatgggtcttcagtcctaagaggacgtggatgactatagagtggtacccaaaggctgctagttggcttgatgttccttatggtgtggtgctgagttgtacatgtgatagatttcactaa

SEQ ID NO: 33107 - DNA, 306 bp, Glycine max
  Peptide Sequence Number=SeqID_149885
atggctagaaggaaacattattcgtccattaatggctcccttggagctgcccttctgaacctattaagacttatggagtggcatgagaggagtgtcatcagtgaattatcttctgatgaggaagaggctagatcttctttgtttcctgtgaatgaaattgcctattctttgtcaccaatctttgggttggcctttgcccattctttgtcaccaatctttgggtttgccttgatagtccttatcttgacaatggaagaacagacgctagaggttcagctacagattgagccttctttgctttcttag

SEQ ID NO: 33108 - DNA, 198 bp, Glycine max
  Peptide Sequence Number=SeqID_149886
atgtttgcttatagtcctttcgctaagtgcaagcctcgtgctaagcgcatctttggtcatgcgctaagcggagagtatctagcgcttagcgctcaacccttgcacctcaagctgatttggtctgctaagctagccaaggttgagcgaagcccatttcaattcgatctgaatctggctaagcgatggcctgctagctaa

SEQ ID NO: 33109 - DNA, 307 bp, Glycine max
  Peptide Sequence Number=SeqID_149887
cctcacatttgagtgcctgagcctggccattaacttggcctacatcaggaagaactgttggaacattgatgatctaacagttgctttccaggggactaggagggcgaggccaacgaatattccatcttcttctacagctccagcacatactccaacatctacttttgcagctccttcaattccagctcatgttgactcgcagcgctttgaagctatgcttcaaagtgatagctcctccaggatccatcctatcagtggagcagtttttagagagggtagcctagcctgggacccaaccttctcttga

SEQ ID NO: 33110 - DNA, 213 bp, Glycine max
  Peptide Sequence Number=SeqID_149888
atgaaacatagggagttaataaaaaatgacctctatgctcagaacgacctttctttcagacgaagagttgttctgaatcctttgactccatctgtattgcctattgtcgcaacctacccttttgcgggcgagcaaggcgaggctcacggtcgacaaaagcgaggctcttgctcctacgtaccctccatcgaagaggaaatcagacctgcatag

SEQ ID NO: 33111 - DNA, 300 bp, Glycine max
  Peptide Sequence Number=SeqID_149889
atgggtgctggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgagaagtccactgaaccttatcatttag

SEQ ID NO: 33112 - DNA, 1146 bp, Glycine max
  Peptide Sequence Number=SeqID_149890
atgggacatacttttcaaaatccgtcctacaccacctcttatttctcggaagttaccgtcaatattcctgcgtatctcatcaaattaaagcttggcaaaggcgagtactatagcgagaacaccagaaaacgggatgaaatcaagaaatttgttgaacgcgatgatttaaaagacttcacgcgcccgaccagtaataacgatactaatctatggattcagctgggcatgtttatacagctgtattgggcatacggcgatgattttttcccacgccttaatcaacgctaccgtgcttatcgtccagccgtaacaaatgataatgaagagatccaaacctttatgctttatgcttcgatggttgctgaaagaaacctcacccgatttttcaataaatgggggctttatccagaggatactatacagcgtgaaatgattaagtatcctgagcctgctgtgcctatctgggagaacatctacaacggttttaatgttgatcagcatgtcgccccttattctccgccacaggctactataaagaaaaacaccatcgaatatgtcattggcagtcacctttcccaacaagagatttctgattacttagagaatctttcgggagttcatccgccaattaaaacaacatggataaaagatgacaacatggaagatgatggcagaacttttgctgaacaagtctcaggtaccccttttgaggatggaaacatattaaagttaagcgtctatgctaaaggaacctatactgtatacagtgatagctcggtcattcttccgcgtaatgagtccgataacctggactttttcctgatatcagagcggaaatttaaacgtttgcttccagaggatcgactccccaaagcgacgcctgtacctgccagcacggatatagggatgcccattagtgctgaaacattattgcgcgaccacgtttcgaagcacctctgtcaatacggtacaacagagctattgcactgcgctcttattttaacagtcaagaacgtatcattttacgttttgatgttcgagccaaagcgatggcggcctttgccgatccaaaatggcagggaccacttgattctggcaaaggactatgctttgaatttattttgtatagccctgacaagactctga

SEQ ID NO: 33113 - DNA, 339 bp, Glycine max
  Peptide Sequence Number=SeqID_149891
atggcgatcgtgatcgcgcacaaaacagacgcagccggcgctgagcgcctgcggctgaccattaaatacgtggatgcccgagccctgttccaccagcacaatttcatgaaaatcatggtgatgctccggaaacgccgactgcggcacacgtggctcaatggctatcgtgcaaggctcacaactctgccgttatgcggttctgtgagctcactcacgaacacctttgcaaacctgccagcggtgatgacccgctggcactcgcgggaaggtgtctgcggcgcaggatttctactctgtcgccatgtcttcacagggagtactcgccatgagtctgcgtaa

SEQ ID NO: 33114 - DNA, 453 bp, Glycine max
  Peptide Sequence Number=SeqID_149892
atggtgcaggagatccagaacgcatgcgccgaacaggcgatgcccgtgccgcacagcccggcggcactggcgcgcaccatctttgacagcctggcgctgctctattcgcagacgctgcaggagcttagccacctgcgcggcactgcgctgcgtcagttacatatcgtcggtggtggctgccagaatccgctgcttaaccagctgtgcgccgatgcctgccagctgccggtgtttgccggcccggtggaagcctcgacgctgggcaacatcggctgccagctgatcgcgctgggtgagttgcgcgacgtggccgatttacgccgctgcattcgccacaatttcccgttagaaaaatttatcccgctgaatcacagcgtctttgcggcccatcaggctcgctttgcggcgctgagcctacctgctaaggaacttgcatatgacaaagctgattga

SEQ ID NO: 33115 - DNA, 260 bp, Glycine max
  Peptide Sequence Number=SeqID_149893
ggtacgcagcgacaaacagaagcgatcggccagcgcttcccacgcaatctcctcactgtagtgcgcattcagccagtccagcaagcggtgcaggcgggcatcctggtcctgcgcctgatcgttgtgcgccgcctcgcgcagcagcaccagcagctgcaaaaagtgctgttcctgctgcgcctgacgttccagcgaccagctggccggctgcttcatctgcgtcaccagctgcagcgcctgcgccatcactttatggttga

SEQ ID NO: 33116 - DNA, 426 bp, Glycine max
  Peptide Sequence Number=SeqID_149894
atgaccacttggacccagatgtggatgacattgttgctcaagcaacgtcctgcccaagcgatcataactcggacctccctctgccgaagtgtcagctggtgtatgccacctaccaggcaccctctagaccaagataagtctaacagggccatggggtttccagcgttgatcacgggtctctgccagacattcggggttcccgtcacacctagagaggcgcagggtgatgcaccgcaggccgcagacacaccgccagaacctcatcaggccgatccagctgggtcatttgacatggagcgggttgagtttgcatggcccggagattggcctgaggcccaggcaggggaggtgcccgtagaggctctcgacgatgccgaggaggcccgcatggatgaggagatgacagatttactcggtttcttgtga

SEQ ID NO: 33117 - DNA, 931 bp, Glycine max
  Peptide Sequence Number=SeqID_149895
gcttcgatcaggtagaagctcagctgtgcgcgatggccggcgttgaacgcatcgagcaggtcatcgcgcggttggatgacccggcccagcgccaggtgctgcaggacctgcagcaggcccgctggggcgggcagggtgatctggcgccgctgcgcacgcgcctgcgcgaggtcttccgtgacggaccgcactggtcggcggcggcgatcaccgctgacactggcctggcgccgcttgcattcatttttcgaggaaacccgcgcatgacagcagctgctgccgacaagaagaagttgcccctgcattggaagatgggcatcggctttgcgatcggcctgatcctgggactgatcgtgcacgccctgggtggcagcgtcgatggtctgcaggccggtgccaagtgggtaatggactacatcaccaccccggcgtcgggcctgttcctcaacctgatcttcatgctgatcgtgccgctgatcttctcggcgctgatcatgggcgtgtcggagatgggcgacatccgcgccctcggccgcatcggctggaagaccctggcgtataccgtgctgctgtccggcattgccgtgggcatcggcctggtgctggtcaacctgctcaagccgggcgcgggcgtcgatccgcaggtcgccgcgatgatgctgtcggagaacgccgagcgcagcaaggaaatcgttgctggcatccatggcacgccgaagggcatggacatgctgctgtcgatcgtgccgagcaacgtgctgcaggcggcgtctgacaacggcgcgatcctgtcgctgatgttcttcgcgctgatgtttggcatcggcatggtgctgaccgacaacgagaaggtcgccccgctgcgccgcgccatcgaaggcgtgttcgaaatctcgatgaccctgatcaacctggtcatccgcctggcccc

SEQ ID NO: 33118 - DNA, 141 bp, Glycine max
  Peptide Sequence Number=SeqID_149896
atggtttctctggatcctattgaatttcattccgaagaggaaccttataaagatcgtattgattcttatcaaagaaaaacgggattaactgaggctgttcaaacagtttatggggggcagtatgggatccgcagtaggtga

SEQ ID NO: 33119 - DNA, 315 bp, Glycine max
  Peptide Sequence Number=SeqID_149897
atgtaccctcccttgttctctttgaacaacctagtggatgtatccttcactagaactgatccacaagagatgtaccctctcttgttctcagtcacaacaacccaagtagatgtaccctctacttgtaccacaaaggatgtaccctccaatgtgttaagacaaagttctcaggcggttaaacctttgaaactttgtgaatggggatacaaaagaattctcatgcgggagaagggagacacaaaagaattcaggcagttagtccttcttcttttggaaaagggagaagagagacacaaaaagaattcaggcggttag

SEQ ID NO: 33120 - DNA, 300 bp, Glycine max
  Peptide Sequence Number=SeqID_149898
catagacaggcacagggtggcgacccgcaggccccagacgcaccgccgccacctcatcaggctgatccaactgggtcatttgacacagagcggtatttacggcatttgagccagggttttgcttcttgtccatgccctactccgaatcagttcagggcagaggtcgcatggcccgaagattggcctgaggcccaagtaggggaggcgtccgcagaggctcccggcgatgcagatgaggcccgcatggacgaggagatgacagatttactcgatttcttgggagggagtggagccacatga

SEQ ID NO: 33121 - DNA, 153 bp, Glycine max
  Peptide Sequence Number=SeqID_149899
atggtatgcactcatcaagatgagggtgggctagcttatagctattcagaatggagcaactggggtgatgcggaagccacccgggtagggcttatcaagcggtctagatcatatccacctcatccaaaagcgggtatgtattggctgtactga

SEQ ID NO: 33122 - DNA, 111 bp, Glycine max
  Peptide Sequence Number=SeqID_149900
atggtttgccactctttccttctcccacatgacgttgtcactgctttcctctcccatgcaacattgttgcttcccttgatcacgaagaaggtattacgtaacatgttatga

SEQ ID NO: 33123 - DNA, 2289 bp, Glycine max
  Peptide Sequence Number=SeqID_149901
atgattgtgaatgagcattctgttggtactgaactggcaatgaataatgctagtgtggaggaggaaatagatttctcttgtgacccatacatagggttagaatttgatacagcagacgaagcacttaagttttacacttcatatgccaatcgaacagggtttaaagttcggattggtcagctttatcgatcaagaactgatgggtcagtttcttctcgaagatttgtgtgctcgaaggagggacatcaactcagttcaagaacagactgtccagcattcataagggtgcaaataaatggttctggaaagtgggtggttgatcattttcacaaggaccataatcacaatcttgaaatcagtggtgaaaattgctctccaacgttgcaacagaagggtgctggtgctacggttatcaactctcttactgagtttcctcgcaggccaaggaggaaattgcttgaagaagccaatgatgagtcctcttgtcccttcggcattattgatttcaagcgtctgagaaaggaagaacttgaagggcagtccaggactgaaccatatgtgggtcaagagttcatttcacctgacgaagcctaccaattttatcatgcatatgcagcgcatttgggttttggagttcgaatcggtcaattgtttcgttctaagaatgatgggttgatcacatcccgcagatttgtttgctctaaagaggggttccagcaccctttaagagttggctgtggggcttatttaaggattaagagacagccatcgggaaagtggacagtggaccgcctccgaaaagatcataaccatgatctggactctgaaaaggagggcagggcaaaaagtcttcctgcttctaatattttggctgaagaggtagatactggattggtaaattatgacttatttagaagagataactaccctgtccctagaggaggtaggcaaaatcacattagaagtgagtggtatggcattcttttagaatattttcaatcaagacaagcagaagatactggattcttttatgctgtggaagttgactatggtaattgcatgaacatattttgggcagatggaagatctagatattcatgtagtcagtttggtgatgtccttgtcttagacacatcataccgaaaaactgtctatttggtaccatttgctacttttgttggagtcaaccatcacaagcaacctgtgcttcttggatgtgctctaattgctgatgagtctgaagaatctttcacttggttgtttcagacatggctcagggcaatgtctggccggctgcctctgacagttatcgcagatcaagacattgcaatccagagggcaatagcaaaagtctttcctgtaacccatcatcgcttttctttgtggcaaattaaggcaaaggaacaagagaacatgggtctgatgggtaatgacttcacaaaagattacgaaaattgtgtttaccagagtcagacagttgatgaatttgatgccacatggaatgtcgtactcaacaaatatggattgaaggacaatgcttggctaaaagaaatgtatgagaagcgtgaatcttgggttccattatatttaaagggcacattttttgctggcattcccatgaatgaaagccttgattcattctttggtgcacttttaaatgcccagacacctctcatggagttcattcctcgatatgaaagaggtctcgagcaacgccgtgaagaagaaagaaaagaggattttaatacttctaattttcaaccgattttgcaaactaaagaaccagtggaagaacaatttagaaagctttacactcttactgttttcaaaatatttcaaaaagagcttttgcagtgctttagctatcttgggtttaaaatatttgaggaagggggactgagcagatatatggtgcgtagatgtggaaatgatatggagaagcatgtagttacatttaatgcatcaaatatcagcattagttgtagctgtcagatgtttgaatatgaaggtgttctttgtagacacgtgttgagggttttccagatattgcaattaagagaagttccttgtcgctacatcttacaccgatggacaagaaataccgaggatggtgtttttcctgacatggaatcatggagtagctctcaggaactaaaaaatttgatgctatggagtctaagagaaactgcatctaaatacatagatgctggtgcaacatccattgaaaagtataaacttgcctatgaaattttgcgcgagggtgggagaaagctttgttggcacaggtga

SEQ ID NO: 33124 - DNA, 1224 bp, Glycine max
  Peptide Sequence Number=SeqID_149902
atgtcacccacagataaggaaaggcgcgattcgattcaattcgatgcgaggccacgattggatcaacacgctgatccccgacgagctactcatcgagatcttccgccgcctggactcgaagtcgagccgcgacgccggctccctcgtctgcacgcggtggctccgcctcgagcgcttcacacgcgccgccatctcctcgccgcgcgtttctccaacgtcaccaccgttcacatcgatgagcgcctctctgtttcaatccccgctcacctcgggagaagacgcgcgagcggcaattcctcggtgaagctgcactacgtgaatgataaacacggctctgcctctgaccagagcgatttggattcactctgtatatctgattcaggtttgactgctctcgccgaaggctttcccaagctcgagaagctgaggttaatattctgttcaaacgtcactagcgaggggttgtcatcgctagcaaggaaatgcacttctttgaaatccttagacatgcaggcatttggttgctatgttggagatcaaggtctggctgctgttggacagtgttgcaaacaacttgaagatctgaatctgcgtttctgtgaaggcttgaatgatattggtttggttgaattagcattgggtgtgggaaatgcattaaaatctcttggagtagcagcttgtgccaaaataactgacgtttcaatggaagttgtgggatcacactgcagatcccttgagaccttgtcattggactctgagttcatccataataaaggggtgctttctgtgattaaaggatgccctcatttgaaagttctaaagctgcaatgtattaatcttacagatgatgttctgaaagttgtaggcgctagtgacaagggtttggaagaaattgctactggctgcaaggaacttactcatcttgaagtgaatggatgccacaatattggagctttggggcaagaatcagttggaaaatcttgccaaattggtgatgctggccttctccaggttggacagggatgcaaattcttgcaagcgcttcacttggtagattgctcaaacattggaaatgaagccatgtgtggcatagctattggctgtaggaatctaaagaaactttatatccgtctctgttataaggtattgtctgcatttcacgtttggttttctgtgagaaaacgccattctgtatgtgtaattccatttttggcttcaaattga

SEQ ID NO: 33125 - DNA, 1089 bp, Glycine max
  Peptide Sequence Number=SeqID_149903
ggttacctccaccgcataggcttcaccaggaagagagaaaggctcatcaacccaatggaccgaacctcaccactgccaccatcttcggttcagaaacaacaaggcatgtcagagtcacttccactaccctttctccctgatgaactcgttgttgaaattctctcgaggctcccagtgaagtctctgttgcagttcagcacccacttcacccatcacaggatcatattgagtgccacaaccgctgagtttcacctcaaatcatgttctctgagttccttgttcaacaacctttcaaccgtttgtgatgaacttaactaccctgtgaagaacaagtttcgccacgatgggattgttggctcttgtaatgggttgttatgttttgccataaagggtgattgtgtgcttctttggaacccctccatcagggtctccaaaaaatcaccacctttggggaataattggaggccagggtgtttcactgcctttggccttggctatgatcatgttaatgaggattacaaggtggtggctgtgttttgtgaccctagtgagtattttattgagtgtaaagtgaaggtgtatagcatggccaccaattcatggaggaagattcaggatttccctcatggtttctcaccctttcaaaattcaggaaaatttgtgagcggcactctcaattgggctgctaatcattctattggttcaagttccttgtgggttattgtttccttggatcttcataaggaaacatatagggaagttctgccacctgattatgaaaaggaagactgttccacccctggtttgggtgttttacaaggatgtctttgcatgaattatgattacaagaaaactcattttgttgtgtggatgatgaaggattatggagcgagagagtcttgggtgaaattggtgagcattccttatgtgcctaatcctgaaaatttttcgtactcagggccttattacatttcagagaatggtgaagtgctgttgatgtttgagtttgacttgattctgtataacccaagagataactcgtttaagtatcctaagattgagagtggtaagggctggtttgatgcagag

SEQ ID NO: 33126 - DNA, 1053 bp, Glycine max
  Peptide Sequence Number=SeqID_149904
agtttatgtatgcttgcttgttgggtggaagatccaaatggggatgctttcaagaagcatcttgcacggattccagattatttttgggtttcagaagatggaatgatcgtgcagcccgtaattggtagtcaagcatgggatataagcttcattgttcaagctctacttgctacagatctaattgaggaatttggtcccacacttgcgaaagcacatgacttcatcaagaaatctcagctcacagacaatcttccaggagattttaagagtatgtatcgtcatatttctaaaggagcatggaccttttctcacaaagacgatggatggcaactttctgattccactgcagaatgtttaaagtgttgtctgcttttatcaatgatgccacaagagattgtgggggaaaaaatggaacctgaaaaattatatgattccgtcgatttcatattgtcacttcaacgactaaatcccacggaattttatgctgacttaataattgagaatgactatgttgaatgcacaggatcggcaattcaaagtttagtgtttttcaaaagtctatatccagagtataggaagaaagagatagagaatttcattaacaaagcagtacaattccttgaagatgaacaatcaactgatggttcttggtctggtaagtggggagtttactccacttattcttcctggtttgcacttcgaggtctagctgcagctggcaagacttatacaaattgtgttaccattcgcaaagctgtgaaatttctactttcaatacagactgaagatggtggttggggagagagttatctttcaggcgcaaaaaatacgtacgtacctcttgaaggaaatcgatcaaatgtcgtacaaacagcttgggctctaatggctctaattcatgctgggcaggctgagaaagatccaactcctattcacaatgcagcaaagttactcatcaattctcagcttgaagatggtgattggcctcaacaggtacctctcaaatctcgatccttgataatacagttgttactaatgtgtatgctttgttaa

SEQ ID NO: 33127 - DNA, 346 bp, Glycine max
  Peptide Sequence Number=SeqID_149905
atgtggaattttagaattcttcctgcacttgttcctctctctgaatgtcctcacgctctcgctgtcttgctctctcaacctcgagcactctctctcactggaaagtgtttcgtgctattcagaagcttgggaaaggcttctcctgagttttgtgtaaagaatttggctcaatgggtagtgttaggtcgatatgctcctgtcttcaaaattcacaaggttgatgatgaggttttgcccttgttaatgctagaggatctcaaggatgtggggataaatgctgttgggtcgagaaggaaaatatgttttgtccaattcaaaagcttgggaagggcttctcctgagttgg

SEQ ID NO: 33128 - DNA, 1173 bp, Glycine max
  Peptide Sequence Number=SeqID_149906
atggcggcaggtagtgacggggtggacataaacgacgccgcttcgcccaaaacaaccaccagcaagagggggcgattcaccacctccaccgaatcacgccgacaaaccctaacatcatcttcttcacacactcacacccttcctatcgagctcatccaggaaatcctccagcggctccctgtgaaattccttttacaacttcgatgcgtatgtaagtcctggaaatccctaatttcacatccccaattcgctaagaaccaccttcacagctcaccaacggccacccgcctcatcgcgggattcacgaatccggcgcgcgaattcattctccgagcttaccctctctcggacgttttcaatgccgttgccgttaacgcaacagagctcaggtaccctttcaacaaccgaaagtgttatgatttcatcgttggctcctgtgacggcattctctgtttcgcggttgatcaacgccgtgctcttttatggaacccttccattgggaaattcaagaaattgccgcctctggataatgaacggcgcaacggtagttatacgatacatggcttcggttatgatcgttttgctgatagttacaaggtggtggcaattttttgctatgaatgtgatggccgatacgaaactcaagtgaaggttctcacgctgggtaccgattcgtggaggaggattcaggagtttccttctgggcttccttttgatgaatcggggaaattcgttagtggcactgttaattggttggcatcaaatgattcaagttcccttattattgtttctctcgatttgcataaggagtcttatgaagaggttttgcagccttattatggagtggcagtggttaacttgactttgggtgtgttgagggattgcttgtgtgttctttctcacgccgacacgtttttggatgtttggctcatgaaggattatggaaataaagagtcttggaccaaattgtttagagttccttacatgggaatttctgactcttatctgtataccaaggcactttgtatttctgaggatgaccaagtgttgatggaattcaactcagagttagctgtttataattcaagaaatggcacttctaaaatccccgatattcaagacatctacatgtatatgaccccagagatgctatactatgtcactggtgcatga

SEQ ID NO: 33129 - DNA, 213 bp, Glycine max
  Peptide Sequence Number=SeqID_149907
atgcctaaatcatctcccaacatgcatgtgaagcaagaagtatcaactagagtcaagccaaggctattgtgcaagcaatcaatggggcaaaacacaccgaataaaatagatgatgatggctcaaattctcaccaaggagaaaacaagggtttcaattcacaaaatgcaaagagactcctatttcaaaaacaattacccattacctatacataa

SEQ ID NO: 33130 - DNA, 776 bp, Glycine max
  Peptide Sequence Number=SeqID_149908
gtggacccttgggtactagtaccctcaccttcggaggactacacgtcctcccctccagaggactacatgtcgtcgcctttagagaactacacatcctcgccttcatagggctacacgccctcaccttcagcggactagacgtcctcgccttcagagggctacacgccctcaccttcagagggctgcatgccctcgccttcagaggactacacgtcctcaccttcagagggctacacgccctcgccttcagaggactacacgtcctcgccatcaaagggctacaggccctcaccttcagaggactacacattctcacctttagaggactgcacgtcctcaccttcagaggactgcacatcctaaccttcagggactacacgtcatcgtcgttagaggactgcacgtcctcgccttcagagggctgcacaccctcgccttcagagggttgcacaccctcaccttcagaggattacacgtcctcgccatcagagggctgcacgccctcacctttaaaggactacacgtcctcatcttcagagggctacacgctctcaccttcagaggactacacgtcctcgccatcagagggctgcacgccctcaccttcagaggactacacgtcctcaccttcagaggactacacgtcctcgccatcagagggctacacgccctcaccttcagaggactacacgtcctcaccttcagaggactacacgtccttgcctttagagggctacgcgtcctcattttcagtgggctctattgccacaccttaa

SEQ ID NO: 33131 - DNA, 480 bp, Glycine max
  Peptide Sequence Number=SeqID_149909
atgaaccacttcttccggaaagttcctggaagaggttttccgggagtcttccggaagaagtgttcttccggaagacgtttggttacttccggaagaacacttcttccggaaactttccggaaaatgttcttccggaacttccggaagaaccccttacgggtcttccggaagacttctccgtcagccttttccgccattttttccggcgtactctcgtcttctcccctctcgtcttctaccctaagtgatgcacattacaagctaagggtaaggggaaggggaactaacatgttcgcggagaagaagaagaaagccttggcgcgcctcgcggagaagaagcttcacggagaagagaagaagaagcaggttccgagagaagaagaagctgttccgggagagaagaagaagctgtgttccgggagagaagaagaagctgttcgaaaaaaagtcttccggaaattacattcgcgctttttataa

SEQ ID NO: 33132 - DNA, 447 bp, Glycine max
  Peptide Sequence Number=SeqID_149910
atgcataagacattgcgatcaaatgctccactcccacatccccatctgatcaccttgtttctacaacattttaatgtccctcttgactctaagccctttgtcaaagtcaagagatccttctctatcggtgtgaatgtagtctcctctttcggataccgcaaagagagggatggctcttgggtgaagaaggatgctccagtacaggctgctgaagaccgctctccatcaccacattctcagagagatgactcttcctctcttatgcacaacattcttgacaagttggatggactccacaccttcataggtgaacgctttgactcattggatagccgtattgatgccatggatgcacgatttgcagcgatggacacacgtatcaccaaacttgaggaggatgttacttatgttcgccagtgctttgaccttccaccaccatcctcatag

SEQ ID NO: 33133 - DNA, 183 bp, Glycine max
  Peptide Sequence Number=SeqID_149911
atgccttcatttacctttcaaaagatttcaatgtctttattaagcgcgcttagcacaacagaagaatctggcagagcatcaatatcaaggctgcacgctaagcgcgagatcagtgcgctaagcgcaatagttgtcttcagccaggctcagcgcacgactggcgctaagctcaaatccacttaa

SEQ ID NO: 33134 - DNA, 210 bp, Glycine max
  Peptide Sequence Number=SeqID_149912
atggatcaaatgaaaagaggaggaggaagcgttatcatatgcgatgagatgcgcgaggcgaagagtgcatgcatgcgctatttcaaaggcgtgtggggcagagattgtgggagttcaaaggatttagcggctttggttgtggtgcaagatgagaatgaggatgttgcaaagaaccgcggtgaaggggttggttttaaaaattttggttaa

SEQ ID NO: 33135 - DNA, 378 bp, Glycine max
  Peptide Sequence Number=SeqID_149913
atgtgcaaggagttttttgagttaatgaagggtgaatttgaaatgtgtatgatgggtgagctaaatttcttcctaggacttcaaatcattcagaaaggtgatgggatctttatccatcaagagaaatatgtaaaggaccttctaaaaaggttcataatggatgaagccaaacctatggcaacccatatgcatccttccacagtcattgtcaaggatgagaaaggtaatgatacttcagaaaaagagtacaaagcatattgtgatgctgattttgttggtgataaagttgaaaaaaagagcaccagtggtgcctgtcaattccttggagaatcactagtatcttggacatccaagaagcaaagcacaattgccctatga

SEQ ID NO: 33136 - DNA, 384 bp, Glycine max
  Peptide Sequence Number=SeqID_149914
atggtccaacctgtcgccgctatcgttgccgcagtcacaatggttgaccatgcaacccgtaaaactacgaccgacaggcgcaaagatgcaatcacttgtctatccagtagccaagcttctcttatcgacaaacattccgatctcgtcgacaaatattctgaactctccggcaaagtagatttcatcctcaatcacctccatctacggtcacctaatcatcatcaccccaattccagtacccaagtccaccagtgcaactccgtcatgttggacatcccaagattcgatggacacgatcccttagggttgcctcctccgttcctcctaagttgcttcatttccggtttgacgccggaaatccactgggaagtattagcactctag

SEQ ID NO: 33137 - DNA, 2287 bp, Glycine max
  Peptide Sequence Number=SeqID_149915
atgaatcaaacttcacgcagacgtagtaaatgggccgaatccaatctcgacaccccaaccatcgaagctttactcaaacagttccaacacctcttccaaactccgaccaacctaccacctccgcgaggagtagtccattggataaaccttttaccttcaactgccccggtgaatgtatggccgtatcgctattttcatttccagaaaaccgaaatagaaaagcagatttccgatcttatctccgctggtcttatacggccaagtacgagcccctactcgtccccgattctcttagtgaagaagaaagacggtacgtggagaatgtgcatggattatcgcgccttgaactcagtcactgttcgagacctatttccgattccgacgatcgacgagttgctcgatgagttaggccacacttcgtggttctccaagttggaccttcgacagggtttccaccaaatccttatgcacgaacctgacatagagaagatggcgttcataacacatcaaggacactatcaataccgcgttatgccattcgacctgtgcaacgtgccctctacctttcaggccgccatgaacagcctcttaaccccgttcctgtgccagtttgccgttgtgttcttcgatgatattttggtgtatagtgattctttatcatctcacatcaaacatttggatgcaatctttcaagcgttgttacaagggcaattctacctcaaacgagccaaatgtttatttgcacaaagtcaagtggaatacttaggccacgttgtatcaggcaagggtgtcgagcctgaaccatccaaggttcgagccatagtgcaatggcctacgccaacttctaccaaggaacttagagcgttcctgggactcattgggttttatcagaagttcgttaagaactatgcttccatcgcagcccctcttactacactactgtgcaaagatgctttcgtatggattgaagcatctcaggccgcctttgatcagctcaaaatagcaatgaatagtgcactaatcttagccctacccaattttgtagaacctttcattgtcgaaacagacgcttcaggcataaccatgggggcggtcctagcacaacaaggtcaccccatagcattctttagcaaaacctttgggcctcgtctccttcatgcttcaacttacataagagagctccacgccattgtcactactgtaaggaaatggcgccaatacctccttagacgttcgttcaccatcttgaccgaccacaagagcttccgagaactaatgtcacaggtcattcagaccccagagcaatactactacctatctaaattgttagggttcgactacacaattcaatataaacccagtgcttctaacatcatcgttgacgctctctctcgcgtgccatcaaagtcgcacgggcaattactcttgctctcaataccccacttcgacttcatcgatgacctacgacgcatgttgcatgctaactcagactttcaagctcaattatccaaggtttgctccaacccttctgattaccgtgactacaacatccacaatgacctgctattattccaaggctgtatatggttgaacaagaacaacccatatattcccactctcttatttgagttccacggtacacccttgggcggtcatctgggcgtctcaagcactcgtcggccggcaagacttctgcaaccgttatcgatcccaaatggggtatgggaggatttgtttatggattttatcacccaccttccgcagtcccagggatttacagtcattctcatcgttgtggatagatactccaagggcatacactttggagccctacccacaagctactccgccttcaagtggcactcgtttatgcatgagtacaacatatcacccatagaccaatggccaaaccgaggtgatgaatcgcctattggagcagtacctgcggtcgttcatcctttcacagctgcaatgaagaagcatgttgataccaagcgtaaggatgttactttcaccattggacagtgggtttatgttaaactcaggccatttcgtcaatgttccgtcgccggattaactcacccaaagctttcaaagagattctttggacctttccagatcaccgatcgcatatcggctccatctaccaaacatggcgcacatccatccagtatttcactattccctcttgcgtgcacatcacagttcgatgactctacatcacctccaacccgtttggtccttacccaatgggtcaacctccagaagatacaacttgagaaccatg

SEQ ID NO: 33138 - DNA, 441 bp, Glycine max
  Peptide Sequence Number=SeqID_149916
atgggaattcctctcccgtcttacgttgtagttgcatgtgatgccacgagagctcgcaatgagcatgaggtcaagcttgtggttgatcatcttagaagcaggggtgacattctctctgaaagtgatagcttgctagtgttctgtgccttgcacaaggttgctcaccctatggggtaccagacattagcatgcccggagtccttcgctggcaccaatattcgtgcaatggaggaggaagttaacagaaaagctgcagcatataaaagtgtgcttctgccgacttatgaagaacgtgaaaataaagggctaacgttgtggtgtcattctaaagacaatatattaatatcttcacttcaagaattcatagggcatggtagcctctttgatgctgcaagaattctgcagaaacttagagcagccagaatagcttttggagcttaa

SEQ ID NO: 33139 - DNA, 594 bp, Glycine max
  Peptide Sequence Number=SeqID_149917
atgactgaacttcatgataagggaggtgtaatcagtcattatcggcacaaattgcttcagccattcaatccccaagactgcattggcaccacttatcggaagcagatggaaggtgaccttggagtgatagagaagtgttcagacatagttggttgcagtcaaggactaagttgttgcctactaacacacaaaggggtaaggaggactgagttgggaggtggaggaattgtgcgatgcgaggatagtgaggcttgcgtggctgatgacgctgaaaaggcgaaaggtttcagtcaaaggaaggccagacaaagcatggaggcttatgtgagggtatttggtatcgggtatgggcttaggatcaatagggggttcaagttttgttgtgatttctgggcttggataatcggttttcgagacatgattatccacgatgaacaagagtactcgacccttgcagtgatggctagcgttccacttttcatcgcaattgtagcaaaggcccttctcgcggcggaagaccatctcatctggagttcgttggacaaatggttgttttggttttgggtttgggttggttgggtgattcgacggtga

SEQ ID NO: 33140 - DNA, 1426 bp, Glycine max
  Peptide Sequence Number=SeqID_149918
gacatgagattctacaggaacaagatatcatgtaaaattgcactggttaaagatgacttgtcggtggatatttggagatcacatcatatacatgaaacagatgtaacagaacaaaagcttatctattctttgtccaagtgtgtttcactatcagattctcatagtattggagatgaggagcaatctgttatcttttgcaaaagctatcctctttccattgcttctgacacctctaatatgtctaagagcagtatgaaacattcaaatgctaacaagttaggggagcatatttcttcaatagattttggatcttcttcaggcagaagcattcaagtagaatataagcatcccattaattctcaaattttgcaaaagcaaaacagatatgacttcttaccaaattcttcagagactccaattctttgtgctggttgcgggacacaaactgcattatacaccaatgagttaaagaggttcagctattctgagatacaacttgcaacaaatgatttttcaaaggataacttattaggtgaaggtggatatggtcacgtttacaagggcatgcttaaagatggacaacaaattgctgctaaagtaaggaaagaagaaagtagacaagggttttctgaattcacttctgaggtttacgtcttgaatttcgctcggcacaagaatatagtaatgcttttgggttactgtttcaaagataggctaaacattttggtatatgagtatatttgcaacaagtctcttgattggcatttagttgataataaaaatgcggctgttcttgagtggcatcaaagatatgtcattgccattggaactgcaaaaggattgcgttttctacatgaggaatgtcgtggaggtcctatcattcatcgtgacatgagaccaagcaatatactcctcactcatgattttgttcccatgctaggtgattttggccttgccaaatggaagactagtgataatactctacacacaaggataatgggcacattaggatacctcgcccctgagtatgctgaagatggtattgtttctgtgggagtggatgtgtatgcttttggcattattttgttacaattaataactggacgcaagccaacttctagtccagagcaacatctttcccttcgacaatgggctgagctcaagattgagaagttggcatttgatgaacttatagattctcgtctaggggattcttataactcaaatgagttatacaccatggccaaggtagcatactactgtgtgcaaagagatcatcagaagcgcccctctattggagaggggattgactctatatcttttgggttgccttctattgagactcctcttatgaaggtgtttacactcttttggatttggctcaactgccaccacctagagtgtttggctaaggaagttcctaggg

SEQ ID NO: 33141 - DNA, 794 bp, Glycine max
  Peptide Sequence Number=SeqID_149919
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggagttgtggccatgggtaggacagctcaagaccataagctggcaaggaaagatcacagaggaaccagtatcctgatctttctctattcagctatttcttcccattggtggaagcccaagagaaacacaagaccagggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 33142 - DNA, 595 bp, Glycine max
  Peptide Sequence Number=SeqID_149920
ggattgcatcatttacaatcccgtcctcgctataagacaacttggttaccctatgagaggggcgccatcagaggaaggcctcatacctttccttacacgaggtttcaatagcaccaatgcgggggtgcttcagagggtccacaaggcatgggaaatgtcgcaaagaaaggacaaggaacttaggtggagtagcaacgggcccatcggcggctaccgtatgtggttgaaagcctacacgcaagatctggattggctcccgagtttgaggaccactaaggggatagagattgaaactccggaagaagacgaagaggaaaacgccaaactgagatacgtcaatatagccaccactaaggccttggagcaagagaccaagatggcccgtagggaagaacatggccagaacaaatttcgaggggctctgtggggcagtaacagcgagcttatgctccggagagaggaacgggaccaatcgcgagtagacggtttgattctgaaggatgaattaagggtttgcctaaggtccaagaggagttttgtctcagcggttatgcgagaccgaaacaaacatgttagccatcatcagcaagtacca

SEQ ID NO: 33143 - DNA, 486 bp, Glycine max
  Peptide Sequence Number=SeqID_149921
atggcgagagatagattgcaagatgttcaagtgaataatatcaagttgaaattgattgctaatcgtgagaaagatggtcgtacatataatgtacctactgttcctgaagttgcagcactaatagtaagcgattttgatgcaaattcaaaaagagatattattattgaaactcagcatggacaactacaaaggatccatgaattacattctagctatctagctctacaataccctttcttatttccttacaaggaagatggatatagacctgatattctacatagcattcaatcagatggtgagaaaaggaaaagaaatcgtcttacaatgaaggagtggttttcttataggctacaatgcagatcaaatgagtctaaaactttgttgaattctaggagactattccaacaatttctagttcccgggtatactatggttgagtcagaaaggctttcttacatcagaaacaaccaaaaaaaactttga

SEQ ID NO: 33144 - DNA, 405 bp, Glycine max
  Peptide Sequence Number=SeqID_149922
atggcccgcacaaagcaaacaggggatatgacgactgaggctgcaaaggaaatcgctgaggaagatcgtaagattcctttgaggagcaggcgacacagggatccttcgtcccctatggatcaccctggacgtgtccgtgctgctggagccggtgtcaccatcaagcattacttcggatcggctccacggacgtcccgcaactcttcctcgctgcctcctgaagaattgcagcagctgctgacccagcaaattagggaccagctagaggagtcgatcacagaaaaagaaactaagacgggtgactcagataggtgcggcttgtacattgaagcagatcctgcatgcctggtaggtgtggaggaggttaaagatccaaatgctccagttcctatacccactgatgag

SEQ ID NO: 33145 - DNA, 249 bp, Glycine max
  Peptide Sequence Number=SeqID_149923
atgaacatttggaccttctacatcggttacaaggcatattctacgtcgggtcctacatcgtctttgaataagaagacccgtctttgtttgttgatgagactacgtggcagtggtggcaacaacacgaggtgtggaggtcaggaaatgcaacaatgtagggttccttttgcggaggtcagggaaacggcacaatgtcagggtggtgagagggacattcaggtgaaacagtcgacgggagctgatacatga

SEQ ID NO: 33146 - DNA, 213 bp, Glycine max
  Peptide Sequence Number=SeqID_149924
atgtcttcattagtaggcatgtctgttacagtcgaggatggggatggtgtggatgtaggtaccagggatagtctacgtgcatcaattgggaatgtggatggtctaactttagtcggagttggagatgatgtaggtgcaacattcgaagtagacggggatagggtagatgatgacaaattacctctacatggatatatgcatagaaaaatgtga

SEQ ID NO: 33147 - DNA, 198 bp, Glycine max
  Peptide Sequence Number=SeqID_149925
atgttggtgaaaaaggacatgatggagaagattcatcccttctttcaaagattttggacagaaaggtttgacactttggaattacaagtggatatgtgcttcaatgagatggagtcaagaatcaccaaggttgaaaaagatgtgtcttacattcgttcaagctttgatctaccaccgccgtcgccaccatcatcttag

SEQ ID NO: 33148 - DNA, 377 bp, Glycine max
  Peptide Sequence Number=SeqID_149926
atgtcatttaggactgtgggaaagcttgggctgtgcaaaggaggaaaatcagtgaccaaagtgaaggcaagagtcatttctagggctagagtgatttcgaaaatctgcactattatgcagaattttgctattgtgtttgtgcagaaaatgcttatgcatggctggttgtggaaagggttgtacatattcggttctggacgttttctagcagatcccaacggtcaaaatgtgggcaactggggatggtgggtttcatgtgtgatttgtggatgtggagagtcgacttgcaccatcgcccgatcgccacctagtaccacatatgacggagtggtacttggagatatgtcgtgggggtcaggagaccttggggacgtcag

SEQ ID NO: 33149 - DNA, 297 bp, Glycine max
  Peptide Sequence Number=SeqID_149927
atgagtaaacataatctttgggtggaatgtgaagaacacgagaaatctatgagtttcttgaataatgagcttctgaagtatcaagaacttaaaggtcaacctcaagatgttgtcaaacttcatgaggaaataagaaccttaaagccttggatcttcttcatcaatggagtcctttgcttcttgaaatcaatggcagtggaatggagaaggaagaaagaaaattggaggcaccacttcaaggagaagataagtcaagaacaagctcaccaccataggaagccatggataagagcttga

SEQ ID NO: 33150 - DNA, 264 bp, Glycine max
  Peptide Sequence Number=SeqID_149928
atgcgcggagtcaccaccaacgtttattcgaggaaaacgtcggaaaaaccggaaaggtgtggtctacgaactttaagtgtgaaaggttcgggagttgtatttacgcacggggaagaatctttacggattgcgcaacaatgcttcctttcgacttccgacatgccgtggaacctcacaaattatctaacaatgggtgttaagtacttcaaagcgatcaagcgaaggttgcatcccaccaaacaaatggtccccggacgaaattag

SEQ ID NO: 33151 - DNA, 990 bp, Glycine max
  Peptide Sequence Number=SeqID_149929
atggattctttttacttctttatttccaaaaataatacgcagtttgatagtattaacaaacctggaattctgctggaagtggtgcaaatcctgacagaccttgacttcataattaccaaagcttacatatcgtctgatggtggatggtttatggatgtatttcatgtcacggatcagcaaggaaagaagataacagacagcaaaacgattgacttcattgaaaagactctaggaccaaaaggccagagcacagaaggggtgaagagttggaaaggcaaaagggttggagtgcactcaattggtgatcacacagtaattgagctcatcggtagagaccgccctggtcttttgtctgagatatcagcagtccttgccagcctccaattcaatgtcattgcagctgaagtttggactcataacaggagaatagcttgtgtcctttatgtcaatgatgctacaaaccaagccatggatgactcaaaaagactgtctattatagaggagcaactcaaccacatcctacgcgggtgtgaggatgatgagaaagtggctaggaccagtttctcaatgggtatcacccacatggatcggaggctccaccaaatgctgtttgctgatagggactatgaaagtgctggagtaacaacaacagatgttgattgtcccccttgttttaggccaaatattagaatagaacgtattgtggaaaaaggttactcagtggttagtgtgaaatgcaaagatcgggcaaaattgatgtttgacattgtttgcactctcactgacatggaatatgttgttttccatgctacaatctcttccgaagggcaatatgcatcccaggagtactttatccggcacatggacggatgcacacttgatactgaaggagagaaagaaagggccatcaaatgcattgaagctgccatacaaagaagagttagcgagccatctacttgtattgttgcgaatggtacagcagataaatga

SEQ ID NO: 33152 - DNA, 390 bp, Glycine max
  Peptide Sequence Number=SeqID_149930
atgcgaaaaataccaaagatgaggggcaaaaaggtctttttgttgagtttcctggaccctagcttgcccaggctagcctctggctcgcctgagcccccaaatggctttagggtgaagaaaccagctcgcctgggcaagccaattacttcaggagtaagtctcagctcgcttgggcgagctgccatggtcctaagtgcccttttttctataaataggtgtaaaagggaggctgaggaagggttccaagggtcaaaaggtgagggaattgagagaagagacaaagaagaagaagaaagaagaggaaataaggtcaaggcgctaccgaattacgaccatgatcatcctctacatcgttccttgttaggtgttcttcgtgcgatcgtcggttag

SEQ ID NO: 33153 - DNA, 195 bp, Glycine max
  Peptide Sequence Number=SeqID_149931
atggctggtttggataggcagtggataaggaagtgtttggatgggttgaatggtgaggatggcaaaacgatcccgttggtgaaagttattggagtgccactaatgaacgcaatgcgacgtatgaagtcaaagataagatgggggaatcatatccgcatattttccaagcttggtagagacatggaaactgcctaa

SEQ ID NO: 33154 - DNA, 477 bp, Glycine max
  Peptide Sequence Number=SeqID_149932
atggcaaatatatggaagcctcttaaaggagttaccatttcatatattggcaatggaactttcctattccggttctaccatcaagttgacattcaaagagttctaaaaggagggtcatggaggtttgacagatacatgctaattctgggagtgattacggaggacgagaatcctttagagataccgttgttcaacgtgcctttttgggtccaaattcataatttgcctttgggattcatgtcaaaaaggagaaaccctactgcagcaggaggctcaaaataccttcgggatggtggcaacagaggttccgatgagcccaaaacccagacagctcgtgatttggagattcaaggcattaattgtcgagggacaacgacaataaatgccaatgatttggagattcagaaacgggtggaattgatggccgaaatatttaagaatcccaaactgatattctcgaattcagtgcaacaataa

SEQ ID NO: 33155 - DNA, 171 bp, Glycine max
  Peptide Sequence Number=SeqID_149933
atggttgatattatcttctacgggaatctccaaacctcaacatcattttcttccatatttaggtcattgataggtggatcttccatgatgaaggggataaagatatgtgagggggttggattctattgggtttgggtgagagataagagtaatgagaagagtaaattttaa

SEQ ID NO: 33156 - DNA, 294 bp, Glycine max
  Peptide Sequence Number=SeqID_149934
atgaatggtgaggttgcgttgaagaaatggatgacggacagagatacactagggtgtagtgggcagaaaggagaagaggactcacccatacaaccaacaacttttcaagagcaggatacgactatcgaagtctacgaggatgaaggagattttattgatgatgaggatttagcgccatccgagaccactttttatcagggtgtctgtggtgaagagatatttagggaagagatggtttcgtcgacaaggaatgagacttctcgaaaaacaaaagcaaccattctgaggatatga

SEQ ID NO: 33157 - DNA, 252 bp, Glycine max
  Peptide Sequence Number=SeqID_149935
atggtgtggccgtgccaccgcaaagagtgcgtgagagtaagagtgagaaggaaagcgcgagagatgagtgatagtgagaatgaaagtgcaagagtgagagtgagagatgttgttggtctatggccaaaaatccaacagatcatgtgcaaatggcagaagttacaatgtccaatgatcaagattgtagcagatttgccattatttaatggaccaactggcggtgaaggaatgaaaaaatttgggacaccatag

SEQ ID NO: 33158 - DNA, 450 bp, Glycine max
  Peptide Sequence Number=SeqID_149936
atgcatggagttaaggtatcctatattgatgtggatcacctgatccgtaaacaactccaagcttccctattccgacatcaatggcggaaaatgattgaaattcttacctcgacggtcgacgctgacgatgctcgacgatggatgctggttcgtggttcgtggctcctcttgacggcaacacggctcccttcacggtggtttgtggccgaggaagaagacgaagatggtagcgcgaggaagaagaatggctgcaaggagaatgcgaggaagaagaatggctttgtgggggggggggggggaagaagaagaatgcaaggaagcaaaggctgcaaggaagaagatgaacgcgaggaagaagaagagtgctgggtgcgcgaggaggagagagagagtagcgggagagagagagtcaaacgttttttttttaaattaacccaggggcataaatga

SEQ ID NO: 33159 - DNA, 267 bp, Glycine max
  Peptide Sequence Number=SeqID_149937
atgggtgccaagtacctcaaagtggtcaaacgagggtcgcatcccaacaacggatggtccccggacgaaattaggaatgaccataatttgtctctgcgttttgttggacacgatcgagcctgggcggcaagacacagaatggccataatttgtctctgtgtgccaccggacacgatcgcctctgggtggcgaaaaggtgtgcggaatgacaaagggtgcagaatttgtctctgcgcgtttatcacccaacttgcgaaatctgaatga

SEQ ID NO: 33160 - DNA, 400 bp, Glycine max
  Peptide Sequence Number=SeqID_149938
atggcacaacctccacctcgtgagaggactctaagggaaatggctgcacttgatttcacctatgaaagcttgtgcatccaataccctgatgaggatgtcccatatgttcttaaaactggactgattcatttgcttccaaagtttcatggccttgcaggtgaagacccgcacaaacatttgaaagaattccacattgtctgctccaccatgaaacccccagatgtccaagaggatcacatatttctgaaggcttttcctcattcattagagggagtggcaaaggactggctatattaccttgctccaaggtccatcacgagctgggatgaccttaagagagtattcttagaaaaaattttccctgcttccaggaccacagccatcaggaagaatatctcag

SEQ ID NO: 33161 - DNA, 405 bp, Glycine max
  Peptide Sequence Number=SeqID_149939
atgagtcttcattcttcatctagtgttaatggtgagggttctactcctaaggaccccttgtataagatattagatgagttgagatcccttaagttgtggaaagaaaaacaagagagaaaagaaaaaggaaaaaaaagagcgaaagaaataagtcaagatgaaaaggagaaaataagggaagatgaaagaaggaaaatactaaaagagttaagaaaagaaaaacatgcctcctatagtagtcataactcttgcaagagcctaagtgaagaacttcgtgactattatgaaggaagacataggtcacatcttagacctcactcccataggagagaaaatggaagaaagcctcaagaggttaacattaaactcccatacttccatggggaaggacaatgtagaggctaa

SEQ ID NO: 33162 - DNA, 402 bp, Glycine max
  Peptide Sequence Number=SeqID_149940
atgactactcattgggactttagtatgaatgggtcgaaaagaacaaattggagacatacagaaacatggaaagagttagaggttttgaaggatagggttccatgtttcaaaggaatgagtgctatggaggtatacttaaagtgggagatgaaaacagagcaagtatttgcatgctgcaaatatagtgaagcagaaaaggttaaggtagcagctctagtgtttaaagatcatactataatttggtgggatcaagaaaagaaatataggaagagattcaatgaaaccccggtggcaacatggttggagatgaagaccttgatgagaaagaggtatgttgatgcaatcctccctaggaaaggaagaattaccagagccatgagcaagaggatccaagaggattag

SEQ ID NO: 33163 - DNA, 609 bp, Glycine max
  Peptide Sequence Number=SeqID_149941
atgattgaagctatgataaatgatcccatgaagactttgatggactatctaaccctcaaggatcctatgatgcacatgaggaggatcgtgtggttgtgcaacactatcaaacaacctaatgtcatcaaagagtacattaggctgaagcctaggaaagattccaagagtttccaacattatgggttcaaccaacataggatagtgcatattttctacggaggagtatctaatccctacaacaattctagagataggagaatcatgaagaggccaatcaaccagacccagcctcaggttcctaactcttcacctctctaccacacttgtgataactgtagatgtgtcaatgggctaggggaatgcatagtgggggatgagctgggccaaaccatgaatgagaatgatcaatgtttaaagctcataaagtcccaacttgcttctatacaagcccttttatctcaaagagcttctaacacactcccttcccaaactgaagctaatcctaagaacgaggaagtgaaagttgtgagcaccagtagtggatggtctatgacagagataaaaaagaaaaagaaaagccttccaccaccaaaaaaaggctcttattga

SEQ ID NO: 33164 - DNA, 384 bp, Glycine max
  Peptide Sequence Number=SeqID_149942
atgactatccagagtatacaatttcagcaagagacaagagcctccattcagagtctgacaaatcagatggggcagctggctactcagttgaaccaaattcaagtgcctcaaccagtagcagcacctgcacctgaacctatcaagcttaattctacacatgaaaaagaggatgagatagttgcacaaaagagaaagcttcctaacaaaaattttcatgcaggtggaacttcgtcaagtaattatgacttacagcagcctcttatccctcttccattcccacctagagcaattccaaacaaaaaaatggaagaagcggaaaaagagatcttgaagaccttcaggaaagtagaggtgaacatacctctgctagattccatcaagtag

SEQ ID NO: 33165 - DNA, 222 bp, Glycine max
  Peptide Sequence Number=SeqID_149943
gacaagtatccaaaaggagaaacattgaagaagaagattgctgctgattctgatgatgaagaaagcagttctgaatcttcagatgatgaatcctctagagcaatttcctaccgaactcccttttttacgcagcaacatgcggctcagcatgaccagattcccgaagtctttcagaatctcgccgcaaagctgattattgttgaggttaaggtgtttcagtga

SEQ ID NO: 33166 - DNA, 885 bp, Glycine max
  Peptide Sequence Number=SeqID_149944
atgaatggattccttgacagggaaactatgcttgaccccatggctgtcttcgccctgctctttgggagtgaattgtttgaggactacatagggcatctagctgtggcatcaatggcttcctctgagctagctgatgaaactgaggatcctgataaactcaatgagaagctaaaggcaagaatgttctacattcacttttcagctgtccaaaaagaaagagaagaaaagctagcaagaattttgagggattatcttggccaatatgtccggggtaacaaaaaaggattcttccaacgcgcagaatctgaaacaaggcggctttctcgtgctgcatttggagttgatatgttacataccatcggctacatatattcaagacaggcagcacaagaactaggtaaaaaagccatttatcttggagtgccatttctggctgaatgggtacgaaacaaagggcatttctggaaatcacaattcacagctgctaaaggtgcttatcagttacttcagctccaagacgacatgcgcaagcaatttaaaatggatggtagtagtgtgcctgaaaatgatgttgactctcacattcgccttaacaaggatacattgatgaattccttgtggaagttaaatgtagtggacatagaagtaaccctcgtacacgtgtgtcaaatggttattgtattcattgtcgcttatccagataccatgaagctcttggtgctaagggaaaataacgttaagaaggaggaacttagacttcgggctactgctcttaaaattcttgggaagatatttcaggtgcaaattttcagatactttggcatcaattatttcagttttcagctttctaggaatattgctcattataataatttctgtgtttaa

SEQ ID NO: 33167 - DNA, 255 bp, Glycine max
  Peptide Sequence Number=SeqID_149945
atggaatcgaagaggagaaagaagaagaaagaaagaaagagaggaatgggaagggaaggggtcacgaggaagtggaggctttacagttctgatgggcaatattgtatttcacgggaagtactttttcgcgggaggaaacagttttttaagcgttttggtcctaccgggagtcgaacccaggtcgctggattcaaagtccagagtgctaaccactacaccatagaaccacttgataacagacgtaagcctaagtag

SEQ ID NO: 33168 - DNA, 282 bp, Glycine max
  Peptide Sequence Number=SeqID_149946
atgagtcaatctcttataagggtggacccttgggtactagtacctatcgccttcagaggactacacgtcctcgccttcagagggttgcatgtccttgccttcagaggaatacacgtccttaccttcaaagggttacaggtcctcgccttcagaggactatacgtcctccccttcagaggactacacgtcctcgccttcagagaactacacgtccaagacttcagaggactactcgtccacgccttcagagggctacacgccttctccttcagaggaccacat

SEQ ID NO: 33169 - DNA, 444 bp, Glycine max
  Peptide Sequence Number=SeqID_149947
atggtatatgatgtaacgcggcgggaaacctttacaaatctatctgatatatgggctaaagaaattgacttatactcaacaaatcaagactgcatcaagatgcttgtaggaaacaaagttgataaggaaagtgaaagggttgtcagcaaaaaggaaggaatagactttgctagggaatatggatgtctgtatactgaatgcagtgcaaaaaccagagtcaatgttgcacagtgttttgatgagcttgtgatgaagagtacctttgtccttcactccttacctccaagaaatgcttgcagcttgatggctgtcctagataagtttcaaatgattttggagacaccaagcctcttggctgagggctcgtccggtgtgaaaaaaaacatcttcaagcagaaacccccacagtctgatgcatcaagtagtggctgctgctcatggtga

SEQ ID NO: 33170 - DNA, 129 bp, Glycine max
  Peptide Sequence Number=SeqID_149948
atgggagggaaaaagttgaaacttgctatttgggacactgccggacaggaaaggtttagaacacttactagttcatattacagaggagctcaaggaataattatggtttggtatcttgttaagctgtaa

SEQ ID NO: 33171 - DNA, 183 bp, Glycine max
  Peptide Sequence Number=SeqID_149949
atggtgggagaaagatcctcgaaagtatcagagcttattggaaattctagacttgacttggattcggtggaaagtggaagcagaaggaaaaggaaagagattgaagagaacgaggatttagtagaaggttgcggacggtcaaagaaaacccgtttcaagtttgtcgcgtgcatgctgcggtga

SEQ ID NO: 33172 - DNA, 324 bp, Glycine max
  Peptide Sequence Number=SeqID_149950
atgaccaatgaccaacgacagcaacaaaactatgacgaaaaggacaactatgacgagcacggcggctacggcaacattggaagcaacaacaaggagaggccattcgacatgaagcagcactttggacacaaggaagacgttaaaggtgaccgagtggagcaagatagggtctcgcatatgatgggtcgtgggtttaaacccctactcgtccctttgagtggggtaaaggactatatcctgtacaagcctcttcaatgtgatatcttcatcatcttgagtttcttgaagattgagggacgtttgagcagtcctagactgatgtga

SEQ ID NO: 33173 - DNA, 363 bp, Glycine max
  Peptide Sequence Number=SeqID_149951
atgggatatcgcttagaggatatgctttgtgatcttggacaagagtcttttcagcaagcacatgcccctgtgtatgatacattagaaagtgattccaaaaagcctttgtattcagggtgcaagaagtcattgacgctattgtcggtgtgtggggtatcacgatacaaagtaaaggatgatgatgagagtagggatgaggaaagcataaagaaaggccccccagtgaaggtgttatggtatctttcgatcattccaaggcttaagtgtctatttgcaaatggagatgacgcaaaagaccttacatggcatgcaaaagagagaaactggaatggaatgctccgtcattcaaatgattcctcatag

SEQ ID NO: 33174 - DNA, 536 bp, Glycine max
  Peptide Sequence Number=SeqID_149952
tgggattagctagggcagtgtctgaaaccctagggtttgaagaaaactacatagaaaaggaattcaacctaaagtcagggtttgatgtgatggccatgaacctttatccacccaattctcgatcgaagggggctattggtatccccgaacacactgaccctggctttgtggtttcacttgtgcaagatgtagatggtggcctccaaatcctatcccatcaaggaaaatggattaatgcttatattccccatcatgccatactcatccaacttggtgatcatcttgaggtcttaaccaatggaaagtacaagagtcacatccatcgagttattgtcaacaacaataaggtgccaaggatatccgtggtcacccttcatggacctgcgttggacaaattcatcagcccgggcgtagagtttgttgatgaagaacacccacaaaattaccatggaatgacctataaagaatccttggaagcaaatgggggcgatcagatcgatgtgcaatcatcacttgataaactaagacttgtgtga

SEQ ID NO: 33175 - DNA, 302 bp, Glycine max
  Peptide Sequence Number=SeqID_149953
gtgagtcagagttgaggcaggaggctgctactcctgagaggacatcacagaccccagaaggtccactcttactagggatagacctatcttttgctcaacaggtagcggatcctcctacaccagtatgggagagacaagcagatcctcctacacccatcatggagatgccagaagaccctaccatgccaatcctgagactgtcatccactcctccagctatcccagttttacatctgacagatgaggacgatatgctggaccaggacacacagggcacacaggaccagttccaggaattctaa

SEQ ID NO: 33176 - DNA, 360 bp, Glycine max
  Peptide Sequence Number=SeqID_149954
gtgaggacgtgtggtcctctaaaggtgagggcgtgtagccctacgaaggtgaggacatgcagtcctctgatggcgagggcgtgtagccctctgaaggtgagggcgtgcagccctctgatggtgagggtatgtagccctacaaaggtgaaggcacatgaccctttgacggtgaggacgtgtagtcctctgaaggtgaaggcgaggacttatagtcctctggaggtgagggcgtgcagccctctggtggtgaggacgtgtagtcctctcaaggcgaggacggcgtgcagccctctgatggtgaggacgcgtagtcctctcaaggcgaggacgtgtagtcctctcaacggtgagggtaactag

SEQ ID NO: 33177 - DNA, 211 bp, Glycine max
  Peptide Sequence Number=SeqID_149955
atgaaagtcaaacacaagcgttatgcggaaaatacactatactcaagcctacatgtaatgtggtaccatttttcagtgaaaaacctcgtcggacgtctaggagtacatgataggacatgcctcacaatgggcttaaaggagcactcaaaccggatgacccccaaggcttgcactccgaagagtccgttagggcctctccctcctgattcag

SEQ ID NO: 33178 - DNA, 263 bp, Glycine max
  Peptide Sequence Number=SeqID_149956
atggcttgcacccaggagcacaggtcgcttgagcaaacagaccaatggcttgcacccacattccggatttacacacgatggcttacacccaggagcacaggtcacttgagcaaacagaccaatggcttgcacccacattccggatttacacgcgattctcctcaaattccatccagcccatatcaattagactttgcaccttacgctttagagccctacaatgctcaatggaacgccccggggcttctccgtgacaagcacac

SEQ ID NO: 33179 - DNA, 314 bp, Glycine max
  Peptide Sequence Number=SeqID_149957
atggccaatcaaggagactgggtcccgtttatggatgtgttaactttgctaatttttggggtcgtcctctttccaaacgtggatggtttggtagacctagcagcaatcgacgctttccttgcctaccaccatagcaaggaaagtccggtggtagctgtcttggcagatctgtttgacacatttgaccgaaggagaatggattgggaccagctcttggccgggataggaggtagaacaatcagttgttcccccgatggaaggaaggaaaagaaggagtccttttctcatgtggaagatacccaaacattccgctg

SEQ ID NO: 33180 - DNA, 476 bp, Glycine max
  Peptide Sequence Number=SeqID_149958
atggtgatctcggtggtcctggtcactttcgtgtcgctgaccttcgtcggcgcggcgatcctgatgcagggccagatcggagtcatgcgcgggtactgggcggaacgcgcccaggtggccgtctacatgtgctccgcggtctccgaatcggacacgtgcatcgacggggcggcgagcgaggaacaggtcgctgccgtacgcgcacagctcgagggggaggcgctggcacccctgatcagctcgatgacgttcgacaccaaggaggagacctacgccaagctcgtcgatcaactcggcgaggaccaggcgagcgtgctgtctccggagcaggcgttcgaggtcttcttcgtcacgatgaaggacccagggcagtcgcaggtgctggccgaggcgttcagcggccaggcgggggtcgagcaggtgaaggaccagctgcagtacctcgaaccgctgttctccgccctgaccgttgcgac

SEQ ID NO: 33181 - DNA, 330 bp, Glycine max
  Peptide Sequence Number=SeqID_149959
atgtaccctccactagaactgatccacaagagatgtaccctctcttgttatcagtcaacaacacaagtagatgtaccctctacttgtaccacaaaggatgtaccctccaatgtgttaagacaaagatctcaggctgttaaacctatgatactttgtgaatggggatacaaaagaattctcaggcgggagaagggagacacaaaagaattcaggcggttagtccttcgttctttaggaaaagggagaagagagacacaaaaagaattcaggcggttagtccttggcgaattctttttggcaaagggagaagggaatgaaaaagatgaatag

SEQ ID NO: 33182 - DNA, 168 bp, Glycine max
  Peptide Sequence Number=SeqID_149960
atggcggtggtgggaacaacagaattttcgaagacaggagatgaagtgttgaatcaatatggaaacacgagtatatatagtacgaaatttacgacggtgtataagcaacaccgtctttgtatccttttatttctacgacggtgtcttcaaaagcaccgccttcgataa

SEQ ID NO: 33183 - DNA, 135 bp, Glycine max
  Peptide Sequence Number=SeqID_149961
atgcatgttattttcgtaacctacactgaaccccggtcacattggcgagtagaggcttgcgtggaatcaacgagcaaggacgaaaaggaatcttcaagtgacacgacgaggaatccgcggggtagctcacgatag

SEQ ID NO: 33184 - DNA, 2550 bp, Glycine max
  Peptide Sequence Number=SeqID_149962
atggcagaaactgcagtgtccttggctggtcagcatgcgcttccaaaaatattggaagctatcaaaatggtgagagatctcccaaaagaagttagagacattacagatgaacttgaaagctttcaagatttcattaatgatgctgataaagtggctgaagctgaacaagatgatggaaggcgtcatagaataaaagaaagggtgatgcggctgagagaagcagctttttgcatggaagatgtcatcgatgaatataacatctcctgtgaggataagcaacctggtgatcctcgatgtgcagctttactatgtgaggctgttgccttcatcaaaactcaaatccttctccttcaaagtgcgtataagattcaggatgttaaatcccttgttcgtgctgaaagagatggtttccaaacccattttcctttagaaccaagactaacaagttctagaggaaatcaagatgtcacctggcagaaacttcgaatggatcctctctttatcgatgaagatgatgttgtggggcttgatggccctagagatacattgaaaaattggttgacaaagggaagagaaaaacgcactgtaatctctgtggtgggaattcctggggtgggaaaaaccactcttgccaagcaagtttatgaccaggtgcgtaacaatttcgagtgccatgcattgatcacagtgtctcaatcctactctgcagaaggactactgaggcgtttgttggatgagctttgcaaagtgaaaaaggaggaccctcccaaggatgtttctaacatggagtcgttgaccgaagaagtcgagaatccgcttgcgcaacaagaggcatttcagtatagttccgatggagattgtccagaagaacttaaagatatatctcttcacattgttagaaagtgtaaaggtttacctctagcaatagtggccgttggtggtcttttgtctcaaaaagatgaaagtgcacctgaatggggacagtttagtcgagatctaagtttagacttggagaggaattctgagttaaatagtataacaaaaattttaggtctaagttatgaatatttgccgatcaatctcagatcatgtttattgtatttcggaatatatccggaggactatgaaattaaatctgatagattgattagacagtggatagctgaagggtttgtcaaacatgaaaccggaaaaacattggaagaagttgggcaacaatatttatcagggttggtccgtagaagtttggtgcaagtatcctcatttagaattgatggcaaagttaaaagttgtggtgttcatgacttaatacacgacatgatccttagaaaagtcaaggatacagggttttgtcagtatattgacgggtgtgatcaatctgtatcaagtaagattgttcgacgcctgacaattgccaccgatgattttagtgaaagtataggaagctcatccattcggtcaatttttattagcacaggagaagatgaaatatctgaacacttagtaaacaaaatccctacaaattacatgctattgaaggtacttgattttgaaggttctggtttacgttatgttcctgaaaatttggggaatttatgccacttgaagtatttaagcttccggtatacagggatagaaagtctaccaaaatcaattggcaagctccagaatttggagaccttggatataagagacacaggtgtgtctgagatgccagaggagattagtaagcttactaagctacgccatcttctgtcttattttacgggtttaattcaatggaaggatattggaggcatgacatccctacaagagatacctccagtgattatagatgatgatggagtggtcattagagaggtaggaaagctaaagcagttaagggaactgtcggtggtatattttaggggaaaacacgaaaagactttgtgttccttaataaatgagatgccactcttggagaaagtacgtattgatacagctgatgagagtgaagtaattgacttgtacattacgtcaccaatgtctacacttaagaagcttgtcctacgtgggacgttaacaaggttgccaaattggatttcacagttcccaaatcttgtgcaactgtatttgagcggctccaggttgactaatgatgcattgaaatcactaaaaaatatgccaaggttgatgctcctctttttaagtgacaatgcttatgaaggtgaaactttgaattttcaaagtggagggtttcagaaactaaagacactgctactcaaatctttgaataagttggagtccatccttatcgacagaggagcactgtgttctttggaactattttctttacgagaactctcccaactcaaaacagtaccctctggaattcaacacttggagaaacttaaagatctctatatcaaggacatgccaactgaatttgagcagcgcactgctcctgatggaggagaagaccactggatcatccaagatgtgccccacgtacgtatttggagtgaagatgctgaagaacctttgcatatgttcggcagaagtcatcactaa

SEQ ID NO: 33185 - DNA, 524 bp, Glycine max
  Peptide Sequence Number=SeqID_149963
gggatgtgaatcatcgcattcaagcaggatggatgaaatggagaaaagcatcgggggtgttatgtgatgcaaaggtaccgatcgaagctaaagggaaagtttatcggactgtggtaagaccggcgattttgtacggaacagaatgttgggcggtcaagagccaacatgagaataaagtaggtgtagcggagatgaggatgttgcggtggatgtgtggtaagactcgacatgataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaagtatgctaaaagggtttgtttccctaacaatcgcattcagctactacaatttatcatag

SEQ ID NO: 33186 - DNA, 183 bp, Glycine max
  Peptide Sequence Number=SeqID_149964
atgataatgacattgcttgctgacacacagagagcaaaactcactaagaagcttagtgaggccaaccagcaaaaccggttcctaaaaagacagcatctttttaagtatgatattgataggttgcatcgggtcaatgccaatagagtgaaagccgccttagacattggctctaaaaggaggtga

SEQ ID NO: 33187 - DNA, 693 bp, Glycine max
  Peptide Sequence Number=SeqID_149965
atgagtcacttagttactgaaaggcagtgctactactaccaccacctacgagcgactcatcatcttcttgaactcttcgaaattgacgttgccgtcgccgtcggcatcgacgtttccgatcatcctccggcagtcgctgagggagcacttctcccccaacctccgcatcacggagtgcagctccttcgccgagatcagcccgttcttgtccagatcgtacagctcgaacgcctcccggagctccctcccgtcgccaccgccgccgcagtggaactcgccgaactccttcaagtcaatgtagccgtcgccgttccggtccagctccgccatcatgcgcttcacctcgtccgacgtcgttttggatcccagcgccgccatcatctccttcagctccgcgcacgagatcttgccgtcgccgttcttgtcgaacttgctgaagatcttgcgcacctcttcttcgtccatggcgacgccgagagaagaataataaacttacgagttcagttcgcgcgagatcagcgattggctcacgtaaacgcgttaagtaggaaacaagttgaggaaaggaagaaaggaacagttgtgttagtgcgagccaaacgcggtgttgttgagtgtggcagaagtggtgaagaatttggacgcgcgtcacgtcctcgtggagtgcacgagaatcaagatatcatgtcgtga

SEQ ID NO: 33188 - DNA, 288 bp, Glycine max
  Peptide Sequence Number=SeqID_149966
atgaaaatgatccaatttcactcagtgacattgatgaatgcaacgagtggcttgtgggtttttgaggcttcgggaatcggacaaccaatgacatatactaggcaaaggattcaaaagagaaagaaaccccttagtgttgaagatgttgcacctaagacaaaaagaggtcaaagaagggtgagggctcaagggctcgaggtcgaaggtgagggtcttgagagaaagggaggtcgtgagagtgaggctgacgcgaagctaccgccgtggagggaggttgtgagggactga

SEQ ID NO: 33189 - DNA, 138 bp, Glycine max
  Peptide Sequence Number=SeqID_149967
atgtgtgataatgctcttgccacaaaaacaccggcacgagtgttgtccaaagcatccaccttaaaccccttgacttcaccacttggcacaaaggactgcaaagaaatagatgagacagaagagtctgactcgaattaa

SEQ ID NO: 33190 - DNA, 838 bp, Glycine max
  Peptide Sequence Number=SeqID_149968
atgggtcaacttcaacggcaagccttccgcaaagcctattgtaagatttgggacctagctagggtagaagtctccatggaaccgattgcatccctttcccagtattatgaccagcccctaaggtgcttcacattcgaggacttccagctagtgccgactgtaaaagagtttgaagaaatcctgggatgcccactgggaggaaggaagccatatcttttctctgggttctatccctccacgacaagagttgccaaggcagtgaaaatctcagcacaagagttggaccggttgtcctctttccgattatggaaaggtttagtggacctagtagtgattgacgctttcctcgcctttcagcatggcaaggaaagcccggtcgtcgccattttggccatgtatgacaagttcgaccggggatgtgaaaagagcggcgcaagaattgaaggaaaaatcaggattctatcttcatgcgaaggatgtcccatgagaggagtgccatcagaccaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaag

SEQ ID NO: 33191 - DNA, 159 bp, Glycine max
  Peptide Sequence Number=SeqID_149969
atggcaattaacaagagagggaaagagaacttacttggaactatagagattgcgatttgctcgctatgcacgagtgttgcactaagcgagcactctgtgacgtttgaattttcaaaatttaaattcacatgcttagagagacagactcgctcagcctaa

SEQ ID NO: 33192 - DNA, 1530 bp, Glycine max
  Peptide Sequence Number=SeqID_149970
atggagatcgttaacgcaccgcatctgccagtcagagagcactggctggcactgcatcatgaacccgctttgatgcccgacctgccgatggtcgatgcgcatcatcacttatgggaccgccagtcagggcgttatctggcgcctgaattcagccacgatatcgaaacgtccggccaccggatactctccaccgtctacattcaatgccgttcaatgctgcgccgtaacggaccggaggccttcaaacccgtcggtgaggtggagtttgccagcggcgttgcggcaatgtttgacagcggccattacggcgcggcggcaggctgtgaagcgattgtcggcggtgccagcctgctggctggcgatgacctgctgccggtgattgaaagcatgacggaacgttcagggggacgattatgcgggatgcgtaatccgctggcctggcacgatgacccacgcgtggtatccagtcccgtgacgccgcccgccggtctggcggccagtgccgcattccggcgcggtgccgcatgcctggcccgcaaaggactgtcgctggatgtctgggtttatcacacccaactcgatgaaatcgctgagctggcacgggcgctacccgatctgcacattattgtggaccattgcggcgggccgatcggtagcgggccgtatgccgacaaacgggatgccaccttccaggaatggaaaaaggccatcatcgcgctggcggcgttgccaaacgtgagcatcaaaatcagcggtttcggcatgaccgtcatgggctactccttcgctcagcatgccacgccacccgactccctgacgctctcgcaggcctggcggccgcagtttgaaaccctggttgacgcgtttggcgtcgggcgctctacggcgtattctggaatgcctgtaaaaggctggctgagcacgcttcgccgaccgaaagagaacagctgttctggcgcaccgcggctgcacgctatcgcttatcctccctggagaatatggatgaatatcaaatcaagactgcatgaagcgcctcccctggcgcaggatgagtccgctgcagcgatctcgtatacatcggcagaaaaaaggacgctggcgctgggcgggttaggatggacgtttgaaagctatgactcgtttttgctctcgctgttactaccggtactgggcgtggtattcgatgtcagcaaaacggaacttggcgtgtttatcagcaccacagcaggcgggcagattattggtggcattctgtttgggctggttgccgataagatcggacgcgtcagaacggcctttatctgtatcgcgatctattcacttttctccggactgctggcgttctcccacaatcctcaggcgtttgctgcgctgcgattctgcggtgcgctgggtatgggcggcatgtggacgtcaggagcggcattgatcgccgaaacatggcgtccggaacgtcgtgcacgcggtggcgcgctgatgcaaatggggttggcggtgggggcgattctggcgattggcctgacggcgctg

SEQ ID NO: 33193 - DNA, 382 bp, Glycine max
  Peptide Sequence Number=SeqID_149971
atgtcgctgaccttagccgactccgcggcgctgccgcgtaaagtcaatacgcaacagacggaagcaccggtgccattaccggctggcgccgcgcatatcattcgcgacgatgcggaagctatcgccgtagcccatcagttggcggtcagcttcgcgcgcgaggcggcactgcgcgatcgtgagggcattctgcccctcaaagagctggatgcgttctcgcaaagcggcctgtgggcaatggccatccccaaagcctggggcggagcgggcgtgtcgtggaccaccgtggccagggtgatcgccatcatttcagctgccgatccggcgctcggtcagctgccgcaaaaccatctggccggtgtggcccatctgctggaagacg

SEQ ID NO: 33194 - DNA, 1242 bp, Glycine max
  Peptide Sequence Number=SeqID_149972
atgccttcaccgtttttgctgtttgcgttcatgatgaatgtccctggtcatctctctgccggattgtggcgacatccccaggatcaggcgcatcgctataccgagctggattactggacgaccctcgcgcggcagcttgataccgcaggttttgatgcgctgtttattgctgatgcgctgggacaactggatgtatggcagggcaagccggacgcggcgttgcgcctggccgctcagatgccggtgaacgatccgctgctgctggtctcagccatggcagccgtcacgcagcacctcggtttcggtattacggtctctgccacctacgaacatccttatttgctggcgcgcaagttcacgacgcttgatcatctcacccgcgggcgtatcgcctggaacgtggtgacttccatgcttgattccgcggcgcgcaatctgggtttgacccggcagctgccgcatgatgagcgttacgatcgcgcacaggagtttctggatgtgaccgcgaagctgtgggaaggctcatgggaggaagatgcggttagccgcgataaagccaacagcctgtatagcgatccgcaaaaagtgcacgctattcagcattatggtcgctggtatcaggtgccggatgcacatctcagtgagcccagcccacagcgcaccccggtgctgtttcaggctggcacttcggcacgcggtgcgcagtttgctgcccgtaacgcagaagtcattttcctcggtggcgtcaccgcgcaggcgattgccagcgatattcagcgcattcgtcagctggccgtggcagaagggcgcgatccggcgtcgctgcgtttcgtcacagccatcacggtgatcacggccgaagatgatgccgccgcccgggccaaacttgaggattatcagcaatatatcagtgaagaggctgcgctggcgctcttctcggcgtggaccggtatcgactggtcgcaggaggatccggacatgccgctggcctttcgcgaaaccgacgcctgccgttcggcgctggccagcctgacgcgaattgacgatcaaaaacgctggacgctgcgtgaggcagcccgctacatcggtatcggtggtctgcatccgttgctggtgggcggcggcgaaaccattgccgatcggctggatcagtttgcggcagaatcgggcgtggacggctttaatctgggctgggctatcagcccgggcagcttcaacgatttcattgcctgggtcatgccg

SEQ ID NO: 33195 - DNA, 777 bp, Glycine max
  Peptide Sequence Number=SeqID_149973
cccacggttggcgtcgacattgccgccaaggccgccatttatcaaaccctgcagcagctggcggccgccggggcggtgattatcctgttttccaccgatctgctggaactgcaaacgctcgccgaccgcattattgtgctggcgcgcggcgagcaggtcgccactctgtccgcccggcacaccaatcaccaggagattctgtccctggcttccggcacgggcgcattgacggagcaaatcctatgagtgaactgagccaaccggcggtggtgacggcggcaggcaaaccgcaggggcagccgtggctgcagcacgtcgcgctgctgattattgtactggtgctggcggtatttgcctggctgtcgcctattttcctcagcatgatcaacctcagtaacgtattgcatcaaacggcggtggtgggaacgctggcgctgggtctgacgctggtgctaagcggtggcggtgttcaggggattagcggcggcattgatttatccattgccgctaatatggggttgtgtgccgcggtattcgcgtcgcagatcgctgagcaacactctgtcacttatgcgctgctgctcacgctgctcaccggcatcgccgtggggatattcaatgccctggcgattgtctggcttggtattttgcccctgctggcgacgctgaccagcatgaacatcgccatgggactggagatggtgctgagcggaaacgcgtcgatttccgccagcagcgcgctggcaaaacctgctgatagccagcggaccgctgggc

SEQ ID NO: 33196 - DNA, 1791 bp, Glycine max
  Peptide Sequence Number=SeqID_149974
atgcataaacaccgcctggccggactattactggcctctgcatcgctgctcgccggcttgtcgctgcacgctcgcgccgctgacgcatccattccctcactggccggtaaacgtatcggtattaccgtggccggtaccgatcactactgggatctgaaagcctatcagggacaaattgatgaagtaaagcggctgggtggcacgcctatcgccctggatggcggacgcaaagagtcacagcagatcgcgcaaattcaaacgctgattgcacaaaaaccggatgccattattgaaacgctgggcaccgcctcagtgctggaaccctggctgaaaaaaattcgcgacgccggcattcccttatttaccgtagataccgccagcccatccagtattaacgtcacaacctccgataacttttatattggcgagcagctggcattaaaactggtcaatgatctgcgcggcgaaggcaatattctggtgtttaatggtttttatggcgtgccggtggtggcgatgcgctatgaccagttaaaagccgtgctgaaatggtatccgaaaattaaaatcattcagcccgaactgcgcgacgtcattcccaataccgtgcaggatgcctatgcgcagattagtcagctgcttaacaagtatccgcaagggtcagtacaggctatctgggcggcatgggacgtaccgcagattggtgccactcaggcggttgatgctgccggtcgcagtgaaatcaaaacttacgccgtggacggcagcccggacgtggtctcgctggtgaaagatccgaaatccagcgcggcggcggtggtggcgcagcaaccctatctgatcggacagactgcggtacaaaatgtggcgaaataccttgccggcgatcgttcacttccgcctgccacctatgttccggccattctgatcagtaaagcctttgacggcattcccgcgctgcaagcggtatcgcttgatgtccacgccggcgaagtgcatgggctgattgggcataacggagccggaaaatcgacgctgatcaaagtgctgggcggcatccacgctgccgatgagggcagcgtgacgctggaaggccggccactggtgttgaccagtccggctcaggcacaacagcagggcatcgccattgttcatcaggagcggctattgccaggcacgctgacggtggcggaagcgctgctgctcggtaatgagccacggattggcagcacaccgtttatcgatcgccggcgtatgcggcagcaggcgcggcagctactgcaacagcacttcgatctgcagatcgatcccgatgcgctgatcgccgggttaagtgtggcggaacagcaactggtgcagatctgtcgcgtattacagcgcgcgccgcgcgtggtggtactggatgaaccgaccgccgcgctggcgcgccacgaggtgcaggcgctgtttcgcgttattgaacgtatgcgtcagcaggggatcgcactgatctacgtttctcactatctcgatgaaatccaggcactgtgccagcgggttacggtgctgcgcgatggtaaagacgtcgcgcattttaccggcgacgccctttctccgcatgcgctgattaatgccatgatcggtgagacgcagcaggcgattgcaccgcgcggtctgccacctgacggcgagccggtgctgaccgtagacgccctgagcgcgccgggtcgctttcacaatgtttgtttcagcgcacgacgtggcgagatcgttggcattaccggcctgctgggctccggagggaaggcgtaa

SEQ ID NO: 33197 - DNA, 273 bp, Glycine max
  Peptide Sequence Number=SeqID_149975
atgccgatctccccctgtggaagtatcagttggtctgtgtcgttccgacatggggatcacgcccgcaagacactcagtggacccggagaagtccaacagggtcctggggtttccagctctgattatgggcctctgcaggcgcaggatgagacaccacaccacaacagacgcaccgccgccacctccaaagcccctcagctcatctacaaagctggagcgttgcctacgacctatggtcgaccagcaggcgaccaagtccaaagccaaagataa

SEQ ID NO: 33198 - DNA, 810 bp, Glycine max
  Peptide Sequence Number=SeqID_149976
atgggcatgcgtatttccgctaatttgcagcacagcgcttatcaggtgttttactgcgagaattcaccgcaggcgcagcagcaggtgattgcacaaggacgcgagctgtcggatgccgcgtcggtggtgccgctgagtgacgtggtgatcctcgccgtgccggatatcgtactgggcaaagtctcgcaaagcgtggtgccacagatgcaaagcggtgcggtgctgctgacgctcgatccggccgcggcctatgccaacctgatcgcccagcgtgacggcatcgaatacgcagtcgcgcacccgtgccatccgtcggtatttctggcccgctacaccaaagaggagcacgccgatgcgtttggtggcgtcgctgccgttcagcacgtcgcggcagcctgggaaagcggcagcgctgaacagaaggcagagctgagtaaggtaatcagcgtgatgtacggcccggttgatcaggtgcactgggtcacggtgacgcaactggcgtatctggagccgacgctggtggaaaccgtcgcctgcatggtcggtgccttcatgaaagaggcgctggatgaaacggtgaaacacagcggcgtcccggaagaggcagcgaaggccatgctgtacggccatattcagattgcgctggcggtggctttccgcgccaccaacccgttctcggatgcctgcatgatcgccatggagtatggccgcgagaagatcatcaaaccggactggaaacagatcttcgaccagcaagagctggataaggttattgcccgcatgctgaaaattgacgccattcagcgttaa

SEQ ID NO: 33199 - DNA, 2103 bp, Glycine max
  Peptide Sequence Number=SeqID_149977
atggaaaaaaacacgctttctcaggactccgagctgctgacggaaattgccgtcgcctactatcaggacgaaatcacccaggaggagattgcgcgtaagtttgggatttcccgtatcaaggtggggcgactgctgaaacgcgcgcgtgaagagggcatcgtcgagattaatgtgcgctaccatccggtgttcagtacgcggctggaacagcagttgcagacgcgctttccccatttgcagcgcgcgctgattgccctcgattcgccagacagcgacgagcagcggcgtcaggtggcggcgctggtgtcggcgcatctcgcgcagtcgctgaaagacaacgccattgtcgccgtgggccaggggcgcaacgtggcggccgtcgctgattatcccggtcaggtgccgacgcgcaactgcctgtttatcagcggcatcggcggcacccatcgtccgggggatgccatcaacgcggaccacatcagtcgccggctggccaaaaagtttggcggcatcagcgaaaccctgtacgccccggcttacgtcgaaaaccgggcgctgcgcgacgccttcatgcaaaacggcaccatcaaagagacgctcgaccgcgcgcggaaagcggatgtggcactggtgggcatcggtgacatgaacgaaaacagctatatggtgaagctcggctggttcacaccacatgagatcattgatgccagcgtcaatcagggcgtgaccggtgatgtggccggctatgatttttttaatgcccagggccagcacgtggatacggtgatgaacgaccgggtaattggcctgagtatcgatgagctgcgtaaaattccctgcgtgattgccattgccgctgaaaacaccaaagccatggcgatcctcggcgcgctgcgcaccggcgctatcgacatcattgccaccacggcgcagaacatccgcaccattctgagcatgtcgcaggggattctgcgccagggcgccgtccatcacccaacggtcacccatctctcgctgcaacacatcaccaaaacctggggcgataaaatcgcgctgcaggatatcagcttcgacgtggcgcagggcagtttcgtcgcactgctggggccttcaggctgcggtaaatcgacgctgttgcgcaccctcgccgggctggaaacggccgacagcggccgcatttatttcaatcacaccgacgtcacgcctctgccaccggcgcagcgcaagctgtcgatggtgtttcagtcttacgcgctgtttcctcacctgagcgtgcgggagaatctgctgtttggcctgaaggcgcgcggtgaagataagcaacagtttgccgcccggctggcgcaggtcagcgcactgcttgaactggaaccgctgctggcgcgcctgccttcacagctctccggcgggcagcagcagcgcgtggcgctgggcagggcggtgatcgccaacaatacgctgtgcctgatggatgagccattatccaacctggatgccaaactgcgtcagagcatgcggcgcgaaatccgcgcgctgcaaaagcagctcgggctgaccatgttatacgtcacccacgatcagaccgaagcgatgagcatggccgatcacatcattctgctcaacgatggccgcattgagcagcacggcacgccagaccagctctacaaccagccggcgagctgttttgccgcgcagtttattggcgcaccgccaatgaatatcctgccactgcacagcaaaggcgcgcatcactacctcagccatctcaacacaccgctgctgagctatgccggcgaaacggcgctgagtctgggcctgcgcgcggaggatatccagctggtcgccccacagcaggccgcgctgagtgcgcgggtagtgagctacgaatacatgggcgcggatacgctgctggtctgtcggttgcccggcatcacggaatcactgaccgtcaaagtgcccggcctgcagcgcttcacggatgacagcctggtcggcctgcagtggtccaccagccggcaatacctgttttccaccaccagcggccagcgctgtgtcgctgctgaacacccgatgttgctcgctgagaaaaaatacgctgtttaa

SEQ ID NO: 33200 - DNA, 213 bp, Glycine max
  Peptide Sequence Number=SeqID_149978
atggcatcatcaggtatgggtgctggagatggctcaggctcaggaggggtgagctcatcctccccctctgctgctactgttggctgctctagttcaggctcctgggcttcggaggccccaccctttccagaaggagaaggctgggctcctggtcaggccaccttcgcgtcgaactcatccatgctcataatggatggcaagcccaagccctga

SEQ ID NO: 33201 - DNA, 318 bp, Glycine max
  Peptide Sequence Number=SeqID_149979
atggtgacaccagttcagcatgtcctccagcgacgcaaaggcgcggctgatcaccccgtcaaacggtggctcagccggaaactcttccacccggctctgcaccggcgtgacgaaacgcacgcgtttcccgaggcttttccagttttcgtaaagtgcgcctgcgggcggacaatcgccagggggggatccaaaggcaggcccggtccggtaccgacatcaataaagcgctcaccctgcaggtggggttctaccacgatgctgtcgagaatgtggcgcaccagcatctgctgcggatcgcgcaccgaggtcaggttgtag

SEQ ID NO: 33202 - DNA, 273 bp, Glycine max
  Peptide Sequence Number=SeqID_149980
atggctccaaagaaactcccagccaagaggtccaggaaggatgccactggagagggttccagtgcggccccgcaggaagatatagactttcatagacaacagttccggagtacggaacaccaacaatggaaggctagcactgtgagttcccccaaaggaggagtcaagccgccgactttgatgaggaggctatcagtcagttgctatgcattgtggggcatgactgttggatcgagtggcctcagaataattaagaaggggaggttgaattaa

SEQ ID NO: 33203 - DNA, 324 bp, Glycine max
  Peptide Sequence Number=SeqID_149981
atgcagatctgtaaggcgttgctacttagcaacattctcccgaaggaccataactcaaacctccctctgtcgaagtgtgagtgtccacatcacctagccgatcgctgttgctatttaccagtttgcaaggattatgcctccgagacacctagtggacccagagatgtccaacagggccttaggtttcctgctttgattacaggtctctgtcagttatatggagtggcggccaaccccaccaagctcatttggactcccatcagtagggcctacagcgataggtactacatgcccaggaagatgaagggtcaggcaccccaatag

SEQ ID NO: 33204 - DNA, 309 bp, Glycine max
  Peptide Sequence Number=SeqID_149982
atgcagatctgtaaggcgttactacttagcaacattccccccaacgaccataactcggacctccctctgtcgaagtgtcagttggcttatgccatcctgactcagtttgcatggattatgcctccgagacacctagtggaccaacagaagcccaacagggccctagggtttcctgctctgattacaactctctgtctgttctatagagtggcggccaaccccaccaagctcatctggcctcccatcagtagggcctacatcaataggtactacatgcccaggaagatgaaaggtcgggcaccccagtag

SEQ ID NO: 33205 - DNA, 381 bp, Glycine max
  Peptide Sequence Number=SeqID_149983
atggcgaggaaagcagatcaccataatttgtctccacgtgccaacggacttgattgtctctggaaggcaaaaggagactgtaataatctcgatcgaaagacattaaagtctttgaaaaggcggcagatgaccactctggatggccctactgatgggaggccatatgagcttggtggggttggccgccactccatagaactgatagagacttgtaatcaaagcaggaaacccagggccctgttggacttctctgggtccactaggtgtctcggaggcataatccttgcaaactggaaagcggatgaccataatttgtctctgcgtgccaacagacttgattgtctctggatggcaaagggagactctagaagtctcaattga

SEQ ID NO: 33206 - DNA, 467 bp, Glycine max
  Peptide Sequence Number=SeqID_149984
agacccctcgtgggaggatgtgcagaaaaggcacaggccatccagacgcaaaacatcgccccccacgtgttgtctcgtggggcactgaggctgtgattgaccctccatctcccatcagacgacacgtgaagtggaagatggcccgcaccaagaaaactgggcagatgacgactaaggcagcaaaggaaattgatgagaagattgattctttggaggagcaggcgtcacagggttcatttgtcccctatggacgtcaggatctcttgactgctgccattaggcgaccagaacaccctggccgtgtgcgtgctgctagagccacagctgactcaacaaatcaaggactagctggaggagtcgatcacaaaaaaagtgactcggcagctgatgttatccttcagccagatgcagtcccagttgcaatcacagatccaatcacagggacttgcactgacttcggagcctga

SEQ ID NO: 33207 - DNA, 1092 bp, Glycine max
  Peptide Sequence Number=SeqID_149985
ggtgccgggttttatctcaacgccacgcagcaaccgtgggcggcacattatcgcatgttcgattatctcagcgaggagctgccggcactggtggcggataacttcaagctgagcgatcgccagtcggtaatggggcattcgatgggcggccacggcgcgctggtgctggcgctgcgcctcggcgggcgctttgcgtcggcgtccgcgtttgcgccaatcgtcaacccgaccgaagtgccgtggggacagaaagcttttaccgcctatctgggcgacgaccgccagacgtggcgcgagtgggatagctgcctgctgatgcagaacgctgaacatcgcctgccagtgctgatcgatcagggcgatagcgatcagttcctcgccgatcagctacgcccggagcggctggaagcagtggcgcgcgagcagaacttcccgctggagctgcgtatccagccggcttcgtggaagaccatctgcggttccacgcgcagcatttactggcgtagtgcacttctctgcccctctgatgctgaggggcagaacgtgtctgacgtcaggccagcgattccgccaccagcccatcaatcattacctgcggcatgccctttgcccctgcttcagcatcagcgcgtgatcggcatgacgcagcgcgatattgatgtcatgcaccaccaccaccgtcaccatgttgcgcagccggcagcagcagttccggacggcgaatcagcgactgcgccagcccgaccagctgcttctggccaccggacagctgatcgagataacgcatcgccaggtgggcaatgcccagctgctccagcaggcacgctgcgccacgatgatcgactccagcacgtgcagatgcacaccggctggcagcgtctgcggcagatagaccacgcgctgcgcgcgccgggcaaacggctggctcatcagctcttcaccgttgagccacagctcgccctgccctttgctcagaccggccagcgcgcgcagcagcgtcgatttgccgcagccgttggggcccagcagtacggtgattttgccgcgtggcagctgcgtgacattgagatcgtcgatgacgttccgctttgg

SEQ ID NO: 33208 - DNA, 363 bp, Glycine max
  Peptide Sequence Number=SeqID_149986
atgcaaagacaagctgaaactaacaagaaacagcgtagaaccatgtctaagggttcctctcagtgtggggttgcaacggcgaacaacgacggtttgtggtggctaatggtggttgtgggtgatggagaaagtgcttgggatgttagaaatggttttggaagaaagaaagaagaagaaatggtgtttttcctaagctacacgaaagcaagggctgaaaacgctcaagtgagaaatggtctcggacacggaaatatcacgcacactccagacatcttctcgaagatcccaacggcagctcatgtagcttcctcaagaagctttattaagaggcttcctcaagaagcttccttgtggcttgtttga

SEQ ID NO: 33209 - DNA, 639 bp, Glycine max
  Peptide Sequence Number=SeqID_149987
atgaaaaagaaatataggaaggaaaacaaaaagaaaaagaagaaaaagaaaaagttgaaaaaaataaagaagaaaagagtaagagtgaaaaagcaagagaaaaaaaataaagaaacgacttcaaatgaggggaagaaagtgccatatcctttggtactttctaagaaagataaggaatgtcacctggcaagattcctagatatttttaggaaactggaaataactatgccatttggagaagctttggaacaaatgccactctactcaaagtttttaaaagacatgttgacaaggaagcataagtacattcaccaggaaaatatagttgtggagggtaattgcagtgctgtgattcagaaaattcttccaccaaagcacaaagaccttgggaatgtgaccattccttgctcaataggtgaagttacagtgggaaaagctctcattgacttgggagctagtatcaatctaatgccactctccatgtgcagaagattgggggtgctggaaatcatgtccactagaatgactctattgttggctgaccgctccattaccagaccatacggagtaattgaagattttttggtcaaagttagggaggttgaacaagaggtcctgaaaggtgaggatcaaatttga

SEQ ID NO: 33210 - DNA, 963 bp, Glycine max
  Peptide Sequence Number=SeqID_149988
atgttgaaacgttttgcactgctgtgctggtgcctgatcggcgccaacgctctggcggcgggccccaacgccaatatcaagtattacggctatgactggctggacttttatgaaactgccacgccgtctttcagcgccacagaggcgcttaaggcgattaccggcaccggcttcagtatgaccaatctgaacgtggtgcacacgttggcaagcctcaatctgcccgtttgcgccggtggcacctgcgccgtgaacattcaggctggttcgggtgcggtctcgggatcgccgtttatcgatatctgccctggcgcagactcgaacggcagttgtcaggccgcgggttcctggaacgccatttggacggcggtgaaaaagatcgccgaagccaaacataagcccggcgccatttattttatcgatgagccgttcgacgttcccgcgttacagaccgcggggaaatacgacgcttaccaatattcaagctatgtttgcaccctgcggcaggccatgcagcagtatggcgtcgcgatccccatctacaccatcttgtcctaccggcatgccaacaacgccgaatggatccgtgaaatacagcagggcgcgcctgcgaccgcgtgtccggccaacgtaaaaagcacgcccgattgggttggggtggataactacaactggtcggtggcggatatgtggagtacctacaaccgcctggcgccgataagcgcagccggacaaaagtgggtgttggtaccgccttccacggcatcgttaggaatgaacgaccagcaactgcatgcgcaaattcaactgtattgggattttattaaccaatatcccaatgcgcctgtggtttacatcatgaactggcggtttgatcgcgaggttaccgagaaccgtgcagcctaccctcaatcgaccgccttactgtctttcatggcgaacacgctgcttgccaaaccttag

SEQ ID NO: 33211 - DNA, 739 bp, Glycine max
  Peptide Sequence Number=SeqID_149989
gacggtgcggctgctctgttgagccgcgccatggaatcgagagctccaagtgggccatttttggtaagcagaactggcgatgcggggatgaaccggaagctgggttacggtgcccaactgcgcgctaacctagaccccacaaagggtgttggtcgattaagacagcaggacggtggtcatgggaagtcgaaatccgctaaggagtgtggcgcggcggtcgctgcaaaactccagggcgcgagcccgggcggagcggtcgtcggtgcagatccttgggtggtagtagcaaatattccaaatgagaactttgaaggccgaagagggggaaagggaatcgggttaaaattcctgaaccgggacgtggcggctgacggcaacgttagggagtccggagacgtcggcgggggccccggaaagagttatcttttctgtttaacagcctgcccaccctggaaacggctcagaaaagaggtagggtccagcggctggaagagcaccgcacgtcgcgtggtgtccggtgcgcccccggcggcccttgaaaatccggaggaccgagtgcctcccacgcccggtcgtactcataaccgcatcaggcaagggaagtccgcaaaatggatccgtaacctcgggaaaaggattggctctgagggctgggcacgggggtcccagtcccgaacccgtcggctgtcggtggactgctcgagctgcttccgcggcgagaacgggtcgttgcgtgccg

SEQ ID NO: 33212 - DNA, 392 bp, Glycine max
  Peptide Sequence Number=SeqID_149990
atggactcgggaaggttccagattagtataccaggtgacagctgccccatccccttgtacttatcaaagaccaacaccttgaacttcagtggaatgactacgtcaggcactaggcacaactctgccatggttgtggttgtgggcgatactgagggccccccaaagtgtttggctggggtatgccaccaaacgcctgcccctcagtggcatattcgaggcaaggcttggagtcggctagagtatggtctcgggtacttcatgtgtctcccccatgggttgaaggacctgtacctgaccagattggggttgttggctctcaatgagtatgggagcggagttatcgacattctcatcaggagcatgtgcaacattgggtggtgtatagttgggat

SEQ ID NO: 33213 - DNA, 588 bp, Glycine max
  Peptide Sequence Number=SeqID_149991
atgggcctgaaatctaccctaaggctcatgagaaccctaggaccttctcttgcatctttggcccaatcttcttggagtcttctatccaatgcccttggggggtgcggtgtaggtgaaggtaccggtgttgagtgttgcggtggtcgtcggcggcatccgaggtatgcagaaggtggtgctgctgtcgggatgaagcatgtggtgcgaatgaaccacgttgattgttccgatgcgtttaatacttctcaggtgtttgagtgccgagaggatattttacgatgggctcgatccgttgctcatgaaaacggatttgtggcggtgattttaaggtcagacacaaacacaggtagtagaggaaggactacgtttgtgttaattggctgtgaaaggagtggtgagtataggtgtaggaaaaaagaatttatcagaaaagacactaggactaggaaatgtgggtgtcccttcaagcttcgttgcaagccagtggttggaggagaaggctggatggtgaagttgatttatggagtgcataatcatgaattggccaagtcattagttggacatccatatgtggggcaattgacttaa

SEQ ID NO: 33214 - DNA, 369 bp, Glycine max
  Peptide Sequence Number=SeqID_149992
atgggctcaaaaatctaccctaagattcatgagaaccctaagccttctttatcaactctagcccaatcctcttggagtctcttgctcatggctctggtaactggtcctttcctagggaggattgcatcaaaatggcaaccaaaggtaacgacaattacagaatcaagagaccttactaacatgtgtcttgcaactctttttggaaagcttcaggaacacgaaatggaactcatgagactaaatcaacatgaagaaaatgacaagaaaaagaaaggaatcacacttaaagctttatcttcagttcaagaagaaagtgataaagaagacttgaatgaagtagaagagatgatgatttcagtttcttcgtaa

SEQ ID NO: 33215 - DNA, 462 bp, Glycine max
  Peptide Sequence Number=SeqID_149993
atgatcacttctttctcttcagaaggtaatgatgaggaggatcaccatgagcactggaatggatctatgagtagaagtcagtcaaaacatcctaatcaacaagcttcaccacttccgactaaacttccagctggagctcatataccctcttgtgcttggcctgaagagggtggatctgagtatcccagacacatgccaggagctgatcacaagcaacccaatcacaagggtggtgagacttcaagttcaactgagagcaatggtggcagtcaaaatgtccgttcgtcaataccaattttaccaaattccagttcttcattagtttcaatgacatactctccttctttcaactctagtcaacttgttgctcagaggaaactgtttgcagaatcccaaataggaaggaccagttttcagaggcttttggagccaaactcaggttcctggaattgctccttatag

SEQ ID NO: 33216 - DNA, 1380 bp, Glycine max
  Peptide Sequence Number=SeqID_149994
cgtcgcgaggacatccccctgttggcacagcatttcctctcccggtatgcacgccgccttggccgtccagcgcgtcgcctgtcgcctgacgcgctggaagcgctgcgcgactacagctggcccggtaatattcgtgagctggagaatacgctgcacaatgcggtgctgctcagtcgcgatgagacattgacgccgacgcagctgcggctggcaggttacagtgaacgcggatacagcgaaacggacgatttgacgctggatagtttcctgcgccagcagattacgcgcgaaccgcaacagctgtttgatcgggtgattcagagtctgatcagtaacgcactggaaattgcggacaacaatcagacgcaggccgccacgatgctgggcattagccggcacacgctgcgcacgcatctggcacagatgggcatcataaaagggcggcgtaagtctgccgtcatggccttcgtgcacgccagcggggccgcgcgccctgaacgcgagttgcgcatcggctttcaaaaatttggcaatcttggcgtgttgaaagcgcgccagacgctggaacagtgcttcaatcagcagggtatcagcgtggtgtggagcgagtttcctgccggtccgcaactgttgtatgcgctgcaaaataatgagattgattttggcaccaccggtgaggtgccgcccattttcgctcaggccagtggtaacgccgtgacttatatcgcctgggagccacccgcgccgggcagcgtcgggattgtggtgccacacgacagtactatccacagcctggcagatttgcggggtaagcgtatctcggtcaataaaggatcgaatgttcactggttgctgttgcagctgctggaggaagccggcatcggtctggatgaaattaaagtggtgtacacgccgccgaaatatccgctcacagccagcgattatctggccgttgatgcatggatgatgtgggatccgctgctgagtgccgcagaaagcaacgccgatttgcgcgtgctggagaagggcgaaggccgggtgcgtaaccaccagttttatctggcgcgccatgattatgtgcagcagcatgacgatatcgtgcagcagctggtaacgagcctgcagcaaaccgggacctttatcgataatcatcgccatgaagccgccactatgctggcgcaggaactggggctggagttcgcagccgtggaacgtgccttatcccgtcgcagccaccagacccgggccatggttttccacgtcatcaaagaacagcaaactatcgctgaccgcttttatgcgctcggtttgattcataaaccggtgcgcgtgcgtgatgcagtgtggcagtcgcccagccagacggcgcttatggcatag

SEQ ID NO: 33217 - DNA, 1590 bp, Glycine max
  Peptide Sequence Number=SeqID_149995
ggtacgttctttaacgtaccgggcatccatctgtgtgaaccctcgccgcagcgcacgccggtgctatatcaggccggtgcatcgagccgcggcaaacagtttgccgctgagcacgcagaatgtgtgtttgtcgccgcgccgtccaaagtgctgttaaagaaaaccgtggccgacatccggcgtcgtgcagccgaagccggtcgcgatccgcgcagtattttgatcttcaacctgcagacggtgattgtcggtgaaaccgatcgggcggcacaggcgaagtggcaggagtataaaaactgggtcagctacgaaggcgcgctggcgctggtctccggctggaccggcatcgactttggacaatatcagccggaccaggtgctgaaatacctgcacaccaacgccattcagtcagcggttgaaactttctctactgccgatcccgatcgtcaatggacggtgaaagcgctggccgactgggtgggcatcggcggttttggcccgctgctggtgggcagtgcggcaacggtggcggatgagttgcagagctggcgcgcagcagcaggaggtcatatgatcgaaatcgagcgcctgagtaagcactaccgtgcgccggacggtcgcgtcaccgacgtgctgaaaacatcacgctgcaggtgccggaagccagcatcaccgccgtggtcggaccgagcggtgccggaaaatctaacgctggcgaaatgcatcagcctgctggagcagccgagcggcggcagcatccgggttaacggcagcgatttatcccggctggatggcgaagcgctgcgccgcgcgcgtcgcgccatcggcacggtatttcagtcttccgcgctgctgcagcgtaaaagtgcctgggaaaatatcgcgctgccgctgcgctatctcggtgtggtcgagcgcgatatccgcgcccgcgtcggcgagctgctggagagtgtcgggctgagccacaaagccagcgcctttcccgcccagctctccggtgggcagcggcagcgcatcggtattgcccgcgcgctggcgctgcgtccctctgtactgctggccgacgaagccacctccggcctcgatccggaagcgacggtcaccatccttgagctgctgaaaaaactgcgtgacgactaccggctggcaatcgtgctaatcacccatgaaatggatgccgtacgtcaggcggcggatgcggttgccgagattcgcgatggagagatagtgcagtatggcaccgtcagtgcgctgctggcacagccggacagcgcgctcggccagcggctgctgccgctgacggcacaagtcagtgatgccggactggtgctgcagcttagctaccgtaccgatgtcgcggtggccagcgactggatttcgcgcatcagccagcagttcgctttaaaggtggatctgctgggtgcgcatgtcgagcgggtcaatggcatccaggccggacggttgcaggtgggcattcattttcagcaggagcaggtgccgctggcacggttgctgacgcagcttgaacagtatggcctggcggccagcgttgctgtcagcgtgccgccgttacgggaggcggtatga

SEQ ID NO: 33218 - DNA, 387 bp, Glycine max
  Peptide Sequence Number=SeqID_149996
atggccgttttaagttttgctaaacataagtccccaaaatttttgcctctcccaaattcagccacaccaagtgcttctggtgtaccatttgaaggtacactgaatgatgattggaaatttgatttctctgtgcctcatgcccccggtgctcaacccaatgatgatgaaggacacttaccaataggagaggattcctctctccttcagagtattttggacaggtttgatggacttcaaacctatgttggtgaaaggtttgatgctttggaacaacaagtggacatgcgattcgacgagatggactcaaggatcaccaaggttgaaggagatgtcactttcatccgcacatactttgatctaccaccaccgccgccgccatcatcttag

SEQ ID NO: 33219 - DNA, 348 bp, Glycine max
  Peptide Sequence Number=SeqID_149997
atgcggctttcaaaagccaatgatccggcaagaagccttccggtcatatccgcttggttggtgcaaaccaaccgggggcatgaggcacagagaaatcaaatttccaatcatcattcagtgtaccttcaaatgtgcatggctaggggtaatccaggtgatttacaatcctttgatcctgaaatagatagaacctttcatagattagttaggcatagtgtgcatcttggtcattctgtgcattttgagcattttgagtattctgttgctggtgattttgaatattctgattttgagcattcgactactaattttcatattgagaacatggctcaacctccacctcgttag

SEQ ID NO: 33220 - DNA, 1059 bp, Glycine max
  Peptide Sequence Number=SeqID_149998
atgacgaaagataacaattgcggactacacgtcctcaccttaagagggctacacaccctcccctttagaggactacacgtcctcgccttcaagggactacacgtcctcaccttcagagggctacacaccctcgccatcagaagactacacatcctcgccatcagacggcttcacgtcctcaccttcagagggctacacgccctcaccttcaaaggactacacgtcctcggattcagaggactacacgtcctcaccttcagagggctacacgccctcacctttagaggactacacgtcctcgcaatcagagggctgcacgacctcaccttcagagggctatatgccctcaccttcagagagctacacgccctcacctttagaggactacacgtcctcgccttcagagggctccacgccttcacctttagagggctacatgccctcacattcagagggctacatgccctcaccttcagaggactacaagtcctcgccttcagagggctgcatgccctcgacctcagaggactacacttcctcgcctttagagggctgcacgtcctcacattcggagaacaacaggtcctcgccttcagagggctgcacacactcgcccgtcctcaccttcagaggactacgggtcttcactttcagaggaatacacgtcctcgccttcagcggactgcacgtcctcaccttcagaggactaaacagggcaacacgccctcgccttcagagggcaacacgccctcgccttcagaggactacacgtcatcgccttcagatgactacacgtcctcgccttcagagagttgcatgccctcgcctattatcaccttcagaggactacacgtcctcgcgttcagagggctgcacgccctcgcctttacaggactacacatcctccccttgagaggactacacgtactcaccatcagaggactacacgtcctcgccatcagaggactacaagtcctcgccttcagaggactacacgtccttgccttcacaggactagaatatcctcaccttcagcgggctacacgccctcgcctttag

SEQ ID NO: 33221 - DNA, 264 bp, Glycine max
  Peptide Sequence Number=SeqID_149999
atggtgagcgatcacttggaaacaatagaaggtcacgtttcaataattaaggcaaagtttgatggcaaaattgtcaccatcacaataccaaccattccaggaaaagtctctaaaaaagaagcagaatcaaacccaggggatgaaaaagaaggtactcctacagatgatgatcaaaagaaaaccattgttagtgatcaggttcccaaattaatagttgagtgtaaagaagagattgatcatgaggcttcaaccccatcaaattaa

SEQ ID NO: 33222 - DNA, 1153 bp, Glycine max
  Peptide Sequence Number=SeqID_150000
atggcgcaactacgtcattccgcacgacaaacgcatcgccgagatgacgggccagccttttggcgaagcctatttcaacggcctgctgcgcgacaccacggcagtgatggattccgagccgccgatcaccgctatcctggcggcggaaaagctggcggggcgcgggctggacatgctgcaccgcattcagcaggcgcactatcaagaaggccggcgcatcgccgatacgccggtgctggaagcgttggcgaaagaattggggttgccttcggcggcgtttatcgccgaaatgcgtttcaacaccggcgcgccaaccgcgcagcacatcgcggaaagccgggcgctactggccaaagtgcaaggccagggcttcccgacctttgcgctgcaggacagcgaaggcccctggaaaaacctgctgggcgccgccgcgctggcgtaacctacctttcccgccccggctgccggggcgggtcattcgacccgcacgaaccgcccttccgcgcgcacgttgtgaccgaacccgcaatccccccgcgtgtgcatctccagcgcttgctcgccaaattccagcgtgacgtcgcagacctgcgcgctttccgagtcatgctgatggtagaccgctttgccgtgctcaattggcagctcggcggtgaagtcacccatgttcggcccgtaatacagccccatctgcggcatggcgtagccggaaaaatcgatcagccagcgctcgccctgcggcttcaccgccacttcgctccacacgccgcgcccggcgtattgccaatacacaccgcccggcccctgcggctgcggccgctgcgccaggcgttggcgcaacaggctcatgttgtgctgcgatttgtcatcgtgcggcgccagcgccaggtaggcctgtgccttgagcaattccccggcgcgcatcagcgacagcgccacgttgttgtaggccgtggcgatggcctgctcgctcaggccgcaaaactcgctccaggccgcctgatcgcgaaagatgtcggcagctttggcgtaatcctgccgctgataggccttttttcccagttcggcgtagctcgccacctttgggcagtcggcggcgatgtccggctcgtcaacgtgtgcccaggcccgggcgccggcgaagacgccgcag

SEQ ID NO: 33223 - DNA, 267 bp, Glycine max
  Peptide Sequence Number=SeqID_150001
atgattttgcaaaccacttcctatcaaatcaaagattacatgcgtgatcatggatcaataggactttccttgggaatgggttcttttggtgggaaatttggctggcaaggattgacattctcaccctgggtcaaggttcatgataagttgggattttggctcaaggcttgtagaacggttggtcacgatatatgtcagggtttggccagcggttcggggataaaggggacgtcccacattatttccatgatatacatgcaacaatga

SEQ ID NO: 33224 - DNA, 306 bp, Glycine max
  Peptide Sequence Number=SeqID_150002
ctttcatctttttggcatcatcaaaagcttcatacaacatatgcttctacagctatcatcgaagctgatgctagaacaagtggaggaggttatggcagtgacccaagaaaggagaggcgtgatggagtgagagataggaataggaagatggaaaggagaggaagaatgaaagtgtttgggattgaacgttttttcgacatactagatgaaaagacaatgttcacggagcagcagcacaatctaaacagagttgctatgagagcttcaccaaaagacgacacatgtagcgtgcttgcaagaccttga

SEQ ID NO: 33225 - DNA, 171 bp, Glycine max
  Peptide Sequence Number=SeqID_150003
atgtgttcaaataccttgccttctttatctggtcatatacagctctataagtatacttccaccaagactcgaaagcggcttttattggcactagttgatgtaagctccattggagcttcagcagaatggagaaggaagagaggaggagacgccacttcaaggagaagatga

SEQ ID NO: 33226 - DNA, 501 bp, Glycine max
  Peptide Sequence Number=SeqID_150004
atgtttgtttcagattttcatgaagatattccagttagtgctgccaatggtaaacctaagattgagaagaagatagcaaatggtgaagatgaagattcctctgaatctgaatctgatgatgattcaagtgaagatcaggaggagggagacgatgaatctgatgaggagacacccaagaagattgaagcaagcaataacacgggtattgactcttctaagaaaacacttgtttctgtgaagaagacaaaatttgttactcctcagaagactaatagcaagaatgttggctatgttgcaactcctcacccttccaagcagactggtaaaccaactctgctaataacaagcagcagactccgaagtcaggagattacagctgcaacccttacaacagcaatcaggcacatcaattcacacataatttttatattggcttgcatgtcatttaagacagcagatgccttaagttctcataacaatgtcaagcacagcgctaactga

SEQ ID NO: 33227 - DNA, 555 bp, Glycine max
  Peptide Sequence Number=SeqID_150005
atgggaacgatgtacaactctgactccaagaaggactcctcccataatagaaaacaaatcacttggacacaggaaaatcaacatattggtaatgatgatttgatactttttcgtcgcaaactagatattatgaaacgacatgaggagccttactcaacaaatcttatgtcagtgttgcctccaatttgtttagttggaagtgttttgtggtgcgcggtggtgccactaatttgtttccaagtcattgagtggcaccaactcgataaagttttgagacaatttggcatgcaacaaccaattccaagttctcctccgcaaccatttaatattcaaggcataactttgaaaggaaaacatgataaaaattgggggcaactgttaggcccaatgatcaatcaatggaacaatcaggctgattttagggtcgacgcttatcctcgacaagaaggtctactgatctttaactctgactatatggtgtggttgaagttgcagagacgttacagtacatggtgtcgccacaagagagaaatacatggacagttgatgatctag

SEQ ID NO: 33228 - DNA, 133 bp, Glycine max
  Peptide Sequence Number=SeqID_150006
atggatttctttgtcgttctggagcgccctggctaccgtgtgggacgacgctgtcggtgcaaggctcgtgttagaattcagcatcgtgtcacgaaggaggatgccatgaagtggttccaagttaaatacgaag

SEQ ID NO: 33229 - DNA, 354 bp, Glycine max
  Peptide Sequence Number=SeqID_150007
atgatgataaacgaggaagtccccattctagagcttgtagatattgttgaattaagcaagacttttataaaatatcataatttacttcttcctagaccccttaactatgaagcaaacagtgtttcattcaagagtgtcaatgcaccaatttattttagctacaaggatgacaccttcgtatttaacttggaaccacttcatggcatcctccttcgtgacacgatgctgaattctaacacgagccttgcaccgacagcgtcgtcccacacggtagccagggcgctccagaacgacaaagaaatccattccgtaaatgccagtcgaaggatcatacctgaagcacaaaaatgttaa

SEQ ID NO: 33230 - DNA, 477 bp, Glycine max
  Peptide Sequence Number=SeqID_150008
atgggcgaaaatgcccttccgcgaaagctctttccgaaagaatcttcttctggaatcatttcggaagacacttttttcaaaaaagtttcggaagaaccttcttccgaaagaagattttgtgattccggaaaaactcagaaatacttttcgaaagaacatcatccggaatgtttccggaagaatgaaggttcttccggaagacaaccttcttcttccggaagaaggatttggtggtcccgtgaagcaggtgttccgtatttgaagtttttcgtcagagtaaatttgtggatgtggttatatgataatttgaatgtacttgtgtatgatgcatatgtccttaagatggacgaagatcaatggaggtataactatgcgatgtcacaagaagttcatatggattatgattatgataatgaaaaagaatgtggggtgaatgaaccacatgtggattgttcaaatgcttttaatacgtctcag

SEQ ID NO: 33231 - DNA, 258 bp, Glycine max
  Peptide Sequence Number=SeqID_150009
atggcctccgaaaagaaactggcgaacccaatgcgagaaatcaaagtccagaaactcgtcctcaacatctccgtcggcgagagcggggatcgtctcacccgcgccgccaaggcacgtataagaaagtgctcgaacaactcagtggccaaacccctgttttctccaaaggaggaacgagaagatcgcgtgtcatgtgacagtgagaggggacaaggcgatgcagcttctggagagtggcttgaaggtgaaggagtatga

SEQ ID NO: 33232 - DNA, 144 bp, Glycine max
  Peptide Sequence Number=SeqID_150010
ccagaaggttggagttgggaatgagaaggtgcttcctctaagtggcaaccaggcacgtacaaaagggagagggtatgagagccatggagaaaatggggagtgcagattgactgagtttaccgagttagtgacagtgaaggagaa

SEQ ID NO: 33233 - DNA, 678 bp, Glycine max
  Peptide Sequence Number=SeqID_150011
atggtgaggattagagaaagaccacttcaaggcaacaaatggcacaaaatggaccaatcatatcccattccttactattgtcagcctgaggcatttcagggcaagtttgagattctatttctcacccttacaatgccaaagaaggccacttctcaagttgctcctaaacaacaagaagtgggaacatcccatgagataggtgaagtaaagcacacagaaaattggaagaagcaattcaagagaagattaagtgtttcaccaccaagtcctgacttaaaggcacaacaaaaaaaggattctcaaatccttttagaaccaattaaggatcaaaaggtgaaaaaagaattggtgccaaaaccaacaccaccaccaagggtagcgacaatgcaaacatatgaaaagtctcaaaagggtcaagaggtgagtgagtcaaaaccaacaacaacaatgctaaccaatttcaaaacaactgaaatatcacaaaagggtgaagaggaatctgaagcaaaattagaaccaacaatgttgacaaaagtcaaaacagctaaaagagcccaaaagggtgaagaggagtttcaagcaaaacaaacaccaacaatgctgaccaaagtcaacacagctgaaagccctcagaagggtgaagaggaatttgaagcaaaccaacaccaacaatactaa

SEQ ID NO: 33234 - DNA, 210 bp, Glycine max
  Peptide Sequence Number=SeqID_150012
atgagggagatcatgacaaaccaggcaacatcctgtgatttgaaggagttggtccgtaagtttattcctgagattattggaaaagacattgggaaggcaacatctagtattgaccctgtgaagaatgtgtttgatcgtaaagtcaagatcctgaaagcacctaagtttgatcttgggaaactaatggaggaaaactctgtcaatgcttag

SEQ ID NO: 33235 - DNA, 177 bp, Glycine max
  Peptide Sequence Number=SeqID_150013
atggcaaacatcaaagagggagctaccattctatttagcttctctaattatggcgatggagacgctatcgaggatgacatcgacaacgacattggtgaggtgcttatgcttattgagagggacgctgagcttgtcaaagtagcggagaagctcggggccgttgagggattggagtga

SEQ ID NO: 33236 - DNA, 468 bp, Glycine max
  Peptide Sequence Number=SeqID_150014
atggaagcactctggtggcaaagatcacatactccccgtgcatcatccccggtctttcaagtctctgttcgtagatacgtgaagaatgcaatatggctccttcctgatatggattccataggaaacttgtacaagccaggacaagtttatctggggagagacccagttctcccttatgttcccaatgttgatttatgtgatgccaagtgtttatctgagagacgaatccaaagagaagcacactacttttcttttgaggccggctcaagagaaatatggccttatggcatttggggtattaccatgactggttattggctttttattgtttggttgtctgatcttataggagggaagatacgctttaaacttggagctgaattaagtggagttgatggtgtggttatagaggagggaacaactggagatgggggaaaggatgttgctcaaaagggcatgtgcaagtaa

SEQ ID NO: 33237 - DNA, 153 bp, Glycine max
  Peptide Sequence Number=SeqID_150015
ggatttcttgatttgcgactaaagtcatggattcggaatctgctaactcgttgcttagccattgttcctagtttgattgttgcactcattggtggctctgctggagctggggagctcatcataattgcatcggtaagaataccttgccattag

SEQ ID NO: 33238 - DNA, 1026 bp, Glycine max
  Peptide Sequence Number=SeqID_150016
atggaaggcataataatattaatgatgtttcaggttgttgtttctgctcaagaccatattatgtgcattcagactgagagggaagcactcctccaattcaaggctgcacttctggatccctatggcatgctctcttcttggaccacttctgattgctgccaatggcaagggattcgctgcactaacctcaccgcccatgttctaatgctcgaccttcacggtggtgagtttaattatatgagcggagagatccacaagtcgttgatggagttgcaacaattaaagtatttaaacctcagttggaattcttttcaaggcagaggaatcccagagtttcttggttctctcaccaacttgagataccttgatctggaatattgtcgttttggcggaaaaattccaactcagtttggctctctttctcatttgaaatacttaaatcttgctttgaattctctggagggttcaatccctcgtcaacttggaaatctctcccagttgcagcatcttgatctcagcgccaatcattttgaaggaaatataccctctcaaattggaaatctctcccagttgctgcatcttgatctcagctacaattcttttgaaggaagtataccgtcccaacttgggaacctttcaaatttgcagaagctttatcttggaggcggtgctctcaaaattgacgatggagatcataggctgtctaatctcatttctttaacccatctttccgtgttacagatgcctaatctcaacacttctcatagcttcctccaaatgattgccaagctaccaaaacttagagaactgagtttaagtgaatgtagccttcccgatcagtttatccttccattgaggccctctaaattcaatttttctagttccctttccgtccttgatctttccttcaacagcctcacgtcatcaatgatactccagtggctgtccaacgtcacttccaaccttgttgagcttgaccttagttataacctcttggagggttccacatcaaaccattttggccgt

SEQ ID NO: 33239 - DNA, 2703 bp, Glycine max
  Peptide Sequence Number=SeqID_150017
atgatactccagtggctgtccaacgtcacttccaaccttgttgagcttgaccttagttataacctcttggagggttccacatcaaaccattttggccgtgtaatgaattctcttgagcacctcgacctctcatataatatattcaaggctgacgatttcaaatccttcgcgaatatatgcaccttacattctttatacatgccagcaaaccatttgactgaagaccttccatcaatccttcataatttgtctagtggttgtgttaaacactcattacaagatttggatttgtcagataatcaaatcactggctctttacccgacctttcagtattctcatctctaaaatcattgtttcttgatcaaaatcaattaaggggaaagatacctgaaggcatccgcttaccgtttcatttggaatctctgtcaatccaatcaaactctttagaaggtggaattcccaaatcatttgggaactcatgtgctttgagatcactggatatgtctggtaacaatttgaataaagagctttcggtgataattcatcaattgtctgggtgtgccagattctcgctgcaagaattgaacataggaggaaatcaaatcaatggtacgctttctgacctttcaatattctctgccttgaaaacattgggtctttcacgaaatcaattaaatggaaaaattccagagagtaccaaattgccatctctgttagagtctttgtcaattggatcaaactctttagaaggtggaattcacaaatcatttggggatgcatgtgctttgcgctcattgcacatgcctaataatagcttgagtgaagagtttccaatgataatccatcacttgtctggatgtgctagatattcattggaacgattatatctaagcatgaatcaaatcaatggtacgcttcctgacctttcaatattctcatctttaagaggattatatcttgagggaaacaagctaaatggagagattcctaaagatattaaatttccacctcaactggagagactagatatgcaatcaaattccttgaagggtgtgctcactgactatcatttcgctaatatgtctaagttagaccacttggagttatctgacaactctttagtgaccttggcatttagccaaaattgggtcccaccatttcagttgcgcttcataggattgcgatcttgcaagctaggtccagtatttcccaaatggttggagacacaaaatcaatttcagggtattgacatttcaaatgctggaatagcagatatggttccaaagtggttttgggctaatttagcattccgagaattgatttcaatgaatatttcatacaataatctccatggtataattccaaattttccaataaggaatattcaacattccctaattcttggatcaaatcaatttgatggccctgttccaccatttctgcgaggtttcgtatttcttgatttatccaaaaataaattctcagattctctttcatttttatgtgtgaatgttaaagttgaaactttgtacgaattagacctttcaaataatcatttctctggaaaaattccggactgttggagccatttcaagtcattaacttatttggacttaagtcacaataatttttcaggaaggatacccacatccatgggatctcttcttcatcttcaagcattgctattgagaaacaacaacttaacagatgagatacctatctccttgaggagttgtacaaatctagtaatgctagatatttcagaaaacagattatcagggcttatccctgcttggattgggagcgaattacaagagttgcaatttttaagtttgggaagaaataatttccatggaagtttaccattgcaaatttgctacctaagtgacattcaactcttggatgtgtcactaaaccgcatgtctgggcaaattcctaaatgcataaaaaattttacttcaatgactcaaaagacatcttcaagagattatcaaggtcattcatatcttgtcaataccattggcatttattattattatacatatgatttgaatgcactcttgatgtggaaaggttcagaacaaatgttcaaaaataatgtgttactacttttaaaaagcattgatctctcaagcaatcacttttctggagaaattccactggaaatagaggatttatttggattggtttcattgaatttatcaagaaaccatttgaccggagcgattccttcaaatattggaaagttaacattacttgactttcttgatttgtcaagaaaccatctaattggttcaattccatggagtcttactcaaattgatcgactcggcgtgttagatttgtcacataacaatctatctggagaaattccaactggtacacaattacagagtttcaatgcctcatgttatgaagataatcttgatctttgtggaccgccactagagaaattgtgtattgatgggaagcctgcacaggaaccaattgttaaacttcctgaagatgaaaatttgcttttcacccgtgaattttacatgagtatggcaattggatttgttataagcttttggggcgtttttggctcaatcttaatgaatcgttcttggagacatgcttatttcaagttcataagcaatttatcagacgctatttatgtcatggtagcagtgaaagttttcaagtggcgtcacagacgatag

SEQ ID NO: 33240 - DNA, 288 bp, Glycine max
  Peptide Sequence Number=SeqID_150018
atgcaggatggtggaagcagtcaacactgtatcatcatcgtgattttacaaagaataatattactcggtgaaagagcagtctatgcaatgatgctggtgtttccacctgaattttctcctttgaaaactattttatttggaaatccttcccaaaacactgttgaatcactgatggaggctttggaggaagattataaagatggaaatgagataaatgaatcaaggcagtttattgaaggagtattggatcttgaaaagagaatcaatagactagatacattgacttag

SEQ ID NO: 33241 - DNA, 462 bp, Glycine max
  Peptide Sequence Number=SeqID_150019
atggcttacaaattctgttttgaagcacttgatcaaagtctaagagatgttattaaggcaaaatcaagttctgataaaatctttggtggtaaagttatgatatttggtggagattttcggcagattctgccagtcattcctaggggtagccggtctgacattgttaatgcaactataaattcatcttatctatggaatcattgccatgttttggcactgtcgaaaaacatgcgtttagaagccaatatagatgcaacagacagagaagaaactttagcttttgcacaaaggatccttaatattggtgatgggattgttggccagcaaaatgatggttcattaggcaagctttggaaagtgttgtttttcaccttctcgctaagccaatctgctggcttagcgagcgttcgcaaaacgcaacactcatgggctaagcgcgaggaagactctggaagaaaatga

SEQ ID NO: 33242 - DNA, 504 bp, Glycine max
  Peptide Sequence Number=SeqID_150020
ggtacatcttttgtggtacaagaagagggtacatctacttgggttgttgtgactgagaacaagagagggtacatctcttgtggattagttctagtggagggtacatccactaggttgttcaaagagaacaaggaagggtacatcccttgtggatctttgcttgtaaaggattttacaaggttgaaaagaaatctcaaggaccgcaggtcgcttggggactggatgtatgcacgggttgttgccgaaccaagtgacaaccttaaaaatgaaaactacaatcaattggggcatacccttctcgaggtttttgttgtgctaggaggaaagggtgaacactacttgtggatctgctcccggggctcccccaagtcggactttgtgggcttcattgcagtgtatgtcaccattattcatgccgatgcacaaaaatggaagaagaagttgctaatgtgtctggaaataagagagggctttggcgtacaatggaatagaaaacctagatag

SEQ ID NO: 33243 - DNA, 399 bp, Glycine max
  Peptide Sequence Number=SeqID_150021
atgaaggcccttcttggagcacatgatgttcgggaaatggttggaaaaggctataaggagtcgcaagatgagacttcattatcccaagcacaaattaagacttttaaggattcaagaaagagatacaagaaagaccgagtccattaccaattattttcaagaatcctcattgtttcaaatcaactaaaaagaagtggtgagaagttagaagatgtaagaattatggagaacatattacattcattatatcccaaatttgagcacattgttgtgacaatcgaggaaaccaatgatttagaaaccatgatgatagaacaacttcaaggatcattgcaagcttatgaggagaagcataagaagaagcaagagatcaccaagcaactctcaagatgcaactaa

SEQ ID NO: 33244 - DNA, 393 bp, Glycine max
  Peptide Sequence Number=SeqID_150022
atgatagaagtctccgtcgaagccatcgcatccctcgctcaatattacgaccagtcgctaagatgcttcatgtttggggactttcagttgcgcttggaggaaagggccgaagctttggcagatcaaggagaatggacttcattcattgatatattagcattgttggggttcgggaccatactctttccaaatgtagacggcctagtggatttagcaacgatcgacgcttttcttgcttatcaccacaataaggaaagcccggtcattactgatgcaatcctccctaggaagggacaagtcactagagccatgagcaagaggctccaagaggattgggcaagagctgctgaagaaggccctaggattctcatgaacctcagggtagatttctga

SEQ ID NO: 33245 - DNA, 693 bp, Glycine max
  Peptide Sequence Number=SeqID_150023
atgagagaaggtactccaccgaaagaacattttgatgagttaaactatgttctgatagagctctatggcattgatgtcaagatagaagatgaagatctagcaatgattttgttagcctctctccgtctttcctataagaatttgaagaagaagaaagacaaaggtagcaagaagagcaaggttgatccaaaagacatctatgattactgcgaagaacctggtcattggaagaaagattgtctagagaaaatatgtgatgggattgctaaagccttaaccaatgctcatcatgctccagagcttaagaaaaatctagtctttgtgggtgccatggattcaaaaggtttttcttgttgggttgaaggtggagttatgcaaatcaaagggaaaggggaagtttgtggtaatgtgggacctcttcagttttgtgaataccatgtctataagaagcaacatcagacaaaattcccaaaggttgtgcatgctacaaaggccatattggactgtgtttattttgattgttgggggcctttgagagttccatcactgggaggggcaaggtacttcctctccatcatcgatgattactccagaatgacattggtattcatgatgaagcagaaatctaaagctttcaaatgtttcaagcattggatgattcttatgaagaatcaaacaggaaagacaatgtag

SEQ ID NO: 33246 - DNA, 378 bp, Glycine max
  Peptide Sequence Number=SeqID_150024
atgaaacatccatttgaggatcattctatttttcgtgctgagataattgatcagattgttgatgattatatgtttgattttgattatgctcttcatggtaggaaacatccatttttgtcttatatgcatacttgtcattccttatgtattgaatctgaatctgagtttgaatttgatcctgtatctgatttttatgctaagaataaatctgaatttgagtcaggttctgattttctgggtgttgtacctcttgatgttgattttctagagtcagaatgcattaaccatgtgtcataccctaatttcgtccggggaccattgtttggtggcatgcaactttcatttgatcacttcgaggagcttgacacccatcgttag

SEQ ID NO: 33247 - DNA, 600 bp, Glycine max
  Peptide Sequence Number=SeqID_150025
atgacgatggaaactctcttaggaaaattgcttacacatgaacatgagttacaatctcatgtagaagatatagaaaagaaaagggaagggattgcactcaaggctagttcctcaaaagaagatcgcaaagaaagctctagtgatgataaagatgtagagaatttgagcttaatggtgaacaagtttggcaaagttctcaaaagaaccaaagacagaaaatttactaaacctttaaagaaggtggaaagcaacaacaacaccttcacatgtttcgaatcttgggaagataatgcgtcaacaacctctgattcttctagtaaagaagaagttacaaatgtgtgcttaatggctgattcaaaggatgaatcctcaaccattgatgaaactaagagatgcagtggaaggaaaaggagaagaggagaagggaggcaccatccactagggaataagccatggaagaaggagcttcaccaccaagaatgtgccttggataaaaagcttgaagaggatgctttaatggaggaaaagaaagagggagagaaagagagaggggggagcacgaaattgaaggaagaaaaagggagagaagttgaactttga

SEQ ID NO: 33248 - DNA, 393 bp, Glycine max
  Peptide Sequence Number=SeqID_150026
atgacgataatgacaatggtggtcatagaggtggcattggtgatggtggcaatattgatgtcggtggcaacattggtggtgggtatgatgacgatggtggtgatggtaccaatgttgatggtggcaccaagtggtggtgatggtgacaatggcactgaaaatggcattgatggtggtagtgatggtgatagcaatatcggtgatgatggtgatggtggtggtggtagtgatgtcagtggtggtggcgatgatgtcgttaaatgtataacttcacgctgcccctgtgcagcaccacttttctcttcacagataaatgaggtattcccgcctggatctggcttcccgcctaaatcagagcatcaaagcaagtgtcttcttccacaagctgaatga

SEQ ID NO: 33249 - DNA, 459 bp, Glycine max
  Peptide Sequence Number=SeqID_150027
atggatccaaaggaattgactatcaaacttggtcttgaattcaatagtttggaagaggcatatttgttttggacagattatggaggcaagaaaggctttggagttagaaaaaagaattcaagcaagagtaagaaagatggttccattactcattataaatatgttttttgtaaggagggtgtacgtcaatatgataaaagagatcctaaaacaaccaatccaaaagctgagacaagaacaggaataactgaaaatcaagcatatgaacttgaagtggcagaagatgcagggattcaacaaaaagcctcatttgatttgatgagtaaatatgtcggaggtagagagaatctagggtataccaggcaagatgcaaagaattatttgaattctaagaggcgacgagtatggcttatggtgaagctgggtgtttgctacaatatttccaacaacaactcatag

SEQ ID NO: 33250 - DNA, 795 bp, Glycine max
  Peptide Sequence Number=SeqID_150028
atgtcacgaaaccttatggattatgcaaccgtcccctctttggcctctgaaatgttacggaactttacggattgcccattaacgcttcttttcgactcccgacatgtcacggaatttcacagattgcctaacgatgggtgtcaagtacctcgaagtggtcaagagaaggtcgcatcccaccaaatagatggtccctggacgaaattaggagtgcttttgtttggtggtgacgacaatggtgatggtagtgatgtcagcgacaacaacgacgatagaaatatcaatggtggtcatggtggtagtggcagtgatggtagaggtggcagtgataatgtggtcgtgacagaggtggtattagtggtggtcatggtaataatgtcggtggtgatggtgatggtggtggtagggacaatggtgggggtggtagtggcagtgttggtgacattggcgatggttgtggtggcaatgacaaaggtgatattgttggtagtggtggtgacaatgacggtggcggtgacattgatggttgtggtggtggtggtggtggtagtgatggtgatgttgatggcaatgatggtgggaccaagtgacggtggttgtgacaacattggtggtgtttgtggtggcgatgacggaggtgatggtgataacgacaatggcattgacattaatgggggtggtggtagcaatgctggtggtgaaggtgatgtcagtgtcaatggtggtgataatgacgatagtggtggtggtagtagtgtcggtgggcatggtggaggcagccagttatggcagtga

SEQ ID NO: 33251 - DNA, 432 bp, Glycine max
  Peptide Sequence Number=SeqID_150029
atgtatataaaacagtcccacaatcctaagcttacaaaaccatgctcatatgtcattgaggcatttcaccgagcacttggtgggcgcatgtttggacataaattgcaagagaatgggagcaatgtggcatgccccattgcttcagaatacaacctaggcctaaggccttttcattcaaatcctcaattcaagaaaacaagcaccaaagcaaaccaaaactgcctcacaattataagcatgttctcacaatttaaggcaccaaaagatgaagaaaacacatcaatgggaagcaaaaacctcaaggatggaattcttacttgttggagtgaattgaaacaccaaaaacgaaagcaaaacgcgatcaaaagtggcttaggggagcaagaaccgggttgctcgcccaagcgagctcagctcgcccaggcgagctaa

SEQ ID NO: 33252 - DNA, 174 bp, Glycine max
  Peptide Sequence Number=SeqID_150030
atgttctgtttgttccagcatatcacacgatgtttctactctacagcagttggaggattgagatgctatgagaatccaaagaataagattactacagtacctgctgaggaagaggaaatctggggtgcattgttcaaggtaatcttagagcttaagaagttagagttgaactag

SEQ ID NO: 33253 - DNA, 261 bp, Glycine max
  Peptide Sequence Number=SeqID_150031
atgttacggaacctcacggattgtgtaacaatgcttccttttgattttcggcatgttacagaatttcacgtattgtgcaacaatgggtgccaagtacctctaagtggtcaagcaaaggttatgaggcttcactgttatcaagcgagtcagagacccagcatgactacagatcgacctccactccttatggctcacatagacccgggtatagggcctaatatctcaatgtgtgtgcgaggtgtaggtgccatgtgtgcgtag

SEQ ID NO: 33254 - DNA, 426 bp, Glycine max
  Peptide Sequence Number=SeqID_150032
atgacaggcatgagtgttgttacatcacttggtcatgatccagatgtcttctatagtaatttacttgagggtgttagtgggataatcaagattgatacttttgactgtgaagaattttcaatgagaataggtggtgagatcaagtccttttcaactgatagttgggtagcacgaaaactttcaaaaaggatggataaatatatgttgtatttgctaacagtagggaaaaaggccttggcggatggtggaattactcatgacaaaatggatgagttaaataaagaaaaatgtgggattttgattggttcagttgggtggcatacagttaatgacattagactaattgatgaggaagttaaaactgcagtatataaaaaaattacatgtgactactcagttagactctttgataatgtgacaagttaa

SEQ ID NO: 33255 - DNA, 234 bp, Glycine max
  Peptide Sequence Number=SeqID_150033
atggcccttttcaggtcttggaaaggatcaacaacaatgcttatagatgataaggggtctgtagatttgaggacaaatcctcttcaagagggaggggatgatgtaatcctcccaaggaggggacccatcaccagagccatggctaggagactccaggaagattgggtcagggatgcaagagaagaccttaggattctcatgagccttagactagattttggatccatgggctaa

SEQ ID NO: 33256 - DNA, 150 bp, Glycine max
  Peptide Sequence Number=SeqID_150034
atgccgtttcgcttcttcaaacgaggagatacgagaaagcgcgttcttcttaaaaaagagagggggaaaaaacacggagaattcggcaaaggagagttgaatgtaaggggaattgaattcggaggagggatgcgtggaagaaagggataa

SEQ ID NO: 33257 - DNA, 384 bp, Glycine max
  Peptide Sequence Number=SeqID_150035
ggacagcgagtcaggtggtaggcggagaaaccttatggtcatctgcacctttcgtcaaccaaggcgaacgagttcgacgacattcaagcccgacgatgcacgagattctactctgctgggcggggacgatcaagtttgatagcgtgtggaaacatcgtgataggggtgtgtcgcaacatgcccttttgcgggcgagcgaggcgaggctcaagtgtgcgctttccaaaggaggaaagatgtgcggagtcgccaccaacgaaggtattagcacctctcatgtcgacaaaagcggagcttttgctcctacgtaccctccatcaaagaggaaatcagacctacgtagttctttcatgcgtgaatcaaatgattctttttacttgaagg

SEQ ID NO: 33258 - DNA, 834 bp, Glycine max
  Peptide Sequence Number=SeqID_150036
atgtcgtcaggccaagctacaccaggaggcattagcatcaatgatctagaaaaagcctatgatagattgaactatacgttggatagagaaacactacaggatattggccttcctaattctttcttggatctagtttggacttgcattattactcctagaaaagggtatggtttaagctcgtacctaaaaagtgggtgctcaaggcacaagacgaggaaaaggtctatgttcctagacctaaaatcacttgaaggaggatttgtcacctttgaagggatgggtaaagaaggcactgttggtaaaggaaaaattgtggttgctcaaggcactgttaggaaaggcaaaattgcaagaacgacatgggtggatgtggacgccctcgacggcatcgatgaggaggatgcttcaccccacgtgcacatgaattctgtgttctccatcaacaccaccgcgcacgtggcgctcttcagagcgctccatcgagctcctcaatgcgccttgctctgccacaacctaaaatgcctcgttactttctataacagcagcagcaactactgccgcattccgtgctcttttggcttcgtgccgtcgccgtcctcgcttcgatccgtccgcggactgctcctgcgaacgctgcgttgcatttcgagcttcacggcttcctttgcttctcctgctggtggtggaaatggcagcgctggaaccggcgacagtggcagaggtgacgattctggcagtgagtctggagatgctaatctcaaactggtaggagacgcgactcaggagctttccggactttcgcctaatgttatcaatcttgatgttttggtgtga

SEQ ID NO: 33259 - DNA, 201 bp, Glycine max
  Peptide Sequence Number=SeqID_150037
atgcaagaaaactttaagtatgaaaaaccgcaacaaatcgacataatagaaaacgcagaagacgggaagggtaaacgaagcacatcaacgtcggagcaacaaagaaaacactctcgtactcatcaaaatcgcagctttagtgtgttcgtccaccttctctgccaaccaaagaacagaggaactacggtgaaggaaagctag

SEQ ID NO: 33260 - DNA, 516 bp, Glycine max
  Peptide Sequence Number=SeqID_150038
tcacatgaagaggccaaacgatttcgattcaaagtcattcctaattgggatgatattgttgacctatgtgcaaaggatagagctactggactcggagcagaaaatgcattagatgcagatgatatcatgagcaaagaaacaaatgaagaggaagcaattcatagtgtgagttttgacttagagggatcaagttctgccacgagaaaaaacattcgcccaagtaagagtggagagaaagaagggatgatttcctcaatgaaagaagtagccgagtcattgaaagaatttgttgaagtgactaagaagaagatggagaacaaaaaaaagatggagataaaagaagctcaagaagtggtacatgaagtggtgagtgagctagataatatacctaattttaatggtgcacttagacatagagcaattgattggttgacagaaaatctcattaagtttgcgattataaaagctcttccattagatgagaaagaggattacatcttatcttttatgccttga

SEQ ID NO: 33261 - DNA, 1764 bp, Glycine max
  Peptide Sequence Number=SeqID_150039
gaacttgaggaaaatgttcttaggcagaaggcgaagattgattggctaaaattaggtgatggcaacaattcatttttctacacaaccgttaaatcgagggctaatgctaaagggatgaacatgctaaggaagattgatggtacaatttgtgcaactcaggaagatattgagaatctggtcctggagttttatggtgagctgatggggaaaaaatctaccaatctgaagcatatagatgcagatgctatgcgaagaggtgggcaactttcaatggagcaacgacaatttcttgttgccccagtcaatgatcaggaaatcctaaaagcgctgaatggtataggcgatttgaagtctcccggtatcgatggatacggggcaaattctttaaatccagcatttaactgcattattgtaactcttattcccaagcatgagaaggctgtctctgtgaaagactatagaccgattgcaggatgcactatcttatataagattatctcaaaaatacttacagctaggcttggaaaagttttgaatagtattgtaagtctgtgtcaagcggcctttgttcctggacagcaaatccataatcacattctgttggcctatgagcttataagagggtatgctaggaagaatggaaccccccgatgcatgattcaattagaccttcagaaagcgtatgacatggtggactggtttgctttggaaactattctgctggaaacaggtattcctaaagagtttgttaagtggattgtgcttattgtcactttcgtcacctacaggtttaatatcaatggtaattacaccaaatgtatgaaagctaataggggcatacgacaaggggaccccttatccccggtgctgttcgttattatcatggaatatctcaatagactcctccacaagatgcaaaggaatcctgatttcaatcatcattccaaatgcgaaaagctaaatattactaatttggcctttgctgacgatgtcttgctttttgctataggagattacagatcagtagagatgttgatgcagaccttgaataccttctctgaaacaactggtttagtggggcccctccctttcaaatacttaggtgtacccttgactagtaagaagttgtctatttctcattatctcagtctaattgatagaataactagaaagattaatcactggagtaataagttgttgagttatgctggccggctacaactcattaagagtgttaccttttccatagcaaactactggatgcaatgttttccgttgcctaagcctaggaaatacgggggtttgaatgttattcccctccaaacgtggaatcatgtcactatgatgaaactactttggagtcttagtgagaaggcagataatttgtggagtgatttgggccagaaggataggggaaaattcaatatgaagacactgtatctgaagatgcgatgtaaaggctcgaatgaggttgtgtggaatagacttttttgtggtaaccctgctaaacctcgcgctttgattactctatggcaagcctgccacgataggctacccacaaaagatcatttgcaaagatttggaatgctaggtgataagatttgttgcttctgtgagggaccagaatcccatgatcaccttttctttggatgtagtgtccttggtgatgtgtggaaacaagtccttgagtggattcagctggcggtgactgaaactgtctatggcatctggaaataccgcaatgctaagatttttgaagaaact

SEQ ID NO: 33262 - DNA, 444 bp, Glycine max
  Peptide Sequence Number=SeqID_150040
atgttgtcattcaaccaaatgcaatcccaacaaccacatttacttgagccatatgtagctctttccagtttccatgtgagcacaaagggaagttgtgttaatattaatgttgatctcttgggacaagaccttgacactgatatctcaaataggcatgtgttgtatgttgatgacattcctctttgcctagtttcccttgggagagtttatgagggatcgtcaattgtacaccacgtgtgtttggccaatggtatggtgaaggtgggtgttgaagaacttcgagatgctaattcttgtgtccctatacccactaaagtggttcaattagtgagacaggctttgaacaccttctttgcatgggcgaaacatcttgataaagaggtaccaaagaaactgaagaagcctgttgataagctagaacctgatgataatcccatatactaa

SEQ ID NO: 33263 - DNA, 168 bp, Glycine max
  Peptide Sequence Number=SeqID_150041
atgactgaagcacgtcaaaagggggtacggaaaaacagcccccttcagcctatttataggaaaaagggggaggaggttgccgcccagctcgcccagaagcattacgggtgtcctagaagccccgaaatcccattttttaacaaaacgggggaggtggttgccacctag

SEQ ID NO: 33264 - DNA, 285 bp, Glycine max
  Peptide Sequence Number=SeqID_150042
atgtatggaaaagtggtggctaaaaaccgctactatgcgttccactacaagcttccctcatctccaaaatgttcatcttctaggtcttcatcttcaccaatgtttgttagggctggatggttcaatgatataactgtacgatccacccttgcccacaattttgatgatcacaaaggtaaggacaaaaacaaaggaatgaacaaagggtttgtggaagaggtggttacgcgtgcggatctagcaattactagatctgagaaagggacaatgatttgtgatttctaa

SEQ ID NO: 33265 - DNA, 264 bp, Glycine max
  Peptide Sequence Number=SeqID_150043
atgtcgagaattaaccccgagttccactattataggctagccatttgtctacaggctagaccagttgcacaaagaaagaggaaactcgaccctgagaagggaaaaactatggataaaatcccgatctttaagcaagatgaggagaaaactatgtttatgactgatacgactaattattattattcggttatatcacttgatcttaagaatggcaaagcaacttatcagaggttgatggacagtcaatttgagcttaacccatga

SEQ ID NO: 33266 - DNA, 272 bp, Glycine max
  Peptide Sequence Number=SeqID_150044
atgattgcatcgccattcatgaacaagttcatctgtgtgacgaagtcacccacgtgtttgtttggatccgagaatccattgttacaattgatgttcaacaacttccatccttgtgggagttgtgcctccacaatcccgtcaacaaaggtgtcattttgcttcaaggatgcatctctctctgtagggcgatggtcgatgagtgatcatcaagctcctacacgagggacttgccatgtttgttgggttcccctttttaggggcacccacaatag

SEQ ID NO: 33267 - DNA, 210 bp, Glycine max
  Peptide Sequence Number=SeqID_150045
atgcagaaaaagaataggaaatcaaaggtagaaaacacactgaaattagaagatagaaatgaaaacgaaattggaattaaaagcagaaaacgaaactggaatttgaagcagaaaacgaaaatggagttgctacgtgaacagtaccatgcgcgtgaacataaccggcccatccctaaaaccctagcagctgggctcactaaaggtcactag

SEQ ID NO: 33268 - DNA, 132 bp, Glycine max
  Peptide Sequence Number=SeqID_150046
atgcggaaattgattaaggaaatgatggaaaataaggtggttaatttcgtgggtcttaataaggttaagtggtggctggacagaaatatagaaatggcaataactgaagctacagggctccaaatgaggtga

SEQ ID NO: 33269 - DNA, 153 bp, Glycine max
  Peptide Sequence Number=SeqID_150047
atggagcttgaaaatgcttcagctagcattgtcatcgctttcaagtaccttgaagtaccccaaaggttcacattaggtggctcaaagaatctaagggtgatagagataatattttggtgtgggtttcattgtcaatcaaatcggcaaccgtag

SEQ ID NO: 33270 - DNA, 525 bp, Glycine max
  Peptide Sequence Number=SeqID_150048
atggcaaaggaaagagagggagccatagaggaaagggagatcctacctatttttccagttccaggcctattcgaagtccgtgtagttggtgagccgtgtgatggaaaatcttcctgcatagttcggagaggttcacctccgtcgttggtggtcaccgccgtccccaatatgtccccacaaaagaccaccgacatccctgtcttggccaggcatacccaagaaattaatgttgtccccaggatgcccccttgtcgtcccagttccatccctatccccgtgcagtattggaaacaagagacaccacctagcagggtgctcaaggcttgctatttccctaattcctctcctttggaagcaaagaaactcttccagtcaagctatacctggaccaacattgcctcaacaaacgatttggttgaagaggggatatcttggcgcatagggaatgatgatgcagtcaagatttggtctaacaggtcgatccccaataatctcatcctcacagaagaatctgtagcaccctag

SEQ ID NO: 33271 - DNA, 456 bp, Glycine max
  Peptide Sequence Number=SeqID_150049
atgaggaagaaagttatgacagcaaaaaataagtctctgttatccgacacttatgcttgcattgctaatcgtaaacccaaaggggaaatatcttacgaaggcaagcgacctgatttgaagtgtcatcatcttgagcatctagtggaacaatctaggaagggagataaggaagtttcaagttctgcaaattcaaattccacaacccttcttggtaagtttgctggtttattggggaactccaagcttccttctcatgaaagtattgaaggtatgccaactgcattttcaacttctatgaaatttagtactgtgaatgatttttggattgatgattctgatatcgaggatcacatgacgaacaaattaagcaatcttttagatttcaaaaaattttctactccatctcatgtgtctattgccaatggtgttcttgttattgggaaaaagaaaacttaa

SEQ ID NO: 33272 - DNA, 333 bp, Glycine max
  Peptide Sequence Number=SeqID_150050
atgtttattctggtaggaacaggttatgcccatggcaagcggagaggaatcacattactagcagtttggagggctggtatctacgagcaaggcgagatgaagcatatcaaggtgacgcttcctgttatagaacaaataaaaaatacaaggtgttactcaggattacgtctccaacactccaacatcgtacccgtgaggcttaggtgtcagggagtgtggtctgcagcttttgtggtcaattatggatccaacagaaacggtattgttttcaatgaggcaatacctgatgcagccagtgttttggatatgatcattgtgagatcttggtcgtga

SEQ ID NO: 33273 - DNA, 1022 bp, Glycine max
  Peptide Sequence Number=SeqID_150051
atggtagtttctagtaaaggcctctttcttaaccaacaaaagtacattcttgacttacttgaagatgctaagatgatagactctaagccagctcttactccattggatagtaagttgaaacttgacacaacaagtgcaccattacaggctatcaatgactatcaccgattggtgggtaaacttatttatcttactattgctcgacctgatatcacttatgttgttagtctagctagccaatttatgcatgtgcctacagtttttcatttgggcattgtcaagcgcatcttacgataccttaaagggtctattgggtgtggaattgttctaaccaagaatggtcacacacaaataactggttataatgattctaattgggttggaaatgcacttgatcgaaaatctactactggtttttgtatgtttgttagtgataaccttgttgcttggcgtagcaaaaagcaacatgttgtagctcaatctagtgccatggcttctactacttgtgaaatgatatggatcaaaggtaagagaccctcccatttcctctttcatcctccatttttgttttgctccatgggcacttttaggagcttcatgaaagtgagttttaggtggggtattatcgtcctaatgttgtgcctcaattatctcgcaaatccagcaaagttcttggcttctatcttgctctcggtcttgatcacacgaagggtccttgtctttgataaatctttttatgaagatgtcccttctggatcaatttctctaatcctcaagggtagtaaattctactatgatgtgaccaataactcgataataacgacaatacttggatttttctacccttgggggaggtcgattcttagccgtttctggctaaaagaaaagaaagttcaagtagctgatgtctcgctaagcgaggcatatgcgcttagcgagtcacatccgctaagcgaggcacacagctcgcttagcatgccgggaaaccctagaagaggatcagtcagagatgtgctcgccca

SEQ ID NO: 33274 - DNA, 354 bp, Glycine max
  Peptide Sequence Number=SeqID_150052
atgagttgttacaagttcctttatccagataaggagaacaaaattatagagtccatgaatgctaagtttttggagcttgatgtggcagaccctgttgttccatctgatgatattgatgtcgagtcacgtgagactatttctttttctttgccactacctaatttagttgttagtgtttcgaatgctgttccaattaatgttggggttcagaccgtcccaattgagactagggtctcgattgttccagttgagaccataattgcgactggagatatagttgaatttgaagccaatgatatgcttgatccttctactatgaatgagaatgcacaactaattgagttgattccatag

SEQ ID NO: 33275 - DNA, 165 bp, Glycine max
  Peptide Sequence Number=SeqID_150053
atggagcaaagtgaacgtcaagggaggagagcagggtggggatgggaatgggtttgggttgagggttcaagaacacttggaaaagcttggaagaagaatgggaatggtgtctccttccctcatgatcagcttgtgaaagagaggaagaatgaccaagttttgtga

SEQ ID NO: 33276 - DNA, 1122 bp, Glycine max
  Peptide Sequence Number=SeqID_150054
accctggaagaggccatggaaataattgaaaatatggctgcaagtgatcatgccatactgcatgatcgaactcacattcccacaaaacgaagtctactggagctttcctctaaggatgcacttttggcacaaaacaacatatgcagaggagctcacgagtctggacgttgtattcccttagatgacatagcacaagaggtgaattacatggggggaaccaaaataggtcaggattcaatgcatgtggatattcatcttttcaacaaggttcaaattataaccagcaacaagggcagtggagggcatagcctctatgacagaacaactaagctggaggagacactggctcaatttatgcaagtcacaatgtcaaaccacaagagcacagagtctgccatcaaaaaccttgaaatccaagtgggacagttggcaaaacagttagcagaaaattcttctagcacttttggagcaaacactgagaagaatccaaaagaagaatgcaaaggcattatgaccagagggaaagaggtgccatatcctttggtaccatcaaagaaagacaaggagcaacaattagctcagttccttgacatcttcaagaaattggagataacaattcccttcggagaagccttgcagcagatgccactctattcaaaaattttgaaagatctattaaccaagaagagcaaaatccttccaccgaagcacaaggatcctgggagtgtcacaattccctgcttttttggtcctgtgtctgttggaaaagctctcattgatttgggggccagtataaacttgacgccactctccatgtgcaagagacttggagagttggagattatgccaacaaagatgacactacaactagcagatcattctattaccaaaccatatggtgtaattgaagatgttttggttagagtgaagcattttactttccccgttgattttgtagtgatggatattgaagaggacactgaagtccccttgatcttgggacctcccttcatgttaactgccaaaaagcatttgctcgaccagaatgtctgttcaaaggtagatgaaggatggaaggagatggttctgaaggttggaaccaaatttgatctagacccatga

SEQ ID NO: 33277 - DNA, 594 bp, Glycine max
  Peptide Sequence Number=SeqID_150055
atggatatggacttgggctcgctcatttccagccagatctcacagatggcccagtgcaactcctctcggtttggctttcctacactcatcatagcccagtgtgtagccaaaagagtcatatctgattctctcaccttcgagtccctgagccctaccattaatttggcatacatcaggaagaactgctggaacctagatgatcccatgatcacctttccggggacccgcaaagctagggctcggggaccatcaaacacttctgcttcttcctcctcagctccaactccttctgctccagcttcaccagcatcagtcttaagtatccacgacttggctcagcatcggcccatcatgagcatggaggcatttatggcccaggtggcctggccaggagttcagccttctcctttggggggaggtaaggctcctaaagcccaggagccgcagcctaagccggaggacacacctgaggccactccagaggtcacacctactgccacaccacttatggagatcgtagaggatgagggtggcgttgaggatatagattatgcagctgatatggtagcggcacagagcacttgggatccctag

SEQ ID NO: 33278 - DNA, 360 bp, Glycine max
  Peptide Sequence Number=SeqID_150056
atggcgccgggaatcggaggcctgcagctgacttccctcgccggcgaccggagaaccgccgccgccgactccgatgagctggaggacatgcggctcttggactcctacgacgaaatcaacggcggagcgaggcggattcaggtggaggttaccggaatgacctgcgctgcctgctctaattccgtcgaatcagctctcaaatcactcgacggcgtcatcagcgcctccgtcgcgctgcttcagaacaaagccgacgtcgttttcaacacggctctgctcaaggttcgtctctcttacttagttgcttttgcatcgttttactgcttcggaaaattgaactttgaagtgttagctgactaa

SEQ ID NO: 33279 - DNA, 444 bp, Glycine max
  Peptide Sequence Number=SeqID_150057
atgaagaaaaaggtttgtctaaacttgggtttatgttggcatggagaacctgaagccaatggtgaagggttatactcggtcaaaagtgcatacaaaattataatgactcaagttttttaccttagtgattttaagatccctagggattggaattgtgtgtggaagctgagtgtgccaccgaggatgcagaccctgatttggagacttgctcgtgagtgtctccctactagagctaatattaaagcaaaaggtgtagcttgctctttattgcgccctctatgcgagattgttgtggaaactgcattccgcactttctttgcgtgccaaactaacataggatgctggaattatgctgatggtgctttagtcgttgcacgaaccatgtggagagagccatgtatgcaagcccgaaggagaagcatggggaattctacaagcgcttga

SEQ ID NO: 33280 - DNA, 2424 bp, Glycine max
  Peptide Sequence Number=SeqID_150058
atggtggggttacttatatttagatatgaaatcacggttttttggactcctcggttacagacttacagcttttttctactgcatgatgaagacataaaaaatgcaattgaagatgctgggtttgaagcagacatattacctgaatccagtacagttggaaaggtgccacagggaaccctggtgggacagttcacaattggaggggtcagaagggctgtggtagctttggctacttcgtcaggtgaagttgaatatgatcccagtgtaattagtaaagatgatatagtcaacgcaattgaagattctggttttgatggttcatttatacaaagcaatgagcaggataaaataattttaagggtggttggtgtgtacagtctgattgacgcacaagttttagaaggcattcttagcagcacaaaaggagtaagacagtttcattttgatcaggtttcaggtgaattggatgttctgtttgatcctgaagttctcagttctagatccgttgttgatgcaatccaggagggaagcaatggaaaatttaaattacatgtcagaagcccttatacaagaatggcttctaaagacgttgcagagacctcaaccatatttcggctattcatctccagtctgtttcttagtattcctctcttcttcatgagggtagtttgtcctcatattccactattctattccttgttactttggcgatgtgggcctttcctcatggccagcagagctcttagaaatggttctacgaacatggatgtcctggttgctgtgggaactactgcttcttatgtttattctgtttgtgctcttctatatggtgctcttactggattttggtctccaacttactttgaaacaagtgctatgctcataacatttgtattgttgggcaagtatttggaatgccttgccaagggaaagacatctgatgctatcaagaaattagtagaacttactcctgcaacagctttactagttgtcaaagataaaggcggtaaatctattgaagtaagggaaattgattctttgcttattcaacctggggacacattgaaagttcttcctggtgcaaagattcctgctgatggtattgttacttggggctcaagttatgtgaatgagagcatggtaactggtgaatccgtacctattatgaaggaggtgaatgcttccgttattggaggcacaataaatttgcatggcgtccttcacattcaagccaccaaagtaggatctgatacagtattgagtcagattattagtttggttgagacggcccagatgtccaaagctcccatccagaagtttgctgattatgtagcaagcatatttgttccttcggttgtttctttagcattattgacattattgggttggtatgttgctgggtctattggagcttacccagaagaatggctgccagaaaatggaaatcactttgtttttgccctaatgttctcaatatctgtagtagtgattgcatgtccctgtgcacttggcttggcaacaccaactgctgtcatggtggcaacaggggttggggctaacaatggagtgttaattaaaggaggagatgccttggaaagggctcagagggtgaagtatgtgatatttgataaaacaggcactctaactcagggaaaagccactgttactgcagccaagacattcacaggaatggaacgtggagaatttcttaaattggtggcttctgctgaggctagcagtgaacacccactagcaaaagcaattttagcatatgcacgccattttcatttctttgatgactcttctgatactactggtaccgagattgatgctgaaaatgatgcaaagtctgggtggctttttgatgtctcagacttctctgctcttcctggaataggtgttcaatgttttatagacgggaagcttattttggttggtaacaggaagttgatggaggaaaatggcatagatatttcaacagaagtggaaaattttgtggtagagctggaagaaagtgcgaagacagggatactggttgcatataatgatatattaactggagtcttggggattgcagacccactaaagagagaggcttctgtagtcatagagggcctccagaaaatgggtgtcacacctgttatggttacaggagataactggagaacagctcgtgctgttgccaaggaggttggcatccaagatgttagggcagaggtcatgccagcgggaaaagctgacgttgttcgttcattccaaaaagatgggagcatagttgcaatggtgggtgatggtatcaatgattctcctgcattagctgctgctgatgttggtatggcaattggggctgggactgacatagcaatagaagctgctgagtatccatcgatctttcccggaagaccttttctcgtattcgattga

SEQ ID NO: 33281 - DNA, 600 bp, Glycine max
  Peptide Sequence Number=SeqID_150059
atgaggagagcgagaatcatgggggtattaatgaaggtggcatgtgcaactaatgctgagaaatcaagaaagattgtttgtgctagaggaggtggggcaacatcaagggttggtggagatgctatccaggtggaaaataagaggtatagatgtgactcacgtgaggtctcggtgcccaggcctgctaggagaaatgattatcatgagatggaattgttaagacctagtcaaacccaagtagatgtaccctctacttgtaccacaaaggatgttccctccaatgtgttgagacaaagatctcaggctgttaaacctttgatactttgtgaatggggatacaaaagaattctcaggcgggagaagggagacacaaaagaatttaggcggttagtcctttgttcttttggaaaagggagaagagagacacaaaaagaattcaggcggttagtccttggtgaattctttttggcaaagggagaagagaatgaaaagatgaataacacaagttttcaaggtttggaaaaccagaaaacttcaaaaagcttttggtacaaagaagaagaagaagttcaaagagattcaaggcttgtaaaggattga

SEQ ID NO: 33282 - DNA, 1371 bp, Glycine max
  Peptide Sequence Number=SeqID_150060
accttgcccctgcacgagcacgagtttggagggtggtgtggtagcattgttccatttccattcgaggatggtgaagcaagacgtgaaacattggatgaattcaggacgactctgaatcagaaagaggccaaaatagcatctggacaatttccagtacttggtagcgagggaagatttccgatacggacgcaatctgacatatacctaggctctcatataataagtgacatcccgacgatggcaaggtttctacggcttccacctgggatgagccttttatctattgagggatggaaggaggaggtccaggaaatggacccactgttgtgggcagtcgtggatgaaagccccgagatattgctccacgacgtggttgagtacctcagtttgatcgttcgttttagggtcgaagaaaaggatggccacaaaatgagccgtatattgagctgtccaaagatagctcttcccacagggcgttggggactggaagaggatgaagtaaacccacgggtttcttcgtctctagaagttatcttggacacggtgaagagttttcgcaaagcccaagtggccaccgataggtgtagagtgaaattcctccataataatgggaataaatgtgttatccgagggaagccatatcttcttatggaagaagaccaagtcacggctgatggtgaacccttcatgttctggaaattggtagatgttatttatcagggtggatcaaagttgggaagggataatgagagtagagtccctgaagaaggtgggggtttgttgttctggggtctgaatgacttgcctcatgaggtgcttgagactcttgtggttagtgtgaatgatgaagtgactgtcgtgcaagtaatggcgccatttacggacaatgacagtgatggcatgcagttcgcagacataggtggatgctcgctaaagtcgagcacagaacaccttactgtggaaagcgatggaatgggaacgttggatgagggaactggctatggaggcgtaacctttgataaagcgaaggtagaaacccgtgaggccgaggaagccatgtcgagcttggagaaccatttagcttgccccaattcgtctaagagtttgtcaatggtgggcatcacaggggatgagaatggactttggcttatccggatgagaccattggcaagcatggaagcaacttgtagtggtacgggcggacatttacgaggtggattgaggaaggaggtggatgtgggggttccttggaggattgagatgtcaccgataacaatgagaggtgaaacagggccgatatactatttgtttggaatatgcgtcaaacctgttgagcgaatacggagctgggctgggatgggacatctgtag

SEQ ID NO: 33283 - DNA, 180 bp, Glycine max
  Peptide Sequence Number=SeqID_150061
atggatccttcaccaagacttcatcaacagtcccaacagtcaaacagtataaatgttgtggttttatctctcctagcctcaccacttttggattatgtaaaaatctaccaagtgaggaaccttgagatccctgagaaaattgagattgagaataggcatcttcctgagttacttcactag

SEQ ID NO: 33284 - DNA, 1426 bp, Glycine max
  Peptide Sequence Number=SeqID_150062
gcgcaaacgatttcagttaaagagagaaactcggggaagagagatagagagagtcagcgattgatcatacatggatacgcacgcggtgcatttggccctggcggcgctcgtcggagcctccgtcgtggccgtgtcggcgtactacatgcaccgcaagacgctggcgcagctgctggagaagcgccgcaacggcggataccgccggggctccgcgtcgctgccggacgtcacggcgatctctggcgggttcgacggggacgagaagcggaacgggccggtgcacgtcgaggggattccggcggggctgccaaggttgcacacgctccgggaagtcttttaagaccaacttctcccaagtcccctgttgcaagtgccagtgcctttgaaagtgtagaaggatcagatgatgaagataacatgacagacaaagttaaacttgatactacatatctgcatgcaaatgggactgttggtccagaaggtaaaatcccatttgagactttacctaatcatgttaatgccaatggagagcagatggcaattacaccgagtatgatccgctctcatagtgtttctggtgacctgcatggtgtgcagcctgatccaatagcagctgacattctgaggaaagagccagagcatgaaactttcacaagattgagaataactcctcttgaggctccgtcacctgatgaaattgaagcttatgtggttctgcaagaatgccttgaaatgagaaaaagatatgtttttagagaagctgttgctccgtgggataaagaagttatatccgaccccagcacacccaagcctaacccagatccatttttatacattcctgaaggaaattctgatcattattttgaaatgcaagatggggttattcgtgtatatccagatagagatgcaaaagaagagctttttcctgtagctgatgcaactacatttttcactgatcttcatcacttacttcgagtcatagcagcagggaatataagaactttatgccatcataggctcaatcttctagaacaaaaattcaatcttcatttgatgctaaatgcggatagagaatttcttgctcagaagagtgctccacatcgagacttctataatgttagaaaagttgatactcatgtccaccactcagcatgcatgaatcagaaacatcttttaaggttcataaagtcaaagctgagaaaagagcctgatgaggttgtaatatttcgagatgggacatatctaacgttggaagaggttttcaagagtttagatttgtctggatatgacctcaatgttgaccttttggacgttcacgcagacaagagtacttttcatcgctttgataagttcaatcttaaatacaatccttgcggtcaaagtaggctcagggagatatttcttaagcaggataatctcattcaag

SEQ ID NO: 33285 - DNA, 300 bp, Glycine max
  Peptide Sequence Number=SeqID_150063
atggctaaatttgaggaattgtgtttagatcttcatgacaggctcaggacacttgttgaaaactcatcgagggatgcaaaactcttgtttaaggatcttgatgaagtcatccttgttggtggatcaacacgtgcccttggagctacaattcaggctagtgtcttggttggagatgtcagcaacattgtgttgttggatgtcacaccattatctttgggtctggaaactataggtggtgtgatgacaaaaattatccctagaaatgctactcttcccacctcaaagtctgaggttttctga

SEQ ID NO: 33286 - DNA, 540 bp, Glycine max
  Peptide Sequence Number=SeqID_150064
atgtttgtattgaacaatgctttgaaaggacttgatgatactccacaaagtaagtccaaggctgctgctaggtggattgttgttaaatatttcaatgatgctagaccattggaatcagagagactaaaggcgctttgcatccagtgggaaacctattatttgaaagttctgaggaagcttgtggatgatgcttccaagtttttgagcgataaggttaccaaggtcgttgttactgttcctgcttatttcaatgactcccaaaggactgtcactaaggatgtgataactgaggccatttgtctaacagcctatggctttgaaaagaaaaacaatgaagcaattcttgtttttgaccttagaggtggcacctttgatgactctatgctcgaggttggtgatggagtgtttaaggtcctctctacttctagggatacccacttgggtggcgatgacttatataagagaatttttgattggctagcttccaactttaagagagatgaaagcataggccttttgaaagacaaacaagttctttag

SEQ ID NO: 33287 - DNA, 297 bp, Glycine max
  Peptide Sequence Number=SeqID_150065
atgtcacctaacataatcagagaagaagaagtagacgacgttcatgctaattgtaaatggctacaccacccagctctcctcctcctcctccttctcctactgacaagaaaagccatacacctaagatcattggctactaggccaattggggcaaagagacccttggtccatgtggatcccgcaatcgggaaagccaacggtccccacaaaaagaagttaagaacatatttggggatcatcactcgtgataaggtgaatgtgacatacgagaattggaaacaagtctctactacttag

SEQ ID NO: 33288 - DNA, 237 bp, Glycine max
  Peptide Sequence Number=SeqID_150066
atgaacgacccaaaaacactcaacaacatagcaccccaagacgctagagacaaccttaaccgagaaaccaatgctaagcttcactatgctctagacctcacacgtgtcacttggagagttacagaacctgcgtgtcttctttctcctttagccgcgtctgtgttgcacgtgtcagtgcatggcaacacttactttttcattttaaccggttgtcaccttctggttaatcccctctaa

SEQ ID NO: 33289 - DNA, 681 bp, Glycine max
  Peptide Sequence Number=SeqID_150067
gttgttgggttggatttggttgatgatgaaagcaaacctgaaagacggccaacaaaacacatgcctacacctgagcaatggactaatgttttcaatccggcattttcatactatgtctattactgttatgcaaatctttacaccttaaacaagcttcgagaatcaaagggaatgacaacaatcaaattccgtccacattctggagaggctggtgatattgaccaccttgcagcaacctttctcacggctcacaacattgcacatggaatcaatttgaaaaaatctcctgtgcttcaatatttatattatttagcccagattgggctggcaatgtctcctttgagcaataactccctattcttagactaccatcggaatccttttccaatgttcttcttacggggtctgaatgtgtcactttctactgatgatcctctccaaattcacttaacaaaggaaccattggttgaagaatatagcatagctgcttctgtgtggaagttgagctcatgtgatttatgtgagattgcccgtaattcagtttatcaatcaggtttctcacatgctttaaagaaagctgagagattcatgtgtttgaagttggagcgggtaaactggacttctcggagaatcacaccacaaaagctacttcttgtagttggagagtccaaggccgtctaa

SEQ ID NO: 33290 - DNA, 255 bp, Glycine max
  Peptide Sequence Number=SeqID_150068
atggtcatttttctgagacaagtttggtgggctgcggttgccatccaacatgagatcctgcgtaggaaccaacttcacaacctgctccagagcctcaccctaatgaagatgactcagaacttgaaaaagatgaagaaccagagcctgagcctcaaaaagtcagtcaaattcactaaactattacaacaaaaaacacaaaacaacattcttttcaagaataataagaccaagaaaaatacaaatattgaggattaa

SEQ ID NO: 33291 - DNA, 126 bp, Glycine max
  Peptide Sequence Number=SeqID_150069
atgaggtttttcactgacatgggtgtcacagaagcagtatcaatgttttctgaggcctctatggaattaaagacatgcaatgtagcactgctcgaaactcctgggaaatcttgggatgaggtttga

SEQ ID NO: 33292 - DNA, 324 bp, Glycine max
  Peptide Sequence Number=SeqID_150070
atggagactaaaaaattacattgtgtgcttcgtcaatataggaaagttaataggtacaccattagcgacattaagggaattcaccccaccttttgcatgcttaggatttttatggaagaggggcatataccttacattgattgtcaacataggttgaacccaaacatgaaagcagaggtcaagaaagaggttttgaaattgttgggtgctatggtgatttacccaatttctgacagtccttgggtgagccctgttcatgtggttcccaaaaagggtggaaaattgaatagtgccactaggaaagaccacttcccactgccttaa

SEQ ID NO: 33293 - DNA, 357 bp, Glycine max
  Peptide Sequence Number=SeqID_150071
atgacaagcccaacaccaactcccccattctacattgacaccaacaagactttgtgggagcacgatgatgcgctccatgtgaaccgcttctacaggttccttcgttgccatcatgcattggtggacgtactaggataccaaccctgcataatagacctcaaagtttcatggacccagcctacaccgtcttactaccgcttcacaatgcttgcgcctaagctggttattccttttgagttgcattcaccgcccgcgaatgatgtgatttcttcctctagatctcactcctcatataaggatactgagaccatttcccccactatgatgtctcctcgatcgatattgcctaagttttaa

SEQ ID NO: 33294 - DNA, 165 bp, Glycine max
  Peptide Sequence Number=SeqID_150072
atggctcttctttctttggagatcccactgttccttcttccgagggcaaggatggaaattctcatcatgggtcaaggtttatggtggtttgaggttttggctcaaaaggcttgtagaacggctgaacatgatatatgtcagggtgttggtttggccaacgattaa

SEQ ID NO: 33295 - DNA, 273 bp, Glycine max
  Peptide Sequence Number=SeqID_150073
atgactgcggtaatggcagctaaaatcagatggaggcagaggcagcaaaagcatttcactgttgtgaagcacaacaaatatatggcaaaaggactaatcaaagttatgggatttagctccaaattctttggagtcatattcgaattactatatgagatgcaaaagaaggtggaagaaaaatttaatgatctggggacgtgtgaaagagaggagtatgaatctagggaagcttatgaacaacaaaagaagtttgagtccttgatggttagttag

SEQ ID NO: 33296 - DNA, 462 bp, Glycine max
  Peptide Sequence Number=SeqID_150074
atgattaatttgcgaagtttgatcactgaacggatgaacaagtttttccgtgaaaatattgagtttctatttgatcattttgagtgtcaggatctgtgtgccatagtggaattagagaagttgttggatgtcttaaaatattcacatgaactactgtctagagatctttctgtagactcttttagtctcatgttgaacgagatgcaagagaacatttcccttgtatcattttctagtcgacttgcctcacagattactttgcatgaaccaatgattacaggattacaagactctgccaaaatcaattgggcttcttcctttcgatggaggtgtgatagtgatgcaatcctccctaggaagggaccagtcactagagccatgagcaagaggctccaagaggattgggctagagctgctgaagaagaccttagggttctaatgaacctcaggatagatttctga

SEQ ID NO: 33297 - DNA, 312 bp, Glycine max
  Peptide Sequence Number=SeqID_150075
atgagcaatggctataatgctatatataggcatagccgcatagggaacttggttcctggtggccatgatgtggctcttggtttgtttcatgaattagttgattctttatgcaagattcttcctggtggtggagcctcgatctcacgtatggcaacaaacatattaattgactccgcatacacgatcccatgttacataatcacatcaacaaagggtgttgagggtagtggaagagctgtgttactatcatcttgctacaaaactttcaatttcagacacctctttatgtatctttgttgtcttttaccttag

SEQ ID NO: 33298 - DNA, 2113 bp, Glycine max
  Peptide Sequence Number=SeqID_150076
attgctagctatcggtccaaatttgaatgttccaacttggaagggatatgatatcaatcattattctttctacacaaagtcccaggatgataaaagtagtatgcagaacagcggggttagtgtggatggtcaatcgcatcacttttgtagtgcttctgacaatagccccattgaagcatgcatgccttactatggagtcattgaagacatttgggaacttgattatggtgaatttagagtacctctctttaaatgtaagtgggtcaatggaaatacaggtgtgcgtcaagacaaaatgggatttactttagtagaccttaaaaaggtaggttacaaggatgacacattcataatgacagtgcaagctcgacaagtgttttatgtagaagatccctacgactctagatgggtagtggttttgcaagggagaacaatttctacaagtcaccatattgatggttcaacacttgatgcacctgacatgctgcctttctccaaatacatgccttcaactactaatgaacaaatggaggatgatgtatatgcaaatcgtactgatcatgatgagggtttatgggagaacattcctaccttagataacccacgaccaattgtgaacgtgaatcctgctacaggtagaggctcagggcctcataaagagaaatttcacagttatctaggggttgtcacaagggaaaaaattcctattgtccacgcgaattggagtgttgtcccagacaatctaaagaacctaatatgggaagatattttggaatcatttacttactgttacataacaccttttgttgtgcatcacaaacttgacatccctgaacgtgaggaggcaaaaaagaagtcgtcattgacttctaaatttgtctatgctgacaatgaaggtcagcaaatatctgatcctacggtgaagtatggtcttgatctagcaacatgggccgaatttgcaaaaagccaccaaacccctaattggcagaaacttatggacgagaagaggaagcgtcgagatcagcaagatgagtttactgaaaacccaacactcaacctcgaccctccatccccagtgtcgagacacctgaagtggaagatggcccgcacaaagcgttatggccaaatgacttctgaagcggcacaacaaattgcaaacaaaattgaacaggctacgcagggaagctttgttctgcataggcgtcaggatatactgaacacgaccataagccgacctgagcatctaggacatgttcgtgtcacaaggacaggtgtcacaataagccaatactttagcaaagtgtcatgtgcttctagcacgtcctcaccatcaatcaaccaacaacagttgcctgaaatcatcagtggaattaaggatgagataagaaaggagccttctgatgttgatgtggatctaatgggtttgttcgtagttgaagatgaaagtactttgctagtggccttgggaaaagtgtatgacaattcatccaccatacacaatgtttgttatgcagatgacgttgttagggtgaatgttgtcacatattaccaccctgacactgaggtcctttttcctacatcagagcctccatcgaagtctgttgaacaaactgacagggccaatgttgtggccacagatgatcccctgggagagttggttaagaagttggcacattggcaacttcttgtgttgtgtccacgagagaatattgtagtatggttttgttctatacggagaaagcatgatgttcacattaaggctacagttaacagcgcaatgaagaaaatatccattactttccaaggcaaggagaatggacctccacctcaatggattgaaccaaagagttatgtacaagccggagcctatgagtgtggatattatgtgatgcataggatgtggtgcatcgtcaccggcggtttgaagaatgaatggaacaagtgtttttctaatggaacaccattagacagtgacaccatgacgacattacgaaagaaatgggcagcctattttctacaagttggaaagatggatgttgttccagttactcttcaacaattacatgctccaactaaagctccttattggcctgttgctgctgatggttggtaa

SEQ ID NO: 33299 - DNA, 271 bp, Glycine max
  Peptide Sequence Number=SeqID_150077
atgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggag

SEQ ID NO: 33300 - DNA, 890 bp, Glycine max
  Peptide Sequence Number=SeqID_150078
atctgcaccgacgaccgctccgcccgggctcgcgccctgggttttgcagcgaccgccgcgccctcctactcatcggggcttggtccttgccccgacggccggaactcgcccgcgggctccagctatcctgagggaaacttcggagggaaccagctactagacggttcgattagtctttcgcccctataccccaagtcagacgaacgatttgcacgtcagtatcgctgcgggcctccaccagagtttcctctggcttcgccccgctcaggcatagttcaccatctttcgggtcccgacagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccg

SEQ ID NO: 33301 - DNA, 270 bp, Glycine max
  Peptide Sequence Number=SeqID_150079
atgcagctgtgcgctaagcgcgccatacagatttcagtttctaaaaaatcaaaggcagtggcactttgggtactacctttgcacccaaacctctgcaccttcttacccttgagcacttgtgtattttctacttcttttgtattgtttctctgcatcttcattgcttcatttcaagaacactccaatacggctaagcacaccctgtgcactaagccggagtgttattttgttgagtctgagctaagcgtgccatgcagcgatggcatctaa

SEQ ID NO: 33302 - DNA, 787 bp, Glycine max
  Peptide Sequence Number=SeqID_150080
atgggttttactaggaaaccaatgctgtttccttttttgccggttttgttcataactattcttcttgagccaccccatgttgcagaatctgcttcttctgattactccactttggtctacaagggctgctcaaaggagcctttcacagatccaaatggggtgtactcccaggcactttcagcactctttggctcattggtttcacaatccaccaaagccaagttctacaaaaccacttctggctcaggccagaacaccataactggcctcttccaatgcagaggggatctcaccaattctgactgctacaactgtgtcagcaggctcccagttctgtgtgacaaactttgtggcaaaaccacagctgccagagtccaacttcttggatgctatgttctctatgaggttgcagggttctcccaaatctcaggtatgcaaatgctgtacaagacttgtggggccacaaatgctgctgggagagggttcgaagaaaggagggacactgcattctcagtgatggaaaatggggtggttagtggccatggcttctacactaccagctaccagtctttgtatgtgatggggcagtgtgagggagatgttggtgactcggattgtggagagtgtgtgaagaatgctgtgcagagagctcaggttgaatgtggtagctctatttcaggacaagtgtttttgcacaagtgcttcattagttatagctattacccaaatggggttccttctagatcatcatcttcatcatcagcttcatactcttcatcttcttcag

SEQ ID NO: 33303 - DNA, 525 bp, Glycine max
  Peptide Sequence Number=SeqID_150081
atggaggccatgaaagaccaaatgactaccatgatggaggccatgatgagtatgaggaaaatgatgaaattcaacgcggttgcactcgctgccacaagtgtcgccgtggaggtggaaccgactcacccgtctggtcagggaggcaaagcattgggaagtgcaggcgacccccattttgtgcaagtacagagcaagcatcccttcctaccgtatgacctgcctcccaattatgcaccacccaatgtggtacatgtgctcgatgagaacgtcgaccatttcgctctcataccccttgagagccaacaaccccagtctggacatgcacatgtctctcaacccataggggagacaccaaaagtaccccgagaccacactctggccgacttcgagcctcacctcggatatgccactgagcagcaagcatttggtggcgtacccctgccaaacgccttgggggccttcaataccgcccacaaccacaacccttacattttgcagtgggaaggctgcctcctgccatggtag

SEQ ID NO: 33304 - DNA, 453 bp, Glycine max
  Peptide Sequence Number=SeqID_150082
atgcagagtgggtcccaatgtaaatcatttgatgtagaaataggagatcgcttggaggatatgattcgtgatcttggacacgagtcttttcaaccagcacatgtccctatgtataatacattgcaaactcattcaaagaagcctttgtatctggggtgcaagaattccttgacgttgttgtcaacggtgttaagtctagttaatgtgaaagccatatatgggtggagtgacaaaagctttagttcacagcttcaagtcgtgaacgatatgcttccagaggaaaatacgttgccaaaaagttactatcaggccaagaagatattgtgtccgatgggtattgagtatcagaagattcatgcttgccctaatgattgcatactgtatagaaatgagtttcaagaaatgcataaatgcccaaggtgtgaggtatcatgggtacaaagtgaaggatga

SEQ ID NO: 33305 - DNA, 213 bp, Glycine max
  Peptide Sequence Number=SeqID_150083
atgtgctataacgtattacagagcaagagcctggtcaggacctgctcgaatcgaaaagagaggagagtctttaagaaggaattcccaggttcaaaggagtatttacgaagtacaaagctaagacaagaaagaggacttcgagctattgggcaattcgaactggtgtatggacgagtcgaagtcgaggcagcaagagttctggacttagcgtaa

SEQ ID NO: 33306 - DNA, 685 bp, Glycine max
  Peptide Sequence Number=SeqID_150084
gccacttgatccaacacctctggcatcaactgaagtttctactcctatcgttgctgcagttgttgtcgttcctactgatgttgttgttattacttctgctcctccacctccttctactatgcctattcaggaggccactcctactgttgtagttagtacgttgtctacttcggcttgttcaattgtggtgccttcgtccatcattgttgcacctttgctgagtatgggtgtggcgaccacaagtgctcatgtgttgccgcctctttcttctttagcaccaccagctctagcctctactctgttggtgatggcatcaccttccatgtcttattgtcctaatgtctctttcgatcacttgtacatctacaacgaaactaattcactgtgggactttgataagaacctcatttggtctgttggggagaatgaaaagcagcatcaagaggctatgcgcaaggtggcatccttggaggtagaggtcgccaaatggagggctactgctcgcattgtttggagagtagagcgccctaaggtagccaatgccactgttgcctttattgaaactgtgaagtcgaatcaccaattctcttccaaggaagagaaaaaggatttggctggcaaggtggaaggcattgcagtggagagggatgagcttgctaaggtggttgctgagttagaggcctga

SEQ ID NO: 33307 - DNA, 522 bp, Glycine max
  Peptide Sequence Number=SeqID_150085
atgggatcaagaaagccgcgcggtcccaaggatttattgaacatgaagatagtgaaaaagtccaggagcaagcaacctatacgaattgttagaagaggcattcaatcggaagaatatggcgcttcagaaattcgaaaatcggaagaatatgtcgcttcagaaattcgaaaacagaaaaatcatagaggaagtaacaaaaaaagtaatgagtcgcttaaatcaactgagagcatggaggaatttgtgattcccggagatattccagagcttgattcgttggtggtttatgagaaagaactacgttcagatttttttagtaatgttgcggcggcctgtttggaaccatctcgtgaaaggaaaaagaaaaaccgtcacaaaagtcgtaacaaagacgaatcacatgatctaattaagagtataactgattttgtgattcctggagatgttcctgccattgattcattgatgggctttgacaataattttttttcagatttttttaccaatataccggtattctag

SEQ ID NO: 33308 - DNA, 816 bp, Glycine max
  Peptide Sequence Number=SeqID_150086
atggctgtttcaagggatttggcatttttcagtttattggcctctattctacagctaaggtcaacgatggtcaaatttggaggtctccatgatgtcgaagacgattctgaggacgaacatgaaaatgacttgcaggttctagtagatgctaaagttgttgttgagaagtctgctcaaccctcaaccctcatttaccctaaagaagatgatcaaagtggtgcagtggtaaaggagaatgttcattggaaaagcaaaagtgcaataaaacagaaaaagaaggataactcttcaaaggaccagaaagaatcacaagaccagtctgatagcatcaatgttggaagtaggacttttgaaactgctggcatagagaaggcagaggatgtgtctgccattgatgttaaagtgaagcttaagaaaaataaaaatggccttcaactggtatctcagcatatgtactctcaattaaagcctcaggtctctgttgatgctcaggcaggcactgcttggggtctattgggtcgcaaccagaatggcttgagtggtggtgtggcaacaagtgttgatattgatgatttggcaatccatttgatctgttcgaatcattgtttgagggcaattatcgtggcacaggttccaaaggttcttggaatggagcaaatgatgctgaacatgagtattatagtcttggctaaactagggactacaccatccagatgtagcacttgtggaggtcaaggccgggttttctcatcaaccagaactccattagccatcttccagcggtcaatgacatgctctgcatgcaatgggacatga

SEQ ID NO: 33309 - DNA, 1473 bp, Glycine max
  Peptide Sequence Number=SeqID_150087
atgttggtcatggcttatcacaggtcttatgatcttccaattataacttctagaggcaataatgtttatggtcccaaccagtacccagaaaagcttgttcctaaattcattctgcttgccatgaagggtgagaaattgccaatccatggagatggatccaatgtgaggagctacctccactgtggggatgtggcagaagcctttgaggtcatacttcacaaaggagagattggacaagtttacaacatcggcactaagaaagaaaggagtgtgttagatgtggcagaggaaatatgcaagctctttaaattgaatcctaaagatgtcattgagtttgttcaagataggccattcaatgataagagatatttcctagatgatcaaaagctcaaaaaacttggttggcaggagagaactccatgggaggaaggacttaagatgacaattgaatggtacaaaaagaatcctgattggtggggtgatgtatccactgctttaaatccacatccacgtttttcggctatcaatctctccgatgaagctcaatggtcctttcaatatggatactcaaggcttgcaaggtcatatactgaagttggtagaaaaaaatcaagattgaagtttttgatatatgggaggacaggttggataggggggttgttgggaaagctttgtgatgaagagagaattgattgggaatatgggagaggaagattggaagataggaaatcacttatggaggatataaggagggtaatgccaacccatgtgttgagtgcagctggtgttacaggaaggcctaatgttgattggtgtgaatcacacaaggctgaaactataaggactaatgtagtggggattttaacactggctgatgtgtgcagggaatatagcttatatatgatgaattttgcaactggttgcatatttgagtatgataaagagcatcctctaggatcaggcattgggttcaaggaggaggacaagccaaatttcattggttccttctattcaaagaccaaggctatggtggaggatcttctaaaaaattatgacaatgtctgcacattgagagttagaatgccaatatcatcagatcttagcaatccaagaaacttcatcacaaagatttctcgttacaacaaggtggtaaacatacctaatagcatgacagtgctagatgaactcttacccatatccattgaaatggctaagaggaacttgaaagggatatggaacttcaccaacccaggagtcattagccacaatcagatattagaattgtatagggataacatagacccacaatttaaatgggaaaattttgatttgaaagaacaagcaaaggtaatagttgctcccaggagtaacaatgaaatggatgcttccaagctcaaaaatgagtttccaaatttattgtccatcaaagattccattatcaagtttgtctttgagcctaacaagaaaacttga

SEQ ID NO: 33310 - DNA, 270 bp, Glycine max
  Peptide Sequence Number=SeqID_150088
atgtatgaaccaaaaaatatcctcattactggagcagctgggtttatagcctcccatgtcactaccaggctaattgataggtaccctagctacaagattgtagctcttgataaattagactattgctccactttcaagaatttgttgtcatgttcttcatcatcaaaattcaaattcatcaaaggtgatatagccactgctgatattgtgaatcacattttgatagaagaggaaatagacaccattatgcattttgctgctcaaacacat

SEQ ID NO: 33311 - DNA, 336 bp, Glycine max
  Peptide Sequence Number=SeqID_150089
gtggaggatgttgacgaagaggagaaggaagaaaaaaagaaaaagaagattaaggaagtgtcacatgaatgctccttggtgaacaagcacaagcccatttggatgagaaagcctgaggagatcgcaaaggaggagtattctgctttctacaagagtcttaccaatgactgggaagagcatttggctgtcaagcacttctcaagtgagggacagttggagtttaagcctatcctctttgttcctaagagggcaccttttgacaagttgacacaaggaagaagcctaacaatattaaggtttcgaacagaagacttgaggcttgtaaaatttaattaa

SEQ ID NO: 33312 - DNA, 208 bp, Glycine max
  Peptide Sequence Number=SeqID_150090
aactccggaatacattccgaaagaacgtgttccagaatgttttcggaagaagggtctttcggaagacaaccttcttattccggaagaagctctagcttctcatctcaaggaggtgaacttagctattagagagcttctcaaggaagttttctcaaagaagcttctcaagaaagttttctcaagaaagcttctcaaggaagctacctag

SEQ ID NO: 33313 - DNA, 390 bp, Glycine max
  Peptide Sequence Number=SeqID_150091
atggcaagtgacagctcatcaaatacaggggataacatagcaagtcaagaggaagatgctacagtagcaacaacaagggtacaccaaccaaacaaagaggtgcaattagtgagtaaaactaaaaggaggattgtgaggcccacactattggctaaagttttcacagtttctgccaaggcaaagtttgatatcgcagaagctacgaaggtgaagacgaaggttatgtcaacagtagcgacgagatggcggcaatttaagtccatattgactagcaaatttgtgtttgctaagagtgaaggtcaacaaacgcaggatgttgtgacacaatatggactagatcctgaagcgtggaaacaatttgaagaaacccggctcacacctaactgggag

SEQ ID NO: 33314 - DNA, 300 bp, Glycine max
  Peptide Sequence Number=SeqID_150092
atgggtgccggtctagttgcgttcctcttaatggttcttgtgcaattggtctatgcagtgatgaacattacttcaatgcttgcaatagaatctggaatgagccctcttgtccttgttgcttatcgacaactctttgctactgtttatttaccaacaacgacgggtgcacgggccaccgtcgttgaaacttcaaagaacaacgacagtgtgctcaccaccgacgttgacatactgccaaacaacgtcggtggtgagcccgccaccgatgttgaaaggaaacccaacaaatacgggtgttag

SEQ ID NO: 33315 - DNA, 224 bp, Glycine max
  Peptide Sequence Number=SeqID_150093
atggggctatgggcaatggttccatttctcaagaccacttcatgttggcttcaccgtttcgtgctggtgttcaaatttgattttgaaatcgataggccagcctcctatgaaactaggttgcaaaccttggggaagctcacttcacttggtaaggtcgacaatggtgccgccacgttggagaaaacaatgtcggcggcagaaaattccaaggaattgggcacaag

SEQ ID NO: 33316 - DNA, 519 bp, Glycine max
  Peptide Sequence Number=SeqID_150094
atggccaccctcaacctctcttcgttgcaagctctctcctcccatcgtttatgctcttcttttccccaaaatacccctaccccttccttcaatttccagctaaaaccctcaattaacccgcgcccaatttctctgaaaccctacgtttccgagaagcctcgcgcgcgcgtggtggcattggccgtgaagagcctcggcgatacggaggcgctggcggtgtcgcctgaaaatgacggccccgccggagaactgccgtcgggcgccggcgtctacgccgtgtacgacacgaacggcgacgttcagttcatcggtttgtcgcggaacattgccgcgagcgttgcggcgcactggaaatcagtgccggagctgtgcggttccgttaagatgcttaggaagggtggagatgctttgcaaacttcattttgctaccaacgtccgtttgcaacggatactcaaacatgtttggaagttgagttttggagaaggaaggggaccccatatattttaattgtaaattaa

SEQ ID NO: 33317 - DNA, 216 bp, Glycine max
  Peptide Sequence Number=SeqID_150095
atggatttgaaaccctttgacccaagtagagtcttagctttgattgcattgcaaccttcgacaaccatgcctcctctactactgagtaaaaccatcgtaagaaggtcctttgtgaatttaacctcctattctttggtttttgtgttgtctcttctagctataggctttgactcaacccccatctttggcttcttcgccactgtggagcaaggctaa

SEQ ID NO: 33318 - DNA, 594 bp, Glycine max
  Peptide Sequence Number=SeqID_150096
gctggggtagtggatgaaccagacagagaaactctaacccaagcatggaagtcttggatggaagaatacataaaagatagtggaaaagttccacctggcaacgaatcaggaaatgccacttgggtcaggcaggcacctaaaaggaagcctgatcttcgattaacacctggtcgccgcatgcaattaactgtccctcttgagaacctcattgacgggttggtgaaagagaacaaggtagttgcattcattaagggccctagaagtgcacccttatgtggattctcacagagggtgatagccattcttgaaaatgaaggagtagattatgagagtgtaaatgtgctcgacgaagagtataattacgaattgagggaaacacttaaaaagtacagcaactggcccacattccctcagatttttgtggatggtgaactggttgggggttgtgatatattgacctccatgtatgagaaagggataaccgggttccaaacagtggaggtcaaagccgtgactaatatgaaagggaagaagcttggagggagtggcggagatcgaagatttgtcgacttggatggaggtggttggggttga

SEQ ID NO: 33319 - DNA, 477 bp, Glycine max
  Peptide Sequence Number=SeqID_150097
atggagctcgaaaacggcactgtaatggctgcaagggagaagaagctgcacggagaagaaggagaccaaagaaccacacaagaagacaaaacgtactactcattgtacggacatgtggagagactagcagaagaaataaagaaaggaaccaattgtgttgaaggcgttgaggccaaactatggcagatgcaagcggaggtttatgggaaacacaacaacttgcaggcaaacttgttggaatcttctacagcaccagatcccaagatcttacggaatattaatgatgagaaattgtgggatgagtatgcctggcttactgctatagctcaaccggttcatcatggaatgttatttgttccaattggatacacatttagtgctggaatgttcgagatggaggaactaaaaggtggtagtccatatggttccgtggttcaggaacttatgctggtgatggttcaaaacaaccaagcttga

SEQ ID NO: 33320 - DNA, 435 bp, Glycine max
  Peptide Sequence Number=SeqID_150098
atggcgacccaaatgagcaagaagagaaagttcgtagctgatggagtgttcttcgctgaactgaacgaggttctgacaagagagttggccgaggacggttactccggcgtggaagttagggttacgccgatgcgcaccgaaatcataattagagccaccagaacccaagctgttctcggtgagaagggaaggagaataagggaacttacctctgtggttcagaagaggttcaagtttcccgagaacagtgttgaactttatgctgaaaaggtcaacaataggggtctttgcgctattgctcaggctgagtctcttcgctacaagctccttggtggactcgctaaaattgctgtcgcggtgactcaaaatcttcccagaaaaactttatactgcatccatagttgtattcctggagaccgtgttttaaaaccttga

SEQ ID NO: 33321 - DNA, 654 bp, Glycine max
  Peptide Sequence Number=SeqID_150099
atggtcttgaaaaggtctgttgaaaacaatgcaccgtcgctgtgtgaaaccactccacctataacatctgcacgtaggcaacaggaagctacacatgttgctaaggatgttcagtacatggatcatgcagctaacgaggaacgtcctgagttgaagttatcctcccatggaaggaagggacttatatcaacttttgcggagaggtggcataagaaaactagtattttccatcttactgtacaagaggtgactatcaccttcaatgatgtggcatcattgcttcatctgcccatgacaagcgccttctatagctttgaggctctacatatggacaaagttgtgttgctgttagttgaattgcttgaagttagtgtagatgaaagtggaagctacgcatggggagttgcctccctagtccatatgtataacaatttgaatgatgcatctaagagtagcgctagacaacttgcaggatatatcacacttttacaatgttggatttatgaacattttccttctgttactgagtctattgctgctaaagattatgatgagaggaaaccacgtgcttgttgctggaattctgggaaggcattatcagtgtcgacatatcgaaagcgtatagatagattgacgtctgatgttgtgtgttga

SEQ ID NO: 33322 - DNA, 309 bp, Glycine max
  Peptide Sequence Number=SeqID_150100
atgaggcatattgcttgtgcacccagtaatattatggaaagattcattgtgtctgctttggtcgaggtgaaagtgttatggaggtatgtcggcaagtggtggttgtggtggtggttattaatggtggagatgaacgaagatcaatggatgcatgacagtataatgtctgaagaagttgatatgaatgaacaaaaggaagacgaagctggtgtgaaatcaaaacatgttgattattctgatgccttcaatacttctcaagtgtttgctacctgtgatgatgttttgaattgggttcgagctgttgcttag

SEQ ID NO: 33323 - DNA, 357 bp, Glycine max
  Peptide Sequence Number=SeqID_150101
atgtacttttgcgggcgcgcgaggcgaagttcacgggtcgacaaaagcgaggcttttgctcctacgtaccctccatcgaagaggaaatcagacctgcgtagttcttttgagggtgaatcaagcgaatctttttacttggaaggtgatcattttaaggcgttggaccttaaaaatgatccatttacttggcgagaaaacggcttaaacgatcggttaaagctcgtcaaaaatggaagaaaagaaaccgaaattgaacgaaataaaaatgaaagccaagaaacaagaaatgaattaaaagtctcggatttggaaacttacccgttgaagaacgaagaacggatgaagaacggtgaataa

SEQ ID NO: 33324 - DNA, 699 bp, Glycine max
  Peptide Sequence Number=SeqID_150102
atgttcctaaccgcaacaggcgccagaaattgtgggttaaccaggcatagagaaattccaaaggttcgtatgttttccggtgcatcatcttccaaatcagcacaaagcaccacgccatatggcacgagtcctttcacagtctccatccggaagccaatagccccgttgaactgcaccgcatacaacctcaccggaacatgccccacaaacctacaagaccatcagagcactccagccaccgccacgtgtccagattacttccgttggatccacgaggatttgaggccttgggcccgtacgggcatcacgcaagacatggtggagagggcaaagcaaacggcaaattttaggttgataatattaaagggtagggcttatttggagacttactcaaggccctatcaaacaagggatgtttttagcatatgggggattctacaattgttgagaaggtaccctggcaagatacctgatttggagcttatgtttgattgtgtggattggcctgtggttttgtctgatcgttacaatggccctaatgttgagcaaccaactcccttgtttcgggcagagattaatataaagccatggcatattttgttgggagagttgaaagaaggcactacgaggataccatggctgaacagagagccttatgcttactggaaaggtaatccagctgttgctcaaaccagataa

SEQ ID NO: 33325 - DNA, 708 bp, Glycine max
  Peptide Sequence Number=SeqID_150103
atgagtcgtgttaaaaagaaaagaaaagtgagtgggaaagacacactcgagtcgagcgggagtcaaagctggaagtccaaagtttctggaaatcaaactagtagtgtgggtgtggaacaggacaagggggtttctgtgaaggactatttggtggacaaactgaggcctggtgatgaagacggggctctctctgaagtgatatcagagactctgcacaagaaggaactgcccccagtggaagttactgaagaaggtgtgagaaaggtggtttctgatgctgtgcataagagagaggataatcctgagagaagaatggaacatcaaagaatactgggaaaggtaactgagtcagaggaagtgaagagaaggttaggaggtgaaagtgtggtgacagagaaaaagtaccaagagatgtatgtgaatagtccggggaaaggtgtggttgataagtttaaaggtatggttgggacatggtttaccaacccagcagagaatcaatcttcacaagtttttcgattttcttatcttggaagaagtgttttgagaaacaaacgaaattatgattatcaaagtgccacattaattttgaatttgtggtttgcatgggccgaagattcatctatgaattatgaggcaggaagggcagaagtggaacaagttaaccaaggtgcagcaggtgaaagaaggcagcaggagtcatctaattga

SEQ ID NO: 33326 - DNA, 177 bp, Glycine max
  Peptide Sequence Number=SeqID_150104
atgggtgatttagcctctcattgtcatgagagggttactaatacaaaaagaaagcaagagccagcatgtgctcgcgaagcgcacatgcaaagtccatctgacataagtgaatgtgcgttaagccgcaaggtgcaggctaaaccgcatatgcgtactaggccgccacatacaggctaa

SEQ ID NO: 33327 - DNA, 312 bp, Glycine max
  Peptide Sequence Number=SeqID_150105
atgattatgaagggccaagacatttatagtagtcaagatgaggttactacttcaccttcctctagtgaaagtgaagaagcaaaaggggaagaatctagtgaagaaattgactcccaagaagaaagggaccttttaatggtcagaaggcttctaggaggccaatcttgtcacttggcaggtgatatttttttgcttgacattggttacaaagtagcacctactaatgttgatgagaaaaagcttggcctacgtcagttgaacaaaccctcagctgccataaacagaaaacaaactttgtcgatgtcagcataa

SEQ ID NO: 33328 - DNA, 349 bp, Glycine max
  Peptide Sequence Number=SeqID_150106
gatctttagcgagtgtgtgttttggatcatcttggaagttgggataagttttatctttggtagtgttgcaacatgcccttttgcgggcgagcgaggcgaggctcaccggtgcgctttccaaaggaggaaagatgcgtggagtcgcctccaacgtttatttgtggaaaacgtcagaaaaaccgaaggaaaccggtcaaaaagaatattccaagttcgggagttgtatttacgtttgaggaaggtcgacaaaagcggagctcttgctcctacgtaccttccatcgaagaggaaatcagacctacgtagttcttttttaagggtgaatcaagcgattctttttacttggaag

SEQ ID NO: 33329 - DNA, 357 bp, Glycine max
  Peptide Sequence Number=SeqID_150107
atgaaagaaagtccaggcatatttcctagaagatgctattcaattcctgctagagaaatcacaccagaagaacttattacagatgtattcattatgactaatgtctctgattgcagttatttcacgtctgatacatatgccaatgagcattcagcacttgctgctaggttggccgctagattatgtgttgatctagcatcagcaattgtttctaggcgagccaaaaatggatttgttttggttaagcctcctggtcatcatgctggtgtaagacaggcaatggggttctgccttcacaataatggagttgaaaggaagcatagacattggagaacgtcatgtatgcaccggtattag

SEQ ID NO: 33330 - DNA, 234 bp, Glycine max
  Peptide Sequence Number=SeqID_150108
atgaaaaaaagggtaaccgagatgtgtcgctcaatcaaacgcttctcgaagaggagaccggagttccgggacacgacgggatcttccggaacttcgccggagactgcaaaaacacagaaaaaagacgatcgagcgagagaacgagcgcgaaagagagttagggttttgggttttggggagaagtgtgtgagtgagagggaaacggaagtgaacgaaaggaaccaccgcaaatga

SEQ ID NO: 33331 - DNA, 174 bp, Glycine max
  Peptide Sequence Number=SeqID_150109
atggaaattctcatcctgggtcaaggtttatggtggtttgaggtcttgggtcaaaaggcttgcagaatggccggacatgatgcctacctcgccttttctgccatcaaagataggaaagttattgggaaggtgatgattgtttttgatgaaaaaactacaagatctaagttgtga

SEQ ID NO: 33332 - DNA, 651 bp, Glycine max
  Peptide Sequence Number=SeqID_150110
atgacggcacatcgcaatgagtcaatctcttactttctcataagggtggacccttgggtactagtaccctcaccttcaaagaactacacattcttgcctttagaggactacatgtcctcgccttcagaggactacacgtcttcgctttcagaggactacaccccttgccttcagaggactacatgtcctcgccttcagaggactacacccctcgccttcagaggactacacccctcaccttcagaggactacacgtcctcgccttcagagggctgcacgccctcgccttcagagggccgcatgtcttcgccttcagagggtcgcacgtcctcgccttcagagggctacacgcccttgccttcagagggctacacgtcctcgccttcagagggctacacgtcctcgcctttagagggcggcacgtcctcgcctttggaggactgcatgccctcgcctttagaggggcgtacgccctcgccttcaaaaggctacatgccttcgctttcagagggctacaccccctcgccttcagagggctacacgtccttgccttcagaggactgcatgccctcgccttcagagggctgcacgccctcgccttcaaaaggccacacgccctcacctttagaggggcgcacaccctcgtcttga

SEQ ID NO: 33333 - DNA, 216 bp, Glycine max
  Peptide Sequence Number=SeqID_150111
atgaaagagagaactcgtcatcgtcgcgtcatcgtcggccatccgttgccatcgtcgttgccatttgttgtcgtcgttgttgtgaatgggagaactcacgacttcgaggtgagagaactcgtgtgttgctcgtgtctatcacgctgctcatctcatttaggattccaaacccaaggtttagggttgggttgggttagcccaaaacagcctatgtga

SEQ ID NO: 33334 - DNA, 1170 bp, Glycine max
  Peptide Sequence Number=SeqID_150112
atgctatcgcgtcgtgatatattgaaagtatccgccgtcagcgcggccgccgccggcatgatcggcggcatcgtaaaaaatgccgctgccgacgatcatcgcaatatcgtcccccccagcagctatcagccgcctgccgatgcgcagcatctctataaatacaaattcaccgacagcaagaagcgcagcctgcccagcggctgggcgcgcgaagccaccgtcgagcaattcccgatctccgaaggcgtggcgggcgtggacatgacgctggagccgggcggcgtgcgcgagctgcactggcacgccatcgccgcagaatgggcgtttatgctggaaggccatgcgcgcatcaccatcctcgatcccgagggcaaatgcgaagtggcggatttcggccccggtgacgtgtggtatttcccgaaaggctatggccattccattcaggcgctggcagatggcgcgcattttattctggcgttcgataacggccatttctccgagttcggcaccttcagcattaccgattgggtggcgcatatgccgaaagaggtattggaaaaaagcgtcaacatgccggcggcggtattttccaaggccaaacagagcgaggcttatattgtcgacggcgccgttccgcccaccttgccattgccgaaaaacgacggcggattaaataacaccccgctgacccaccgctatgaattaatgaagcaaaaaccgttctttgaaaatgacgccggcagcgtccatttggtgtcatcgaaagaatttcccatttccaccaccatgaccggcatcatcgagatcgtgaaacccggcgcgatccgggaattgcactggcaccccaatgccaacgaatggcaatactatattgccggcaaaggccggatgacggtgttcagctcacacggccacgcgcagacggaagagtacgccccttcggacgtcggttacgtgccgcagggcttcggccattacatcgagaacatcggcgatgaggatttgaaggtattgatcgtgatggacaacggcatttatcaggacatttcgctatccgactggctggcgaaaaccccggcctacctgctggcggacaacttcaataatcagattgaggactggcaggatagaccgaaagacaaacgggtgatgtcgcgccgcagccgctga

SEQ ID NO: 33335 - DNA, 225 bp, Glycine max
  Peptide Sequence Number=SeqID_150113
atggttgttgatcgtggtagtggtaggcatcagaaatggatgatcagcatgaacaatggcctttcatgtgttgctgatgcgtggatccattatttaggtgactgtcatttgaaggctggagatgaggtcatctttttctacaacattgaccaacatttatgggaggtcctctataggaagcaagttaaatgggatgacacagaggatgaagctgactccccttga

SEQ ID NO: 33336 - DNA, 528 bp, Glycine max
  Peptide Sequence Number=SeqID_150114
atgcctactgacactagagaaattgagactgcactgtgcatacccggccgagggtttattctaaatgctgaaggtcgcccggggaagatcctcagaaaagacctaaccacccttgctcaggtctggagtgttctatcctactccaacctggctccgaactcccacacatcagatctgactgtggatcgagctaggttaatctttggcctagttactcagttggacatgaatgtcggagccctcatttctgggcagattacttctatggcccagtctaactcctcaagacttggatttcctactcttatcacaactttatgcaagattagaggagttacctccgacagtcttggggccagaagaccaagagcaaggctagttgagactccttctacatcagcggctgctcatccagcttctacatcagcagctcctcctccagctcgtattacaacagctccttctaccccacctactgcagattttcaacatttcaaagccatgcttcgaagcatacatcaggggtag

SEQ ID NO: 33337 - DNA, 397 bp, Glycine max
  Peptide Sequence Number=SeqID_150115
tgctgtaatccaaaagatccttccacctaagcacaaagatcctgggagtgtaaccattccttgttcaataggagaagtcaatgtcgaaaaggctctgattgatctgggagccaacattaatttgttgccactctccatacgtgttggtcagggtaaagcattttacttcccagcagactttgtggtcatggatatctctgaagatattgacatccctgtaatcttaggaaggccgttcatgttgactgcaagcttcatagttgacatggggaagagaaagctggagttaggttttgaagaccagaaaattgatttcgacttgtttgtggaagacaagcatgctccagaacacaatgtttgcttgcaggtaatgggagaaggtcaaaaggttctgaag

SEQ ID NO: 33338 - DNA, 219 bp, Glycine max
  Peptide Sequence Number=SeqID_150116
atgtaccctgagaaagtgctcgacagcttctggaagtcacgctcagacatgatgtcattcccaccgtcgccaccacactatgcaacggcaacatcgattgcacgctctccctttcttcttatcctggatcttctagaagaagcgttgtgtgcttttgatggtctcgggttttgggaagataaaggatatcagtgggaagtggaagaggaaccagaatag

SEQ ID NO: 33339 - DNA, 318 bp, Glycine max
  Peptide Sequence Number=SeqID_150117
atgactaggagtgagaccaagcagtcagtggataccctccaacaaatggtagtagacatacttaacaagacccaagtggagaaggatgaaggcccaagtggagaaggaaaaaggcccaagtggagaaggatgaaggcccaagcggagaaggatgaaggccaaaggttcctcgctgaaccaatcttggacttatcaagttaccttccaaagaccagccagggtcgcttattggcatgccacattattgatgattatggacatattttactaaagaggacccttcttgtctatgtttcacttccaaaccaaattttgtaa

SEQ ID NO: 33340 - DNA, 3103 bp, Glycine max
  Peptide Sequence Number=SeqID_150118
atggagcttgtggcatcacttctggtgatgtcattctattggttgtgccttggtaaccacattattgtggtttctggtctctgccttggtgatcagaagtctttgctgctgcaatttaagaacaacctcacattcacaaacatggcagacagaaatagcagcaggctgaagtcttggaatgcaagtgatgattgttgcaggtggatgggagtaacctgtgacaatgagggacatgttactgctcttgacctcagtagagaatcaatctctggtggatttggcaattcaagtgttcttttcaatctccaacatctccagagtctaaatttggcttcaaataacttcaattctgtcattccttctggattcaacaacttggacaagttaacttatctgaatttgtcatatgctggctttgtgggtcagattccaatagagatttttcagctgacaaggttgattactcttcatatctcttcttttttccaacacctgaaacttgaggacccaaatctacaaagccttgtccaaaatctcaccagtatcaggcaactgtatctggatggtgtaagtatatcagctccaggttatgaatggtgcagcgctttgttgtcgctgcgtgacttgcaagaactgagcttgtcaaggtgcaatctcttaggacccctagatccttccctggcaagacttgagagcctatcagtcattgctcttgatgagaacgatttatcatccccggtgccagaaacatttgcccatttcaaaagtctcaccatgctaaggctttctaagtgcaagttaactggaatatttccacagaaggtctttaacatcggaacattgtcccttattgacatatcttcaaacaacaatctccatggtttctttcctgactttccattgaggggatctctccagaccttaagagtaagtaaaacaaacttcactcgatcaattccaccctctattggtaacatgaggaatttatccgaattggatctttctcattgtggttttagtggaaaaattcccaattcactgtcaaacctaccaaaactcagttacctggatatgtcacataacagcttcactggtccaatgacatcctttgttatggtaaaaaaacttacccgtttagatctttctcataatgatttaagtggtatactcccatcatcttactttgaaggactgcaaaatcctgtccatattgacttgagtaataattctttcactgggaggactccttcaatcctttttacactcccatcactgcaaaacctttggctttcagacaacttgtttactcaattggaggaattcatgaatgttacatcctctagattagttaccctctatatgagtaacaataatctatctgggacgattccttcatccctttttgcactcccactgctgcaagagattcggctttcccacaatcatcttagtcagttagatgaattcataaatgtgtcttcttctatattagacacccttgatttgagtagcaataatctgtcagggccttttccaacatctatcttccagattagtacactctctgtcctccgactttcttcaaacaagttcaatgggttggtgcatctgaataagcttaaaagcttaactgaactagagctttcatacaacaacttgtcagtaaatgtgaattttacaaatgttggcccttcttcctttcccagcattagctatctaaacatggcatcttgtaacttgaaaacattccctggtttcttgagaaacttgtccacattaatgcatctagatctttcaaataatcagattcaaggaatagtgcccaactggatttggaaactacctgatctttatgatcttaatatttcctacaatttgttgactaagttggaaggcccttttcagaatcttacttctaacttggattaccttgaccttcattacaataaacttgaagggccaatacctgtttttcctaaagatgcaatgttcttggatttatcaagcaacaattttagctctcttataccacgagatatcggtaattacctttctcagacatattttctctctctttcaaacaattctttgcacggcagtatccctgagtccatctgcaatgcttcatcacttcaaatgcttgatctttccattaataacattgctggaacaattcccccctgtttaatgataatgagtgaaactcttcaagtattaaatctcaagaacaacaatctctcaggctctattccggatacagttccagcttcctgtattttgtggtctttaaatcttcatggaaatctattagatggcccaattccaaactctcttgcttattgctcaatgttagaggtattggacgttggatcaaatcaaatcagtgggggctttccatgcattttaaaggaaatatccacccttcgaatccttgttttgcgaaataacaaatttaagggttccctaagatgttctgaatctaataagacttgggaaatgcttcaaattgtggacatcgctttcaataattttagtggcaaactgccgggaaaatattttgcaacctggaaaagaaatttaagtttgcttgagaaatacgaaggtggattaatgtttataaagaagttgttttatgaatccgaggatagcagggtatattatgcagatagtctaacacttgctttcaaaggtcgacaagtggagtttgttaaaatttatacaatcttaacatccattgatgcctcatccaaccattttgaaggacctataccaaaggacctaatggattttgaagaactcagagtcctcaatttgtcaaacaacgctttgtcttgtgaaatcccttccttaatgggtaacttgagaaacttggagtccctggacctttcacaaaactccctgagtggagaaattcccatgcagcttacaactttgtactttcttgcagttttaaacctctccttcaatcatttggtgggaaagatcccaacaggtgcacaatttattctatttgataatgattcctatgaaggtaatgaggggctatacggttgtccattgtctaaaaatgcagatgatgaagagccagagacaaggctatacg

SEQ ID NO: 33341 - DNA, 153 bp, Glycine max
  Peptide Sequence Number=SeqID_150119
atgataattggagaacttgaaggtgctacgaaaccgagaccagtcccaaaggatcttgatcattatctcaaagggtcttcaaaacttgaaaattttaaaagtgttagacttatatgcaaattatatggtcggttcaattcaaggtaccactaa

SEQ ID NO: 33342 - DNA, 1960 bp, Glycine max
  Peptide Sequence Number=SeqID_150120
atgacagtgagaaccaaattaaggacaaaaactcaaaaagttaaaaatgctgaagttaagtggaaaacacagtggcagacagaaactgcatttaagaacaacctcacattcacaaacatggcagacagaaatagcagcaggctgaagtcttggaatgcaagtgatgattgttgcaggtggatgggagtaacctgtgacaatgagggacatgttactgctcttgacctcagtagagaatcaatctctggtggatttggcaattcaagtgttcttttcaatctccagcatctccagagtctaaatttggcttcaaataacttcaattctgtcattccttctggattcaacaacttggacaagttaacttatctgaatttgtcatatgctggctttgtgggtcagattccaatagagatttctcagctgacaaggttgattactcttcatatctcttcttttttgcagcacctgaaacttgaggacccaaatctacaaagccttgtccaaaatctcaccagtatcaggcaactgtatctggatggtgtaagtatatcagctccaggttatgaatggtgcagtgctttgttgtccctgcgtgacttgcaagaactgagcttgtcaaggtgcaatctcttgggacccctagatccttccctggcaagacttgagagtctatcagtcattgctcttgatgagaacgatttatcatccccggtgccagaaacatttgcccatttcaaaagtctcaccatgctaaggctttctaattgcaagttgactggaatatttccacagaaggtctttaacatcggagcattgtcccttattgacatatcttcaaacaacaatctccatggtttctttcctgactttccattgaggggatctctccagaccttaagagtaagtaaaacaaacttcactggatcaattccaccctctattggtaacatgaggaatttatccgaattggatctttctcattgtggttttagtggaaaaattcccaattcactgtcaaacctaccaaaactcaattacctggatatgtcacataacagcttcaccggtccaatgatatccttcgttatggttaaaaaacttaaccgtttagatctttctcataataatttaagtggtatactcccatcatcttactttgaaggactgcaaaatcttgtccatattgacttgagtaataattctttcactgggaggactccttcaatcctttttacactcccatcactgcaaaacctttggctttcagacaacttgtttactcaattggaggaattcatgaatgttacatcctctagattagttaccctctatatgagtaacaataatctagctgggacgattccttcatccctttttgcactcccactgctgcaagagattcggctttcccgcaatcatcttagtcagttagatgaattcataaatgtgtcttcttctatattagacacccttgatttgagtagcaatgatctgtcagggccttttccaacatctatcttccagctgaataagcttaaaagtttaactgaactggacctttcatacaacaagttgtcagtaaatgggaattttacaattgttggcccttcttcctttcccagcattctctatctaaacatcgcatcttgtaacttgaaaacattccctggtttcttgagaaacttgtccacattaatgcatctagatctttcaaataatcagattcaaggaatagtgcccaactggatttggaaactacctgatctttatgatcttattatttcctacaatttgttgactaagttggaaggaccttttccgaatcttacttctaacttggattaccttgaccttcgttacaataaacttgaagggccaatacctgtttttcctaaagatgcaatgttcttggatttatcaaacaacaattttagctctcttataccacgagatatcg

SEQ ID NO: 33343 - DNA, 952 bp, Glycine max
  Peptide Sequence Number=SeqID_150121
atgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactgggaggatacaatccgtaaatcccgcgtggggcgtggaaagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagac

SEQ ID NO: 33344 - DNA, 666 bp, Glycine max
  Peptide Sequence Number=SeqID_150122
atgcttatagggaagtatataatcttaacatccattgatgcctcatccaaccattttgaaggacctataccaaaggacctaatggattttgaagaactcagagtcctcaatttgtcaaacaacgctttgtctggtgaaatcccttccttaatgggtaacttgagaaacttggagtccctggacctttcacaatactccctgagtggagaaattcctatgcagcttacaaatttgcattgtcttgaagttttagacctctccttcaatcatttggtgggaaagatcccaacaggtgcacaatttagcacatttgaaaatgattcctatgaaggtaatgaggggctatacggtttgccattgtctaaaaaagcagatgatgaagagccagagccaaggctatacggttctccattgtctaacaatgcagatgatgaagaggcagagccaaggctagcttatacaattgattggaatttgaatagtgtcggatttggattggtttttggtcatggaattgtttttggtcctctcttggtttggaagcaatggagcgtatggtattggcaactcgtgcacaaagttctttgtagaatatttgcacaaatgtatcttgaatatgtaacgggaggaggacatacgtacacaactttaaggtgggggcattag

SEQ ID NO: 33345 - DNA, 309 bp, Glycine max
  Peptide Sequence Number=SeqID_150123
atggttcctcttttggaacatggatgccagagtggcaagggcatcgatcatctgattctcctttctaggaatgtagtgaaaggatatgttatcgaagttctctatcaatttcccgatgtaggcctggtaaggctgagtcccatataccatgagcaacttgacctttgtcgcaacctacccttcgacgggagggcgacgcgagggctcacgggtgcttcttccatgggaggaagatgcgcggagtcgccaccaatgtttattcgaggaaaacgtcggaaaaatcggaaaggtgtggtctacgaactttaa

SEQ ID NO: 33346 - DNA, 1367 bp, Glycine max
  Peptide Sequence Number=SeqID_150124
aggttgataaagatgcactagtagaagttgacactggttctggcagtcattctggtactaaggatattattgagtttgaggcctcactttgtggtcatgaacttaaagcgggtatgggtttggttgctgctgccgaggtttttgaagcacatcggatatctgcaaaagaatttagaagttctacattatccataattaagaatgaaaatcttgttctgaagtttagagagaggtatctactgtgggaaaaggttgctcctcttgtacttggaataactgtatttggtttagacttacttattgagcctaaagatacaattccagtgggactggatgatgtagtgaaggccaagaatgatgctcctggaccagcttcatctggacgcagatggagactttggcctatgccttttcgaagagtcaagacaattgatcacactaatagtgtatcaagtgaggaggtatttgtagattctaagtctgatttccaaacttctattgtcgagccatctccaacatctgctatgcctatttccaaattcattactatttcacagaagtggatgctacaaggaagaatcttggatagccatacgagcctttccatgtgccagaagatgtcaagaagtatggatggggagcattggagtcgccatacccctaagggtactaaacttgaagctgagtggaatgccaagtttgtggaatatgagaagaaatacaatgaggaagctgcaaagctaaaggctattattattggcaaattaccagggagaaagcgcgcacttctgccaatagagcatttggcaagcttcagggcaatgccaaacactttcatgcttcgtccagctgatggtaatgacactgctggatcatacaaagttgttgtggttaacaagaagagaccctcaattgttgcactttgttggcaaaagttgacccaacttccaagaacttctattgagggagttgaaaagggtggctacctcatttccgacaactcatcaagtaacaagcctgatgttattttgattggaactggttctaagttggaaattgttgttgcttttgctgaggatctatggaaggaaggaaaatcagatgaattcaacgagagtgttctacctgcttcaataacagctagagttagcattgaggcaggatcaacatttggttgccacaatcgagcgttcgctaagcgcaacactcctgggctaagcgtgaggaagaatccagaagaagatgagttgtacaggtttgctaagcgcaccgcttcagttcatccgctaagcgagaaaggcgcgctaagccaaaaatcactaacgtgcactaagcggtccatatgtgtgctaagcgcacgagcatga

SEQ ID NO: 33347 - DNA, 435 bp, Glycine max
  Peptide Sequence Number=SeqID_150125
atgtccaacaaggccctggggtttccagctctggttacgggcctctgtcagtcctacagggtgcccgttccccctgcaaggtcatgccatcgtgacataggaatcgcacccacaaagacacccagtggacccggagaagtccaacagggccctgggggatcgtgcccgcaagacacccagtggacccgaagaagtccaacagggtcttggagttgccaagctctaattaccggcctctgtcagttctacggagtgcctgtcgccctcagcaaggtcatcaagccccctactaatcgagctttcatcaagaagtattgcgtccccaggcaggcgcagggtgaaacaccacaacagcctggggatggccgtcagcgggcaacagacgcaccgccatcacctctagagttcacctctgctcatccacaaaaaggttag

SEQ ID NO: 33348 - DNA, 1413 bp, Glycine max
  Peptide Sequence Number=SeqID_150126
atggagatagagagaaggttctttgacattaagatcttggaaatcgaagccactggtttgcaatctgggtgtggtttcaaccaagttccaaattacaaaaattgcagttttaaagagagattgaaatgccagatggagtacatggaatcagttaagcagctagagcagaagttggtgtcaaatgagaaaagacatggcagcaattattttgtggatggttgtggagagggcccaactccatcttctgaagatgaagtttctgagatcagaaagctgtttgaaaatgaatgcaataggagaaaggcagcggaagcagaggtagaacatctaaaaattctactggggaaaaatacacacacacaggctggaggggatgcagaggttataaaggttcacagcattctggaggatgaggttaatcagaaaaagaaacttgaagaagaaataataatattaagaagtcaattattgcaattgaactttgaagctgagcagatgaaaagatgtttaggaagtgaaagatcagtaaatgcctcctctgccatggattcttccatgtctcaagttaggcattcccaactcaaagacactgggaatggccagaaggcatctgttgctacactctttgagcaagttggattgcaaaagattttgtcgttgctggactctgatgatccccttgtacagattcatgctgttaaaatggtggccaatcttgcagcggaagaggtgaatcaaaaaggtattgttgaagctggtggcctttcttccttgttgatgcttcttagaagatatgaggatgaaacggttcgcagagtagcagcaggggcaattgccaatcttgccatgcatgaagccaatcaagaacttataatggccgaagggggaatcactctgttgtcaatgactgcatctgatgctgaagaaccacaaactcttcgaatggttgctggtgccatagctaacctatgtggaaatgataaaatattgatgaagttgagatcccaaggaggtatcaaggctttactgggagttgtaagatgtggacatcctgatgttctttcacaagttgcacgaggaattgccaactttgccaaatgcgagtctcgagcttctagtcaagggataaaaagtggtacgtcgtttttgatagaagacggtgcacttccatggatagtacataatgctaacaatgaagctgcaccaatcaggcgtcacattgaacttgcactctgccacatggctcaacaagaagtgaatgcaaaagacatgatcaatggaggtgccctttgggagcttgtccggatttcaagggattgtacacgagaggacataaggaatcttgctcgtcggactctcacttctatcctgccattcaaatctgaattgcggcgattacgtatagacgtatag

SEQ ID NO: 33349 - DNA, 159 bp, Glycine max
  Peptide Sequence Number=SeqID_150127
atggtacctatcagatggggaatcaaagacagcactgatggtaacaacattagcctaaggcttcgagcaaaatcaatccacaaaggaggcaattttgaaatcatgaaagccacaagcataatgtcaggcaaaacaattcctttcaatttcatgtcataa

SEQ ID NO: 33350 - DNA, 564 bp, Glycine max
  Peptide Sequence Number=SeqID_150128
atggtgcaaataagcatgcggtgtctctacatgtcatcaaacttgccgtctctagatgacgagggtgtcgataaccatgcgatgtctccggtgtggataatcatgaggtgtctccgggtgtcatcggacttgtcatctctggatgacgaggaccctgacgtctctgaaaacggagcagatgaccatattgttctatgcgtgtcattggacttgctatcttcggatgacgagggtgcagataaccatcaggtgtctctccacgtgtcatcggactttccgtcttcggatgacgaggatgacgagggtgcggataaccatgaggtgtctccatgtgtcatcggacttcccgtctccagggtgcaaataaccatcgggtgtctcagcgtgtcatcggacttgccatctctggatgacaagggtgcagataaccacacgataaccatgagttgtctccgcgtgtcatcggacttgccgtctccggatgacaagggtgcggataaccataagggtgtgggtaaccatgaggtgtctacgcatgtcattgaacttgccatctcaggatga

SEQ ID NO: 33351 - DNA, 474 bp, Glycine max
  Peptide Sequence Number=SeqID_150129
atggctcaattgatttctgatgccatccactatttgcaaggatcgcgcccacaagacacccagtggacccggagaagcccaacagggccctggggtttccaactctggttatgggcctctatcaatcctaccgggtgcctgttcccccctagcaagttctacggagtgcccatcgcccccaacaaggtcatcaggccccctattaactgggctttcatcaagaagtactgcaccccccaggcaggtgcagggcgagacaccacagtagcctgggaatggccggtagcgagcaatagacgcaccgctgccacctccagagcccatcagctcatctacaaaggtttgagcattgcctacgacccgtggcagaccatcaggcgaccaagtccaaagccaaaggtaagcaaaagtactaggtccgtgaccgacaagtcatcacgtgtccagctcaagatgttaaagaagcgctactag

SEQ ID NO: 33352 - DNA, 318 bp, Glycine max
  Peptide Sequence Number=SeqID_150130
atgctacctagatgcaagctaagttccacaaaatcatgcgcaaatgccattgaggcatttcaccgaacacttggtgggcgcatgtttaagcatgaaaatcaagggaatggggacaatgtggcatgccccattatctcagaatgcaccataggcctagggccatcccctacaacccctcaattcatcaaaaacaagcaacaatccaaggataaatccctcacgttttttagcaaatacatgcaatttagagcaccaaaatacatcaatggaaagctagagagcccaagaatgaggtacttagttgttggagatgaataa

SEQ ID NO: 33353 - DNA, 174 bp, Glycine max
  Peptide Sequence Number=SeqID_150131
atggccaccccaccatacggaagttcaccagttatgacatgctggcgtgcaagctatgggaccacagcttcaatgaactctaggtatgggactgcaggctcatacatagccttaaacgtagttgcgtttcaagcatttgcacctttcatcatgttcatctccaagaggaaataa

SEQ ID NO: 33354 - DNA, 234 bp, Glycine max
  Peptide Sequence Number=SeqID_150132
atggtggaggtgaaggcgatgttgctcatcggaggcattcccgtcatcataggtgttgtcagtcatcaaagcggttgttggtcgtcggaggcatcatgggaggatgcaagtgaggaagggatgttgtggaagaaatattttgatgagagagggttcatgataacactttacacccttatcaatccaaggattcccaagtgcatgtggtccatgatagatcgcttaccttgctag

SEQ ID NO: 33355 - DNA, 165 bp, Glycine max
  Peptide Sequence Number=SeqID_150133
atgactaaagttctttccgagttacggggtcttcgttcttatgttggtgaacgtttcgactcactggatactcgttttgccggaatggatattcgcctcacacaacttgaagaagatgacttatattgtcatcatcaaaaagggggagattgtagaagtaagtga

SEQ ID NO: 33356 - DNA, 174 bp, Glycine max
  Peptide Sequence Number=SeqID_150134
atgaaaggaaaaagagaaaagggaattaagctaagctacctttatgggagtaagggagaggtagttcagggtttggagggaataagtttttgcttttgggcgaaaccccatttgggttattactgcgttgctgggttagggttaggtcgaaggaatcggatcgatgatggatga

SEQ ID NO: 33357 - DNA, 414 bp, Glycine max
  Peptide Sequence Number=SeqID_150135
atggggtggccctttcttggggaaaccatagggtatttgaacctttaccctgctgttacacttggagaatttatggagaaccacatagcaaggtatggtaaaatttacaagtcaaacttgtttggggggccaaccatagtgttagcagatgcagggctgaataggaaatggtctatgttggtcttagtaggggacatgcacaaggaaatgaggaacatttcactcaactttctcagcaatgctaagctccaaacacatcttgtcaaagaggtcgagaggcatgcacttctcattattaactcatggaacaataattctacattctccgctctacaagaagccaaaaagttcaccttcaattttatggagaaacgtataatgagcttggagcctgggaatcccgaaacaggatag

SEQ ID NO: 33358 - DNA, 285 bp, Glycine max
  Peptide Sequence Number=SeqID_150136
atggaaactagttggaaattgagtgaagagaatgaattaagtaaaaataagttagtgatttccatgagaaaaccagaaactaaacatagaggtgatctgagtgaagattttgctttctccacattttccccagaatttttaagactagtcatagaccctattgcttcaatatttcatcgaatgctcaatggaagatatgatgcttctaatgatggtcaaggcaacaatatggaaagtgagcctttaccaggttcggactcaattgaggcatccaggagacgataa

SEQ ID NO: 33359 - DNA, 293 bp, Glycine max
  Peptide Sequence Number=SeqID_150137
atgaagttagatgaactacatgcagatttaactaaaaaacgtatattaggaagagttgtagcagacatgtataccattgagtttcgaaagcgtggacgaccacacacacatttacttctcttcatgcatccatcctataagtatccaactacaaatgatattgacaagattattttagcagagatgccatgtgaacataatcagaaagagttgtacaacttggtgaagtcacacatgatccatggaccatgcggtttagccaacaatacatcaccatgcatgaagagtgaaag

SEQ ID NO: 33360 - DNA, 1245 bp, Glycine max
  Peptide Sequence Number=SeqID_150138
atggccaagccacaaaatacaaaacccgggtgtttctctttctcaagcttcctacgcgtgtttctatgtgctggaaatggaactactccaccagtgcacccttatcacattacagaatcagaagaatcagaaaatgcacatttcaccaaagaaaaaatggtggtgaatgataatgatgatattgcttctgcccctggagtggtggcaaggctaatggggctggattcacttccaaaccccaaatgggtagtgaaatgtggcaccccagattcggttcctagaagcaggtcagtgaactttgtggattacttgcttgagtttgatgcaagccatgttagtagccataggagggtgaagacctcggcatcgttcagagaggttcctagtttggttcagaaccaaaagggtaatggttatggtaatggtaataatctctttgtgttttgcatggctggtgacaataacatgagggaagagcaagagggtagaaatgagatgagggaagtggaaaagttgaggcagaggaagaggcagaaggagagtgtgagtgtgaagaaagagaggaatcaagggaagaagaacaagaagatttccaagctgaagaatgaaccaaggagggtcccttcttcttctaagaatggttcaaggggtcgaaatcatcatggtgaggttagagatttttcttctgtgtcctcaaacccctctaagtgtagtagttcttgtagtagcagacacaatggtgctagttcaagaacaaggttcaacacttctttgccaaataagaacaaaaagggggttgtggaaccaaatatcaggaatagaaaccagcagtcagtgttgaaggaagaaagtgaatgcagcttggaaaaccacagtcctgtttcagttgtagagagcaatgactatcttttcctgtatggagctgattttctagatggttcaagctcccttacgtcaaagtgggaatctccatcactattgtccttgggtgatgatgttgaagacaatgcaagtactaatgaaggttataccttcattgatgtcaacaaggaagcagagtattactcagaattgatgttgaagcttcgtactttgactgaacaggatataagagaatcagattgtacctcaaaacgtgtacgcgatattgaaagctttggggatatttgtttgatgtttgagcataaaattttcgaccacttattatatgaggtcgtcaatgaagttatagaactttattgttga

SEQ ID NO: 33361 - DNA, 858 bp, Glycine max
  Peptide Sequence Number=SeqID_150139
atgcttccaccttttcttattctgctgcgtatgctcttcatgagaaagacacgacacggcgatgaagacggagaacagtgcagcaagcccttgagcaaaagggcttcaaaaccttttagtacccttattattttaggatcaggtggtcatattgctgagatgcttaatctactagcagtgttacagaaaggtaggtttaatccaagattctacattgttgttgctactgataatatgagtcttcaaaaagctcagttgttggagaattccctggctgctgagtacgttcatgatgaatcagaaactttatctgatattgatgatgaagaagttgatttgtacattcatgatgaggaggggaagcatatcaagaagatactgtgggaaacaacatatagggagtatcttgaggagcaggcagccaaggaagcagctgcagcagctagcaagaaagcttttgaggcaaaatttgaaaactgttcggaggatatactagcggcaagagagcttgctgcatcttctactgaagctgtggcaaaatccaaaaaggaaatgagacagaaacgagcttatgaggcaaaaaatacaaggccagctcaatctgctgcagaggcctttggccaaatgtctaataaaaaaagggagcaggtagccaaggaagcagctgcagcagctaacaagaaagcttttgaggcaaaatttggaaactgttcggaggatatactagcagcaagagagcttgctgcatcttctactgaagctgtggcaaaatccagaaaggttagaggtgttcatgttagaggttatggtgttcatgttcgatttatagttatagaccattttttggctagtacctag

SEQ ID NO: 33362 - DNA, 252 bp, Glycine max
  Peptide Sequence Number=SeqID_150140
atgtgggtgtcaagggagcggtttccggcagatttcaggtgggaagagaaagagaagactgatttcaagcaggaggagaaaaagaagagaaagagaagaccgagcgcgcggttaacatcggttttgccaaaaccgatgttaacatcaaacaggttgaatgaccatcggaaacgggatggaatggctacaacaagcactaagtatgtggaggaacttgttcaagaagaaggatcccttgaggatgcctcatga

SEQ ID NO: 33363 - DNA, 348 bp, Glycine max
  Peptide Sequence Number=SeqID_150141
atggttttcattttaattttggatctcatttttatagaagcctacaagttacaggagagtatttccttactcttggaacctattggtctaatgggtgaagctaagtttctcaatgatgttgttataggtacaccgggggacaatccaaatgattcaaaggaacctgtgggaatgttgagtgctgataatctgactaagggcatttctgtgagcgaaggacttatcactactaaaaaaaaggccttctacatcggttctaatggactttctacatcggttatgatgcgtggtggtaacacagtgtcgttgaatatcgacatcggttcaagaaccatctttgaaggatga

SEQ ID NO: 33364 - DNA, 834 bp, Glycine max
  Peptide Sequence Number=SeqID_150142
atgccgttccatttcaagcctttcgctgggtcgtcctggtactaccactacccaacagcacaagcgcctttcgcaactgtgccgaatggggcttcgatgcagtattcggcaaaccgctcgcatccaacgaacgcgcgtcagggccaagtcggtcagccctggatgaggctcgcgtccgatttgcaccaaactgatcccacggacagatcttcacacacgatcacaactcccaggcatccaagcgcccccctccaccgcacaatgctgacaacgattgccatggcgtcagcacgaattgacggacggaccatgaatcgatacccgcctccggagtctcaaatgtccttcttccaacgcgttgtccccctcgccgccacgctgctgctgagcgccaccgccaccgcggcaatggccgaaccggtcgcccccgccgcgctcggaacggccgcgacgcaaggccaggcccaaccgcgggccccggccgcgccgcaagaacgcctgcgcatcggcctgaccgagagcgacaccaagctggtgctgccgtggttcgtgacggagctgaccgacgtggtcaaccagggcaagccgctgaacgagaccggcaaggcgctgggccgggcgcctcgcgccctggcccggcgtcacagatcattcaaggatttctcgcgcaggtgccgggcgaggaactccaccagtgaccgcaccttgcccgccatcagccgctggtgggtcatcaacgcgaacaccggccggggcggggtttccgacgccaccagcaacggctgcaggcgccccgccgcgacgtggtccgcgatcgcccaggcgggcgcatag

SEQ ID NO: 33365 - DNA, 288 bp, Glycine max
  Peptide Sequence Number=SeqID_150143
atgtggggtgctaataccttccccgcgcgtaaatacaactcccgagcctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaagggtccctccgctcagagctcaaagccttccttgtctatgctgcagagcctgcatcagggccagctcctaatcatgcagagtttggaggatgtggtccagtag

SEQ ID NO: 33366 - DNA, 606 bp, Glycine max
  Peptide Sequence Number=SeqID_150144
atgattcgcgatcttagacaagagtcttttcgacaagcacatgtccctatgtataatacattccaaactgattcaaagaagcctttgtatccgagatgcaagaattccttgatgttgttgtcagtggtgttaagtctggttaatgtgaaggccaaatataggtggagtgacaaaagctttagttcactgcttcaagtagtgcacgatatgcttctacacgaaaacacgttgccaaaaagttactatcaagcgaagaagatattgtatccaatgggtatggagtatcagaagattcatgtttgccctaatgattgtgtattttacaagcatgagtttgaagaaatgcgcaaatgccctaggtgtggggtatcgtggtacaaagtgaaggatgatgacgactgtagtagtgacgaaaactcaaagaagagcccccaacgaaggtgttgtggtatcttccgatcattccaaggtttaagcgtctgtttgccaatggagacgatgcaaaagaccttactttgcatacaaatcagggaccagctgaaggagtcgatcacagaaaaagtggctcaacaattaatgttgtcctttgttatgcctctaggatag

SEQ ID NO: 33367 - DNA, 171 bp, Glycine max
  Peptide Sequence Number=SeqID_150145
atgttaagagttataactcttaacattttcttcaaaaacattctctgcgcaccacttcatctctctaagcgcaccgcttcagttcatccgttaagcaagaaaggcgcgctaagccaaaaatcactaatgtgcgctaagcggtccatacatgcgctaagcgcacgagcatga

SEQ ID NO: 33368 - DNA, 294 bp, Glycine max
  Peptide Sequence Number=SeqID_150146
atgaaaaagcaaggagtttttgaggaacatcgagaacttttgaagggtgttagtggtgtctttagaccaagagtactaacagctctgatgggtgctattcaaggagttcctaagatcaaagaaggttataatcctgcaacctggatgttggaagttacatcagcaggcatagaagcatctcttaaggtcaacttcaccaatgtgtacagaaactcagaactataccggttagactccttacttaatccaacaaatattggtacagatgttattttgtttcttttttttctttag

SEQ ID NO: 33369 - DNA, 327 bp, Glycine max
  Peptide Sequence Number=SeqID_150147
atgatgaacagaggtgtcaaccttatagtgtttaaatcgaccattctacaagcatggaatgttaaaaatagggtggaagttagagatgtggcaaggaatcttttcttttttaggttctttgatagaagggacatggagagagttatggaagcggggtcgtggaactttgacaggagacttattgtgttgaaggagatgaagggggatgaaaaccctaaaactatgtatgatctacccctcagtagaagaacaaagacgataactaaaatgatggggagttcgtggcatggaacaattgagaggagagtagatttgggaaggctatga

SEQ ID NO: 33370 - DNA, 2961 bp, Glycine max
  Peptide Sequence Number=SeqID_150148
atggaaggtgagactacaagtaagaagaagaaggccaatgatgatcatggattcattgatttgattttttcttggtccattgaagacattctaaatgaagatatgtacaagaacaaggtacagaagattgatctatcatttcagtccattgatcactacgttcaatcttatgcctaccctttattggaggaaacaagagcacaactatgctcaagtatggagatcatacaccaagcaccttatacagaggtgattggtataaaagaggccaaaccacttcaaaataaactgtataacttgaaaattgatggctggaaaaacaggttttctcatcatggaggagaaccatacagaactttacctggtgatgttttgattttggctgattataaaccagaagctgtaagagacttgcaaaggattagaaggttgtggtgttttgcgtcaaccgtatggacaacagaagatgagggtgatagcacttctttgaaagttaaggcatcaaaagatattgacctggaagagaggaggaataaaactctatttctcatcttcttgacaaatgtaaaccctaatagaagaatttggggtgcacttcatatgcctggtaatttgaagctactcaggcagattttgtgcagcagagacgatgttgaggaatgttgtggatgtagctatccgtctgatgctttaagggatgactgtacatatcaaatgttattatcagagctgaatgaatctcaaaataaggcaatttctgcatgtctttctggcctcaattgcaatcacaactccgctgtgaagctcatatggggtcccccaggcacaggaaagactagaactttgggtacactgctttatgctctgttgaaaatgaaatatagagtccttgtatgtgcccccacaaatgttgcaatcaaagaagttgcatcacgtgttgtagatataatgaaagaggcacatagtaaagaatctggtgatttgttttgttcaatgggagaagtcctattgttcgggtacaatgagaggctgaaaattggagaagatgttgaagatgtatatttggatcatcgtgtgcaacagcttacagaatgtttttccccatataatggattcagttccagtctaaaatcaatgattggttttcttgaatattgtgtttccgattatcatatatatgttgagaatatgaaaagggaggggagcatggccaaatcatttttagtgtttctgagagaagggtttcattctatagcattgccattgaaagcgttcatttctatcttgtgtacacatgtagccatgagtcacttgctgaaacataactatcaaaacttactgtgcttaaatgaggcacttgaatcatttcaagacctgttgttgaaaaatactttgttttctgaacgattggaaaaacttttctcctataaaaagttaccagttgcataccagacgatttcttggtcatttgatggtgatgcataccagttgtacgagaagcgaactgcatgtcttaatgctttattggcggtggaacattcacttcaagacttcatgttgaaaaaatctaataacagtgagattagggagttttgtttccagacatcatcattgatattttccactgcttctggttctcataagctgcattctttaaccatgaagccactgaacattttggtgatagatgaggctgcaatgctaaaagactgtgaatcaataatacctctgttacttccaggcattagccatgcccttctttttggtgatgaatgtcaactatcttcaatggttagaagcaatgtttctaatgaagctggttttgggaggagcttatttcaaagattgagttcattaggtttcccaaagtatctccttaatatgcagcataggatgcatccacaaataagttcatttccaaattcatatttctattttaacaaaattcaggatgcatctaatgttgaaagaattgactatgtaaagcaataccttccagggccaatgtttggtccttattcttttataaatgtatttgaaggaaaagaacaatttgatgatgcaggaagaagctataaaaatatggctgaggttgcagtcgtgatgacaatactgaaaaatttgttcaaagcatggttgaactcaaagcacaaactcagcattggtatagtgtctccctatgttggccaagttgttgcaattcaggagaaacttggacagatttatgaaagtcatgatggatttaatgtggacgtgaagtccattgatggttttcaggggggggagaaggatgttattatattatcaactgtaagaactaataacagaacatctcttgagttcatttcctctccacagaggactaatgttgctcttacaagggctaggcactgcttatggattttggggaatgaaagggcccttgcaagcaatgaaaatgtttggaaggctatagtgcttgatgccaaaaatcggaaatgtttctttgatgctgatcaagataaggaattgggaaaagcaatattggatgcgaagaaagcgtcaaatcagttagatgatttgcttgatacaaatagtgtccttttcaaaagtcaattgtggaaggttcatttcagtgacaaattcctgagatcattcaaaaggatcaggtctgaaaagatcaagaaaaatgttataaaccttctgataagactttctagtggctggagacccaaaaggttttctgtggatttgtcttgtgaaaattcctcacagatgttgaaacaatttaaggttgaaagcttctatgttatttgctcaatcgacatagtcaaagcatcaaggtatattcaagttttgaagatatggaatatattgcctttagaggatatcccacagttagctaagcgccttgacaaagtgttcaaaggatacacaaatgaatatatcagcaggtgcaggtgcaaaaagaaagatgggtga

SEQ ID NO: 33371 - DNA, 678 bp, Glycine max
  Peptide Sequence Number=SeqID_150149
atggtagaccttgcgtaccttgagttcccatggggatggaactttagtaatgtgaggcttcaccaagggtggtccttgagtttgtcgagctttgaactagggacattgggactcaccaagggggaccttgggttttgtgagccctatagaggattgactagggaattgtccaacctatgttttgagcatcgtgctcttgcatacatgccacttgtcctaggtggcacgctctggagacatggtgatatgcttctgtgtatatgccattcatcatgggtggcacatactagagttatgatgacaatatgctcttacatgcatgtgtattactcattgtgggtgacacacactgaaggcttgttaagatgctcgtgctcacatgccactagccgtgggtggcatggtgctcatgtgcacatgccacttgtcgtggatgacatgtactggagtcaccgtcatgatattcacttaatgcatgctcatgagaaccctaaggccttctattgcatctatggcccaatctacttggagtcttctatccaatgcccttgtgggttaggattgcatcattacctctcccttgaaaaggatttgacctcaaatcccgaggtaaggtctgaaaacccatttcctgggcatcttccgatgaaggagcatggttcctctccaactcaatga

SEQ ID NO: 33372 - DNA, 315 bp, Glycine max
  Peptide Sequence Number=SeqID_150150
atggatggtatccctgagatacagaggggagggttacttcaaagaactcttcttcatttatcaactaggttagtctacaaaagtgaaaaagagaggaaagtgattacttgcatgcatgtagaaaccaaagctcaagagcaagaattgagcttcaaaattaaaactcagttaacgcaagaacaaactccttacgtccatgtttacctcaatctgatgagaagagaggggaggaatgaagcaagctttgaagctttagtgcaatgtagagggatcaagagcagcgcaagatggaaagagcttgattataacttatga

SEQ ID NO: 33373 - DNA, 192 bp, Glycine max
  Peptide Sequence Number=SeqID_150151
atggacaaggagaaaaaggaaacaaagagtaaaagattcgaagatgacgaggttgacgacaacagtgacccgaggtgtaagtacaagctctttgcctcaaaaattttcgacgaggaggccctggttaagagcgatgaggaagaaaaggatgatgaagagggcaaagatgattcttcttccgtgtgtgactaa

SEQ ID NO: 33374 - DNA, 450 bp, Glycine max
  Peptide Sequence Number=SeqID_150152
atggtagaactgtgtctagttcttgacgtcgttatccctttgaagttcaaggtgtcgggtttcgataagtacaaggggactacttgccccaagaatcaattgaaaatgtacaacaggaaaatgagggcatactcgaaaaatgaaaaattattgatgcatttcttccaggaaagtcttactggggcaatcgtcacctgctcaagtagcaccccaataacagagaaggagatgataacaatgatagtggacacattactggtgttctactatgagaagatggtgggttacacacctttaagctttgctgatttagtttttgccggtgaaaggatcgaagtggatctgaaaagagacaaatttgattatcctgctttgatgaataggaagcctggggcaaatggagagaatgagaaggagggaggaacccatactgcaagttatcttaaataa

SEQ ID NO: 33375 - DNA, 398 bp, Glycine max
  Peptide Sequence Number=SeqID_150153
gtatggcgcctactaggcactctctagacccagataagttcaacagggccctggggtttccggcgctgatcacgggtctctgccagtcctacggagttcccatcaccccaagtaaggccgtaggtgcaccgccaccacctcggcaggccgatcctgctaggccactgggcgtggagcgttatctacagcatttgcctcagtcagcaggggcagggttccgcccctttcgtatgccctaccccgagcagtttggggctgaggtcgcatggcctggagactggactgatgcccaggcaagggaggagtctacaagatcccccggtgaggcagatgaatcccgtatggatgaagatatgactaacctactcggtttcttgggagggagcggagccgtgtga

SEQ ID NO: 33376 - DNA, 324 bp, Glycine max
  Peptide Sequence Number=SeqID_150154
atgaaggaaccatcgaaaaagcggaaaggaacttcgagtcggagtcagcggcattccggggcacaggaagcaccaattccttcctccattccctctggatcattattctcatcagaggaacagcgtatacggtacacaaacctcttttcctctcgttccatagaagacccaaaattcatagatatggagttcttctcaaatgagaattttgaatgcttccaagcatttgaaaactccaatcttattccattcatgtctctgaaattacctgtctattatgaattagtcaaagccttctattccaatttaggtgggatcctctag

SEQ ID NO: 33377 - DNA, 297 bp, Glycine max
  Peptide Sequence Number=SeqID_150155
atgcatgcacctgacctcaactctcaaatgcaatgtggtaccattcatcaaggaaatagcctaagtgtgtccacacgccactctcacttagaaaaactaggcagtaagtgtcgaggtcaccctgtcgtgcacaggcaactcccccccatggtgatcagcctgagtctcaagggagttctaaaccaagtgacatgctcccaagtacaagtattcctccttatgagaaactataagtacatactaacaaagtttatactattttcatgctatgaaacatgggcaccatcaatgcactaa

SEQ ID NO: 33378 - DNA, 432 bp, Glycine max
  Peptide Sequence Number=SeqID_150156
atggagaatgagtggagggagagaggagaacgaaattttgagagagaaaagagggagaatgagctatggctcagcctactaatccaagatcaaatcctagattctccactaagtgtgcttaggtgtcatgaggcatcccatgggtccaaaatctaccctaaggttcatgagaaccctagggccttttcctgcatccttggcccaatcttcctacagtctcctaaccatggctctggtgatgggtcctctccttgggaggattgcatcatggtggagattgtgggaatgatgaaggagaaaggaggcgtaagagacatggggcatggaggaagagatagagaggaaaaaataatagagaagatatggatgaaatatcctaagtgggagatgaaagttgaacaaatctttgcatgtcataagtatagtgaatag

SEQ ID NO: 33379 - DNA, 180 bp, Glycine max
  Peptide Sequence Number=SeqID_150157
atgcatcaaggcttgttggttggacagaaaatactttggaatctcatcaattctcttatggaaagtggtttcgcacaaaacctttgcttccctcagtgctacaaaagctgccccaacattcttgatctctacttcgaccttgctgctggtgaaggatttaaagggaattatgaaggatga

SEQ ID NO: 33380 - DNA, 600 bp, Glycine max
  Peptide Sequence Number=SeqID_150158
atgctagacttgtcttataatcatttgaagggaaaaattccaacaggaactcaattgcaaacctttgatgcctccagctttatcggcaacaatctatgtggtccaccactgcccataaactgcagctccaatgggaaaactcatagttatgaaggaagtcatgggcatggagtgaattggttttttgttagtgcgacaattggatttattctgggattctggatagtgattgctcctttgctgatttgtagatcttggcggtatgcctatgttcatttccatgatcatgtggttcaaacttcaatcttttcgctcagagggagagtagctgaacgtaaagaggggaaggataggaggtgtggggaaatggaactaaggataaccaacaccaacacaaaaatgttatatttaccagtagcagtagtgtgtttcttcccaaattgtgcaaatgctcgtcgacaaatgggtgagatcaaaagctcaggtatggtggctccaggacctgtgcactctcttcaattcacctcaatttctccacaaccttttgatgctatggagctctcagatgaacctgccgttgctccattcccgcaatactaa

SEQ ID NO: 33381 - DNA, 231 bp, Glycine max
  Peptide Sequence Number=SeqID_150159
atggtacaaaaattgcgagggtttgatcctcatgaatcacatttgaaaaatgtgaaaaggatcttacattatctagtaggtaacactaaccaatgtttgtttcataagaaaaatcatgatttcagcaagaagcagaactccattgctctatccacaactgaggctgagtatgtgtctactgcaagcggttattctcaactactatgggtagctgcaagattgaagtactga

SEQ ID NO: 33382 - DNA, 195 bp, Glycine max
  Peptide Sequence Number=SeqID_150160
atgttatttccgcaagaggcttgcctagcaatagctgaaaggttggaaaggctgctcaacctaagaatagtgattgaaggaacaaaagcatacaccgtcaccaccgaagaatgcctgaggatcgcaagaggtgtcactatgcaaagagatatgtacattcgatcgagacaaaggtggcgtatggaagacgcatga

SEQ ID NO: 33383 - DNA, 117 bp, Glycine max
  Peptide Sequence Number=SeqID_150161
atggggatgcaatttggaaagttaagtggtgcagggaaatgggagggaattatgagaatttataggagggaggcgtctgagattattgttggtagatatcagggagtgcatttataa

SEQ ID NO: 33384 - DNA, 174 bp, Glycine max
  Peptide Sequence Number=SeqID_150162
atgttgattgatgttggaatgctttggcatgtgcatgttgtgtatgttcgtggagggcgaagtgcactgaccttccagggtctttggcacttgctttgggccattgtatgttcatggggggtaagtgcactgaccttgtcggatggcccagacgtgggtgacaagcgtggttaa

SEQ ID NO: 33385 - DNA, 725 bp, Glycine max
  Peptide Sequence Number=SeqID_150163
aggactatacatcgtcgccatcagagggctacacgtcctcgcctttagagggctacacgtcctccccttcagaggacaacatgacctcccctttagaggaatgcacgccctcgccttaacaggactgcatgttctcacatttagaggactacacaacctcgccttccgagggctagacgccctcgccttcagaggagtacacatcctccccttgagagggctacacgccctcgccttcgtagggttacacacccttaccttcaaaggagtacacgtactcaacatcagaggactatacatcgtcgccatcagagggctacacgtcctcgccttcagagggcttcatgccctcacctttagaggactacacatgctcgcctacagaggactacacgcctttgccttcgtaggactacacgccctcaccttcagaggactacacatcctcgttttcagagcgatacacgccctcgccttcagaggactacacgactacatgtcctccacttcagaggactacatgtcctccacatcagaggactacacgttctcccctttagaggactacatgtccttgccttacgagggctacacggcttcaccttttgaggactacacgccctcaccttcagaggattacacaggactacacgtcctcaccttcaaagggctacacgtcatcgccttcagagggctacacgtcctcgctttccgtgggctacaag

SEQ ID NO: 33386 - DNA, 177 bp, Glycine max
  Peptide Sequence Number=SeqID_150164
atgacaaaagtaaaaagtgcgggaccaaatggttcccgcatctcatcgggcctgccacctctagatgacaaaaggttagtactgacagaggttgtctgcgcggaagatgacgttaatctccgcgtgtcaacgggcttgttggccgcgattgacaaagggtgcaggagacgatgttag

SEQ ID NO: 33387 - DNA, 204 bp, Glycine max
  Peptide Sequence Number=SeqID_150165
atgaatgagattttggatgttagcatttcgcttctaaatgagcatttagaggaaacactgggttcaacaaaaatagaagaaaaccactcaaagtgtatcaatctcacatggggcaaggttcatggtgagttgggaccttggctcaaggcttgtagaatggatggatatgatatatgtcagggtgttggtctggttcagggataa

SEQ ID NO: 33388 - DNA, 1374 bp, Glycine max
  Peptide Sequence Number=SeqID_150166
atgccacctccagtctgtggaagcccccagcccgctgtatctgaagttccacctccttttgctcagcagtcagcaccggttccgcaacccagtacctctttccctcaagctgcaatgacttattcagctccactgattcacactattcaacaagaggtcgaaccaattttccaagctgaaaatgttgtagctttcgacaagatggaagaactccaagaaagatttgatggtatgcaaagggaagtcgaagccctccgaggaagagatctgttcggaaaggacgcctgtgaattatgcttggtcccaaatgttactatccctcacaagttcaaggtgccagacttcgagaagtataaagggaactcttgtccccgcagtcacttggtgatgtacgcgcggaaaatgtccatgtatactgacaatcataagctgcttattcatttctttcaggacagcctgactggggccgctctgaagtggtatatgaatttggacagtgcgagcgttcgtactttcaatgacctgggtgaagcgttcatccggcagtataagtacaatctggacatggccccagatcgtgatcagctccgtgcgatgacacaaaaagagaaggaaacgttcaaggagtatgcccagcgttggagggaagtggctgcccagattgtcccgccgttggaagaaagggaaatgaccaaaatatttctgaagaccctgagccagttttattacgagaaaatggttgcaagtgcaccaacagacttcaccgaaatggtcaacatgggggtgcgattagaggaaggtgtccgagagggacgtttgactggggaaaagtgcccctgctgcaagcaatgccaagaaagtttggagggccactttgcgaagaagaaagatcaagaggtggggatggtagctcatggtaagcctcagcagaatttcaccccatatcgtcaggttgcgaatgtcgcatccgctatcccaaacccatcatatcaccaacaaaggccacattacccctacccataccctccacacccgtaccctccacaacaataccctccacaacaataccctccacagcaataccctccacagcaataccatcagccacaataccctcaaaaacaacaaaatcgcccgcaaaccccccaacaaccatatcactcacaaaaccgccagaaaacaacctttgatccaatcccgatgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaa

SEQ ID NO: 33389 - DNA, 273 bp, Glycine max
  Peptide Sequence Number=SeqID_150167
atgtctccttatcgggttgtttttgaaagggcatgtctttttccagtggaaattgagcacaaagcatactgggcagtgaagacttgcaatttctttatggatcaagcgggggaggaaaggaagttgcaactgatggagatcaaaagggactccacaaacaagagcttcaaggtcaacggacatggacttaaaccattcctcacgaacccttttttaggggaggtagggggggaagagacttccttactcccccctactcttcctcccccatga

SEQ ID NO: 33390 - DNA, 321 bp, Glycine max
  Peptide Sequence Number=SeqID_150168
atgtcaggatttacatgcgattctcctcaaatttcagccagcccgcatcaattagaccttgcaccttacgcttcagagccctacaatgctcaatggaatgccccggggcttctccgtgacaagcacacgttgcgttcgagtcgtattctcggagaaatggaggttgatgaaccttggttggggttatggctaccattgaattatcaagtagatatgggagcaaggatggcctttgtggataactgggtggtgggtaaggagaaggttggttattggctgagtaatgacattgttgggttggtgggaaacttggctgtatag

SEQ ID NO: 33391 - DNA, 651 bp, Glycine max
  Peptide Sequence Number=SeqID_150169
atgtctgatgaatactgggtcaaagcaatgcaagaaaagctagccctgtatcaaaagaatgatgtatgtaagctagtagaattccccaaaggaaaatttgttgatgaagcaaagtgggtgtgcagaaacaaatttgatgaaacatgtaaggtagggaggaacaaggtgaaggttgtagccaaaggttactcacaacaggaaggtatcaattatactgaaacttttgctcttgttgctcgtgtagaggaaatacgcattttactgtcctttgttgcccatcatgtttctaattgtccaaatatatatggacaatatcgtattcagtccggagaaaaggaatacaggtttgttggttattgtgatgcggattttgttgaagataaagtggaaagaaaaagcaccagtggaagatgtcacttcattggtggatgcttggtctctaggatgagcaagaaacataggacaatagctttatccacaacagaggcaaagtatatatatactgcaagttgttattcccaactcttatggatcaaacatcaacttgaggactacaacttgtatgagagtaaaatccatatcctttttgataatattgctgtcatagatctttctaaaaacccatcatgtgttcatgttccaaacacatag

SEQ ID NO: 33392 - DNA, 303 bp, Glycine max
  Peptide Sequence Number=SeqID_150170
atggccaagaaacaaaaccaaccccaactgtccaaatcacacctcatttcacaaacaacccccgctacattttctaggaatggttcccatgttcagattaccagacctgcacttgtgactatctttgctacacaagtcacaatgaaggacaaggaaccacgagctcatgttaaacacttctttgatatctacttgttggaaaatgttggctacgtcatcaatgcccaactcatgctgtgtggcatccaccacttctttgaagaccccaaggtggtgatggctgaactcatcaaagagttttag

SEQ ID NO: 33393 - DNA, 366 bp, Glycine max
  Peptide Sequence Number=SeqID_150171
atgcacacacaaagtttcacaattccacaatttcctaaaataggcctaactcacaaaaacattccccagtggagtcgccaactgtcgcaacatgcccttttgcgggcacgcgaggcgaggctctcgggtgcgctttccaaaggaggaaatatgcgcggagtcgccacccacgtttatttgtggaaaacgtcggaaaaaccgaaggaaaccggtcgaaaagaaaaattccaagttcggaagttgtatttacgcttgaggaaggtcaacaaaagcggcgctcttgctcctacgtaccctccatcaaagaggaaatcagacctacgtagttcttccttatgcgtgaatcaagtgattctttttacttga

SEQ ID NO: 33394 - DNA, 111 bp, Glycine max
  Peptide Sequence Number=SeqID_150172
atactgttcgaatcgaaaagacaagaaggagggcttcgaaacattgggcgagtcgagtgggtgtatagtcgagtcgaaggcaatgcagcaagatttctggacttagcgtaa

SEQ ID NO: 33395 - DNA, 531 bp, Glycine max
  Peptide Sequence Number=SeqID_150173
atggccacaatgatggaggccatgatgagcataaaggtgataatggaggttaatgcggttgcaatagccactaccagcaccattgttgaggtggacatgacccccccatatggcctcaaccaaataaatcatccaacctcagatatggtaggtctggaaggcaaagagttgggagcgtacactcccaatgagaatgccaataactccactcctatactcattgagagccaacaacctcaatctgatcatgcacatgtctctcgacccattggggagacacatgaaatgccccaccacaatctagccgacttcgagccttgcctcggatatgccactgaagggcaagcagttcgtgatatacccctacaaaacacattggagggccctcagtatcacccacaaccacaccccttgcattccacagcggttaaaaaccttcatgctatggaagaaatgggaatgttggatcatctagaggaaaggctcagggccattgaaggaggcgaagattatgcctttgctaacctataa

SEQ ID NO: 33396 - DNA, 351 bp, Glycine max
  Peptide Sequence Number=SeqID_150174
atgaccaagagcaagggcaaggatccacttgaaggacttggaggaccaatgacaagggctatagcaaggaaagccaaggaagctcttcaacaagtgttgtccatactatttgaatacaagcccaagtttcaaggagaaaagtccaaggtattcactaagacctatggtatagactactcagagacctttgccccggtcacaaacacagttagaattctcctatcacttgatgcaaacttggattggtttttgcaccaattagatgttaaaaatgcattcctcgacaatggcttggaggaagaggtatacatggatagtcatcctggctccaaacacaaagttgggacaaag

SEQ ID NO: 33397 - DNA, 297 bp, Glycine max
  Peptide Sequence Number=SeqID_150175
atgaaggcaatgtgtagcaaacaaaattggcaagaagagagtagccaacacttacactccaagagtggggacttgtggggcggaggaaatgatccttgtccccatccttgtcgtgcctatgacgaaatatttatccccatccccgtcccgtgggaaaatattccctgtctgtgggccccgaataggatagtcccttcggggatccccatttatggtgttgtcagatgtttgggtctaatattatatattggtggtctcgaaagcagtaattggttgcaaggtcaagtacagaggtag

SEQ ID NO: 33398 - DNA, 414 bp, Glycine max
  Peptide Sequence Number=SeqID_150176
ctccatctacttctgctcttcctccaccaccagcagctccagttcttccaggtccctccgctcagagccttccttgtctatgctgaagagcctgcatcagggccagctcctgatcatgcagagtttgcaggatgtggagtccagccttctcctttgggatggggtgaggcctctgtagcccaggagcctcagcaggaccaagtggacaacattctagaggcctcagagcccactccacctgagcctttcatttttgagactgatccagttattgttcaggaggatgttgcagtactagagccatctcctcagcctgagcctgagtcatcagcactagtgttggacctacgtctttctcaggatccatcatctgcaccagcactggacctgaatgagcatgcacaagatcattga

SEQ ID NO: 33399 - DNA, 255 bp, Glycine max
  Peptide Sequence Number=SeqID_150177
atgggtctctgtcaattctacggagtacctgtcacctccagcaagggcatcaggccccctactaatcgagctttaatcaagaagtactgcgtctccaggcaggtgcagggcgaaacaccacaacagcctggggatggccagcagtgggcaacagacgcaccgccatcacctctagagttcatctcagctcatccacaaaaagccatcaagcgtccagctcaagacgttaaagaagcgctactaggaggcaaccta

SEQ ID NO: 33400 - DNA, 276 bp, Glycine max
  Peptide Sequence Number=SeqID_150178
atgtcggtctctataatgttgtgcacctgtctccaaaaagccttgcatatgacctcttgtcaaagatgcttgagttacatagcatacaactttgtcattggtacttactcatactgggggcccaaagctggctataatatacatcacatgactgaagtagatttgatatttggaggaattacaattgtaagtggaatagcgggcactttagctggaggctttgttctggattatatgagtaacaccttatcaaatgcatttaaggttggaatttaa

SEQ ID NO: 33401 - DNA, 321 bp, Glycine max
  Peptide Sequence Number=SeqID_150179
aacgcgagtcctactttgctcgcgctctattcttgtccatctaagcttcttcttcttcacgaccgtttctatttgtatctgcaagcttatcgagaccgtgacacctcaccaccttaccttgatctttgtttgtttgtcttgcaaggatttggtttgtggaacttgtgttcgctgcaaggatttggtttgtggaagtcgtggtcactgctaggtctgtttggggtgctcacattgcagtctgtttggggtgctcagtcgtgctcgcagggtctcattttgagtaaggtgattcagattgctagttgtcctttgaatgcttaa

SEQ ID NO: 33402 - DNA, 229 bp, Glycine max
  Peptide Sequence Number=SeqID_150180
atggctgaaataacatcatctctaacccaattacaactctcttccaaacctaaattgaatgccccagattactacgatgctccttctcagaaagcagttgtaggtcatcattaccatgctggtctttattcagcttctgatgatgaaatacccacggttgattactctctactattctctaataaccctgttcaacggtttcttaccctagaaaacctccgtcaagcat

SEQ ID NO: 33403 - DNA, 1323 bp, Glycine max
  Peptide Sequence Number=SeqID_150181
atggagtggacgacgctgcagcaccttgatctgcgccacgtggggcgcggcgtgagacctctgcagcctcacgctgcttccttccatcctcaccaagctctcgtcgccgtcgcaatcggaacctacatcgtcgaatttgatgcattaacaggaagcaagatttctgctcttgacattggagcacctgctgtgcgaatgtcttacagtcctacaagtgggcatactgtgattgcaatcctccagatggtgcagacaaacaacaatttaggaattagtatcttgctgaaccgccgaagtgttttacttgatgaagattgtacaattcggtcttgtgattttgacttagagcaaacatgtgtattgcattcaccagagaagaagacagagcaaatttcttctgatacagaagttcatatggctttgaccccactacaacctgttgtgttttttgggtttcataaacgaatgagtgtgacagttgttggaactgttgaaggcggtagagcacccacgaaaatcaagacagacttgaagaagcctattgttaaccttgcttgtcatcctcgcctccctgtactgtatgttgcttatgcagaaggtttgattcgagcatataatattcatacctatgctgttcattacacgctacaacttgacaatactataaagcttcttggtgctggtgcatttgcatttcatccaactctggaatggatttttgttggggatcgacaaggtacactgcttgtatgggatgtatcaactgagagacctattatggttggaataaaacaagttggctcacaaccgataacatcagttgcttggctccccatgttgcgtttacttgtaactctatctaaggatggaaatcttcatgtttgggaaacgcgcgttacggtgaatcctaatggacctcccacacaggctaatttttttgagcctgcagcaattgaatcaattgatatccctcgcatcctttctcaacagggtggagaagcagtttatccattgccgcgaatcaaagctttagagtttcatccaaaatctaatttagcagcactagtgtttgcagttacgtgctaccttactttgtttataccttgcttaatgcgacaattgccgacaattcaaaaaataaggccagatacagtagagaagggagaaagcagctttttgcagttttacaaagtgcacgaggatcttcagaggtgctatgcagcatctgttttaaaggaaaaactttctgccttgggttcatctggagtgttggcggaccatcagcttcaagctcaactacaagagcatcatcttaaagggtga

SEQ ID NO: 33404 - DNA, 747 bp, Glycine max
  Peptide Sequence Number=SeqID_150182
atggctccaagctcgttaagtgtttttctgccgattaaggccaaagagctttccctgactgaaggtggttatcgagtcctcgtagcctctagtctcgactttctcgcctgtgaagctgaggagtggaccgccgtgaggatggacaaggatatcaacggaactaccttggtcgatgaggaccctagtcaccatgaaatttgcaatgatgatagagtcaaccacgagcttgtcttgattgacggggttgatgcccttgaagtccctatccgtgaaagtgataggcgggttcttttacttgtggaggttgtcattcacgctgttattgttggtgtctttgtctgtatcggtcatctattcttctttctacttcctggttcctgtgcttctcctcttcacatccttcagggtcttgatcctgcttgccggatggatacctccatgttgaatgcttccttgagaatcatggtgcgattgggtgttaggggcgaggagcatggaatgcaacactacctcgatgttaagattttggatctagatggctgtctgtccaaatctgtccatgaattttttgagggactcatcgtctgcttattgcagactgaccaaggcagccgaggtcatgcagtgagacctgctggtggtgtactgcacactgaaccatttaacaagggtatcaaaactgtctatggacctgggtgggagtccaccgaactagataaagaacgtgttggtcttcctactggatga

SEQ ID NO: 33405 - DNA, 125 bp, Glycine max
  Peptide Sequence Number=SeqID_150183
aatttgatgcattaacaggtagcaagatttctgctcttgacattggagcacctgcagtgcgaatgtcttacagtcccactagtgggcatactgtgattgcaatcctccaggttgaccatacctga

SEQ ID NO: 33406 - DNA, 219 bp, Glycine max
  Peptide Sequence Number=SeqID_150184
atgtacctccgccgttacaccgcaacaccaatcaccaccacaaccaccacttgccaacgaaccaccataacaatgtgcttcgaccaaactagacacaacaatgaaggaggagttcggccacaactcacaacaatgaatggttatgaagaaaagaatgaacggtgtatgaagaagaaaaaggaagaagaaaaagttagtagggctagtttgggaatttag

SEQ ID NO: 33407 - DNA, 258 bp, Glycine max
  Peptide Sequence Number=SeqID_150185
atggatgatcatagagtgggagttgtgacaagatctcatgaagctgacatggtaaccccgattgaattcgagcgtgttgggtatgaggagggagacctacccatatgctttttagtttttagatggaaatcaatgattttgtgtgagcaccaaagatggaatggattggctatgacatgcgctaaggtgtgtagatggacttgttcaaggaaagaaggatcttttgaggatatctcaagagtacaagtggggatatga

SEQ ID NO: 33408 - DNA, 276 bp, Glycine max
  Peptide Sequence Number=SeqID_150186
atgtacaaagataagtgggctcatactgagcccatgggcccaaaatctatcctaaggctcatgagaatcctagggccttctcctgcatcttttgcccaatcttcttggagtcttctatccaatgcccttgggggggtaggattgcatcaatatgtggcccccatggaggtgtttgtcgcattgtcagtatcttacgctaatttcattctcattgtctcacccctccacactactaaatcaccggttctttatgttggtgttgctaaatttggataa

SEQ ID NO: 33409 - DNA, 99 bp, Glycine max
  Peptide Sequence Number=SeqID_150187
atggttggagcattctcgcaaaacagcgtgacccaccctaattggtctccctgtgaactagctcacggtgattatcgtactaaagatgaagaggcgtag

SEQ ID NO: 33410 - DNA, 318 bp, Glycine max
  Peptide Sequence Number=SeqID_150188
atgaggtttcatgggttgaagatgaacccagataattatgcattcagagtatcagctgacaatttcctaggattcttggtccatcaaaagggaattgaaattgataaaaataagacaaaagaagttttggaggctagaccacctcagaatcaaaaagagttacagagcttcattgaacatgtatacataggagagaatgatgaagctaaccgattagctcaacatgcttctggatacaaaaagataaaagatgaggccttggaatcatctatagaagaatattgcataatggagatcagatcaacagacccattgtag

SEQ ID NO: 33411 - DNA, 312 bp, Glycine max
  Peptide Sequence Number=SeqID_150189
atgacggagaaagagatgatcgcaatgatagtagacacgttactggtgttctactatgagaaaatggtgggttacacgccttcaagctttaccgatttagttttcaccggtgaaaggatcgaagtgggtttgaaaagaggcaaatttgattatcttgctttgatgaatgagaaagctgggacaaacgaagagaataagaaggagggaggatcccatgccgtgactaccattcctacatggccaaatttcccgcaagctcaacaatgtcattactcagccaatatcaacccttctcattacccaccaccctag

SEQ ID NO: 33412 - DNA, 141 bp, Glycine max
  Peptide Sequence Number=SeqID_150190
atggaggttgagaaaccttggctaaggttatggataccatttaattatcgagtagatatgggagcaaggtggtgtttggcattggatgtacagcaggcaggctttgtggctgatttaggggtggcctttgtggttgattga

SEQ ID NO: 33413 - DNA, 228 bp, Glycine max
  Peptide Sequence Number=SeqID_150191
atgggggagatacatgaagcaccccaccataatctagccgacttcgagccttgccttggatatgcccttgaggggcaagcagtgcccaatttcgataagtacaaggggactacttgccccaagaatcatatgaagatgtactgtcagaaaatgggggcatactcgaaagatgaaaaactgctgatgcatttcttcgaagaaagcattactggggcagctgtcacctag

SEQ ID NO: 33414 - DNA, 1308 bp, Glycine max
  Peptide Sequence Number=SeqID_150192
atggaaggggacggttgtaatgtgaagatgttggttaaaattcacacaaattggtttgccccatttgcgttcccagtccgactggcacacaagattgagggttgttttgagttgagtaagtacgtgttattcacgcgtcctcccatatcttcatcatttgaagtggataacgataaagcaagaaaaagaagatcaagttggcgttgtggttgtggttcggaggaagctcgtagggccgtttcaagttaccttggagaattgggggtgtcggaggaggattcggtgtggatctcgtcaaagtcaccggagtacgtgaagatgttggtggaaggtgtgagggatttggagcagtggcaaattgcgcttgctgggttgagcttcaaggacaagattattcatatcgccgctcaaaaaggggacaagggcaaagttgcctacttagagagtctgggctttactctctcttcctccatgaacattgccagatatctcccctctgacactcacactcttccatctctcatgcacaaggttactcgtatcaagcaactcttgttcttttctcccactcccgaccatcacttgcttatcaaaagcattcgcctcatgatgcgccacctctccatttcaattgatgaagaccttcaacacactctgtcctttttcgaaaagctccaagcaaagcctggtggtcttggcattttggcttacaagaatgccgctttccgttccttaatcgaatcatttcctcgtctacttcagttatcagtggacaaccacttcacacccatactccattttctccacaattttggaatccccacatttcgcatctcaaacataatactggcttttcctcctcttctcttctgggatcttcaactccttcaaactagactcctcgtcttcaaggagattgacctgcctgataaagattatgctaagctgttgctaaaatatccttggcttctatctacaagtattcaagaaaactatacggagctccttgccttttcatattctatcaaggttccaaagacacagatagaccgtgcaattgaaagccaccctcatctattgagttgttcaactagcaagctgaagtcaatggtggatcagtttgctgaactaggagttcgaaacaaaaagttaaatcaggttattgctaaaagtcctcaactactattgcggaagcccaaagactttctacagttgacacaactttcaagacacctcaaggaaaagcttgtgtcttgttgctttgggtcaaacctcagtttgagcatttcaaacatgaaacattcgtaa

SEQ ID NO: 33415 - DNA, 546 bp, Glycine max
  Peptide Sequence Number=SeqID_150193
atgggttttgataaagaaaccatcggaagaatacttgctcgctgccctgaaatttttgctgccagcattaataaaactctacaaaggaagattgagttccttggtagagttggtgtttctaaaactttccttcctggggttatcagaaagtatccagaattacttgtttctgacattgacaaaactttgctacaaaggataatgtacttgatgaagttaggtctttcagagaaagacattgcatatatggtacgtacattttctcctctccttgggtatagtatagagggggttcttaggccaaaaatagaattccttgtgaactcaatggagaggccagtaagagatgtggtggattaccctaggtattttagctattcactagagaagaagataaagccaagatattgggtgttaaaaggaagggatatcaaatgcagcttaaaggatatgctgggaaaaaacgatgaagaatttgctgctgagtttatgggtattggaaggatgctcgtctatcctcctgtgtcgtctaatgatagccagtaa

SEQ ID NO: 33416 - DNA, 747 bp, Glycine max
  Peptide Sequence Number=SeqID_150194
atggctaatggaagcttagaagattgtctgtttcaaaaaaagaacaagagtgttctgtcttggcagctgaggttccgaattgctgcagagatagggacgggattactattcctgcatcagaccaagcctgaacctttagtgcaccgtgatctgaaaccaggcaacattttgctagaccagaattatgtgagtaagataagcgatgttggattggcaaggcttgtcccagctgtagctgaaaatgtaacacaatgctgcatgacatcagcagctggaacactttgttatattgatcctgagtatcagcaaacaggaatgcttggtgtgaagtcagatgtttattctctagggatcatatttcttcaattattgacaggcaggcctccaatgggactggctcaccttgctggagagtctatcgagaaggacaccttcgtcgaaatgctggatccatctgtcaccgggtggcctcttgaacaagccttgtgccttgcaaaaatagcagtcaagtgtgctgaactcaggcgaaaagataggccagacctcgccaaactagtgttgccagagctagataaattgagagactttgccgaacaaaacatgagcatgcctatctttttaggatgcactgcatcttcacccagccacagtgaagctttcgtgcatcaggatgtgatcagcgacttgcggcttgtacattcggaaagctcatcggctccatcaacgcccacagaaggaaaaccttaa

SEQ ID NO: 33417 - DNA, 1647 bp, Glycine max
  Peptide Sequence Number=SeqID_150195
atgaccatactaggaataaagcatcatccatctctttggaaggttcaaagtgattgccctggaatatcaatagattccaacctatatgctaatccccccctgattacaaaatccatccctgatattactgaaccagtagtggaaagggatgtcaaatcctttttccagtatagaatgcatccagagatttgcaagttcccttcattgcatttctatgacaacaaattactgaatggcagccaaatgtctaacaaatcagcaccatttcatcaaaccaagggtcttgggccatatgtattctatgatatcattgatggccaggaggttcgaggaaaaaactctggtgtaatgtcgctttgtaatgaacaggaagcggatgctgcagttgaagtactaaagtttttcaagaaaaggtacccagctgaatttgttggtggaagaattggtgttattactccatacaagtgtcaactctctcttctgcgttctcgttttcttaatgcatttggaccgtcgagtgtagctgatattgaatttaacactgtggatggttttcaaggtagagaggtggatataatactactttctactgtaagagcagctcattcaggcattactgcttctgaaataaactcaaactctattggatttgttgctgatgtaagacgaatgaatgttgccttgacaagggccaggttatcactttggattttgggtaactctagaactttacagactaaccagaactgggctgctcttgtgaaggatgctaaagaaagaaacttgatcatgaaggctaagatgccataccattcaatgttcaaaacagataaaaataagtcttatgttgaaaattctgataatcatgcaagacgattgaagcacaagaaggttaaggatactggtcagagtgtaacaaaaattttggttcacggcaaggatattgttgagaggaaaacgaaatgtgttgcctctgaagttagggacaggaagggtaatgtggatgagaatacttcttcagctttgggaaaatatactccatgtaaagaaaggaaatctgaagatgagcatatttccattacgaaggatatgggatatgaagttgaaaaatatgaaagcagaagctcctgcggtgacatgtttacaatgtcaggtcaacaggtttgtaatgggggaagagaaggcaaggataagttgaagatcagcatgggaaagacagcattgggtaaaagacaactaaaattcgaacattcaaggaataatttagaatattctgtggaagagacaggtggtgggcataaggcatcaaaactttcagtgtcagacagacaggttatgcattctggagggaataggagcagttcttcagaaatttctgcttcctcaatgaaaggctgtcacaaagagagagatgccattgatcaaggtactgctcctaatcgaagtaaagttgatgaaatttcaaaaaggaaacagcagcgtgaagctgttgatgctattctttactcatctttgatatctgcaaagaaggatgagacattaccaaaagtttctgctaaaaggcctttttcctcatttgttgctagtgggagtactaagccgcccaagacaaaaagtgatgatattctgttggaaaagctaccttag

SEQ ID NO: 33418 - DNA, 192 bp, Glycine max
  Peptide Sequence Number=SeqID_150196
atggcggatgttcggctggagcgaggacagaaggcgcgcaacagtcgctcaacaaacaaaacagaaggcgctaagcacgcaacagacgctaagcgggcaaaacagaatgtgttaagcgcacaacaggcgctaagcgcgcgtaacaaaacaatactcgctaagcgggaggagctcactaagcgcgcgatgtag

SEQ ID NO: 33419 - DNA, 2997 bp, Glycine max
  Peptide Sequence Number=SeqID_150197
atgggtttgagtcaacccggttcacaggttgaacgggttataaaaatggtggctcttttttttgcgagttgtcctaacctggctcacttaacatatggttatactttggaagagttgacagcacaagtgtcatgcctatccgtttctttatctagggaaggatctcataattttctggaggcaaatgtgaagtccaaatcattggtatctgaaagattgccttttgagaaggattgttttactccagatattcattcttcatccatggaggatacaggcgcacgaaatgtggagactaaaataataactggcaaaaaaagcagtgacagtgtaattattctttcagatgatgaagtggaaccaaaagtttcttccaagaaagactttttgtcagttagtgaggctggtccccacatatctgatggcaatattatgccccctgatgctggtaatagtttaccagctggcgaccttgtaaaccagaatgtttcttttatgaatacttctaagaaaatggagcagaccttccagaaaaaggctagttctggtactttacatgataagcctgtggtgacttcatttattgattcaaaaggctcaagcagttgtaggacaggagtaagctcaaaatccaaggatatggtcaatttgacaaaattttctgatgaagctgtcaatgctaaaagtttgaataaagcttgcagcagcatggcttccaaaactggtgacacttcatcaagtacttgtagtaaaatgttatgtgatattcaggatgccgaagatgatccgctagagactgcattgaaatctgtgggacgtgtccaattgcatgtaccaaagcctacagttatgagaagacaagttattcaactcaaaacacctcttgaaaacaaatctggttatctccgtaaactggaggacccaatgaaaagattcaggccaccaaggttggatgattggtttaaagctattcttgagataaattattttgcaacagtcggattgtcatccgcaagaaaagatgaaaaccgaattgttaacaaattaaaggaagttcctatatattttctatctcctgaacaatatgtggagatatttcgaccattagttttggaggagttcaaagcgcagctacagaattcttttcttgaaatgtcttcatgggaggagatgttttatggaatcctttctgtgatgtcagttgagagaattgatgatttccatcttgttcgctttgttcacgatgatggtgattctacaaaatgtaggagcttttcagaaaatgactttcttttgctaacaaaagatcctccacaaaaatcttctcatgatgttcatatggttggaaaggttgaaaggcgtgagaaagacaacaagagaggttcaagtattattctcatcaggttctattttcaaaatggttcttcacggttaaatcaagctagaaggaatctcactgaacgaagtaaatggaatgcatgccgtataatgaacattacaccacaaattcgagaatttcatgcattgtcttctataaaagacattcccttactttctctcattttgaatcctgtcaacaattccttttgtgtgaatgaatgtaaagatgtagatctcaataatttgtgccagtcattgcagcaaactctgaggtcatcatttaatgtcactcaacttcaagcaataagtgttgctattggaaggggcaaagtaaaaaaaactgttgaattatgtcttattcagggtcctccaggaactgggaagactcgaactattgttgccattgtcagtgcccttctagcttctcaacagaagatgacttctctaaaaaatccttttgatgaaaacttgtaccaaaaatcttctacctattcaagaccaaagattagccagagtactgccattgcgagggtatggcaggatgcagccctggctagacagttgggtgacgatatgcaaaattcatcaaaatcttttggaaattatgcaaaacaaagagtgcttatctgtgcacaatctaatgctgctgtggatgagttggtggcaagaatttctagcggtggtatttatggcagtaatggaaaaatgtacaagccttatcttgtgagggttggaaatgcaaaaacagttcattcaaattcactgccattctttattgatacactagttgatcaacgtgtagcagaagaaaggatgcattcaaatgatgggaggaatgatttgggggtagattcatcagccatgctgcggtctaaattagagaaactggttgattctattaggttctatgaagccaagcgcgctaactcaagggatgggatttctaatgttaaaagtcctctgcataacgactctcatatgggaaatgagaaggaaatgtctgagacggaaattgaaatgaagctgcgaaaactatatgaacaaaaaagacagatatataaagatctttgtaatgttcaggctcaggagaaaaaagccaatgaagaaaccaagtctcttaggaataagctgcggaaggctatactaaaggaagctgaaatagtggtaactacattaagtggctgtggtggggatctttatggggtatgctctgagagaatgttaaactccaagtttggaggtccatctgaacataccctctttgatgctgttgtaatcgatgaagctgcccaagctcttgagccagctactctgattcctcttcagcttttaaagtcaagtggaaccaaatgcattatggttggtgacccaaagcagcttcctgcaactgtcctctcaaatgttgcaagcaaatttcgttattcgtgcagcatgtttgaacgtttacagaaggctgggcatcctgttattatgcttactgaacagaaaagaaaaagggggaatttctgccatggacgctgcaaaccaccatggcaccatggtcatggtggacagcaccattcaatggcaaataatgaatggcaaatggaggagtggtccaaaaacgccatgttttag

SEQ ID NO: 33420 - DNA, 324 bp, Glycine max
  Peptide Sequence Number=SeqID_150198
atgccgccaaccccgtttgaggcgctgttcaagaatgctgttgatggaccagtgtgtcaagggtgcaagaaggcagattgggcctttgaggaccagcttgttggtctggccttcaccgaggtttctgatgggagcaagtttgaggttttctcacagcggctttgtggcatgagcggtgccgccattccagtccatggaggattagaaatgaatcaggccgtaggaaagaacgaaactgccaaaaatggtttcagagtggaagcctgcggtgattgctgcaagacaggccaaaagatctcaacggtggttgggggggctcaataa

SEQ ID NO: 33421 - DNA, 201 bp, Glycine max
  Peptide Sequence Number=SeqID_150199
atgaggttgaaagctcatgtcgaacctaaagtgacaaacatttgcaatatggccatacttacggaaaaattgacactaaaaattagcaaatctgccaccactgcgacctctatcgaagccaccattgttgtgactggcaccacatctaccgccaccgcggtcagcgaaaccaccacaattaccaccgtcgcaaccatatga

SEQ ID NO: 33422 - DNA, 114 bp, Glycine max
  Peptide Sequence Number=SeqID_150200
atggcgtctaggaaacagggatgtgtttctgtctggcactcgtattttagaaattccttcatcatcacatctgacactgggatagttgttgatactggtggtattataatttaa

SEQ ID NO: 33423 - DNA, 1535 bp, Glycine max
  Peptide Sequence Number=SeqID_150201
atggcttccgcatctccgaatttcgtttctaagtcctttcctaattccatcgctgagaagctcgatgatttgaactatctcttttggcgacaacatgttgatcttgtaatcaaatcgcgtaaactacaacgttttgtagtgaatctagttgttcctctgtgttatctcaacgaagaaaatcgtgttgctgattatgttaatcctgataatgaagcgtgggagattcacgagtacattagtcttcagatgaaatcttgtgcgtgtcaattgcaaactccgatgcgtgcaatttcgcttgaaggcaaattgattgatgaatatctgcgtaagatcaaattctatgttgatgagctcgctagtgttggagtgtcagttcgtcacgaggaatatgttgatgcgcttcttgaaggacttcagtccaattatgcaccgatgatctctgttattgaaagcaagaagcgtatgccgtccattggtgaaattaaagctttactctatagtcatgaaactcgccttgttattcgctctctaactcatacaaatttggtgattccggtggttctcggggttcatatggttgcgacggtggtaattgtggtggtttcgctgaccgcggtggcggtagatgtggtgccagtcacaacaatggtggcttcgatagaggtcgcagtgcctcaacacagccaagtgctatgctcaccaattccaactcatggaaatgctaactccatctggattccagattttggtgctagttttcatgtaactgtcaaccctcctacagtatcacattttgtctctcaacaatcttctacctttgagtccaattctttgcactcacaaacatcagagttcaccacatctagtttactaccttttgagtctatgcttgttgctaaccctgccctagttaacactcatcctatgcaaacaaggtccaagtctgggattcacaatcctagacttcatccttcattatttcttgttcattctgagcctaaaactttcctttaccctccaatagacaagctattggatgtaagagttaaggtaaatgttgatggctctattaacaaatttaaagcaaggttggtggcaaagagcttccaccaagtccatggttttgatttccatgagaccttttcccctatggtaaagcctatcacaatccatattgttctcacccttggtctctcgcatggttgggagctgtttcagctggatgtaaacaatgcctttttaaatgggcttcttgaagaatctgtgtttatgacacaacctcctggctttgaagttggggataggtctcttgtttgtaaactcaacaagactctttatggcttaaaacaagccccaagcaaatgtgattcttcactttttatctacaagcatcagtctcatcatgttgtctattttctggtttatgtggatgatatcatcgagagggcgagccctggtgcagcggtaaagttgtgccttggtgacttgttggtcatgggttcgaatctggaaatagcctctttgcatatgcaagg

SEQ ID NO: 33424 - DNA, 306 bp, Glycine max
  Peptide Sequence Number=SeqID_150202
atgaagtcaaagctgaagaaactcaagattagcatcatgaggtttaggctaacgtcatcgacgatggagaataaggcatcaacgaagggactcgaagggaggggtggggagaagttgtcgatgtgtgtgaagtccttccacgagatcttgatgaagttcgattcagaggaacagttcgcattgacaacagcgagggaaagggaaaagtcgcaagtgggagcgagttgggtgggtttagatctggctactatgggtttgggttttggtggagttgtagtgttgggagaggattatgaggggaaatag

SEQ ID NO: 33425 - DNA, 1182 bp, Glycine max
  Peptide Sequence Number=SeqID_150203
atggtattcctatggtgccatatagtactagttagagccacccaccacccacaccatctgctatggtttatattagctccaaatgctccatggaaggttgttcttgtattgacattatttagatatttgatcccgtgttacagtctcttgaagccttgcaagacggggagcttgaaaagcagcgtagatagcgcttcttgttgtacaccgaggttacaagatgaacccgccttgtcctcccttcgagtgtgcacatatgtgttacctgaacagttctcaacatctgtattggacaggggacctgctcttgtgtcatctctgaaggactcctcgcttcacaattctttgaggcaacctgcatttgaccttatacagactattatagtatcagatgctactgctttaatatattcagtgctgaattgctgtgcaactcgaagcactgatagtagcattgcagatgaggtcgttgagttggatgatgaaaatgataattggctgccaactattccagatggtgaagagcaggatagtagtagttcttggagtcaattcagacttcaaagtggaataacttctcaagagtgccaggagtggatgtgcattccaatgttatgggttgatgttttacttgatattaatccctcaatccttccgatttcattttccaaagctgttttctgggcacgatctcgttttccgatggtagaatttgagaaaggtgcagaaatggtgcttccaatcagatctttcctttcatcttatgcagcagaaatttcctcttcatttgggtggaaggttccaactggatctgatgacggtggagatggaagcaaatcaaaaaactcagttgaagtgttgactatgccttttcctttattaagaacatttattaggttaactacacattttttagttcagataagacaaggagagcttcgaagtcagtggacttgggaaccactgatgagtgagagcttgatcctttcacttttggatccaaatgatgatgttagacaatttggaaaatcgatgttggaacaagtttcagatacttggggtctttcaagtggattgaagtttctttgttctcacaatccctcattgtatgcaattattttgggcctcaaacatgctatgaaactggaaatttcattagagaactatgatttaggggaatga

SEQ ID NO: 33426 - DNA, 819 bp, Glycine max
  Peptide Sequence Number=SeqID_150204
atggggccccttttggagactttttacaattacttcaaagatgatcgtcaagattcacctctgaggctgttatggaagagaatctctgatgaaatgcgacagtgcctgcaatgcatttctcagcatcatcaagcccaagacatgtataacacagagtatgagtctagctctattggtcctcttcttgatgtcttgcagaagcttgattgtgagagggtgacatttcatctgagagatatcaacacaaaaatagtaggggaaaagtacaatccctcttgtgataatggtgaagttgtcaatgttttgtatgaggtattgatgttcccaatcctcttagattatcagcctctattcactgagtttgagttgtttgttgaagctattgacaataagcatgaactggctttgtctgggcatcaacaatttccgggagtttatgcattacttttttgcaagagaagtgttcgttctgttggatatcgcttagcaggatcaatgggaaaactgaggagagcaacagacttggaacctttgcagccattgcttaagaaatttattagctgtttagaggcagatgctttgccagtgactttggagacctcaacatcaagaactcaactggatcgtgtgtctttatggattggtatcaaatcactgcttggcttcttggatccttcaacttttgaagaagggatattggaacgctatcccttttttgttgatattgtactcaatcatattagtggtgattcacttgaattttcacatgctgtgacctgcttgagactactatttgaaatgcttgggatatcttattag

SEQ ID NO: 33427 - DNA, 213 bp, Glycine max
  Peptide Sequence Number=SeqID_150205
atgggtggggtgcccgtggccttgatagtgctcagatggtgcagtgatgatcagatctggagtggtgcggcggttgagttgtttggggtgaggaagggttctaaacgaagagaggggaaggggagggagtgtgaggaaggctctagcggcagatattattattgttatcaattaggcttaggcttagaagttagaacaacttacattaactaa

SEQ ID NO: 33428 - DNA, 807 bp, Glycine max
  Peptide Sequence Number=SeqID_150206
atggcaggatgcttccaatgcgctagcacttggtcaaaaggtggggaagaggccacctacgaggaccttgatgctccagttaaaatgagtaaaagggatagagacatgagcaacgttaacatagcctccacctcgcgtggttccacctcctcctccaatggccttctcaccgtcaccattaccagcaccagccaccctgacgaccctcccaccgacgacaacgatgacgacgacttgctcgctgatccggacgatcctttcgatattacgcataccaaaaatgcacctcccgaggccctcaagcgttggagacaagcagctttcgtgctcaatgcgtccaggcgttttaggtacactcttgacttgaaaaaggaagaggagaaagagcaaaagaaaagcatgattagatcccacgcacaagtcatcagagcagcattgcttttcagattggctggtgaacgggaactagtgacaagtaaagcagcagtggcatccccatctccagttggtgaatatacagttgggctcgaacaacttgtttcaatgactaagaatcagaatatttctgctttacaacaatacggaggggcaagcttatcaaatttactaaaatcaaatccggataaggggattagtggagatgatgttgatctatcaaagaggaaaaatgcatttggaactaatacataccctcggaaaaaggggagaagtttctggaggtttctatgggaatcttggcaagatctgactcttataatattgattatagcagctgtagtgtcgttggtacttggaataaaaacagag

SEQ ID NO: 33429 - DNA, 1369 bp, Glycine max
  Peptide Sequence Number=SeqID_150207
atgggttctagattcccatctcatcagctcagcaatggcctgtatgtatcaggtcgccctgaacagcccaaagaaagaactccaacaatgacctcagttgccatgccttacactggtggagacatcaagaaatcaggagaattagggaaaatgtttgatatccccatggatgcttctaaatctagaaaatctggtcagctaaataatgctccttcacggactggatcgtttgcagctgctgcttcacattctggacctatcttgccaaatactgcacctcgttctatttataccacatcttctggaggcatggctgcttcactctcaatgaaaaagaccaattctggtccactgaataaacatggggagcctgtgaagaagtcttctggaccgcaatctggtggagtgacacgccaaaactctggtccaattccacatgttcttcctacgactggtcttattacatctggtcctctaaattcatctggggctccaaggaaggtatccggtccattagagttttcaggatcaatgaaatcacacacttctgtaacccacaatccagccatgaccactcttagcctagatgatgaatattccttcaggaggaacttcccaaagccaatattgtggtctgtaattctgatttttgttatgggattcattgctggtgcttttattcttggagctgtccacaatgccattctccttgttgttgtagtagttctttttggtgctgttgccgcattgttcacttggaacagttgttgtgggaggacagccattgttggtttcatttctcgttatcctgatgctgagcttagaactgccaagaatgggcaatttgtgaaggtttctggggttgttacctgtggtaatgttccattggagtcctcctttcaaaaagttcctagatgtgtgtatacttctacaagcttgtttgaatatcgagggtgggattcaaaagcagccaacccgaagcatcgccattttacatggggactaagagcagctgagaggcatgtggtggacttctacatttctgatttccaatctggattgagagcattggttaaaacaggctatggtgcaagggtgactccttatgttgatgattctattgtaattgatgttaaccctgacaataaagatatgtccccagagtttcttcggtggttgcgagagagaaatctttcaagtgatgatcgactgatgcaattaaaagaagggtacatcaaagaaggtagcacagtcagcgtaatgggagttgttcaaagaaacgacaatgtgcttatgattgtccctcctcctgagcctttgactaccggatgccaatgggctaaatgtatatttccagctagccttgagg

SEQ ID NO: 33430 - DNA, 498 bp, Glycine max
  Peptide Sequence Number=SeqID_150208
atgagttccaaagagagttgcagaagtgaacttcgcattgcgatccgccaactcagtgatcgatgtctctactgtgcttctaaatgggcggcagagcagttggtgggtattgagcaagaccctgcgaagttcactccctcgaacacgagatttcagcgtgggagttcgagcattcgcaggaaatacaagactcatgagatcgcggggaccccaagcgcgggtgtttcgtatgttgccacacctgtgatggaggaagatgaacttgtagatggcgatttctaccttctggcaaagtcctattttgattgccgtgagtataagagagctgctcgtgttcttcgtgatcagaacggaaggaaatcggtgttcctgcgctgctatgctctctatctgttcagtttcatggcaaaatctatttcggttggagatgtgggttatcttctaaatggattgcaattaataggtggtaatacactctatgctgctatagaccattga

SEQ ID NO: 33431 - DNA, 330 bp, Glycine max
  Peptide Sequence Number=SeqID_150209
atggtgatggcgtggaaatggatcgtgcgaaggacccgcgaatcaaagcccttcttccttgcattcgccaccatatgcggcgtcgttccgggcgtcataggctatggcgtcatgcaactcactaacacccgcaacgagaagctcgagtcacatcttcgcacaaatgcccgtcccgaatcattgtgtatattttcgcggctgctggttgatactgttgtagcggttttggctggggttaagccatttgtgctgctatatatacaattatacaaatacaacacctgggtgcttcattggtgggctgcctcaatatctgttcccggtgtctag

SEQ ID NO: 33432 - DNA, 1419 bp, Glycine max
  Peptide Sequence Number=SeqID_150210
atgaccattatggtaaatgattgtgcaacttcatggtgtacggtttggctcaaaataaagtctttagatcccatggctggtgaaaagcggaaagaggaagagatgatagaacttgaggggcctctgggtaagagtgatgctgtcaatcatgaattggtttctttggagagagagttgtcaacacttcgcaagaatggcaaagttgatgcttttggtttgtacttatatggtcttgtgctcaaacagaaaggcagtgagaatcttgcacgtacagttcttgtagaatctgtgaatagctacccttggaactggaatgcctggactgagttgcaatccttatgcaaaacagtggatatattgaatagtcttaatctcaatagccattggatgaaggactttttccttgccagtgtttaccaagaactaaggatgcacaatgactctctgtcaaaatatgaatacctactaggaacctttagtaatagtaattatatacaggcacaaattgcaaaagcccagtacagtttgagggaatttgaccaagttgaagcaatatttgaagaactgctgagtaatgatccttacagggtggaagacatggacatgtactccaatgtgctttatgctaaggaatgcttttctgctttgagttatcttgcccatagagtattcatgactgataaatacagacctgaatcttgttgtattgttgggaattactacagtttaaagggacagcatgagaagtcagttgtgtattttaggagagcccttaaattgaacaaaaactttttattggcttggacgcttatggggcatgagtttgtagagatgaaaaacactcctgctgctgtggatgcctatcgtcgggcagtagatatagacccacgtgattatcatgcttggtatggactaggacaggcttatgagatgatgggcatgcctttctatgtgcttaattacttcaaaaaatctgtatttttgcagccaaatgattctcgtttgtggattgcaatggctcagtgttatgaaactgatcaacttcgcatgcttgatgaagcaataaagtgttacagaagggcagcaaactgtaatgacagggaagcaattgctctgcacaacttggcaaaacttcactcggagctagggtgccctgaagaggctgcattttactacaaaaaggacctagagaggatggaatctgaagagagggaaggacctaaaatggttgaggctttactctatcttgcaaaatattacagagcacagaaaagctttgaagaagctgaaatttactgtacacgtcttctggattatactggcccggagagagaaacagcaaagagtatacttagaggaatgcagtcaacacagtctaattttccttccatggacgttgagcattttcctccctcttga

SEQ ID NO: 33433 - DNA, 702 bp, Glycine max
  Peptide Sequence Number=SeqID_150211
atgagtgaaaaagagagatacgaagaaaataagatagtcccacaaatctcaaagttgcaagaagtcccattccatattccttttctgaggtgcatccattggagcaagtcctcatttggcacgtgcgagcctcacttaaatagcattagcatggccccctcatcatcaccatcttccaagaggcacccactgttccacggaatccgttgccgcggaaggaaatgggtctccgaaatccgcgagccacgcaaggcctctcgcatatggcttggcaccttccccacgccggagatggccgccgctgcctacgacgtggccgcgttggccttaaaaggcgacggcgctgttctcaacctccctcactcggtttcaaagtatcaaatgcctttaaccaactctcctgcggatattcgcagtgctgcctccgctgcagccgcaatgataaaggccgaaactgaaactgaagctacccacaaccacaacatgaatattgcatcaataactgataatgaagctacctacactgcttcaacttcgtggtttgaaactgatttcatcgacgaggaagtcatatttggtatgccaagtttgctggtggacatggccgggggaatgcttctgtcgccgcccagaatgagcccgccaccgtccgataactcgctggagaagcaaaatggtgaaactttgtggagctatttttga

SEQ ID NO: 33434 - DNA, 264 bp, Glycine max
  Peptide Sequence Number=SeqID_150212
atggcagctggtaataggcaaaggaaatcttcttcgggtttcttctctattttcaacatcttctcatcaaggaagcccagaggagggtactctgatgcccctgattcgtggcgcagagtctatcctagtgattacgacaaaggtaactggggtgttgctgagcccaatattgacatgaaagctgaagctttcattgccaagtacaagaaacgtgtttcagaatctgcactctatcaacttgatcccgctgctgaaaatgcataa

SEQ ID NO: 33435 - DNA, 270 bp, Glycine max
  Peptide Sequence Number=SeqID_150213
atggctaattatgatgatgcaccaaagcaatggaccaaagtttggcccagtgatgaggacagaggtcgctggggggtggctgatcctgtcattgacctcagagccactgctttcattgctcaatacaagaaacgagtttctgagtcagaaattcattgccaagctcaagttcagcatttgagctcacttctacaagggtcaagagcaacaactgtaaaaacacctaaaaatgttgatccgctaatatgtctgtcattgaagtacatgtag

SEQ ID NO: 33436 - DNA, 264 bp, Glycine max
  Peptide Sequence Number=SeqID_150214
atggaccatagaaaacacaccaagctcaccaagttcaacaattttttagatgtgatttttgtgttggtaaccatcaaaatggccattgttcagcacctggtgatggacaacaagaagagaaggcccattatccgtagaaccaagccagacctcaacaaaactttgaaggaagctaccaaggctatagaggtggctcaggtccttctaacaactcttatggaggttttccaaataggggtccacaacaacaacaagctcagctag

SEQ ID NO: 33437 - DNA, 1037 bp, Glycine max
  Peptide Sequence Number=SeqID_150215
ttgaaaatggggtggttggaataccgagaaaatgtttggaggcaaaagcaagaatcttggcaagtaaaggcgaatgggccctgttcatagacattctcgcactgttgatctttggaggagtcctctttccaaatgtggatgggttggtggacctagcagcgattgacgcttttcttgcctatcatgaccacaaggaaagcccggtcgttgctatgctagccgacctctatgacacctttgagcgaagatgtgagaagagcaagaaaggaggggcaaattgggaccaactcttagcaaacaaagaaggagcatctgtcaactggttccctcgatggaaggaaggaagaaccggagttcttatttcatgcggaggatttccaaatgttcccttgatggggacgaggggttgcatcagctacaatctcgttcttgctataagacaacttggctaccctatgagaggggcaccactagaggatgagctctcgactgtcatttcacgaggcttcaataagaccaacgtggagacacttcagaaggtcggcaaggcatgggaggtgttgcaaaagaggacaaagaactcaggggcagtaacaatgggcccatcggtggctatcgcaccggaggaagacgaagaggtgcaggcccttagggcggaactcgaacaagcccaaacagttaaagaaaggttcaaatcagcagctctgaaaatccaaaaggagaataccgaactgagagatgtaaatgtggctaccaccaaagccttggaacgagaaaccaagagggcttgtagggaagaacacggccggaacaaattccgaggggctctgtgggtagcaacaaccaacatgttagctattatcaccaagtaccgagaagaactaaatctagccgcggcccacgagcatagagtggcagatgagtatgcccaagtgtacgcggaaaaggaggctagaggaagggtgatcgactcgttacatcaagaggcaacaatgtggatggaccgatttgctcttaccttgaacgggagtcaataa

SEQ ID NO: 33438 - DNA, 1086 bp, Glycine max
  Peptide Sequence Number=SeqID_150216
atggcttctggttccggtaaaccccgcacttatcaaatggtggtagccaaagccaatcatcgtaaaactcgcactcttttattgctcaaggattatctgagggacgacctaagttcgtgttcatccagcggtttcagatcactcccacgtcgacaatgctgcctgcaacaactgcaacctcgcgcttctgctaaatcggttctgcagaaagctttagaggcactgttcaacgccatcaaatcccgaaacaaaggcggtgttggtgttctttctagaagcttcttctggaaaaaagcatccaagagagagtccatttccacttgttcgttaaccgacgttgagatggaaggatcagtaacgacaaccaacacctgctccgtcacgaattccgccagggttgactctcgtggaaaaaaggattggacgaaggtgaaggaacaatttagtcctgtatcggtgttagactgtccattatttgatgatgatgaagagtctacatctcctttcagttccccatcgcgttccaccctggaaggagccaaacatatccagcagcgtcgacattttaatcgcgttgacttagagaaaaagatgtcatggtcagaactacaggaagatgaatcaatatacaactatcccacaaaaccttgtccagtgttagtatcaattacgagtacacaaaacgaaaataataatctgttacatgacagcgtagaaaagaatgcgctcgaccttctcactcgtgttaaaaattcaatttcatctgtctgtttgagaattgagatggagaagttgttgtttgatttcttcaagcagagtatttgggagaatactgatattaaaaattccatgaagtgccatctttgcaacgtggcagaggattggatacgcgggcaatctcatgtacaagatttgagtttgcaaacacgaaagggaagggagatatacgttaaggagatggacaagtgtgggagttggagaacttttgaagaagaaatacaaggcttggctatggaactcgaagttgagttctccactaggttggtcaacgagctcgtggttgacctaaccatgtgctttttttaa

SEQ ID NO: 33439 - DNA, 1659 bp, Glycine max
  Peptide Sequence Number=SeqID_150217
atgactgaatcagtcactgtgaagacaaagaacttggagtggattgtgttggttttcaattcaaagaacccaaagtgtcacgcgaggtcatcgacgacactgccggtggcgccgagttcatcgccaccaacttcgcctttctgcatcattatcatcgcacatcctagcgattacgacaaaagtaacaagggtgttgttgagcctaatattgacatgaaagttgaagttttcattgccaagtacaagaagtcattgaatgcgataacaattaaggatcgttttcccattcccattatcgatgagttactagacgaattgggaggtgatgatgtcttttggcctgtgcaatgcaccctcttcgttccaagccactatgaatatcatttgattcacttggagaaagtgttcgaagttctccttcacgaccaattggtgcttaaattttccaagtgtttctttgctcaaaggcaagttgaatacttaggtcatgtcgtgtctggccagggtgtcgaaccagttgcttccaaagtccaggtcatatatcaatggcccgtcccacaatccacatgggccctgcataacttcttgggtctcattggattttatcgtaaattcatttgcggttatgcctccattgtagctcctttgatcaaggtcaccacgaaggatcctttcgagtggtctactgacgctcaacatgtttttcacacactcaaggaggctttgacttcggcttcggttctcttcttaccggattttacacttccatttactttggaaaaagacgcatcaggcattggaatgggcgtagtcctatctcagaagggccacccaatcgtgttcttcaacaagccattcaatcacaaattactgcaagcatttacctatcctcaaggagttcatgacccagtggcagatgcgttatcaaggattccagacaacccagcaggtaccatgttcttattgtcagtaccttgtttgacatttttggaagaactcaagaaacacttggcccaggattatgttttcactgagttccgacgagcaatcatcacacacccagaagcccacccagagtattcagtcactcaaaatttagtcttaaagagaggatgcatttggctactacaagggcttcctttcattcaaactcttctgacggagtatcattccacccccaccgacggccatatgagggtagcgaaaactttagcgcgggcttttatgtcctttaccgatgccctgtcggccatgggaggatctttccttggactttattactggcctactacctccatttcacgacaatactactatacttgtttttgtatatcacttctcaaatggcattcatctgggcatgctagcacaccaccatacttctcatttggtagcagtcttattcatggacattatcgggaagcttcaaggcatgtcgcgaagtctactttcagatcgagacccaaaccttcgccttggggggaatttctaaatttggtggaatggtcctacaacacttcgtgtcattcgagtttgggtgcatcgccatacgaaatcacatttgggaaaaagcccttcaattttccccaatacattgcgggatcttccaaggtggatgagtttttaatagacaaagaggcagtcttcgcggaattttga

SEQ ID NO: 33440 - DNA, 282 bp, Glycine max
  Peptide Sequence Number=SeqID_150218
atggcgggaactgatttagacacaactatcattgatggtctgggtgttgctagatggagagttggtggaatagaagcagaagctgcaatgcttggccagaataccttggtagagttgtgttcaacacaaatggtgggaactgattcagacacaagtatcattgatggcctgggtgttggtggatggggagttgctggaatagaagcaaaagttacaatgcttggccaagttaatttagaataccttggtagagttgtgttcaacacaaatggcgggaactga

SEQ ID NO: 33441 - DNA, 171 bp, Glycine max
  Peptide Sequence Number=SeqID_150219
atggttggaccacgtacgaggctactatgcggacacggtctcggacaccacacgactcggattttcatggataatgatgatatggcaaaagttgaaacaggctgttgcctgctgttgacacttgaccctgggtgtctcccactacggctccagtctccagctattaaataa

SEQ ID NO: 33442 - DNA, 597 bp, Glycine max
  Peptide Sequence Number=SeqID_150220
atggttgtcaacctgagcctatatgcagttgcattgatagtattcagtgtcatcaatggaaaaacacatgatgatgttgaaaatcagtactgctggattgcatatctgtcaatttttattggatgttgctttgtgggcgtatttcatcttgcaaccaaagagcccagattgaaggtggatgtacatggaatggttcatgcaaggatttcatgggattactggttcaagagaattctatattatcatgttggtcctgtttatgttcttacaagattggttctcaacgtttcacaggcataccttgctttctttgtcatcaatgacctacaaatggcccaatcagccaaagctttgctgctgagtagtatgattttgacgatgagaattttggaatttaagatttctcatgcactcatctatttgatcaacgatttttatagggataaagaattgtcacctttctacatcggtccaataaccatcgttgaagggtgtgggttttcaacgactgccgctacaacatcgggtcataaccgatgtagaaagggccaaataatcgatgtagaaagtctaatttctagtagtgaatgtaactag

SEQ ID NO: 33443 - DNA, 420 bp, Glycine max
  Peptide Sequence Number=SeqID_150221
atgccaagccagttggaagggctaaacagaaattacagttgcaaggaggcagaagtaaatgcaaattttagtggcagcaaggagatgaattactttcccattataattacagattttagtcgaagcaagatcacgacagcaaggatttctggctggggatttgagatgcccgttctgcaatgcatgcaaggagaatgccaatcatttgttattcctatgcaagttctcgacaaatatttggaacaagtgctaaaattgggtgggagtggagatggtacagcacagcgatcctcagaagtgctttgttcaacactatatgggaagcttcttgaagaaaccaacaaacttggcttcggcagtatggtgcgaaacaacatgggtcctatggcagcaccaaaatgggattatctttcacaatga

SEQ ID NO: 33444 - DNA, 1455 bp, Glycine max
  Peptide Sequence Number=SeqID_150222
atggccggagctgttatttttatagtagctgattatgatgaaatctctattccttccacattagttgtttctgccagtttgcaaatgttgcagttggattactctcttctcaagaagaggaatagtatgttacaactgtatataaggaatactatgtctccgtttcacgttgcaatacctactgaaatgaagtgttctgctgattccatggttaaggaaggtgaagacacttctatagataaagaagagggtgatgattgcatcatggtcacaattgttgaaaactctaagaatcctatacaactggattctgttcgggacttggtgataccttttcttctaggaacagcaatacaaggatttctggatgtcaagaaggttgatattctctggaataatcagtcaaaagtaacaaattctcgtaatggtttttctggtgaactgtacttgagggtaactttgtccagcgagggtagcagaggaagattttggggtgtcctcctaaagctttgtcacaagataatgcatataattgactggacacgaagtcatacagataacatcaatcatttctcatcagcatatggaattgatgcagggtggcaatactttttcaatagtttggcatgtgcaacatctgataccggcaagtccatccttcctaagcatttgtgtcttgttgccaatagtctgtcatgtagtggagagtttgtaggattaaatgctaaaggcatggcactacaaagaaaacatgcgtccgtttcatcaccatttgtgcaagcatgctttgcgaatccaggtagttgctttataaaagctgctaagtctggagccacggataatctccagggcagcctggatgggttggcttggggaaactgtctatctatggggacaagtggaatgtttgatgtcatatattcagagaagggacatcaggtagctaagtctgtagatgtgtatgagctgctagaagccagttttgacaagccgaacaataaaattggtactcatttgcacaaatattcatctgacaaatgcggttctgagtttaggcataaaaatggttatgccttgaaagagggaaaacagtggaaaaccattttaagaaattttgtgacagtaaatgatattcagaagctgacttttgcatcgaggtgcatattgaacaagtattcaattgatgagctgctaagtgagagtgacaggtcaacaatgctaagggttttgaattttcatcctcataaaagtgagaagtttggcattggaccacaggacattaaggttggatggcatccaaaatacaaggatagccggtgcttccatataataagaactgatgggacggttgaagatttttcataccgcaaatgcattcttggtgctcttgatatcgttgatccaaaaaaatcaaagatccaggagaaaaaatggtcaggacatggtgacacgtaa

SEQ ID NO: 33445 - DNA, 1830 bp, Glycine max
  Peptide Sequence Number=SeqID_150223
atgtatccaccttgcgcagggggagcatcacagccctgctacaatggttgttttccttcttcttttcttgcctccaactctgacaactctcataacactcccaattctagccatgactttgaggcagccacatctaccactcttcatccacacacccaattcaccaaccatgaggctctcccttctttggaagagtcctatattaacttcaccagagcatacccttcatttggcaacactagtcaagttgatcgaattcgtgaccaagaatatcaccacttgaatccctccaatgtttgttttgactacactggatatggccttttctcccacgctcagcagcaaaagcaaacggcttcagttgcttcttcatcttcttgccctcctccatccttgcctgaaccacccttctttgttatctcctacaagcctgtaactttgcattctcagatactctacggcggccaggaatcggaattagaatccaaaatcagagaaagaatcatggcgtttatgagcatctcagaagctgattacacccttgttttcattgccaatgaggtttctgccttcaaacttgtagcagactctttccaatttcatcctgatggagagcttcttacagtgtatgatcacaagagcgaggcagtggatgagattattgagacctgcaaggagcaaggagttcatgtctcgtcagctaagttcttctggccaagtctcagaatcatgagcagaaaactgaagaaaaagataatgagtagaagagggaagagaaaaagaggtttatttgttttcccacctcattcaaatgttactggaacaccctattcgtatatttggatgtccttggcacaggaaaatgggtggcatgtcttgcttgatgcacgtgcattgggatctaaggagatggacacattgggcctcgctatgtttaagcctgattttatggtatgttccttttacaaagtctttggtgaaaacccatcaggttttgggtgcttatttatcaagaaatccactatctctgctctaaaagaatcagacaatgctacaagcatgggaattgtaggcctgtttccagcatctagacaagaaactgaaccaaaggaacaagagtttgtcatggataatgaagaaactgaaacaaaatcagtgtcagcacatgggactgaagaagtgttttcaacagaaattgtggagttaagcttaagcgcatccctcgagtcaggtaaatgtagagaaagatttggcacggtgagtggaggcttagaggttgagtgtagaggattggaccatgctgactcggtggggctaatagcaattagtattaggggtaagtatcttatcaattggctggttaatgcattaattagtcttcaacatccacatgctccaactgggctttctctaattaggatatatggacctaagatagattcacaccgtggacctgctgtggcatttaatgtgtttgattggaaaggagaaaaggtagatcctgcaattgtacaaaaactagcagataggaacaatgtatctttaagtagtgcttttttgcaaaacatatggttctcggacaagagtgatgaagagggacaaaggactttggaaagcaaagtgcatagggtgaaagtgttgggccaacctaataagacacagagcagtggttttgggataactgtggtgacagcttcacttggttttttgacaaactttgaagatctatacaggctatgggcttttctttccaggttcctagatgcagactttgtggagaaagagaaatggagatacttggctctaaatcacaaaaccatttatatatga

SEQ ID NO: 33446 - DNA, 414 bp, Glycine max
  Peptide Sequence Number=SeqID_150224
atgttgtcaggttatgaattttggattgcggagatttggagacctaaagaaggcgtggtgcttcttatcctgggaaggctaagcgttgacggtaccccaaaaattgtgactatgcatgacgttcctttttggatcccgatacataatctacctattggattcatgatagagacagtagggaaacatcttggcaattttgtgggtgagtttatggagtacgacccaaataataacttaggagtttggagggcttatatgaggattcaagtcagagttgatagaaggcttcctttgaagaaggtcaagaaaccgggtggagaatggaggttggtgcagttcaagtatgagaggttgggaacttttttcttcctttacgggccgttagtgcactctgataaattttgccccaattaa

SEQ ID NO: 33447 - DNA, 738 bp, Glycine max
  Peptide Sequence Number=SeqID_150225
atggagtggtttgtgggtcgagacggaggtagtgttatcggtgtctggaatagtgaggcgaattgggtggtcaaggctagtatttctgggagggttgtgtcagatggagacccagatgcttcactaagcgtttttgcacaaattatgagtgctgcctccatcgatcaaaatcacgacattctgtttggatacctggcccagaagaatcgagaggcacacttatggcctctagtgaacttctcgtcgcagttgaaacaaaggcctctttctctcccactagtcatctcctccagtgtgagacttttcaagggtaagggtggtggtttgctgggtgaaggcaagaagggtagtcgtgctaaccccaccacctggaccaaggtgaaggtccaacctagatacgaagcaactgaggaggaatggtggcagaaacactacaatgcgattggcaagcgcctcaaattttttcaggatgttcgaccaggaagtgagttgatggtttctcatcatccactgaaaccatgtcaaggctggtccctccatatagaaagacgcaatagtaagggaattggtgtgggaatgtctgatgaagatgagggtgaaggaaatggttggaagttgttttcgagattggtaaccctgttgattctgtcatggttgtctctcaatgaaagcaccaatgttatgatcagggagctttctactcaaggaaatgaacaattcctagcgttcgaggcctag

SEQ ID NO: 33448 - DNA, 681 bp, Glycine max
  Peptide Sequence Number=SeqID_150226
atgaacattgaagcggtggatgattggttgagtcacagagacacaatccttgctagtttgacgaagaaattgaccaaagcccaacaaagaatgaaacatgatgcagatcagaggaggcgtgatatgcagtttgaggaaggagattgggtgctggtaaagttaagaccacgccaacaaacctcagttacagagggtcattactccaagttagctaaaaggttctatggcccattccaagttacgaagaagattggaacaattgcctaccaattcaaccttctggcgacttcgcgcattcacccagtattccactattctttactcaaaccatacctcacacctactaatcaggttgatgctcctctagaattgccaaactttgccgaggataatcaacccattatcacaccacttaccatccttgatgctaaatgggagaacatagacataggaagaaaattactcgtgctggtacaatggcagggcctgttccctgaagatacttcgtgggagaagtgggaagaccttaaacttgaatgcaaccttgaggacaaggttgctttggaagcccatggggatgttatgactaagaacaaggagcaacagaacacagagaaagaagaaaaccgaaggccaaggagggaaattaacaagcctcgttacctcagagatttcgcgtag

SEQ ID NO: 33449 - DNA, 1143 bp, Glycine max
  Peptide Sequence Number=SeqID_150227
atgctcctaaatggaattatcaaatccaactccagtcctttctcgttgccggttttgttggtcaagaagagggatggatcatggcatttctgtgtggattatcgtgcattaaacgccatgaccgttaaggatcaattcccaatccctaccattgatgagctgctagatgaattaggaggtgcctgctggttttcgaaatgggaccttttgcaaggctaccaccaaatcctaatgaaagagactgatataagcaaaacaacatttcaaactcaccatggccattatgagttcttggtcatgcccttcgggctctgcaatgctccctcaacctttcaagcaaccatgaacactacatttgccccttacttgcgcaaatttatcatcgtcttcttcgatgacatcttaatctacaataagacattcgtggggcatttagaacatttgaaaaccacatttcaagtgttgagggtaggacaattcttcctcaagcttttgaaatgctcatttgctactcaacaagtggagtacctcgagcatattgtctccaaacaaggagtggaaccaattcctgcaaaaattgaagctatccaacaatggccgacaccctctgcaccactcacaacacttctggcaaaggatcatttccactggaactctgaggctcaacacttgttcacgaatttaaaagatgctctgtgtcgcgcaccagttctgggtctattggatttctctttacccttcgtggtggagaccgaagcttttggggtcagcatgggtgcgattttgtctcagcaaaatcatcccattgcgttcttcagaattgaagacagaattgttgaatcatcaggaattccagggcttcctaccattcaaatcaccctcgtcgaatttcactccacaccaacaggaggtcatatgggagttgcaaagaccttggctcatgttagcgagaatttcatctgggcaacaatgagtaaagatgtttatcgctttgtcactacatgcgttgactgtcaacagacaaaggttgaccattggaaacgcccagggctactttgtcccctacctattccagcacaaccatgggaggacctgtcactcgacttcattgtcggactgccaacctttaagggacatatatga

SEQ ID NO: 33450 - DNA, 246 bp, Glycine max
  Peptide Sequence Number=SeqID_150228
atgcctgtgattattgtgggatcaagtcagaattcaaaaactttcatcaataagggagatcacaagattaatgatgggattggtggggcatcaagcaacacgaaagaagggattatgagtgataatcaacatggaaatgaggaagcaattaaccacaattttaataaggcaactaatgattgtggacaaaggaaaaaaattgtggaccttgctcccagacatgctaggagaaatgattatccttag

SEQ ID NO: 33451 - DNA, 2406 bp, Glycine max
  Peptide Sequence Number=SeqID_150229
atggcttctatcaaacaaggtgatcaaaccataactgactactttacaagattacgtgttatttgggatgaactagagagttataggcctaatccacaacaagatcgtgttatgcaatttcttagaggcttaaatgatcaatttagcactattagatataatgtattgatgatggatccattacctagcagagctaaggttttttcatatgctgctcaacaagaaagagagattaacaacaatgaaatgataggaagcatgagtctaatcaattcatcaagcatcgagaagaatggttttcctcagaattatgcttctagcgaaggaaaaggtagtcaaagtagctctagtagaacgaactcaagaggaaaaggaaacaaaatctacccacattgtggtttagctaaccacactgttgatgagtgttacaagaagcatggttacccacctagacataagttccataagcctcaaagttcaaacatcaacaatgtcaatgttgtgaaagaagaaggtgatagctcatctctagatagaaatcaagagacacaaaataaagatgtgaggttaactcatcaacagtacaaagctttaaacactactgtaacaacaagcactttggcgatcaacagaaagaaacttgatcccagacctgctacttttgtctttttgagtttcaagccaaatacaaaaggatttgtcacctttgatctcgaaactagagccatttctatttctagaaatgtaaatttctatgaggattgttttccattcactgatcaggataatcctaaacctgttactatccttcctaccccttcatctcattccattgtgtcataccctaatttcgtccggggacctttgcttgatgacatgcgacttttctttggtccttgtgaggctgttgcttctggaggaagcaacctggctcgcctgggcgagttgggcgacaaccacctcccctattttgctataaataggggaggaagtgaagaagaaaaggccgaggcgcttctgaaacgtttccgtaacgttttccgtgaagaatttcgcaaaggtttcaaccgttcttcgacgttcttcattcgttcttcatcgttcttcgatcttcaacggagtagattgtcttcctcttatcacagtgtcattctatccattacacaaagtgtcgaacctcaatcctacactgaatcttctaaggatcctatttggattgaggacatgaatgcagatattgaagcattagaacttaatgatacttgggttcttactgatcttcctgaacataagaatgctattggttgtaagtgggtgtataagatcaagcacaaatccaatggttcaatagaaagatataaggcaaggctaatagccaagggctacactcagttaaccacagtgagacttatgttggccttagctactatcaatcaatggtatcttaagcaattgaatgtgaacaatgctttcttacatggtgacttgaatgaaaaggtgtacatggttattcctcaaggcatgcaggtgaccaaacctaggcaagtttgcaagcttcaaaggtccttatatggcctgaaacaagctagtaggccatggaaatatgccttggacattctcaatgatgacggcatgcttggctctaagctagtatctactccttctaattataccaccaagctgcatcaacatttaagaactctcctttcaacagaagatgcttcctcttttgggagattaatggggagactaatctacttaactaacacaaggctaaatattacttatgttgtgcaacatctaagtcagtttgttgttactcccatcttagctcatcaacaagttgcttttcgaatccatagatacctcaagggaactccagatgctcatcaaagaccgagtattgggcactgggcagtgccacttctaagctacaatggctcaactatttgctggcacattgtgaagttgtttcctatcccttctacaaaccaattagcatatatctacactaaggctttaatgcctagcactttccagattctgtatttcaagcaaggaatgtctgatcttcctttgcaagcttcctcggttagctttgcattcatccatggcacgcacgagttctatgagaacatgcttaggaatctttcttctttatcccctcttcctttttatccttatacttggtccaagagtaaaggcactcctcatgtagttgaggagcgtctagacaaagccatggcaactaatgattggttgtacttatctcctaatgttgaactgaaaaatgttatggctttcatgaagttgtcaacgccaatgccaacaagatattgcgagcaagatttgtgggtgtcaagaggagttggaggattgggggagaagagtgagaagctggtttag

SEQ ID NO: 33452 - DNA, 543 bp, Glycine max
  Peptide Sequence Number=SeqID_150230
atgtctctcttctggagatggctagaaacccctccagagctcagaagaaagtcaagtactcatagaggaagcaagaagagtgctctcaacaggattgatacattgttcacgaatgagagtaaaaagaatgacttcaagatgatatacattgtgaacaatgtgagaatacccaagtatctagacttggagtggttctttcaacaagggtttaacttccctaatatgcttgaagcacagggtctatccaagcttgtgcggatgaaaggaactttttatccggagctggtgaaagtcttttatacttgtgcccgcactgatttggaaggattaatgaaattgggggagaagaactgcatatttgcttgcattgtgtcgcaacgtgcccttcgcgggcgagcgagggcgaggctcacgggtgcgctttccaaaggaggaaagatgtgcggagtcgccaccaacgtttatttgtggaaaacgtcggaaaaaccgaaggaaaccggtcaaaatgaaaattctaagttcgggagttgtatttacgcttga

SEQ ID NO: 33453 - DNA, 237 bp, Glycine max
  Peptide Sequence Number=SeqID_150231
atggaaagggagatgatcacaatgatagtagacacgttaccggtgttctactacgagaagttggtgggttacacgccttcaagctttgccgatttagtttttgtcggcgaaaggattgaagtgggtctgagaagaggaaaatttgattatcctactttgatgaatatgaagcctggggaaaatggacagagtaagaatgagggaggaacccatgttgtgactgccattcatacatga

SEQ ID NO: 33454 - DNA, 303 bp, Glycine max
  Peptide Sequence Number=SeqID_150232
atgttacgggactcaatcagacatccgagtaaaaagttatggtcgttgaattggctcagagattccacattcaatttcgagcgtctcgatatattacgggactcaatcagatatccgagtaaaaagttatggtcgttgaattggctcagagattccacattcaatttcgagcgtctcgatatattacgggactcaatcagacatccgagtataacgttattgttgtttgaattggctgagagcttcaacattcaatttcgagcgtctcgatatattacgggactcaatcagatatccgagtaa

SEQ ID NO: 33455 - DNA, 1971 bp, Glycine max
  Peptide Sequence Number=SeqID_150233
atggcagcatgcttgaatccacctaggctatctagcaccgaagatgactctgtgatactctattcaacttctaattctcctgaagagtccaacagtccttcttcttcctctttctaccattcaccaccaccatcactatatcaattcagaactgaaaacaaactttctgtgagaaatctctgctacactttgcaccctcataagaccactcccttttcattttgtcacctgactcaaaaaccaaagccagtaaacatactcaagtcagtctcttttattgccagaagttctgagattgttgctgttgttggtcctagtggcacaggaaagtccacccttctgcgaatcatcgccggaagggtaaaagatgaaggttttaatcctaaaagtgtctcaatcaatgatcagcctatgactactccagttcagttgaggaagatatgtggctttgtggcacaagaggacaatttgcttcccatgctaactgtgaaagaaactttgttgtttagtgccaagtttaggctaaaagaaatgacaccaaaggatagggaattgagagtagaaagcttgttgcaagagcttggcctttttcatgttgctgatagttttgttggagatgaagagaatagagggatatcaggtggggagaggaaaagggtgtcaattggagttgacatgattcacaatccaccaattttgcttctagatgaaccaacatcaggtctagacagcacttcagctttgcaagtcatagagcttctctcatcaattgttaaagcaaagcaaaggacagtggttctttcaatacaccaacccagctatagaatattgcagtatatttccaagttcttgatcctttctcatggttcagttgttcacaatggtagcctagaacagctagaggaaaccataagtaaattgggatttcaaattccaacacaactgaatgctttagaattctccatggaaattatacgcgggttggaagattccagttccaaatatgacacttgcagcattgaggaaatggagccaattccaaacctcatgtggccagaggaagaaaactgtgaagtccaaattgtccaatcgcaatgtaacaagggaagttttggcagtcttttctatgcaaacttgattgagatattgtttctctgctcaagattttggaaaatcatttatagaacaaagcagcttttcttggccagaacaatgcaagcaatagttggtggctttgggctaggaagtgtttacataaagataagaagggatgaaggaggagttgctgaaagattaggtctatttgcatttagtcttagttttctcctctcttctacagttgaagcacttccaatataccttcaagagaggagtgttctgatgaaagaagcctcaaggggagcctataggatttcctcttacatgatagccaacacttttgtctttcttccattcttgtttgtagtgtctatactttttgctgttcctgtgtattggcttgtaggactaaacccttccctttctgccttcaccttcttcacttttgtggtgtggctcattgtgctcatggcaagttctttggtactcttcttgagtgctgtctctcctgatttcatttcagggaactctctcatctgcacagttcttggagccttcttcctcttctctggatacttcatcccaaaggagagcattccaaagtattggattttcatgtactatgtgtctctctataggtaccctttggatgcgctcctcacaaatgagtattggaatgttagaagtgagtgtttctcacatcaaatagagggatcacagtgcttgatcactgggtttgatgtgttgaagagtagaggacttgaaagggataacaggtggatgaatgtgggaataatgttgggattctttgtgttgtatcgtgttctttgttggataatacttgcacgaaaggcctccaagacaacactataa

SEQ ID NO: 33456 - DNA, 1513 bp, Glycine max
  Peptide Sequence Number=SeqID_150234
atgccaccacgccattcccaacaaccccatcaaaaccgtcgtcgttttggtaatggaaaatcgctccttcgaccacatgctgggctggatgaagagactaaacccggccatcgatggcgtgaccgggtcggagtccaatccgctgtccgtgtccgacccagactcgaagcggttcttcttcagggaccgggcccatttcgtggacccggaccctggtcactcgttccaggccatccgggaacagattttcggatcgaacgattcctcgctcgacccgcctcccatgaatgggttcgtccagcaggcctattctatggacaatacctcccacatgtccgagaatgtgatgaacgggttcgaccctgacttggtggctgtgtacaagacactcgtttctgagtttgccgtgtttgataggtggtttgcctccgtgccggcctccacccagcccaaccgcctattcgtgcactctgccacctccggtggcgccacgagcaacgtggcggccaagctcacggcgggctacccgcaacaaaccatcttcgacagcctccacgacgccggccacgacttcggcatctactaccagaacatcccggccaccctcttctaccgcaacctcagaaaactaaagtacgtgctcaagttccacatctacgacgtgtcgttcaagcaacacgccaaagaagggaagctcccaagctacactgtggtggagcagcggtacatggacactaagctgctccccgcgaacgacgaccacccatcgcatgatgtttacgaggggcaggtgttcgtgaaggaggtgtacgagacgctgagggcgagcccgcagtggaacgaaaccctgtttttgatcacgtacgatgagcatggagggttttatgaccacgtgcccacgcccgcgcgtggggttccgagccctgatgggattgtgggccccgagccttttaacttcacgtttaataggttgggagtgagggttcccactattgctatttttccttggattgaaaagggtacagttgttcatgggccaaatgggtcaccatctcctacatcagaatatgaacactcatccattccagctacagtgaaaaagctcttcaatttgccttcatttctgaccaatagagatgcttgggcaggaaccttcgagggcattgttcagaccaggacagaacccaggactgattgcccggagaaacttccaactcctgaaaagattaggaagggagagcctaatgaagatgccaagctcagtgaatttcagcaggagttgatccaactcgcagcggtgattaaaggagataatatcctcactagtttcccaggtacaatagggaaggacatgactgttaagcaagggaaatattacatggatgatgcagttagaagtttctttgaagcaggtcgttatgcaaggaaaatgggagtgaatgaagaacatatagttcagatgaagccttctttgactacgagatcatccaaatctccaaacacaaacccttag

SEQ ID NO: 33457 - DNA, 558 bp, Glycine max
  Peptide Sequence Number=SeqID_150235
atgcaagaaccaagcttgggattgatgggtgaggtctccggcgatcaccaccgtcagctgaaggcggagataacgactcatccgctgtacgagcagcttctggcagcacacgtggcatgcctccgtgtggccaccccgatcgaccagcttccactcatcgatgctcagttatctcagtctcaccatcttctacgctcttatgtctcacacaacactcattctctctcccctcatcaccgccaagaacttgacaacttcctggcacaatatttgatagttctgtgtactttcaaagaacagcttcagcaacatgtaagagtccacgccgtcgaggctgtcatggcctgccgtgatatcgaaaatgccttacaagctctaactgtttttcttgtcgagttaattagactaaggaatggagtggtagggtctaccaatgttatcttgtggagtgtacacaaatggcaatgggaagagttagttagtttggtgaggaatggtagaccctctcgtcccactatggcactgccaacgacttacaatgccataaccgacttataa

SEQ ID NO: 33458 - DNA, 1134 bp, Glycine max
  Peptide Sequence Number=SeqID_150236
atgattgtgaggaaaaacaagccaagtgcaaggtcactacttatgctttttgttatggttcttgcttttctctttgtcacttataatttggtgtttataatcaaacaccatatgggtggaacttgggtagcagaagagttgaggtttcttgatcctgtgatcagcatgcctggaaaggtgatggcattagcaaattccaattcaaaatttcatgttgcagtgaccgcaaccgatgcggcttacagccaatggcaatgccggattatgtactattggtataagaaggttaaagatatgcctggatcagacatgggaaagttcaccagaatagtgcactcaggaaggcaagatcagttgatggatgagattcctacttttgtggttgatccacttcctgaaggcttggataggctgtctggaaggattcatagaaaagaggaaattaaatattctgacagaccatgggcttttgttcagtggctggagaaagcagacattgaggaagaatatattttgatggcagaacctgaccacatatttgtaaatcctttgccaaatttgactaatggaaaccaaccagcagggtatccatttttctatataaaaccagttaaacatgaaaaaatacttaggaaattctaccctaaggcgaatggtcctattactgctattgatcccattggcaattctcctgtaatcattcagaagtccttgctagaggaaatagctcccacatgggtgaatatttccttgcaaatgaaagatgatccggcaactgacgaaacttttggatgggtacttgaaatgtatgcgtacgctgtggcatcagctttgcacggtgtacggcatattcttcatgataacttcatgctccagccaccttgggactttgatgttgagaacaattttataatccattatacttatgcatgtgactacaatttaaagggggaactaacatatgggaagattggagaatggcgttttaacaagagattttatctatcaggtcctccacccaaaaacctttccttaccccctcctggagttcctgaaagtgtggtgcagcttgtaaagatgatcaatgaggctactgctaacatacctaaatgggattctttaaatagaagctaa

SEQ ID NO: 33459 - DNA, 3105 bp, Glycine max
  Peptide Sequence Number=SeqID_150237
atggataaaatgtctgctccttcatcaagggagcgtgcacaacgcctctatgataagaaccttgaattggagagtaagcgtcggaggtcggctaaggcgcgtgtcccatcagatcctaatgcttggcaacagatacgtgagaattatgaagcaataattcttgaggatcatgctttctctgagcagcacaatattgaatatgctctttggcagttgcattataagcggattgaggagtttagggcatacttcagtgctgctctttcttctacaaatgcaaactcatctcagggagggaaaggtcccgcgcgacctgatcggattactaaaataaggctacaatttaagactttcctttcagaagcaactggattttaccatgatcttattacgaaaatcagagctaagtatggtcttcctcttggttactttgaggattcagagaaagatggaaagaaatctgctgagatgaagaaaggtttagtagcttgtcatcgttgtctgatatacttgggtgatcttgctcgttataaaggaatgtatggtgaaggtgactcaattaaccgggagttcaccgcagcttctagttattacttgcaagctgcatcactttggccttctagtgggaacccccatcatcagcttgctttgttggcttcatattctggggatgaactggtggctatttatcgatattttcgtagtctggcagtagatagtccatttacaactgccagagaaaacttgatagttgcatttgagaagctttctggtgatgttaaagctcttgcagtcaaggaatcttctgtgcgatcaactggcaaaggaagaggaaaaggggaagcaaaacttgcaacaaggggtactggtgttgatgccagtcctagaacaggagcatccagtatacaggaaacatataaatacttctgcacgcgctttgtccgtctaaatggaatcttgtttacacgcacaagcattgagacttttgctgaagttcttgctgttgtaagcactggcctgcgtgagcttctgtcttccggtcaagatgaagagctgaattttgggacagacactcctgagaatgcacttgtcatcgtcagaattgtctgcattctagtattcacagtttataatgtgaacaaggaatctgaaggtcaaacttattcagaaattgtacagcgtgctgttctgcttcagaatgcatttacagcagcttttgaattgatgggttacctaatagagagatgtgcacagctgcgtgatccttcttctagttatcttttgccaggcattttggtttttgttgagtggttggctttttatccagatcttgctgcaggcaatgatgtggatgaaaatcaggcaaatttgagatcagaattttggaatcgttgtgtatccttcttgaataagctgctttcagttgggcctatgtctattgatgatgacgaagaggagacttgctttaataacatgagcaggtatgaggaaggggaaactgaaaaccgacatgctttgtgggaggactccgagttaaggggatttattccacttcttcctgcacaaaccatcctggatttttcaaggaagcattccattgtaagtgatggtgataaggaaagaaaagctcggatcaaaaggattttagctgctgggaaggctttagcaaatgttgttaaggttgataaacaaatgatctattttgattcaaaggtgaagaaatttgtaattggtgttgagcctcaaactgcagatgattttggtttttccacctattcaggcatgtcgaatgcaaaagagttagtgcaagaaaatcctgcacagaaatcgaagatggaaattgttcagtcaaaccaacaccagcatatggaaggagatgatgacgatgaggttattgttttcaaacctgtagtggctgagacacgagctgatgtgattgcctcatcatgggcaccccatgtgggtttggaaccttttccaaaagcatctggaggggatttaatatttcatgttaattctacttctaatcctctaagtaacctaagtcatcaaactttatctgttcctggtggtggtatggtgcctcaacacctgcaaccagttcagccacatacatcaaggtggttagaggaggaaatttctcttgctaacaatttaaaaggtcttgggttatttgagaatggacatgtgatgaaacctggtctacaagaagcggttggcttctccaaccatgtttcacttccttttcctatccaacaatctataggtgctgatactaatggcatgttttatggtttctcaaaagctttggagtctgcagtaccatccaaagttgataccattgcatcttctggagtagttactgataatttagctgtaaaaacgtcagctttgccagttggttcaagaaaagccccagtcagtcgacctactaggcaccttggacctcctcctggtttcagtcatgttcctcccaaacaaggtattgaatccaccgtttcagattcaattagtgggaacccaattatggatgattatagttggttggatggctatcatttgcattcatcaacaaaaggattaggctccaatggtcctcttaactactctcagtcaaattctcagcaagtcagtaacaacggcttgagtcctactgccagctttccctttcctggaaaacaagttcctcctgtgcctcttcaagtggagaaacagaatggttggcaagattatcaaacttatgatcttttaaaatcacatcatggtcagcagcttcagccacaacagctcacaactggaaaccagcagttttctcctctgcccgagcaatttcaaggacagtcaatgtggacaggtccttgtaggcatattgcgaatgtgctgcatccttttgctactcaatcaaactccagcttagctgcctcgtcattgaatgttgttggagtttctttggccttggcttgttgcaggcacttgctactacaaaagctggcatggcttggtattcgacgctttgaatggatgaaaggggaatgtgatgaactgatgttggaggttgggatggggactgatcatgccttggttatgatcatttattgccagtag

SEQ ID NO: 33460 - DNA, 297 bp, Glycine max
  Peptide Sequence Number=SeqID_150238
atgcctagactacaaaacaaaacaacatggggacagaacagagcaaggcagcaaatgtcatggatgactggaaacagtgagaggttcaccggaaaatggtctcagaggtcagggatgaccagaaggtcagaaactatggagaacaaaggctgcagagctggagaaggatggatgtttttcagaaaggagaacagtaggtgccgcttcataacagagagcatgcaagtaactgagaaagttagggtttcattctgtcccactccagccacgattttgtctggctatcacagccactaa

SEQ ID NO: 33461 - DNA, 303 bp, Glycine max
  Peptide Sequence Number=SeqID_150239
atggcgaggcgaaatagtggaggcaatagtggtggaatggtggtagtgtggaatggtggaggcgataatggtggtggcagcagcatcggtgtggtgggggcaataacaggaccaatggtggtgatgcaaaagcttcaatcttccgaccctgaacgtcgaagtcggatcacactcacaatcaaagaaccaaaagcaaaacctcttttaagcctccttggtcatttttcagatttgacaatggatacaaaactgttccaacaacaactattccaagcacatacaaacactcaaagcacactctga

SEQ ID NO: 33462 - DNA, 260 bp, Glycine max
  Peptide Sequence Number=SeqID_150240
atgaagttaaataaagaactcaaaggcacacactgtaatgttctgctgctgagaaacaacttaaatttgagtccagatattgctgaagtctcacaggagaaattgctttcattggttgctgaacgattaattgattcaaatagtaatgtgaataacaaagatgcaggctatgttgaaaatcaacaacagaacattgctgatgcaattgacttactccctaggcttgctactggaattgatgtaaatataaaatttaggag

SEQ ID NO: 33463 - DNA, 690 bp, Glycine max
  Peptide Sequence Number=SeqID_150241
atggagggtcatcgtttacgtgttggggccttggcttggagttcctctcttttgtcttctggtggccgggataaaagcatttatcaacgagatatacgtgcacaggaggattttgtcagtaaactgtctgggcacaagtcagaggtttgtggactgaagtggtcttatgacaaccgtgagctagcatctggaggaaatgacaacaggttgcttgtttggaatcaaaagtcaacccagcccgttctgaagttctgtgagcatacagcagctgttaaagctattgcatggtctcctcatgtaaatggacttcttgcatctggaggaggaactgtggaccgaaacattcgcttttggaatacaaccacaaactcacagttaaactgtatcgacactggtagtcaggtttgtaaccttgtttggtctaaaaatgtgaatgaactcgtaagcacacatggttactcccagaaccagataatagtttggaaatatcccaccatgtcaaagctagcaacgcttacaggccatacttacagagttctttatcttgccatatctcctgacgggcagactatcgtcactggagctggagatgaaactcttaggttctggaatgtattcccttcgcggaaatcacagaatactgagagtgaaattggagcttcatcttttggcagaactatcatcagatga

SEQ ID NO: 33464 - DNA, 264 bp, Glycine max
  Peptide Sequence Number=SeqID_150242
atgtctccgaaagacatggagcagttgagccaaaaaatcagggaccagctagaggagtggatcacagaaaaaaccagatgcaatcccagtttcaatcgtagatgtaatcacaggtactcgcactacctcctgagcctgaggatggtcgttcaactactcatgtcagcacaaaggaaaatgttgtcatctggttttgacgatactccacaaagtaaatccaaggctactgctaggtggattgttgttaaagttaatttgaggtaa

SEQ ID NO: 33465 - DNA, 660 bp, Glycine max
  Peptide Sequence Number=SeqID_150243
atgtgtcagattgatatggaaaagcttgtgggatctcttcctttgcaccttactacactgctgatgtcagctgttagagatgaagccctgttcagatacttattatgtggcattcgattattgcactccttgtgtgaattagcctcccgaaattctaagttcgagcagattgtgctagatgatgtgaaaatgatggaacagctgactgacttggttttctacatgcaaattgttcttggtggttacagacaggaatactgtgcttttagttatatgcaccttatgcattcaactcttgtagcctgcaatttacatcttttaacagcgtttatttcaacacaatggcaagatattgttcatgtattgcttgcgcaccccaaggttaacatatttatggatgcagcttttggatcagttcgcatggttgttagttttcttgagaatacactggtagcatatcatgaagatatttctgtggaatcaaatcttacagcagaacaaatggtttattatctctgtcagcagtgtgaagcttctctgcagtttcttcagtcattatgccaacaatttttttttaaggagcgcctgcttaagaataaggttcccaaaccaatcttacattcttacttcataaatttggagaggggactgtgtccctaa

SEQ ID NO: 33466 - DNA, 108 bp, Glycine max
  Peptide Sequence Number=SeqID_150244
atgggggtagcagcggtgaaggtgaagtttccggcgtcaagctttgcggtggttggtggtcagtggcgacaaacgagatggatgaagatgagtgaatgtatgaaataa

SEQ ID NO: 33467 - DNA, 132 bp, Glycine max
  Peptide Sequence Number=SeqID_150245
atgaggaagaggaaatggaggaaggaatctgcgtttcctgagtctcagaatgtcattggcttcggctcgaagaaccctttcgcttctttgatggagcagggacatgttgtaatcgattacagcatttggtaa

SEQ ID NO: 33468 - DNA, 767 bp, Glycine max
  Peptide Sequence Number=SeqID_150246
atggcaaacagaagagatccacgtgggcacacacttgatgcagttcacaagacatacaaggttgaggaagatgctgccgttgttgatagtaaaatcctacaatattgtagcatagacaaaaaagagaagaaatcagttggtgaaatggagcaagaatttctacaggcactgcaagcattctattatgaggggaaggctattatgtcaaatgaggaatttgataatcttaaggaagaactcatgtgggaagggagcaccgttgtgatgctaagttctgatgagcaaaaatttctggaagcgtctatggcttatgtgtctggaaaaccaatcttgagcgacaaagagtttgatgagttgaaactcaggctaaagatggaagggagtgaaattgtggctgaaggtccacggtgtagtcttcgtagtagaaaggtttacagtgacctgtctgttgactatttaaagatgttcttgctgaatgtcccagcaactgtggttgcactaggattgttcttcttccttgatgatgtgactggatttgagatctcatatctgataaagattccagagccttttagtttcatcttaacttggtttgccgctattccctttattttgtggctggctcaatcgatcactagggcaattgtacaagattttctgattttaaagggcccttgtcccaactgtggtactgaaaatacctctttctttgggactatactgtcggtttcaagtggcgattccaccaacaaagtcaaatgtgaaaa

SEQ ID NO: 33469 - DNA, 2020 bp, Glycine max
  Peptide Sequence Number=SeqID_150247
atggatgattcattagacatcactccttcagaaggtgagtcaaatcctcagtcaacaaaaaaaaggggtagaggtcccacacggttaaagaagttaagactcaaacgtgttagagatcagaagatatcaattgagtttgatcaatcgactggcaatgctaaagggccaaacaggactgaattcaacaattatgtgtctttccttgctcgaagcaagctcaattatgacattccgaattcagagttcctaaagaagaaattaatttcatatgctggtacacgttggaggggatttaagacacaactctctagcctttacatatatgggaagtaccaagacaaatctccttgtgataagtatgcattcctcgaggaggagacgtggcagaggtttgttcagagtcgattggaccctgcctttcaggagaaaagaaaaaaggcacaagaggctcaggcaaataatctctaccctcacacattgtcttgtgggggctatcagaagcttgaggagaacatgatgcaagaaaaggtgaaacaaattcaagaagcatcccaattagatccttcattagctgttgttgaacctccatctcctctcaaacgccatgaaaaatggaagagagcccgacaaaagaaatctggagattatattaacgaagacgcacgtattattgctgaaaagattgattccctcgttgaacaaagcacgcaaggatcttttgttccacttggacgtgaagatattttgactactgccattggacaaccagagcatcctggtcgtgttcgtggtgctggtcgaggtgtgggcattaggcaatacttcggaccaccttcccgcaatcctcttagcatggaagatttggaggtcattacacaacggatacaagagcaggttaccaagaagctcagtgagcagctagagcacaagctcaaagcagatctttcacaacagttccaagaacaagtgaggcaagagttggcatctctaggtcttcttcaacaaaatacaaatattgagccaacacctagttctcctataaatgtgagcacaaagggaaattatgctactcctgatccatcggtggaggacaatcacactaatatccgtgatcagtgtgagttgtatgttgatgttgatccccctcatttagtggcaattggcaaagtgtacaatttggggtcaaccatacaccacaagacaatagaggatgacaatgtgagggtggtggttgaagaggttcgagatgcagaggctcgagttcctcttcccactaatgaggttcaaacagtggggcaagcccccaatcaattcattcagtggccgagaagacttgtgaagtctatttcagttaagactattgtcgaatctagcaaagatgttcgacacaaaaggttggaacctcaacttggtccgcttgaacgcttgttgataatagttagcaaaattaggaaggatcatgtacagctaccttgggatcctgatgtactaagcaagccctctaccatgtcatttcatatctatcggagggatatttttgaattatgtatgggtagcgagatgctaaacatctcagttatacaattgtggctgatgtatctgcatagcttatgtactgataaggggaatgcacatatctatggatttatggacccgcaatccattcaaagtgttgggaataatgcaacagaagttcagggctacttgcaaagtaggctacatgaaaggaaaaaacaatgttacctagcaccttatttgcattcagctatggacgagtatcaaaggttggtgggttcgcaatcaagatctagaaggaagaagcctacgtggattttgccccgttgtcaaacacaatccaagggttatgagtgtgggtattatgtcatgaagcaaatgttcactgttgtcactgtagatattgttgattcgtggaagcagctcttcaacaattcgggtccattccctgaggaggatattgcagacattcaacaacgttgggcagcatttttacttcaaatta

SEQ ID NO: 33470 - DNA, 327 bp, Glycine max
  Peptide Sequence Number=SeqID_150248
atggtattaaaaactgtaaatgacaataaactttcctcacctatcgtgagctctccatcaattcctctttgcgtcgctcagagatctctctcgtttacgctcgttagtccaaacgcaaggtttgggagaattatctccaccgaatccttgaggaggattttgaggattctgctccgattacaaccttcttcttggtgtggaggtttggcggtaaacaacggcggctcatggtggccactgatggtcgtgggtggtggagaaggatgtgttagggtttgggtggcatttggagaggaggagaggggaaaaatcgtgttttcacgctaa

SEQ ID NO: 33471 - DNA, 255 bp, Glycine max
  Peptide Sequence Number=SeqID_150249
atggcaaaaaatatcagtcaaaatactgtcgctaccatcgagcaactggacatgacacgaacgagtgtaaggtttgatagagaactaaccaaggaggaagattttggcttgggtatggcttctacaagtggagatgctcctccaccatcttcaaacacagcaaggctcatggcgaagatgtttaaacttggtgatcaaatcagaagaatgagttatgaaaatgaagaaaggatggagagaatgaggagagtttga

SEQ ID NO: 33472 - DNA, 1509 bp, Glycine max
  Peptide Sequence Number=SeqID_150250
atgagagtgatagtgcctctgcaaggcctggtccaaggcacagggggtcttttctggggttctgtcattccttgtgctctcttgtactttcttcagctctacttgagaaccaagccatgccaccaccctcagcctccaccttcccacaaggaccaggaccaggattccaccagcttccaccgctccctctcttccaaccacaggcactccacttcctccgcctctgcttacgtgtcccctcgtgccaattccctcactgctgctaactctccttattatctaggcttgcacaaggttgccgttgatccctatcaccaaactcataatcctcacggcgttattcagcttgctttgcaccaaaacaccctatctcttgacttgattcaagattggattcacctcaacggcagcgctgctgtgttggggacaccactcggcatttctaggattgttccttaccaacctctccatggattgatggacctcaaagtggctgtggctggtttcatgtatcaagttttggaaaaccttattttcttcaacacctcccgaatggtactaactgcaggtgccacttctgccattgagattctaagcttctgtctagcagataatggaaacgcattccttgttcccacgcctcttagccctggctttgacggggttgtaaaatggcgcactggcgtggagatagtacctgttccctgccgcagcactgatgacttcaatttaagtataacttcacttgagagaaccttcaagcaagcaaagatgcgtggtcaaaaagttcgtggaattataataaacaatccctcaaatcctgctggcaaattgtttgatagggaaacactgttggatcttttggactttgctagagagaagaacattcacataatctctaatgaaatgtttgctggctcttcttatggaaacgaagagtttgtgagcatggcagaaatcatggaggcagaagatcatgaccgggacagagttcatatagtgtttggtttgtcgaatgagctctctgttccaggtttgaaggtgggtgttatctactcttataatgacaatgtcgtggctgcttctagcaaattggcaaggttctccactgtttctgccccaacccaaagattgctcatctccatgctttcagatacaagttttgtgcaaaaatttattgaggttaacaggttgaggctgcggaaaatgtataatacatttgttgcggggctgaagcagttggggattgagtgcactaggagcagtggtggtttttgctgctgggctgacatgagcaggttgattggctcttacagtgaaaagggagagcttgagctctgggatagattgttgaatgttgctaagatcaatgttaccccgggttcctcttgtcactgtattgaacctggatggtttcgtttttgctttgctacatccactgaaaaggatgtttctgtagtaatggaacggattcggagaactgttgatgccacaaatggacatggttga

SEQ ID NO: 33473 - DNA, 1518 bp, Glycine max
  Peptide Sequence Number=SeqID_150251
atggcaggtgaggaagaagagatgatgatgatggaagagtcagaaatggaaatagagtcacaggtgttcgttgctcacgagattgacttggattacgagttcgacgcagttcgattcttcgatttcggtgcacaagaaactcccgctcaagctcgccaagccgaactctggtttcattccgccggcagctatcctccttctccttttgtggcgaagttagtggcgagagaggacgacgttagggaatgcgcaaccaccgttcacgctgccaattctaatgttccgtccgggattggattttctcgcaccgtttttcaccatgacgggtcatggctcgtggcttactttactgatgctttcgtcttggcaggttcaaaaggagggggtgggagtgggaacatttctgccttgctgagtggtgttccgcgggatgttaatatgcaactgttacacgtaacctcaggaatgacctttagcagtaagacaattggcggcaatttgaattctaaggtttctaatccttggatgccaagaaaactgtttttccttgtatatctacaactcaactattccattgtcctcaggtttcagaaactacaagatcataacaaaaaaatgaattcatctacctcttccgggatagagtgtcaagctgccaaacggcagaaattagaaggcggtagcttgcacaaggttggtgatgtgaagcagcaagttaattttgtccacaaggcacctaagaaggttgcaactgttgatcaaaattctggacattccaagctgaagattactatccctagagagcctgacctagaaacggctcacagagcacaaaggattagacctaaaattgctgcagaggcagaagttgtgacagtggctgcccccatattcagagcacgcccgttaaacagaaaaattctaaatgctccttcgttgccacttcccaagaggagcactccacgattgccagaatttcaagaatttcatctcaagacacaagagagggccatgcagcatacatctgcgacttctacgtcttcacttcattgcaatgattctgataagatatatatgattagtgatctccggggaactgaagtttgctggttgcaggatttggacaaacatagagctgtttctgctcaagaaaatagaatcagggatttgagaaggccatctgccatgggtgctccaaagcatgatggattggattttgcacatagttttaaagctcgtcctcttaataagaagattctttcaagtaaaggagatattggtgttttccggaacagaaagcaggaaaccacagtgccaatggaatttaatttccatacggaaaagagggttcagcataacccaccaatcgaactctttagcaagatgtccctaacatccgaagtccagtcaaataatggatctcagttgaaactgcttcggcattccagagtgttcagagaggagcttgggaattcgatgatcgcaatacagacaagggccaatgtgcaacatagctga

SEQ ID NO: 33474 - DNA, 2244 bp, Glycine max
  Peptide Sequence Number=SeqID_150252
atggagaaaagcaagtacgtgatggagcttgctttgcttctgggtcttattttcatgcttagtgccaacccaacttcaatggccgaagagcatggcaataacaacttgaaaacttatattgttcacgtcaaaaagcccgaaactataccttttcttcaatcagaagagttacataactggtaccgctcgttcctaccagaaaccactcacaagaaccgaatgattttctcttaccgcaacgtggcatctggatttgccgtgaagctaaccccagaagaagccgaagctcttgaagagaaagatgagattgtgtcagctcgtcctgaaaggaccctttcattgcacacaacacacactccatctttcttggggctgcaacaaggtgttggattgtggaatagctccaaccttggcgaaggtgtcataattggagtgatagacacaggtatataccctttccacccatcttttaacgatgaaggaatgccacctccaccagcaaaatggaacggacactgcgagttcacggggcaaaggacatgcaacaacaaactcatcggtgcaaggaacttgctcaaaagcgctattgaagaacctccttttgaaaacttcttccacggaacccacactgctgcagaagccgctggaagatttgtagagaacgctagcgttttcggcatggctcggggcactgcatctggcatcgcacctaatgctcacgtggcaatgtacaaagtgtgcaatgataaagttgggtgcactgaaagtgccatcttagccgcaatggacatagccattgatgatggtgtcgatgttctttctctttccctcggtttaggctctcttccattcttcgaagaccctattgctattggcgcatttgcggctattcagagtggggttttcgttagttgctcagctgcaaactctggccctaactacagcactctatccaacgaagcaccgtggattctgaccgttggtgcaagcaccattgacagaaaaatagcagcatcagcagtgcttggaaacggtgcagaatatgaaggggaatctttgttccaaccccaagactattcccctagtttgttgccacttgtgtatcctggtgcaaacggaaacaacaactccgagttctgtctcccaggatccttaaacaacattgatgtcaagggaaaggtggtggtgtgcgacataggtggaggctttccaagcgttgaaaaaggacaagaagttctgaaagcaggtggtgccgccatgatcctcgccaacccagagtcctttggcttcagtactttcgctgttgcttatgttttgcccacagtggaagtgagttacgttgctgggttggccataaagtcttacataaactcaacttactcaccaactgcaacaatctccttcaaaggaaccgtgattggtgatgcacttgctcccacggttgtttctttttcttcaaggggtccaagccaggcaagtcccgggattctaaaacccgacatcattggacccggagtgaacattctagctgcatgggctgtgtccgtagacaacaaaatcccggcgtataacattgtttcaggaacatcaatgtcgtgccctcaccttagtggtgttgctgctttgctcaaaagtgcacaccctgattggtcccctgcggctataaagtcagcgattatgaccactgctaacacggtcaacctcggaggcacacccatagttgaccaaaggaatttacctgctgacatttttgccactggtgcaggccatgttaaccctaataaagcaaatgatccagggcttgtttatgatattcagccagaggattacgttccttatttgtgtggtttgggttatgacgatagagagattgcaattcttgtgcaaagtagagtgagatgctctagcgtgaaagccataccagaagcacagctcaattacccttcgttttctattctgatggggtctagttcacagtactacagcagaacgttgaccaatgttggacctgcacaatcaacttacactgtggaacttgacgtgcctttggccttggggatgagcgtgaaccctagtcaaataaccttcacggaggcgaaccaaaaggttacattctctgtggagtttattccacagagaaaagaaaatagaggcaaccatacttttgctcagggttctctcacctgggttagggtatctgacaaacacgctgttaggatccccatctctgttattttcaagtga

SEQ ID NO: 33475 - DNA, 2076 bp, Glycine max
  Peptide Sequence Number=SeqID_150253
atgacaataaccaaacaagtgttatccaccaaattggaacctgcattgcctcttgctcttgctcttatttacttattgacttacattgttcgggttaagaagcttcaggatggtaattctcttcaggctaaggacttgcacggttggtaccattcacttttgccagatagtacaaaaactgatcagaaccagcaacgcattactttctcataccgcaacgtggtggatggatttgccgtgaaattgaccccggaagaagccaaagctcttcaagagaaggaggaggttgtatcagcccgtcccgaaaggacattttctttgcacacaactcacactccaagcttcttggggttgcaacagggactaggactatggaccaattccaattttggcaaaggcatcataattggaattctggacaccggcataacccctgaccacctttcgttcaatgatgaaggaatgccactcccaccggcaaaatggaatggccgctgtgaattcactggggagaagacttgcaacaacaagctcattggtgcaagaaattttgtcaaaaacccaaactcaacccttccactggatgatgtaggtcatgggacccacacagccagcacagctgcaggaagacttgtgcagggtgctagtgtctttggcaatgctaagggttcagcagttggtatggcaccagatgcacactttgtaatttacaagtgcaatactagctggaatgggcactgcaatacctcacttggaggaccatctgttcctttctttgacgatccaattgcacttggtgcattcagtgcaattcagaagggaattttcgctccatggattatcaccgttggtgctagcaccatcagaagaatagtagcaataccaaaacttggcaacggggaaacatttaacggggaatcgattttccaacccaacaacttcacgtccacgttactaccacttgtgtatgcaggtgcaaatggaaatgattcatctaccatttgtgccccgggttccttaaaaaatgtggatgtgaagggaaaggtagtgttgtgtgacataggtggattcgttagaagagtagacaaaggacaagaagttaagaacgctggtggtgcagccatgatcctcatgaactcacatattgaagacttcaatccctttgctgacgttcacgttcttcctgctacacacgtgagttacaaagctgggttagccatcaaaaattacataaactcaacctcaacgccaacggctacaatcttgttcgaaggaaccgtcattggaaacccacatgcacccgcagttacttccttttcctcaagaggtccaagttttgcaaacccgggaattctgaagccagacatcattggaccagggcagaacattctagctgcatggccagtgtctttggacaagaatcttcctccattcaacatcatttctggcacctcaatgtcttgtcttcatctcagtggcattgctgctttgctgaaaaactctcatccagattggtctcctgctgcaataaaatcatcaatcatgactagtgctaacacagtgaatcttggagggaaacctatattggaccaaaggcttctaccagctgatgtgtttgccactggtgctggacatgttaaccctttgaaggccaatgatccaggacttgtttatgatcttcaacctactgattacattccttatttgtgtggtttgaactacactgacaaaaaaagtcggactcatcttgaaccaaaaagtgaagtgctccgagatttctttctcctaatattctcctttcatcataagtttcaatatagaacgctcaccaatgttggacccgccaacataaactactctgtggaagttgatgtgcctctggcagtaggcataagcataaaccctgctgagatagaattcacggaggtgaagcagaaggtttcatactcggttggattttatcctgaaggcaaaaacaatagaaggaaacacccgcttgctccgggatctatcaagtgggtatctagcaacggcaagtactctgttagcatccctatagctgtcgtcttcctgtga

SEQ ID NO: 33476 - DNA, 195 bp, Glycine max
  Peptide Sequence Number=SeqID_150254
atgagttttgaatattctactccgattaaattgttcttctctgtgtggtggtccaacgataagcaaaggcggctcgtggtggtcaccagtggtcagtggtggtggaggaggaggttgggggtgttgggcgagggtttaggggaagagatgcagcttgcaagactcgcccaagtgaaatttggcttgcctgggtga

SEQ ID NO: 33477 - DNA, 1200 bp, Glycine max
  Peptide Sequence Number=SeqID_150255
atgatttcaagtggtctgaaactgaagcacttccgcaatgttgattcgctcttccattttcccaaatccaaacccccaattttactcccatgctgcccaaccatctcttctccatgctccattcgtttcaattcgcatttcccataccggagcaccaaagttcccctaaaatgtgcaccactcccctcttcagattctctgccacctgatctttccgatgccccgacccagacggagcaaaattccatgtcaattctggagattctgaagcaatcaaattcatacctgcctcatgtactcattgctagtatactgctagctctaatctacccaccttctttaacgtggttcaccagcagatactatgcacctgcactaggttttttgatgtttgctgttggggttaattcaaatgaaaatgacttcctcgaggcatttaagaggccagcagaaattgtcactggttattttggccagtttgctgtgaagcctcttcttggatatctgttttgcatgattgcagtaactgttttaagcctaccaacaacagtaggcgcaggaattgtattggtggcttgtgttagtggtgcccagctttcaagttatgctactttcctgacggatccacaaatggcacctttaagcatagttatgacatcactgtccactgcttctgcagtgtttgtcacaccactcttactactgttgctcatagggaagaaattgcctatagatgtaagaggaatggtgtacagcattacacagattgtggtagtacctatcgcagctggcctgcttctaaatcgattctatcctcgtatttgcaatgttattcgaccatttttgcctccactatcagtactggtggcatctatctgtgctggagcaccactcgcctttaatgttgagactatgaaatcccctctgggagttgctatcttgttgcttgttgttgcttttcatttgtcatcttttatagctggttatatcctcagtggatttgtcttccgtgattctcttgatgtgaaggcactgcaacgaacaatttcctttgagacaggaatgcaaagtagcctgcttgccttggctcttgctaataagttctttgaagatccaaaagtggctattcctccagcaatttcttgtggggattgcattttgagtgtgatccagagaggaggatttgctcttggggcttag

SEQ ID NO: 33478 - DNA, 978 bp, Glycine max
  Peptide Sequence Number=SeqID_150256
gacaagcaatgctcaagtatggggaggtctttaaatgcattggggaatggaattggggcacatgcgccatagggattcaagcagccttggaatctaaagctaaaatccttaaagtatatggagactttgtattagtcatccaccaattgaatggagaaggagaaagtcgagattcaaaattaatcccttatcatgcttatattaaagaactggcaaaaaagtttggcaagataacctttcatcgtattcctcacgaggataatcagttagttgatgcattagccatgttgtcctcaatgttcaagataattcctgataggcatatgtcacttatcaggatgcaaagtcaggatcatcttgcttattgccaagtaattggagaagaacttgatgggaagccatggtatcatgacatcaagtgttatatcaagaataaagaatatccttcagatgtgctttataagaaaaataatgacacggtactccttaagtgtgttgactcaactgaggcaaagaagattcttaaagaaattcatgaagagtcctatggaacccatgcaaatgggcatgcaatggctcaaaagatattaagagctggatattattggctaacaatggataatgattgttgtgaacatgtgaggaaatgccataagtgtcaaacttatgccaacaatattcatgcaccacttatatccttgatagctccatggccattttcaatgtggggaatagatgtcattggacccattgaactaagggcctcaaatgggcatcgcttcatccttgttactatttcaccaagggcaactccattctctcttgtaaatggaatggaagcagtactcccaatcaaagtggagattccttcattaagagtgttgatggagagaaagctagaaaaggttgaatgggttcaaactcgatatgaccaattaaacctaatcaaggaaaagagattgatcaccttgtgtcatg

SEQ ID NO: 33479 - DNA, 705 bp, Glycine max
  Peptide Sequence Number=SeqID_150257
atgacgtatttcgaggaggacgccattaacgatgacggtgatcgcgtgagggacgtcgagcgcaatcacgacggcggaggagaatacgtcaaattggtttgggatccacaaccggaggccgtgcccactcaccggggaggatcatcgcgcctctggtattgggttaaattggtgctctgtttcttatgtctgggcctcttggctctcgttgcttttgaatgggttgccccactcttcatagaaaaggtgattattcctataataaaatgggagacgaacacgttcagttctccggtgttagctgttctgttgtttgcttctatagcgctattccctaccctaattttgccgtcctcgccttctatgtgggtggctgggttgaaatttggttatggctttggattcttgctaatcatttctgccgcagcagtgggagtatcacttcctttcttgatcggttcaatcttccatagtaaaattgaagggtggttagaaaagtatccaaagagagcttctgttctaagatctgctggtgggggaaattggtttcatcaatttcgggcagttgctttaatcagggtttctccattcccatacataatcttcaactattgtgctgtcgcaacaaatgttaagtattggccttacttgctcggatccttggtaggaatggtgccagaaatatttgtttcaatttacacgtag

SEQ ID NO: 33480 - DNA, 2742 bp, Glycine max
  Peptide Sequence Number=SeqID_150258
atggcgttggtgatagcgacgggggtggtagtggcttggttggtagggaagaataaatgccgggcagagaactcagaaggaaaaggtagagagagattaaacgggggtgatcacattgtttcgagcatgagaagacaccgtgaaatccatctctctcatgctctgttgtccaccgttttctgtttgtttgtgacagcttctgcagcaactgagaaggaaattttgcttgaattcaagggtaacatcacggacgatccacgcgccagcttgagttcgtgggtttcaagtggaaacccgtgcaatgattacaacggtgtttcttgtaactccgaagggtttgtggagagaattgtgctttggaacactagcttggggggggtgttgtcctcgtcactttcggggttgaagaggttgaggatattggcgttgttcgggaaccgtttttcgggtggtattccagaagggtatggtgaacttcactcgttgtggaagatcaatttgagttccaatgctttgtctggttcgatccctgagttcattggtgattttcctagcattcggtttctagatttgtccaagaatggcttcactggggagataccttcggctttgtttaggtactgctacaaaaccaagttcgtttctctttctcataacaaccttgctggttcaattcctgcctccttggtgaattgttccaaccttgaagggtttgatttttccttcaacaaccttagcggggttgtccctccgcggctttgtggcattccaaggttgtcatatgtgtctctgagaaacaatgccttgtcagggagcgtgcaggaactcatttccacatgccaaagtttggtacatttggattttggtagtaataggttcactgattttgctccattccgcgtccttgaaatgcaaaatcttacctatctcaatctatcgtataacgggtttggaggacacattcctgagatcagtgcctgtagtggcagattggaaatctttgatgcttcagggaattctttggatggggagattcctcccagcataactaaatgcaagagcctaaagctcttggcattggagttgaataggttggaggggaatatcccagtggatattcaggaattgcgtggactaatagttatcaaattgggtaataatttcattggtggaatgattcccagtggctttggcaacgttgagcttcttgagttgctggatttgcacaatctaaacctcgttggccaaattcctgatgacataagcaattgcaagtttcttcttgggttggatgtttcgggtaataaattggaaggtgaaattcctcagaccctttacaacttgacaaacctggaatcccttaacctacaccataaccagcttaatggaagcattcccccaagcctaggaaacctatcaaggatccagtatctagatctgtcacataattcactttctggcccaatccctccttcccttggaaatttaaataacttgacacattttgatctctcattcaataatctctctggccgcattcctgatgttgcaaccatacagcattttggtgcatctgcattttccaataatccttttctctgtggtcctcctttggataccccttgcaacagagctagatcgtcttcagctcctgggaaggctaaagttctaagcacctcagcaattgttgcaattgttgctgcagctgtaattctcactggggtttgtttggtgaccatcatgaatatgagggcgcgtggtagaagaagaaaagatgatgatcagattatgattgttgagagcacacctcttggatcaacagaatcaaatgttataattggaaagctggttctcttcagcaaaagtttaccatcaaaatatgaagattgggaggcaggtaccaaagcattgcttgacaaagagtctttgataggtggtggatcaattggtacagtctaccgaactgattttgaaggtggcgtctcaattgcagtgaagaagcttgagactttgggaaggatcagaaaccaggaggaatttgagcatgaacttgggcgacttggcaaccttcaacaccctcatttagttgcttttcaaggttactattggtcctcttcaatgcagttgattctatcagagtttatcccaaatggaaatctgtatgacaatctacatgggtttggctttcctggaaccagcactagtacaggcaacagagaattatattggtctagaaggttccaaattgcagtgggaactgcaagagcccttgcttatctccaccatgactgtagacctccaattcttcatctcaacattaaatcctctaacattctcctagatgacaagtatgaagctaagttgtctgattatggattaggaaagttacttcccattttggataattatggtctgaccaaattccacaattctgtgggatatgttgcaccagagttggctcaaggcctgaggcagagtgagaagtgtgatgtttacagttttggagtcattcttttggagctggttacagggaggaagcctgtggaaagtccaaccacaaatgaggtagtggttctgtgtgaatatgtaagaggtttgttggagactggctcagcttcagattgctttgatagaaatatacttggctttgctgagaacgaattgattcaggttatgagattggggctaatttgtacttcggaggatcctttaaggagaccaagcatggctgaggttgtccag

SEQ ID NO: 33481 - DNA, 468 bp, Glycine max
  Peptide Sequence Number=SeqID_150259
atggcagcggcaacgttgtacttggcaaaaccatcttggtcttatactcccaaaattccgtcgttgccaagagtgagggacagtggaattggaacggttaaaaccaaagtgaaagcgaaagcgggtatcctgggactgggtctgttccacttcctcaacttcgtcgaacccggttcatgtctccaactgcaattccacgaaccccccaatgccctctctttgcccacatgggccattcacgtgtccagtgtcgctgaatggattatagctatggctttggtgtggcaatacggagaaaaatctggatacccagcttggaagggcctttcttggggaatggtacctctacttggtggagctttttgtgcgtgtacatggcatttcttttataactccgactccctcgaggcaagactcttaaccatgcctttgcatcctagctatgtttggattcatagaaaagactga

SEQ ID NO: 33482 - DNA, 156 bp, Glycine max
  Peptide Sequence Number=SeqID_150260
tctgcctctggtcatgggaccttcaagtgcttcatggtccttgcccttggttatgtcctcatcagatgtctattaggaaatgttcgatcggcgtcatccggtgatgcttcttttttaaacctcgatcgcttaactttcctggccgatgtcggctag

SEQ ID NO: 33483 - DNA, 402 bp, Glycine max
  Peptide Sequence Number=SeqID_150261
atggcggcgcagctaatccatgatcgagtagagatggagtgcctagaagggagcttgggagaccctcaaaggcaacacgaggtgccgatttcggggcaccattcggattcacggctactttctttgcgcacggtggagtggatactacccacgcctacaccatatcgtctagtggagcccagtccaagtgatcgaggtaacgtcatccgaggaagacccgaggaggatctcgaggagctacctcccgagcctgctgtggatgctcttgactatctagagggtgatgaggacccacttcttgaggtggattctcccgatgaagtcatgatggcatctgaggcagactctacggaggatagtggcccgagggagatggcgatcagcggaggctcttcatcctag

SEQ ID NO: 33484 - DNA, 486 bp, Glycine max
  Peptide Sequence Number=SeqID_150262
cttgagaggattgatggggacccactgttgagagaaacgaggatatgggctacgtgggagtacgtgagctcagatggaggtgggcaacaggggatggtgggtttatgcgcgctttgtggatgtggaaaacttgttgtgcaccatcgcccgaccgccacctatggtacctggagatatgtcgcgggggtcaggagaccttggggacgtcaggtggggcgagctcctggcagtcaacagataaaaggaacaaagaccacaaagcaaggaggcttgtggcttaaaaatgaagacaggaggctaagatggtctctggtaatcgattaccacgggaaaggggactggaacctggtggaggcctctggtaatcgattaccagcctgtgtaatcgattacacagagggatgggtcactggtaatcgattaccagatatgtgtaatcgattacacagtgcatttttgcatatttcatgtcctgaggctatgtaa

SEQ ID NO: 33485 - DNA, 903 bp, Glycine max
  Peptide Sequence Number=SeqID_150263
atggatcctattacagcacacggtcattctcttccccctcctttccacgcaggaagagatctccacctccaccagcaacaacaccagttccactccttacaagaagacgagcagagcggaagcagcggaggcctaaacctcgcacacaaaagggaacacgaagaaaacaacaacaacaacagcagcgatggcaaagaaggtggaggtgctggctccggcgaaaccgaaatttcaagaagacctcgcggaagacccgccggatccaagaacaagcccaaaccccccatcatcatcacgcgcgacagcgccaacgccctcaaaacccacgtcatggaagtcgccgacggctgcgacatcgtcgatagcgtctccgccttcgcccgccgccgccagagaggggtttgcatcatgagcggcaccggaacggtcaccaacgtcaccctgaggcaaccggcttcttccggcgccgtcgtcactctccacggaaggttcgagatcttgtccctcgccgggtccttcctgccccctcctgcgccgcctgcagcctccggtttgaccatatacctcgccggaggacaaggccaagtcgtcggaggaagcgtggttggcgcactaatcgcttcggggcccgtggttatcatgtcagcttcgtttagcaacgctgcgtatgagaggcttcctttggaagatgaagacccttcgatggcgcttcagggaggtggttcgattgggtcaccgggaggtggcggtggaggtggcggtggcgttggtcaacagcagccatctcagcagcttatgggggattccactgcgcctcttttccatggtttgaatcccaatcttctgaattcggttcagatgccgtccgagactttctgggcaacgggtcgctctccatactga

SEQ ID NO: 33486 - DNA, 285 bp, Glycine max
  Peptide Sequence Number=SeqID_150264
atggcgggtgtatcttcccccgcttttctcgggatatatatctgcgagctagtgctagagcgagaggtaacaatagaaagatttaggttatgggaaagagttgcatgttgttggaaatgcgatgagattgagaatgggaaggaaggtacatgtatatgggttgtttcgtgggaaggggcagatagaggtagtgacccacatgcaccacactttgggacaatcggcggcttaaagccctttaaggagagtggagtcaatctcgatcgttttaatttaatcacttga

SEQ ID NO: 33487 - DNA, 1854 bp, Glycine max
  Peptide Sequence Number=SeqID_150265
atggccacctctcagggtgctaacagttacagaaatgccagaacctctctcaaacctcacgtcaagtcaaagcctacgcaacaacgccgtaatagcaccggctccgtcaacggcaaggaacacgctgctgttcccggaagagttagagtggctgttagattgcggccacggaatgcagaggaatcagtggcggatgctgactttgctgactgtgttgaactgcagccagagctcaagaggttgaaacttcggaaaaacaattgggatgctgatacttatgaatttgatgaggttctcaccgaattttcatcacaaaaacgtgtttatgaagttgtggccaggcctgttgtggagagtgtactggatggctacaatggaacaattatggcatatgggcagactggtactggtaagacttatactcttggacgacttggagaggaagacaatgctgcacgtggaataatggtgcgggccatggaggatattcttgcagatgtttctttggaaactgattcagtctcagtctcttatttgcagctttatatggagactatacaagatctgcttgaccctgccaatgataacataaccatcgtagaagatcccaaaactggtgatgtttcattacctggagctagcctagttgacattagggacaagcagagttttgtagaactattaagattaggagaggctcaccgctttgctgcaaatacaaaactgaatacagaatcttctcgaagtcatgctattctgatggtgcatgtaaagagatccgtgaaaggaatagatgctgctctttcaagtgaaaatggcaatcatccacacatggttaaatcaataaagccacctcttgttcggaaaggcaagttggttgttgtagatcttgctggttcagagcgaattgacaagtcaggaagtgaaggacatacattagaggaagccaaatctatcaatctgtccttgagtgcattggggaagtgtattaacgcacttgcagagaatagtgcacatgtgccatttcgtgactcaaagcttactagattgctacgtgattcatttggaggtacagcgagaacttcactagtaatcactattgggccatctccacggcataggggagagactgccagtactataatgtttggacagagggctatgaaggtggaaaacatggtaaagctaaaggaggaatttgattacaaaagcttatctaggaggttagacatagaattagataaactcattgtggagcatgaaaggcagcagaaggcatttgaggatgagattgaaaggttatccactgaagcacaacatcggatatctgaggctgaaagaaactatgtagattcattggagaaggagagatcaaaatatcagaaagactatatggagtcaattaaaaagcttgaagagcagtttgtgatgaatcaacaaaagaatgaggaatctcatatgaaattgagtggagagattcccagagtgtctgctgaggaactggctgatttgaaaaaaatgcttcggaaagagactcatctaagaaaagctgctgaaggggaagtaaacaatctgaagattcaagtggctgaactaaaaaagtcagaggcatcaagaaagtcagagatcttaaaacttcataccatgttggaagataaggaacgccaaaaagagaaacttgaaggagaaatagcaatattacaaagtcaattgttgcagttaagtcttgaagctgatgaggtctatttttgcttggaaatcatatttttgccattgggattatgggagctatctactggtaacatgtacattgatattgcagaagttgatactgcagaatgtgaatgtaactag

SEQ ID NO: 33488 - DNA, 1842 bp, Glycine max
  Peptide Sequence Number=SeqID_150266
atgaagactataacaaaggctagggagtttcgatgcattgagtacttatcttcattgcggagaagtttttccttttcctcttcctcttcctcccattctcgtcactttcaatttcgcaatgataaacggaatcatctgaaccccaaagaccttgtcagcgaggataacaaatttgaagaagccgttgatgttttatgtcagcaaaagcgcgtcaaggaagcggttgaattgctccatcgtactgatcatcgaccctccgcgcgcgtgtactccaccctcattgccgcttgcgttcgtcaccgcgctcttgaactgggtaggagggtccatgcccacactaaagcttctaactttgttccaggggttttcatttctaaccgtttgcttgatatgtatgccaaatgtgggagcctcgtggatgcccagatgctgtttgatgaaatgggtcacagggatttgtgttcttggaataccatgatagttggttatgccaaacttggtcgccttgaacaagctaggaaactgtttgatgaaatgccccaaagagataacttttcttggaatgctgcaatatctggttatgtcacccataatcagcctcgggaggctctggagctgtttagagtgatgcagaggcatgagagatcgagttcaaataagtttaccttgtccagtgccttggctgcttctgctgccattccttgcttacgtcttgggaaggaaattcacggctacttaataagaactgagttgaacttggatgaagtcgtttggagtgctctgttggatttgtatggcaagtgtgggagtttagatgaagctaggggaatttttgaccagatgaaggacagagatgttgtttcatggactaccatgattcatagatgctttgaagatggaagaagagaagaggggtttttgttattcagagacttgatgcagtcaggtgttagaccaaatgagtatacgtttgctggagttctaaatgcatgtgctgaccatgctgctgaacacctgggaaaggaggttcatgggtacatgatgcacgcagggtatgaccccggttcatttgctataagtgcccttgttcatatgtactcaaagtgtgggaacactagagttgcaagaagggtgttcaacgagatgcatcagcctgatttggtatcatggacttctctaattgttgggtatgctcaaaatggtcaaccagatgaagcacttcatttctttgaattactactccaatcaggtaccaagcctgatcaagtaacctacgttggtgtcctttcagcttgtactcatgctggattagtggataaagggttagaatatttccattcaataaaggagaaacatggattgatgcatactgctgatcattatgcatgtgttattgatttattggcaagatctggccgattcaaagaggcagagaatatcattgataacatgcccgtaaagcctgataaattcctttgggcatccttacttggaggatgtagaatacatgggaaccttgaattggctaaaagagcagcaaaagcattatatgagatagagcccgagaatccagctacctatatcactctggctaatatttatgctaatgctggtctatggagcgaggtagccaatgttagaaaggatatggacaatatggggatagtgaagaagccaggagaactctcaaagaaaataaaggaagaaggctatgttcctgacacgaactttgtgctacatgatgtggaggaggagcagaaagagcaaaatcttgtttaccacagtgagaagcttgctgttgtctttggaataatttcaactcccccaggaactccaatcaag

SEQ ID NO: 33489 - DNA, 1059 bp, Glycine max
  Peptide Sequence Number=SeqID_150267
atggcggaatcatccactagttctcctgtttcagttgattccattcccagagacaatgataagttctggaaagggtcatttactgtcgccggaatcatggttactctcgtcacctatggtctcttgcaggaaaagatcatgagagtgccgtatgggacagaaaaggagtatttcaagcattcactgtttcttgttttctgcaaccgcatcacaacatctgctgtttctgctggttctttgctggcaagtaaaaaagtgttggacccggtagctcccatttataagtactgccttatctcggtttcaaacatactaactacaacttgccagtatgaggccctcaaatatgttagttttcctgttcagacccttgcaaaatgtgcaaaaatgataccagttatggtctggggtgccctcattatgcagaagagataccagggacctgactatttgttggcttttttagttacccttggctgctcagcatttatcctatatccggcaggaacagacatgagtccttacagtagaggaagggaaaatacagtttggggcattctcctaatggttggctatcttgggtttgatggatttacaagcacattccaagataagttgtttagaggctatgacatggagatacataatcagatattttacacaacattgtgctcttgtgttcttagcctgacaggtcttatcttacaaggacatttaataccagctatagaatttgtttatcaccatcatgattgtttctttgacatagcattgctttcgactgttgccacaattagtcaattttttatttcatacacaattcgcaccttcggtgctctgacatttgcaaccataatgaccacaagacagttggtgagcattatgctgtcatgtgtgtggtttgcccatcctcttagctgggaacagtggattggagctgtcattgtctttggctccctttatggaaaaagcttctcgaggaaaatgcctcagaagacaaccccctctatagcacttgttcaaaatggggatccaaataatttgaaggacaatctgtga

SEQ ID NO: 33490 - DNA, 531 bp, Glycine max
  Peptide Sequence Number=SeqID_150268
atggctcccaaagctgatagttcaaagaaggctgatccaaaggcacaggccttgaaaactgccaaggcagttaagtccggtgctaactttaagaagaagaccaagaagatccgaacatctgttaccttccatcgaccaaggactttgaaaaaggataggaaccccaaatatccacgcattagtgctccacccaggaacaagcttgatcactatcagatattgaagtttcctctcacgactgagtctgcaatgaagaagattgaagacaacaacactttggttttcattgttgacttgcgggccgacaagaagaagatcaaggatgcagtcaagaagatgtatgatattcaggccaagaaagtaaacaccttgatcagtgaatttgatattgcagttttccttccaaacatttattatactgagacatacatgttttgtgctttttggcctgatggaaccaagaaggcctatgtcaggttgacacctgattatgacgccctggatgtggccaacaagattggaattatctaa

SEQ ID NO: 33491 - DNA, 174 bp, Glycine max
  Peptide Sequence Number=SeqID_150269
atgggagaggggggaactagtttcgtagaagatgctgattgctttgtggaatcctcgatggtgcaagaggtggaatctttatgttctgcaaaggagggggatttcgccacgtgggaagtggccccgcaacatggagtgtctgaagcacaggacccgcgtccatcacagccttaa

SEQ ID NO: 33492 - DNA, 417 bp, Glycine max
  Peptide Sequence Number=SeqID_150270
atgtctgaatctgtaggctcgttggccagagacgctggaatattttttgcattatgtatgttgttcattatggtgagtgagtggaaaaaacttatgctttttttgtgttcaaactctggtagaaacagggttgaaggccaatttgttgaggaaacaattcctaatgagtattctattcagtttccaagcgttaacttggagtcatgtgtgataaactctcttccggtgtctcagtttaagaaagatgaggttgagggggaacatatgccagttaatgcggactgtgccatttgtttgggagaatttgaagaaggggaatggctcaaacttcttcctaattgcacccacggcttccatgcttcctgcattgacacctggtttcgctctcattctaattgccctctttgcagagcttat

SEQ ID NO: 33493 - DNA, 372 bp, Glycine max
  Peptide Sequence Number=SeqID_150271
atggagctaagaaagacaaggaaaatgaactgggagggcttcaaattgctatcaagggaaatcagactcagaacaaaaatccaattttggaggttggcgaagaaggaggaggagaaggacgttagcagagagaccaagagaaagtttggtgatgagagttccggtgacggcgaatccaaccaagaagggccagttacgcttccattctcgcttgaagaatacaggccatggatcgaacagtctcattttttcttttcctttcaccctttcctttcctcctcacctccacctgttccagtacgctccgctattccctcaccctcaaacccaatgggccctgttaggcccaacctattttttattgcgctctaa

SEQ ID NO: 33494 - DNA, 153 bp, Glycine max
  Peptide Sequence Number=SeqID_150272
atggctaaattaaaaagacctcaccttcaccaaggccaacaggagaaggataaagctggatggcgcctccaccgttcattttatcaaaaaagagagaacactccagataactttgatgtcatcttcctccttcaccttcgatgtgactactaa

SEQ ID NO: 33495 - DNA, 801 bp, Glycine max
  Peptide Sequence Number=SeqID_150273
atggttcaacaggaagtgcgtaaaggtccttggacagaacaggaagacttcaaattggtgtcctttgttggattgtttggagaccgtagatgggactttatagctaaggtatcaggtttgaaggtggcgggagaaagtaagagttgcagattaaggtgggttaattacctacatcctggcctcaagcgtggaaagatgaccccccaggaagaacgccttgtcttggaacttcactcaaaatggggaaataggtggtcaagaattgctcgcaagttaccagggcgcactgacaatgagatcaagaattactggaggactctgatgaggaaaaaggctcaggagaaaaagcgaggagaagctgcatcgtcatcaccaacaccctctagcgttgattcctcaatatcctcaaacaaccatgcagtggatccacatgcttccaagaaggcaggagaagagagcttttatgacacaggaggtgataatggtgtgatagccgcaacccaagatcagggtcaaaaaggtgatcaacaagggttgttctctatggatgatatatggaaggatattgacaatatgtcagaagagaacaacactactcttcagccagtgtcagtgtatgatgggcacagtgaagagggttgcaacttctcttgcccaccacaagtgccttctccatcatcatgggaatattcttcgtctgaccctctatgggtgatggatgaggaaagtttgttttgccctttgagtgaagaaccatatttttcctgctatgcacagggcaccgtttttttaaccggctaa

SEQ ID NO: 33496 - DNA, 333 bp, Glycine max
  Peptide Sequence Number=SeqID_150274
atgggtgaagtagaggaggtacaagagcaaatggccacaatgatggaggccatgatgagcatgaagaagataatggaagccaatgcggtcacagttgccgctaccagcactgttgctaaggtgaacccgatgccctcatctggcctcaaccaaatgaatcatccaaccttaaatatggtaggcaaagatttgggaagtagggacggcccccatgatgtgcaaattccaaataagtacaccttcccgccatatggctcgcctcccaaggaggatgccaataacttcgttcccatactcattgaaagccaacaacctcaaactagtcatgcacat

SEQ ID NO: 33497 - DNA, 258 bp, Glycine max
  Peptide Sequence Number=SeqID_150275
atgggtcctgtgagaggattcaagaagaaaagaaagccagagaagaagcatgacaagaatggttctggttctgggtcacccgagggagagggtcctgtagattggtgggatgacttgtcaaagagaatgaatgtacattacgcgtgtatgagaaattccaaggaagaatgttactttcttcatggtgctggaatggttgtacaacatgtttgtttccacatcttcacagattttctgtgcatccatcagaagcaataa

SEQ ID NO: 33498 - DNA, 204 bp, Glycine max
  Peptide Sequence Number=SeqID_150276
atggtggcaacaagttatgagagtaggaataataatgcatgcaagaaaggagtgaaaagggaagagagaggacacaaaacaaggaagtatgctaaggttaaggttaaggtaagagaaagagcatcaatcaccaattcaccatgttatgttatgtcgatacagatgcctgattcacttcctgctttcccacagaaaaatttatga

SEQ ID NO: 33499 - DNA, 849 bp, Glycine max
  Peptide Sequence Number=SeqID_150277
atgcttttggcatcaaatcatcatcatcaacaacaacaacagtaccacggtcctgccttaccgatgatgccaaccccactccaagttcggaggaggcctgtctttgaatttgatgatgagcatcttcagaatcaaaagcccaccattccaatggaattgcagattgtcagttcccaacaacattttcgtcttcccgatggttgggtggtcgagaaaaagccccgtccctctcacgagtctcgttttgacaagtattactatgagccaggcaccggaaggaaatttcgttctttgttatctgttcagagacatctagcaggagaaacaagagactatgttgttgctaacacaatgatgtcaaaaaatgaaaacactaattttattgagtctgggtcaggacagaagttcggttccttgagagctcttgataatttcttatctgaagaaaatgcatgtacaacaacacctaagtctgcagtgaaatcaggcactggagagcaaagagcttgtggtgtgagaagtggccaaaaagctgtccataaaggctcttctgtaggagaagaagtacaaatcactccaaagtccttgaaacacactattcaatctgcactttctgagaaatcagattctcggaagaaaaccaagtcggagaaggacaacagagcttccatgcataacttaactgtaccaccaccagcaaaagtaagctgggttctgtctggttccggggggttctggagccctttccttgatgattccattgtaccagaacctgaaaagatgaaatggtccaaagcatttgtactatcaatccatgatgatggagatattaatggacttaatagctga

SEQ ID NO: 33500 - DNA, 225 bp, Glycine max
  Peptide Sequence Number=SeqID_150278
atggcttctggggctttcaggacttccagtattttcgaagcaggattgcttctggaagaagcaacccagggcgagctgggcggcaacctcctccccctttttcctataaataggcgaaagagggttgttctatgggtccctgatcactctggctatgcatttaagctgttttgggtgaaaaaaatggtttccatgaagaaaatccaagccgagatgcttccgtaa

SEQ ID NO: 33501 - DNA, 192 bp, Glycine max
  Peptide Sequence Number=SeqID_150279
atgaatgcaaagagaagaaaatatatggttgatgtgcttccaaaaagaagaacattgatgcggcatagggagtcgtacaggaatcggaacacgttggtgtacactactatcatcaaccacaacattcagtcaacgacgcaaggcatgacacagcgtgccggtgagcacctccaccacttgatagttgtttaa

SEQ ID NO: 33502 - DNA, 666 bp, Glycine max
  Peptide Sequence Number=SeqID_150280
atggctgtttcgcgctgccattgccccgcgagtctgactttgacgctaaagagcttcgagaattcatggattggaactaaagttggggtttcgccatgcagtctcaatcttagacctgtcgtgtccgtttcccggcggcgcccgctcgctgctaccgtctccttcagcctccccaccgcaaagccagagcgtgcttctactggccaagaaattcccaaatggttttccaaggctataaaatcatttgcaatgtctgaattggaggcaagaaaactgaagtatctgaccactggcactgaagcccttctcatgggggttctcattgagagtactaatctaactgctaagtttttgcgagcccatggaattacaattctcaaggtgcgtgatgaaactgtgaagttacttggaaaagctgatttgtttttcttcagcccagagcatcctccactgactgatgaagctcagagggcccttgattgggctgttgatcaaaaaataaaatatggtgatggcggggaaattaccacttcacacatacttcttggcatttggtctgaagtggattctcctggtcacaagattctgtttactcttggctttaatgatgaaaaagctaaagagcttgagccctcaatttctaaacctggatgtacggatgattga

SEQ ID NO: 33503 - DNA, 363 bp, Glycine max
  Peptide Sequence Number=SeqID_150281
atggacaccctcatcaaggatgttgccagtgttaaggttgatatgaatgatgtgtatcgcccaagtcttgatggcattggtgtagatgtagaggaagattcaggggatagtgaagatacaagtgttggaattggtagccaaaggagtaggaaaaagatgaagagtattaatcaccctaaaaagttaaacaagaagaagacaactacatcttcaagaattacaaatgttgttagtgtcattgtagatgcatataaatattatttggtatatgttggctatccaacaccaatgaaatacattggtccttacaaatgtgaacattaccaccttcacgattttagacaaatctgggtttgcaaataa

SEQ ID NO: 33504 - DNA, 1536 bp, Glycine max
  Peptide Sequence Number=SeqID_150282
atgtcagcaaccttaacatgtaaactaggagacaacaacctaagcttaaacgataaaaacgaccaacccccttcacctcctcagcccctacaaaaatgccctgccaatatggtttcgatggtggtctcagagctaagaattcaacgaggaatagcccttccaatggtggccatgaatttggcttggtttgccaagacagccatcacaacagcatttttaggccgtcttggggagcttagtttagcaggtggagctctcggcttcacttttgctaatgtcactggcttctctgtcctcaatggtctatgtggtgccatggaacccatatgtggacaggctcatggtgccaaaaacttcaggctccttcacaagacccttctcatggcaatctcgttgttgctattggtatcacttcccatcactttcttgtggcttaatgttgacaagattttgatcctttttggccagcaacaagacatctccactgttgccaggacctatgtttcatgtctcattcctgacttgtttgttgcctcactgttctgtcccttaaaagcctacttgagttgtcagagcataactcttcccaccatgtttagttctgctgtggcactagccttccacataccaattaacatagtgctctcaaggaccatgggcctcagaggagtttccatggcagtttggataactgatcttattgtcgtggttttgctagccatttatgttttaattcttgagaacaaaaaggaaagcatgtggaaggaaggagggtggtgggatcagagcattgaagattggataaggctgctcaagctttgtggatcatgctgcctcaacacatgccttgagtggtggtgttatgagattctagttttacttactggccacctcacaaatgctaagcaagcagtgggagttttggccattgtgctaaacttcgactatttgcttttctcagtgatgctgtcactagccacttgtgtttccacacgtgtctcaaatgagcttggtgcgaaccaagctggtcttgcttaccgatcagcatgtgtgtctctggcattgggctttatctctggttgcataggtagcttggtgatggtggctgccaggggaatttgggggccactgtttagccatgatatggcaattataaagggagtaaagaagacaatgttgctgatggctctggttgaagtgtttaattttccgctggcagtttgtggaggcatagttcgagggacagcacgaccctggttgggcatgtacgcgaatctaggtggattttatttccttgctctgccacttggtgttgtttttgccttcaagctctgtcttgggcttgttggactcctcattggacttctgactggtattgttacctgcttgacgctgttattggtatttattgcgcggttaaattgggtggaggaagctgccaaggcacaaacactaacaggccaagagcaggttaaggaactttccaaatatgacgcagaagaacgaattgacgcccatgaaaaagatgtagtgtaa

SEQ ID NO: 33505 - DNA, 261 bp, Glycine max
  Peptide Sequence Number=SeqID_150283
atggcttgcacccacttctggatttacacacgattctcctcaaatttcagccaacatcaatcagacctcgcaccttacgcttcaaagccctacaatgctcaatggaacgccccggggcttctccgtgacaagcacacattgcgttcgaatcgtattctcagagaaatggaggttgatgaaccttggctggggttatggctaccattgaattatcaagtagatatgggagcaagtcagcataggatactggaattggggtga

SEQ ID NO: 33506 - DNA, 336 bp, Glycine max
  Peptide Sequence Number=SeqID_150284
atgtggggcatccctttcatccttgaaccaaaccaagccctgacatgtatcatgtctagccattctacgagctttgagccaaaatcccgactcaccataaaccttgacccaggaagaagaagaagagaaaagaaggaaaattccccaatcaaagagtgggagaaagcaaaaagaaaagaaaggaaattcccaatcaaagaatgggagaaattaaaaaaggaagaagaagaaggaaagaaagctcctgatcagggatcgaaggaaaaacagaagaaatgtgcagagaggtctttggaccggacaatatctgaacaatacagaattgtcaccaaatga

SEQ ID NO: 33507 - DNA, 1345 bp, Glycine max
  Peptide Sequence Number=SeqID_150285
ggttgtcattgacaattccgttttctcctcagctacgctagtcaaggttgacagcgccagaaggcatggtattctattggatgctgtagaagtgctagctgacctgaacctttcaattaagaaagcgtatatttctgctgatggcaagtggttcatggatgtttttcatgtcaccgatcaaaatggaaacaagataatcgacgagagtgttttaaaatatattgaacagtcacttgggaacattcactatggaagaaccaacctctctaacggtctcactgcgttggaattaacaggaactgaccgagttggtcttttatcggaagtgtttgctgtactggctgatcttcaatgtgatgtggttgagtctaaggtttggacacacaatggccgtattgcctccttaatctatgtaaaagattctagttctgggtctgctattgaggactctcagaaaattaataagattgaattgcgcttaagaaatgttttgaagggagacaatgacattagaagtgcaaaaatttctttctctatggccgtgatgcacactgaaagaaggctacatcagttgatgtttgttgaccgtgattatgaaagggctcctattcttaaattgacttccgataacgcatcggtgacagtccagaattgggaaggaaggggttattcagtcgtgaatgttcagtgcaaagatcgaaccaagctattatttgacattgtatgcaatttgacagacatggaatatgttgtattccatgcaactattaacactgatggtgaccgagcttacttggaattttatataagacacaaggatgggactccaattagttcagaaccagaacgtcaacgtgtaattcaatgcttaaaagctgctgtagagagaagggcatctgagggtgttcgattagagttatgcacagaagacaggcaggggcttctagcagaagtggtgagaacattccgagagaatgggctcaatgtgaccagggctgagatatctaccatagggaatatggctaaaaatatattctatgtaacggatgcgattggaaatccagctgattccaaaattatcgaatctgttaggcagaaaattgggttaagcaatttagaggtgaaggagttgccattgataaatcatcaggaggcagagagagaggatcaagcggttggaatgggtggggcagtgttgttgtccattgggagccttaaagatgttcacgtcggtgggaaggttgtgagattaaatagtatggaattggattcttgttggcagaggcacaagtgtttaggtggggcttacggcttaattgcaaagtgggaagaattgggtgtttaa

SEQ ID NO: 33508 - DNA, 255 bp, Glycine max
  Peptide Sequence Number=SeqID_150286
atggaaccagaaacatctctgaactttactttgatgctgactttcttactttatctgaacttggttatgggagtgctgagcgttgatcattatcgcagagttgactttcctgatgaattcgtttttggttcaggcacctctgcttatcaggtggaaggagcttctaacgaagatgggagaactcctagcatctgggatacctttgcccatgcgggttatatgcttaattttgaaaaattggtctttgttaattaa

SEQ ID NO: 33509 - DNA, 253 bp, Glycine max
  Peptide Sequence Number=SeqID_150287
ccaatcgggtctgtcaacggttgtccattgccgggtacatggttgcttacttgttactggtataggcaaggaaggcatttggttgatgttactgagatattcaacctgctctcttgggaaaagaagcaacggctcgtcaaactcttctatcttgttttcacccttttcctctctgatgatttacacatcattggattagtaactgcagtgcttgcttgtattatggagtgctgcaaactcccagatgtgtgtg

SEQ ID NO: 33510 - DNA, 234 bp, Glycine max
  Peptide Sequence Number=SeqID_150288
atggttactttcatacttcaacttgactcgatgaaccttttcgtaaaagcgcgagcttggttcaaccccataacccagggaattgcaattttgatcgccaatacttcatcaacatttcatagggatgaaagactcgggaatacgcatgctatgcatggaaaattgaaatgggtttatgatcccaacatggttggctcatggtaccgaatatatgcaactaagaatgcagtgtga

SEQ ID NO: 33511 - DNA, 510 bp, Glycine max
  Peptide Sequence Number=SeqID_150289
atggagatacagacttgtggcaggccgattgactccttgctagagaaagtgctttgtatgaatattctgtcgtctgattacttcaaggagctctatcgattgaaaacgtatcacgaagttattgatgagatctacaatcaagttgatcacgtggagccatggatgactgggaattgtcgcggtccttcaactgcattttgtcttctgtacaagttttttactatgaagctcaccgtcaagcaaatgcacgggctgttaaagcaccccgattctccttacataagagcggttggatttctctatctgagatattgtgctgatccgaagacactatggaattggtttgagtcatatgtaaaagatgatgaggaattttctcccggatctaatggtcgaatgactacaatgggtgtatatgtccgtgatttgcttcttggacagagctctcctaccagaattcagatgcatcacaagattgcagatgcagatatgtccctcatcatcccataa

SEQ ID NO: 33512 - DNA, 872 bp, Glycine max
  Peptide Sequence Number=SeqID_150290
aactctcggtggaggagaaagacctggtggataggagcgctaaaaagattacaggagagggggatcatgcgtttacggaagatgaagaggacatggatcatgattatgtgtttactgaggatgaggaagaagacggggatgagttttgtggactggggattgaagagagaaagttgggggagtatgagtcaatagagaaggtagaagtgtgggtacacttatctaagttaccaattgattactatgatgtgaaggtcttacatgttgtgggtgacaggattgggaggacactaagagttgataagaatgtgttttctcaagaaaggagggatgtcctaagaaagatgagtagcattcatggaataggcaatatgaagttgttgatgataatgacaaggcgtcataggaaagggaaaaagagagacaatggagatcttaattcgatgcataatcaaggatctagctatgggattttgagtagacatcaagatgaggataaccaaacaggagcagggaaacaaccaatgggaatgtcagggcatgggcagtcaaaggccaattttgtttatgaaaagaagacaaaggtgggatccaaggagaaagttatagttttaagatctgctatgattaatttggagaaaaacaatgggaatatcatccctaggaagaaaaaggtcaatcatggtgggattgttggtggggttatcaaggaaaataataaggttattatagttaatcaagatatggaagtgcaaagagcccatgcatatgaggaagtgtcccctcaccagatgatgcaagaggggcaccatggttcccttggaggggacataaatggtggatatggattgtgtgatggagacaccacttag

SEQ ID NO: 33513 - DNA, 582 bp, Glycine max
  Peptide Sequence Number=SeqID_150291
atggctgctccaccggcaagagctcgtgcggattacgattatctcataaaacttctcttgattggcgatagtggtgtcggaaagagttgccttcttctacgattctctgatggttctttcacaactagtttcatcacaactataggcattgattttaagataagaaccattgagcaggatggaaaacggatcaagctccaaatttgggatactgcaggtcaggagcggttccgaacaattacaaccgatatcaggaattggattcgtaacattgagcagcatgcttcagacaatgttaacaaagtactggtggggaacaaagctgacatggatgaaagcaaacgggttgtgcctacctccaagggccaagcactggccgatgagtatggaatcaaattctttgaaacaagtgcaaagacaaatctaaatgtggaggaagttttcttctctattgcaagagatataaaacaaaggcttgctgacactgactctaaggcagagccagcaggaattaaaatcaacaaccaactagatcatgcaacggctggggaagttgcacaaaagtcagcttgttgtgggtga

SEQ ID NO: 33514 - DNA, 516 bp, Glycine max
  Peptide Sequence Number=SeqID_150292
atgaagagaggcagagaagagggtgagttagacatggctaattgcttgatgctattgaccaaagttggtgagagtgaaaccaattacccaatatcaaagggtagagatgatggtgatttcaagtgcaagacttgcaatagaaggttctcttcttttcaagcccttggcggccacagagcaagtcacaaaaaaccaaagcttatggtcacagatctttcgtggcatcacgagttaccgaataacccaaccatgaaacaacctaggatgcacccgtgtccgatttgtgggcttgagtttgccattggacaagccttgggagggcacatgagaaagcatagaagtgctattaatgatggcttgttgtgtggtaaaccttcttcgttgtccatcttgaagaattcatcaaaagatgctcatgaaaggttgaatttgcgtttggacttgaacttgacgccaatggaggaggatgatctgaagctcaacttaaggacgcccgtcctcaattgtttcatttga

SEQ ID NO: 33515 - DNA, 306 bp, Glycine max
  Peptide Sequence Number=SeqID_150293
atgactgttaaattcaccagcaaaatgagacaaataagtaggaaagaattgcagaaagagaaggaggagcaacggaggcaagaacaggagaaggggctggagaggaaagaatcggttggaagtcccggagcagggtttgattacattgctagaattgtcttcaatgtgctgccgtaccacactatcttagtgctaatttccattttaccacagaggttacttgacagaaggattgcttcgcgtttagattgcatacttgagggggttggcacaaaaagcggaggaatctcaccaatattgttctag

SEQ ID NO: 33516 - DNA, 672 bp, Glycine max
  Peptide Sequence Number=SeqID_150294
atggagcccgatgtggtggttgatgggaagctttctcaaacttgttaccttatggcccttgattcttgctataatcacttaagtcacaaatatgagaaacaagagggaaaacaattttgtatttctgatgcagaatactttgtatttcactatccatacaacaagtttgagaagaagtttgggcaatcatctgttttcatagcttcaacactcttggaagatgggggtgttccaaaagcagcaagttctgctacactcttgaaagaggccatccatgtaattagttgtggttatgaagataagacagaatgggggaaagaggttgggtggatatatggttcagttaccgaagatattttaacaggtttcaagatgcattgtcatggttggagatctgtatactgcatgccaaaaaggcctgcttttaaaggttcaactcctataaatctctcagaccgtctgcatcaagttcttcggtgggctcttggatctgttgagatctttttcagtaggcattgtcccatatggtatggctatatctcttacataaactcagttatttatcctctaacttcaattcccttaattgcctattgtgcattgccaactgtctgtctgctcacagggaagttcattgtccccgaggtaggattaatttttctttacttttaa

SEQ ID NO: 33517 - DNA, 342 bp, Glycine max
  Peptide Sequence Number=SeqID_150295
atgtccctagtttgcttccattcattttttcggcgagtggcatcaacagtaccctcgccgttactcaacgccgttacgtggacacttctgttaattgttaccgtggtgttggtatctctggctaccggggtggcttttgtgttggccatatctccatcttcttcgttctcaaagccctgtaacggtgttaggattcctttggattttcccagagagatggtgtgcttgccggaacatgcggtgatgagcagttctcgcttggattttttcttgccaacgttgttcgctgctttggttgttgctgcttcaacttgcttgcttcgttcagtggcctgtgcttga

SEQ ID NO: 33518 - DNA, 453 bp, Glycine max
  Peptide Sequence Number=SeqID_150296
atgctgactgttggattggactttatctacggcttaggattgcttgcgtggcgatccgtgttgttcgaaaactggccaatgggtcgcgccaaaatcgccgatggaatgacgccaataagcgcgtttccctccatgctcagatgcaaaagcgcaaagcagttggcgagcgtcgaaggaagcgttcctccgaggaggttgtggtctgacaaaagggagttcaccggggatgctactagagatatggttttgtatgacgttgagaatttgaaggctggtgaggttggcaatctccggtggaagagtttaaacgaaggcttattttacgcacatgcacaactcaaagatacattcactgagttcaagataaggcagacgcaactccgtgactcgattgttgggggaggggaagcctattccaaatggaagacctatgttagtcctcaatccggttga

SEQ ID NO: 33519 - DNA, 168 bp, Glycine max
  Peptide Sequence Number=SeqID_150297
gccaacaactacctcaagggaattattaacaatgctttgaaaggacttgacgatactccacaaagtaaatccaaggttgttgctaagtggattgttgttaaaaccattagaagcagagagattgaaggcgtttcgcatccactgggcaacctattatttgaaagttaa

SEQ ID NO: 33520 - DNA, 2253 bp, Glycine max
  Peptide Sequence Number=SeqID_150298
atggcgagtaccacaccctctgctgactctgcttcagcagatgaagttaccgcaaaagccgttcacaagcgctaccaagggttgctcacggttcgaaccaaagctataaagggcaaaggagcttggtattggccgcacctggaacccatgttgctgcacaacaccgaaacgggcctccccaaagcggttaaactcaggtgctccctatgcgacgccgttttttccgcttccaatccttcacgcaccgcttctgagcatctcaagcgcggaacctgccccaattttaattccgctgccaaaccagtctcctccgtctccccctcccccgccgccgccatggccgtctcgccgccatcctctccgaccaaccacaaccaccaccaccgcaagagaaattccgcttcgtcgtacgacgcgcctccgccgccggtggtggacccgtcgcgattcttcggggagctcacgtacgcgccgccgcggcaacaaccacatttggtgttatccggtggaaaggacgatttgggagctttggctatgttggaggacagtgtgaagaagttaaagagtcccaaaacttcacctggtccaactctaaccaaaactcaaatcgatagcgccttcgattatctcgctgattgggtctacgagtcttgtggctctgtctctttctccgctcttgagcaccccaagttcagagcgtttctcaaccaggttgggttgccaacagtgtctatcagagagctcactggaagtagattggaagcgaagttcgaagaagctaaagcagattcagaatcgcgaatcagagatgctttgttctttcaagtagcctcggtggggtggaaaaggaaggtgaagaagtactgtgaagagaagttggttaacatgagcgtgaatctccccaatgggaccagtttgcacagaaggacagtgttagttacaggttctgctccttccaattatgcagaagaggttttgtgggagacagtaaccggcatttgtgggaatgtcgtgcaacaatgtgttggtatagttgcggacaagtttaagaacaaggccttgagaaacttggagaatcgaaacccttggatggttaaccttttttgtcagtatcaaggcttcaatagtttgatcacggacttcaacaaggagctctcaatatttagcaccgttacacagaattgtgtcaagctcgtgagtttcatcaatttcaagtccaaagtgaggagtagttttgacaagtgccaacagctggagtacgggcacgcccggttgctccgaatgccattgccctcgctcgagtttgagtcttttgacactgtgtatgcaatgatggaggatgtgttgagttcgtttcgtgcgttgcagttggtgctgttggatgagaacttcaaaatggcgacaattgaagacctgaatgcgagggaagtcggggacatgattcgagatgtggggttttggaatgatttggaggcggtgcattcgttggttaagttggtggaggagatggttcaagagattgagacagagaggcctcttgtagggcaatgccttcccctttggggagagttaagggcaagagtgaaggattggtgctccaaattccatgttgcagaaggagcagtagagaaagtcattgagaaacggttcaagaaaaactaccatcctgcttgggctgcggcttacattcttgacccgctttatttggttagggacacgagtggcaagtatcttccaccgtttaattacttgacgctggaacaggagaaggacgtggacaagctcataacaaggcttgtgtcaagggatgaggctcatattgtgttaatggaattaatgaaatggagaacacaagggcttgatcctgtgtatgctcgtgctgtgcagatgaaggaaagagatcctgttactgggaaaataaggattgtgaatccacaaagtagtagacttgtgtgggagacttatctcactgagtttaagtccttgggaagagttgcagttaggctgattttccttcatgcaacctcgcgtggcttcaaatgtaattggtcttcgtggagatgggagtgtagccaaggaaattccagagcagcactagatagggcgcacaagttgatatttattgcagctcattccaaattggaaagaaaggatttttccggtgatgaagagaaggatgcagagttgcttagcttggcaaatggtgaggatgatgtgctaaacgaggtttttgtggagacatccacagcgtga

SEQ ID NO: 33521 - DNA, 123 bp, Glycine max
  Peptide Sequence Number=SeqID_150299
atggcatccacagcgtcgtcgccgatgacggtccaggcgggtctggttcggaccctgaaagaaggtttgggcggagaagcgggttcgggtccggtcgtttactggatgtttagagaccaacgt

SEQ ID NO: 33522 - DNA, 591 bp, Glycine max
  Peptide Sequence Number=SeqID_150300
atgtggtatatgcgttttgatgaatatacgatcaagattggattctcaagaagtaagtatgaatgttgtgtttacttcaagggtcatggagttgagaaaccaatttacttgttgctatatgttgatgatatgttgttggccagtcaaagtatggaagaaattgcaaggttaaaagagtttctaaattctaaatttgaaatgaaggatctcaagcaagctaaaaagatacttggcatggagattataagaaaaagagacagaaatgagttgtatttgtctcaggaaagttatatcagaaaggttctaaacaggtttctagtgaatctaggcaaaccacattgggaggctgcaaagtgggtattgagatatctttgtgggactattggtaggggactgaattatgtcaatcgaggtggatttccaacgatagaaagttttgttgatttagattttgtaggaagcattgatataagaaggttcataattgacaatgttttcaaagtctttgggaacacaatcaattggaaagctaacttggaggcagtggtagctttgtcatccaccgaagctgagtatacagtagcttgttag

SEQ ID NO: 33523 - DNA, 909 bp, Glycine max
  Peptide Sequence Number=SeqID_150301
atggaaattgagaggttcacaggatcaaatgattttagcctttggcaagtaaagatgaatgtcttgcttgttcatcaaggcttggacattgcattatcaaaagaagtaattgtgaagtgcaatcttgtcaatcttgaagatgaagttcttcgcgaggtggtagaagagaagattgccatgaaaatctgggagaagttagagactttatgtttaaagaagtctctgacaataggaaaagcaactagattaaagttttccactagtgtgcattctagtggaggagctcttggctatgtgcattcaaatttgtggggccatcaaggactaaatcttatggtggagcaagttttcaagaagtttaaggaatggaaagttctggttgaggctcaaataggaaataagagaaaatggagtggtaaggcacaaaatcgtgagaagcataccacaccaaatggtttagccgagaaattcaataggaccattcttgagcgtgttaggtgtatgctaaaccatgctggactaccaaagagtttcctgattgaggcattgagctcaactttgtattgcatcaatccatgtccatccacaactatagggttcaagacaccacaagaggcttggagtagcaagaaggttgattattcagaactaaaggtttttggatgcattgcttatgctcatattaagcaagacaagctagaaccaagagcattaaagtgcatcttcattggttaccttgaaggagttaaaggctacaaattatggtgtttagagcctgggcacaagaaatgtttgatcagtagggacgtgaggcaagaaactcctgagaagtctaaaaatcaagtgattcaaattgaggtggagcctgttgttacaactgaacttgaaactacaactcgtagacaataa

SEQ ID NO: 33524 - DNA, 558 bp, Glycine max
  Peptide Sequence Number=SeqID_150302
atgtgctttagaagcagtataacttccctgctcttgacttgtggtctaaaggcaattgatgctttcttggaggagttgatagtgcggagagagcttgctgataactattgtttctaccagcctcattatgattcattaaaaggagcatgggcctgggctcagaacaccttaatcgaacatgccaccgataagcgagaacatatttacacgagggagcagttggagaagacactgactgctgatcctctctggaatgcttctcagctggagacggttcactatgggaaaatgcatggttttacgcgaatgtattgggcaaagaagatacttgagtggacacgaggacctgaagaagcccttgagatatctctatatttaaacgacaagttcgtgagctcaaaaagaggaaggctgaaaacatgctatctcaataggagaaagtacttcgcagttgtgatcctgaagattgaagaagcatatatatacttctacgtttctaggcatagtatgcatttagttaggagtgctaacgacgatataaccacatatatgccttaa

SEQ ID NO: 33525 - DNA, 990 bp, Glycine max
  Peptide Sequence Number=SeqID_150303
atgtctggaaggacacccctatacaggaagtttgtggtggtcattataatatctctcttgcctgtaattcatcatggcttcagcaacttatttgttttcacggcatttgttttcttcagttctgctatttccaaagaattagttatggacattaagaaagatatggaggtgttgactcgattaggtgcattgagagagatgaatttggagtattttcccatagacagccagggtttcatcacaaataatgagagggcattagaggagctgtttggggatgaagagaataatcataaaggtgttacgtgtttgaatgttatggcaaaacggattgctacagtttttgcttctttaagagaatttccttctgttcgctttcgtgctgccaagtccctagatgcaaccacaatgactactttccaagatcttattcctacaaagcttgctgctggaatctgggactgtcttgtgaaatataaaaaaagtatacctaattttcctcagacggagacctgtgaattgctcattcttgacagatctattgatcagattgctcctgtgatacatgaatggacttatgatgccatgtgtcatgatttgctgaatatggagggaaataaatatgttcatgaagttcctggcaaatccggtggtccagcagagagaaaagaggttcttttggaggatcatgatcctgtatggctcgaacttcgccatgctcatattgcagatgctagtgaacggctccatgagaagatgaccaactttatttcaaagaacaaagctgcacaaatacaacatggttcaaatagtagcagtgaaatgtctacaagggacatacaaaccatcgttcaagcacttccacagtacagtgaacaaattgataagctctccctccatgtagagctttgtttgtcctgtattacgacctccctgtttaatgatgcaatattattgcttccattcatgattcttgctgatagaagataa

SEQ ID NO: 33526 - DNA, 378 bp, Glycine max
  Peptide Sequence Number=SeqID_150304
atgggcgaggcgggcgtgacggcggagatcgtggtgggggaaccggaggaggtgatggagggtttggtcggcgtggacttcttggtggttgattctcgaaggaaggactttacgcgtgtgctgaggctcgcaaagttgagtaataaaggtgctgtcttgctctgcaagaacgctaattcaaactccaagggtttcatatggcggagcctcgtggcgaaaggttcttcgcggcgtgttgttcgttcggcgtttcttcctgtggggaagggacttgacatggcacacgtgtctgcctctggaggtaataatagctccggacatagatggattaagcatgttgatcaacattcaggggacgtgcattttattcgacgatga

SEQ ID NO: 33527 - DNA, 366 bp, Glycine max
  Peptide Sequence Number=SeqID_150305
atgtctatgtccgattccgattcctcttcttacgccggcgccgactacaaaagtttcaagcaaattagccgcgagctcgtcgatgattggtcacgcttttcaactaattccttttcggtactatgcgccaaagataataataaactcagtgtcgaagtttattatcttttgcgcatgccgcatggtttcttctacttttggacttttattattagctacatgacaatcatggtttcggaggttttgggtattgattttggactttggagtgtggtttttggtgctgcacaatggttggaaaggagtgatcgagttttcaggatgattttgcttccgttgcctattccatgggttctcagcgaatga

SEQ ID NO: 33528 - DNA, 501 bp, Glycine max
  Peptide Sequence Number=SeqID_150306
atgtcgtcaaacttaaggacaaggaaggatcgaagaaagattgagatgaagatgacaaacaaaagcaaccttcaagtgcccttctcgaagcgacgtagtggggtattaaaaaaagctagtgagctttgcaccctttgtggtgctgagaggctgccaccacacgacacacagttcatgggagtgaacctgcatgaactcaacgcgcaactcaccaagttcaccacccaacttgaaactgagaagaaacgtgctagtgagttgaaacgattgcatcaggtcgttcaaattcaatggtggtgggcagctcctgttaatgagatgagcatttcgcaattgaacgactcttctaaccttgcgccaccaatgaataaccatggattaggagagattatgaatcaaatgaatcaccgtgactttaccaacaagagaggtcatggtcctaagggggatgatgaaatgttggataagaactcgacccccaaggggggtgatgtcatatga

SEQ ID NO: 33529 - DNA, 1248 bp, Glycine max
  Peptide Sequence Number=SeqID_150307
atgaatcgcgttgcattgcccaaatccattgcccagcgtttcagaggcatccaccacagcccgcggaaccagtggtgtaataacaaccgttgcgaaacgcaggtccaaagtgctgggcccgtggcttctctcctcaagtcccgttccgtcatacggttccgcgggcctgacaccctcaagttccttcagggcctgttgaccaacgatgtacggaggttgggtgagcccgttggtgacagaaccgaaaacttgcccacgcccaacgtgcctgctacatcgtttcctcctatctatgctgctctattgactcctcaaggaagattcctctacgacctctttctctataagcctcccacgtgcgacaccaagctcgatgacaccggcactggacctgattcccaaccacacgaaccctttcatttgtttgctgacgtcgattcttctgtataccggttgaggtcaaaggttgagattgatgatgtctcaagtgatttctcgtgctggcagcgttatggtgctggccttcttgagaagacctcacaagtagaagaacctgaagcagcctctgtaggctggggtgctggtgtggatcgtactgcaatgtcatcctctcaagggagtgatcaagggtggcaatggtttaaggatcccagattggtctgtcttggtttcagagggatcttcccgtcgaatataactcactttagtctaaaggagtcccccacatctctacctgtttcagcacctctaattgaggtggacaaagagactgatgaacagaatttccttctgtggagaatagagaagggagtagcagaaggatcaactgagattccaaaaggcgaggcagtaccgcttgagtataatcttgcaggccttaatgcaattagctttgacaaaggttgctatgtcggccaagaactcatagctcgtacacatcacaggggggtgattcgtaagcggatagttcctctaaggtttctagataacgatgggaaagagttggtaaacaaagtcattccaggctcagaagtaatgaacactgcatctggcaaacaagctggtacagtgactactgccctaggatgtcgtgggctggggctcttgcgactagaggaagaagctttaaaggggtcgagtgccttgtccgttcagggacaagaggatgtgaaggttgtcgctagtagaccagattggtggccttctgaatggcttcaagatcatggacagcacgctgcttttgcctag

SEQ ID NO: 33530 - DNA, 138 bp, Glycine max
  Peptide Sequence Number=SeqID_150308
atggatacctcaaagccctacactgggacaatgaggggcaccgtgcatgaacctcaagtgaacctaggggtcatgacgaaagataacaattggtacctcaaagccttacactggggcaatgaggggcaccgtgcatga

SEQ ID NO: 33531 - DNA, 252 bp, Glycine max
  Peptide Sequence Number=SeqID_150309
atgaaggttttgagcatgctcgtttttctactggcaaatctatccttattttgggaggagctggtggagttagaaactgttattcagttagctaaacaagtttataaggcgtctaagatagtagcaactgctagcactgagaaacttcaacttttaagggagttgggagttgacttgcctattgattacacaaaggagaactttgaaggtcttccagaaaaatacaatctagtgtatgatgcattaggttag

SEQ ID NO: 33532 - DNA, 441 bp, Glycine max
  Peptide Sequence Number=SeqID_150310
atgaggtatggcgagacgagcgcgtggcagtggcgcttcaggaggcagagtgtgaagttgcacctctcctcgagggagtccttcacatctccacgtggtgcgtccacaagacgtggttgccgcagaaggcgttgtggacgatgtgatttgacgcaacaacgaaggagacacggtttaaggatggcaagcgggggagagttaatcgacagcacatggcgacaggggcttagttcgaggcattgcctctattcgaagaaacctcttggttgtggtaaaacactgattgccaaagctattgccaatgagacaggggctgattttattcatattaagataagagatggaaaaattaaagttcttactcctagggaagctaggtatgcagttcagctttcaaacaagccccttcttgatgtttgtccctcaaatggacacaaaaag

SEQ ID NO: 33533 - DNA, 309 bp, Glycine max
  Peptide Sequence Number=SeqID_150311
atgtctgatgagtcttccattgagagatcagtggatggaaaaagaggagtttgttggaaaggagtgaagaacttcccattgtatgatgactggaagagctttgtgtcatgggtttctcttatcaggtcaaactctcgtttgtttgaatctgagaagaaccattggtacccttgtatttgtgccctcatgaggctgtattggtacgaatggggttttgttggtacatccaaatttttggttgaaataagcatgtacacctatgtagagacctggaatctgggtttgattgttgtgtaccctaaacaataa

SEQ ID NO: 33534 - DNA, 396 bp, Glycine max
  Peptide Sequence Number=SeqID_150312
atgctgccttggcatcacccctcactaaacacttatgccatgcacattttcactggccctctaaagcctaccgcatttcaaaacctcaaagacacaatcacagtagcaccgattcttgctttacctaacttcaccaatcctttcattgtcgagacggatgcctctggcacgggaatgggagcagtgctaatgcaggaaaggcatcccattgctttcttcagtaagcaattttgccccaaactgctaaagtcatccacttatgttcgcaaattagcacccatcatcaccgccgtcaagaagtggcgccaatacttgctagggcaccacttcgttatcttagttgatcatcgaagcttgcgtgaacttatgaatcaagcagtgcagaccccagtgtga

SEQ ID NO: 33535 - DNA, 195 bp, Glycine max
  Peptide Sequence Number=SeqID_150313
atgccgaaaaagaagtgggctttattgtataaaggtgggtgtgggaggtttgagtgtgttggtccatggactgctgaggaagacaaaaaactcataaacttcattctctccaatgaccagtgctgttggcgagctgttccccagcttgctgggcttccgcgttgtggtaagaagttgtcgtcttcgttggactaa

SEQ ID NO: 33536 - DNA, 270 bp, Glycine max
  Peptide Sequence Number=SeqID_150314
atgatgatctatggttgcaccataattccatggagagtaattctcaactctttgggactgcatgctagatcatttggaaagtccgtagccaccgttgtttccaagacttgctatgatgaaagaaatgacttccatactgaagtacaagatatgctatcctatcagcatgaactttgcatgaagaagggacatgcatctaatgctagcattaaatgcatcaatggactcaagacctcagacaaagaacagagtgaggaatccaacagttaa

SEQ ID NO: 33537 - DNA, 195 bp, Glycine max
  Peptide Sequence Number=SeqID_150315
atggagtatgagaaggaggttggagaatggagaatggagatggtgcattgctccaaaagctcatttattgtcgctggtgccggtgaagctgtcggcaaagatcgctggagaaggagcagtggctgcgttcgtggtcgatggagacacggattcgacaagaggaaaacaagtgttggggaagaggaaagattatag

SEQ ID NO: 33538 - DNA, 231 bp, Glycine max
  Peptide Sequence Number=SeqID_150316
atgaattctatatgcaaagcattatgcaatgagagtggtgtggaaagcaagtttggtgcgagtattggaagaattgaatggttgcatgatgagaaactgtggtcattgataagggtggatggacaaaatcttggtcaatataagggacttgttgcatcagacaacaatatagtttttccaagggttgcaggagtgacaggaaggttgccaccacttggaggtccattataa

SEQ ID NO: 33539 - DNA, 648 bp, Glycine max
  Peptide Sequence Number=SeqID_150317
atggtcgacgtggaccgcagacccaccggtccgaacccggctcacgcagccggtctaaggcgcctttcggctcgagccgcttcggtctccacccccaccgttcgcaaccgcaacagcctacactcgttctccgcgctgtccgaaaaagtcataacccacctcagtagctcgggaatacagctccacccaagtcacggcgccgagttcgctcgctccgctgactcggatcccatcctcaggaagcagagatccgtctccgccgccagattccccgtccccggcttctcccggcacagcctggacgccgccgtggacctccgccggagatcgaagtgggtggagggatatgtggggatgatgggttcggttctgagagaaggagggtggagcgaatcggatatatcggaaatggtttcaggttcgggttcggttctgttggataatgaagaggttttggatgctttggtttcgaaggcagagaggttttcggactcgttacgaaaatccgggtggagctccgaggaagttaaggatgcgttgggtttggatttgcgaccagagaagaagggagggagaccgcctaagaaggttgccactcaactcgtgggaaggatagggaaactggtggagtcggtttcccggtcatga

SEQ ID NO: 33540 - DNA, 894 bp, Glycine max
  Peptide Sequence Number=SeqID_150318
atggagataatagatgtcaaactatctcaacttttgttagaggctcgaaagggactggacagttatcaacttgcatgggagttggagaatgcatgggaacaaagtattaaatcagggagtccaattgacattgattcttccctaaggagctacgagagagaaagaagactacgagttgccattattcatggaatggctagaatggcggctctcatggcttccacttacaaggcatatctgggtgttggtcttggccctttagaatttttgactaagtttcgtataccacatcctggaagagttggaggaaggttttttgttgacatcatgatgccttctatgttgagctgggtcttaggtggcaatagcgacaaacttgagggcagaccactaagttgcaggctcacagacaaagcaaatgatcagttacgtagatggtttgaagatgatgaagcactcgagcgtgctattaatggagaatggattttattaccgcatggagatggaacaggtctttcaaagcctatatctttaagtcgaaatgagatgaaacccttcataatcgggagtgcaccaatgcaagataattcaggcagttcagttacaatttcttcaccacaggtttctccaacgcatgctcgaattaactataaggatggtgccttcttcttgattgatttacggagtgagcatggcacctggatcattgacaacgaaggaaagcagtaccgggtacctcctaattatcctgctcgcatccgtccatctgatgttattcagtttggttctgagaagcaaccaagttatgtgcaggtttcgttccgtgttaaggtgacaagctctgttccaagagtctcagaaaatgaaagcacactagctttgcagggagtatga

SEQ ID NO: 33541 - DNA, 282 bp, Glycine max
  Peptide Sequence Number=SeqID_150319
atggagtcccaaacccctttggctgttgggaagcggatgaaattccccaccagtgagggatccattgagttgatcaaccatcctttcactatagcgttctcagttcgccatttacagaatgtcgaatcaatttccgacgacaaagggaatgatccgtcaatatatcacagtttgtctttgcctgagatatttgccaaaatggaatcggtagcggaagcatttgatggctactttgtggaatcaccaatcgctgaggaatcaaccatctttgggtcccaataa

SEQ ID NO: 33542 - DNA, 582 bp, Glycine max
  Peptide Sequence Number=SeqID_150320
atggccacgcttagctttggaatagccacgacaagtctgagtgctgccgctggttatcgtagaagaagacccacaattgtgtgtattggatggtctcgtgatgttcccgatactccgcaatacctcatcgaatacttcctcgacactgaagctcaggagattgagtttgagattgcaagaatgagaccgcgattgaatgaggaattctttgcacaactcaaattcgagttaacaaaacacaggttcctacacatggaggatagacagattgagctggaggctctagagaaagccatacaagaaggattaggtttgttagaatataagctcacaccttgctcctatcttctaatacagaagcctatgacaagatgcaagttgctggagatggttgaaaagaatgaaattaatagatctttattggcacttcaagatgaaaacatagcaagtgcacaaaagggcaaccagaaacaggctgcagaatacatggagaagctccgcggggctgttcttagcttgattctgtacaagcttgaaggatggatgaaccaagtgtacttggtgtcagtaaaatgggtttaa

SEQ ID NO: 33543 - DNA, 1080 bp, Glycine max
  Peptide Sequence Number=SeqID_150321
atggtatccaattcagctcttcaaggggagtccatgaatagagagctaaattggtacttggtggctccatcaccagctattgaaaagaaacaaattggagagcatgaatctgaagttgaaggagtaatccatgatgaacctatagaaatgcaacatttaaatataactgaagttgagtgtaaagaggatccttctactaatgaaggaactgctagtgaagaagttcccgtcaatgaagactatatcgatcaaggaagtcaagagccccctcttttcataatacccgaccctctcacttggaacaatcctgaggttgacgtgaagaacgcttttctccatggagatcttgaagaagatgtttatatagatatcccatcgagctatatgccctcttctggaaccaaggtgcatctgcaaggaaatgtgacaactgtaattatttacgtagatgacatgattattattggagatgatatcgaagaaatttcaagactacaagagcaattgacaactgagtttgagatgaagaatttgggtggacttcaagtggggctgctggactgcaaaccaacagatactccaacaatccaaaatcacaaactttctcaatacacagaccaagtgcacatgaataaaggaagataccaaaaattggtggggaaacttatctatttgtcacatactcaccttgatattgcctatgccaataatcacttgagtgttgaagggtacactgatgcaaattgggcaaggaatgttatagacagaaaatccacatcaagatacttcacatttgtggaagggaatttagttacacaaagaagtaaaaagcaaaaagtagtggccttgtctagtgctgaagctaagtttaggggcatgaccaaaggactttgtgaactattatggctcaaaaggttactaatggagattggctttggtcctagcatggagatgaacttgttctctgacaataaagatacaattgatatctcacaaaattctatccagcatgatcaaacaaagcacctggaggtagatagacatttcatcaagcaaaatcttgacaagaagattatttga

SEQ ID NO: 33544 - DNA, 564 bp, Glycine max
  Peptide Sequence Number=SeqID_150322
atggccctcaattcattctcaccactctcagttaattctcttcacgtatcttcaatctcaagttccaagatttcgcgttctctttcaaagtccttccccgttgtgtgccaaactaactccaacagagatcatcgtcaaggaaatgtggtttcggccacgttggcggctgcgattattgccttcagctctgacatgtctgcccttgctgatctcaacaaatttgaggctgaaatgaggggtgaatttggaataggatcggctgcgcagaaagcagtgcatgtcaatgaaaatttcagagccaatttcacagctgctgatatgagagaatctgattttagcggttcaactttcaatggtgcctaccttgagaaagctgttgcatacaaagcaaattttccaggtgtcgatttaagtgatacattgacggatcgcatggttctaaatgaagccaatctctctaatgccattctccttagaacagtcctcacgcggagtgaccttgggggagccatcatcgaaggtgctgactttagtgatgctgtgttggatcttcctcaaaagcat

SEQ ID NO: 33545 - DNA, 261 bp, Glycine max
  Peptide Sequence Number=SeqID_150323
atgaaggaaacaagcctgaggtctgcagagccaaactgcgcagccgatcctattccaaattcacccctcatttcagcctcaaatttgttgagatcagcaagggcagacatgtcagagctgaaggcaataatcgcagccgccaacgtggccgaaaccacatttcctcatttcgtggattctgcattggaaatttggcacacaacggggaaggactttgaaagagaacgcgaaatcttggaacttgagattgaagatacgtga

SEQ ID NO: 33546 - DNA, 654 bp, Glycine max
  Peptide Sequence Number=SeqID_150324
atgggaggcgttgggtcacaaagtccagcgaaggccgcagtagatggagctgcatgcaatggaattacattcaacacggaactgcactatggtctaaaattgcggaaagttcctcatgttgggttcaactcagttcctaattggcttctcattcttaaggaagagaagtttttcactcgctgtttgattcatgactctgtaaagaagaacattttatgcttagattgctgcacaagcatttgcctccactgtttgccctttcaccgctctcacgtccttttgcagatacgaagacgcatgtacaatgacgtattacgccttggtgatgctcagacattgttgaattgttcccctgttcaattcaccgatttcaaattcagcagcgaaatcctgcaaagtatatcaacacctctctgtggctcgggaaccttcgagaatctctccctttcccctccctcttcgcgaaggggtaatctcggaaacccatgcactcccgaggcagattggttcggagcgacgcgtagaggctcgagtggactatgctccgcttcgggtccaaaccttgcggttccgaatccaactccggagtgtacacccaggtgccacccacttgctcgaaaaccaccacgccatgcccttctcgccggagattaa

SEQ ID NO: 33547 - DNA, 1956 bp, Glycine max
  Peptide Sequence Number=SeqID_150325
atgggaagccccaacacaagaaccagctcctcgtctgattccgaactcccttgctctaattacattccggtacccgatggaccccactctcccgcagaaccagctcgaagagaggtgattgtaatcttttgtgggttgctggtgcttgtgtccttggtggctttcaatggttacagctgggcgcattcaaatggacatgatggagatcatcatcatgcgtcatcatcattgccaacaacgttgttaacagtaacacccaatgaattggaactgagccccgacacagtgccatggtcaacatggcagacgacgctttcacgtggcgtgtctgcaggggtctcggagaagtccagctggctattcaacagcaacaatgggaacggggaatcgtatccttggaacaatagcatgctgtcatggcagagaacagcttaccatttccaacctgagaagaattggatgaacggtccaatgtactacaaagggtggtatcacttcttctaccagtacaatccaaacggtgcagtttggggtgacatagtttggggacacgctgtgtcaagggacatgattcactggtttcaccttccacttgcaatggtggctgatcaatggtatgacaaaaacggtgtgtggacaggctctgccaccatcttacccgatggtcaagtcatcatgctatacactggttccaccaacgagtcaatgcaagtgcaaaaccttgcataccctgcagacccctctgatcccctccttgttgattggatcaaataccctgcaaatcctgttctattcccaccacctggcattgatgccaaagattttcgtgaccccaccactgcatggatcacctctgaaggaaagtggcgcatcagtattggttccaagcttaacaaaactggcattgccttggtttatgataccaatgacttcaagacctttgagcgtgtggagggagtgcttcatgttgtccctggcactggcatgtgggagtgtgttgactttttccctgtatctagcaagggtgaaaatggccttgatacttcaatcaatggggagaatgtgaagcatgtggtaaaggttagcttggatgatgatagacatgattactatgcactcgggacttacgatgagaagaatgttaagttcacacctgatgacttcaacaacgatgttggtattggactcagatatgactatggtatattttatgcatccaagacattttatgatcagagtaaggggaggagagtgttgtggggttggattggagagtctgatagcgaatacgctgacgtggccaaaggttgggcatcagttcagggtattccaagaacagtggcacttgataagaaaactggtagcaacttaattcaatggcctgtggcagaggtagagagtttgagattgagaagcgacgagtttcaaaatttgaaggtgaagccagggtcagtggtgccactagaaattggaacagctgcacagttggacattgtagctgagtttgagatagataagaaggccttggagaagacaggccagtccaataaagagtataagtgtagcactagtggtggatcaactgagcgtggtaccataggaccttttggtcttctagttttggcagatgatgatctttctgaatacactcccacttacttttatgtcgtcaaaggaagccatggacaacttaaaacttccttctgctctgatcaatcaaggtcttctctagcaactgatgttagtaagaaaatctttggaagctttgttccagtactaaaagacgaaaagttgtccgtaaggatattggtggaccattctatagtggaaagctttgctcaaggtggaaggacgtgtgtaacatctcgagtttatccaacgaaggcaatctatggagctgctagattgtttttattcaataatgctactgaggccactgtgactgcttcagttaag

SEQ ID NO: 33548 - DNA, 330 bp, Glycine max
  Peptide Sequence Number=SeqID_150326
atggaaatggtgcacctgaagattggccatatcattcgctattctttctttggctttaaagagacttttggatttactccatcatggcttttgtggcttagatatagcagcttcttagttttgtatccaacaggcataagcagtgaagttggtttaatatacattgccttaccattcattaaggcgtctgggaagtattgcataaggatgccaaacaaatggaactcatcatttgattacttctatgctgcgattgttgcaatgggaatctacgttccaggcatgagcaaaacatccttctcactgctgacaatgatgtccttaggctaa

SEQ ID NO: 33549 - DNA, 138 bp, Glycine max
  Peptide Sequence Number=SeqID_150327
atgaagaagaggaagacactcatggcgatgatgaccacaacaatgggaggcaccaatgacgggcgaactgcaaatcaagtagccagtggcggagcttcaactgaaaatgagggggagccacaaaaagatttaatctaa

SEQ ID NO: 33550 - DNA, 3087 bp, Glycine max
  Peptide Sequence Number=SeqID_150328
atggacaaggtttatgaagagctcgatgaagcaaaagcaaaaattgaggaactcaaggaagaactaagagccaagacagattcacttgagaactggaaaaaatcccacaatgcacagatcaatcagatacaggaagcaaagttcaaagctgagaagctggatcaaacactgcttcaacaagcagatgaaatctccgaggcaaagctggtttgtgaagatctcaaagggaagttgactaaaaaggagtccatcatcaaacatctcagggctgcaaatgataaacttcgagtggattgtgatgccaagttcaaaaagtgggaagaagaaaaaagagagttggtgttagccttagaggagggaaatgagaagacacaggaccatgaacaacagattcatcaatacaaacaagaaattgaaagactgaaaggttgtctttcagtttcaaaggagaagtgtgtggagacagaaaaaaaatttaaagcatccaaagaactaagagaaagagatgacatgttccagaagttagaggaggaatgcaggaaggcggaagatcaattaaaatggaagaaggaacagtttaagcatctagaagaagcacatgaaaaactccgagaccagtttaaggctagcaagaaggaggcagaggtggaaaaatctacattgcttgatgggatttcttcacttcagactaggttagactctcagatcagagtatcagaggatttacaacatcaattacacacttgccaccaagctcttgctcatgtggaaagccaaaaaaagtgtctggaagttgaagtttcaaatcttaaagtgcagcttgataatgctagcaatgagtaccaggatgctaggttacagctagattgcttaaacactcactgcgacaaagatattgcagatttgagatatttgctaaagacaaaagaggcatataataaagaatcaaagtacaggattgagaagctagagcaagaaaatcaagagctgcggatgtccctcaaagaactccaggaagctcaaattcaagaagcaggaacttcatattcgcagtcaaagttgcggtccaagctcagaaatttggaacaaactcataaagagtgtgcctctactttaaagactaaagaagctgaatggaactttaagataaaacagttgacagaaaacctgaatagatgtcagtctgatttggaaactaaaattgaagcagtggaagacctccagatggagttagaaaggtctcattctttagccattgagatgatgttattgaatgaggagatttctgtgatgcttcttgtgttgaaacagggaacttctgaggctcaattgaagcttgctggccataaagatgaaatggatcttatcagcaaagctagtgaagagaagatttttcaactaatgaggcagttggagatgaaggatgctgctttgatcagtgcccagaaaagcataaatgaagaacgtgagatagcagcacgtttgatgaagcaggttgagtcttctgtatccaacaatgaactgcattcactgcaaaatgaacttgatagacacaaggaaatgctggaggaatcaataagaagtcagctgatcctcaaagagaacgttttgcagatggaatgtaactttaaagaacagttggagatgaaagatgttgttgtgatcagtgcacagaaaagcataaatgaagaacgtgaggtagaagcatgtttgaggaggcaggttgagtcttatgcatccaacaatgatgaactgcagcagtcactgcaaaatgaagtcgataggcacaaggaaatgcaagaggaatcaacgagtcagccgatcctcaaagagaaggttttgcagttggaatgtaactttaaagaacagcttaaagaaattcatgatgctttcgacagtgtaatcattgaattggatgaaacaatatgtgaaagaaatgaaatggaatttgaattgcaaatatggaagtcaattgttgagcacttgaagaatgatcttgaagaaaatcatgtggtgcgtagagaactggaatcttcacttcttgcacaagtagattttggtgaaagcctcaagcatgagaaagatagcttggtttataagttggaagagaaagagaggagcctagattatctgcagcgacatgttgtgctattggaacgtgagctaatagaaaggggagaatcagcggtgtcctctgagtcagataatgtcagatatctccagatcatagcggagaaggacaagattctagaagagcttcagaaagaggttgtatggctggaacaagaatcatttagaaaagaatttgaaagtgctgtgattgagaaaggcacaatggaaagaacctttgagcatgagaaagataatcttatccagattgtgaaaggaaaagacaggagaatagatgaactcatgcagcaggtgacttcactggagcaacagttcactaactcattgaccaccttttcttcacagcttgctgagaaacaggctgaaattaacctcatccaggaagcttgttacaagatcacaacatctcagattctagctgcacttgaaattgaagagaagaagtttatggtagtggaacttgaggatgatattcatgctatacagcagaaactgaaattgcaggaggaaaagtggagcccatcagagcaacttgcattggatactgaagtagaattgggtgcaaaacagttaaaggcaatggagttgaatgatcaaatggagtctaagctaagaaaatcagatgctttgcttcataaactcaagatggagaatagaaatttacttgaaagtgccacgagactgtcatcggaaagggaaagcttgttggcaaatgttcagggattcagtgataaaatctgcgagttctctactgcagacactatactaatggacaagttgagaagcatggtgcagtcttttgagaatggttgtcccgtaatgaagttgaaaaaggatgatggtttccttgtaaaagagaataatatgttgattcagtctcccacgaggataaagaaacttgaagccaattctgatactagatcaccattcaaggagctaaatttgctagaagaatag

SEQ ID NO: 33551 - DNA, 807 bp, Glycine max
  Peptide Sequence Number=SeqID_150329
atggagggttcgcgacggctacggggacattctataggagttttcagtgaagggattggtttagttttatttcgctggtcgactcttctaacggctgttgagaatgaatggggtggccacgagtcccgtgtcaaagccgatcaacttgccagtgacattctttcctggttcactcaatccaaagagccactttatattgatgacttagaagacatactggatcaaggtatgctttctctcaatgtagaggtggaggatggcagcattgaagaggtagctgaaaaactaatggttatgcacgaagaattcttagaagacaattttagttctttcgaaaatctcaggaaagccaatcttgagcatgctgctcgtcctcctgtaccacagattgtaaatgatgatgaagacgatacagatgaagatgttggtaatgatgaaaacatgattgtggatgataattcttcaaacatgaatccggagacttcaacatctgttgcaaacacgaattcagtgaacaggtcagttaatggacctctgccaaaggtttcaggtgaagcagatgatggatgggttgtagtttcaaacagaagaaataagggtcacatgcgcagatctaagaggtgcagaggtgactgcggtgtgcaacttatggtgtcatggttgggtggtgcacgtttcgatcttgagaaaggaggtggcgatgtgataaggagggaagagggggtgagtggtggaccgtggtggttgcacagagatggtgcaccaagcaaaaaaatgggatgcttttgctttgtgtacaaagtttga

SEQ ID NO: 33552 - DNA, 510 bp, Glycine max
  Peptide Sequence Number=SeqID_150330
atggcagcggaatggagaaggaagagagagaggagatgccacttcaaggagaagatgagtctagaagaagctcaccaccataggaggccatggataagagcttggaggaagaaggagatgaatgaagggagaggaagagaagagcacgaaattttatgctctaaaagagctctgaaatctgaagtgccggagggtactggagtggcaggagtgggagctggtggtgttggaggagcggaagaagagggagctgaagtggaagcatttgatggtcaccgagccctagctttgtgggtccccagaaaggtgatcgtgggatcatctggggctcagggactcgaagatgacgctcttctccgaaagaatgttccgggagtgaacattctatgcatatctctcccaggcgccctcagatatgaatctagtggtatcatagggctcccggggtctggaggcattagcttccctcttcctagaggccatctgcatcaaaagaatcacaagaattga

SEQ ID NO: 33553 - DNA, 306 bp, Glycine max
  Peptide Sequence Number=SeqID_150331
atgacagatcctcttctagggtttcccaacacgctaagcgagctgttacaaatcaaacaaacaaaccttggagtctatattcaacaaaccaagtctgtgaaggagctcctgaagaagttcaacatgcatgatgctaaggagatgaaaacacttatgcatccaaccatatggcttggactagataaggaatccaacaatgtggacaaccataagtacagaataatgtttggatcattattgtaccttacaacatctagaccttgttggacaagtggcctcaataacttaagggggagggtgaattaa

SEQ ID NO: 33554 - DNA, 195 bp, Glycine max
  Peptide Sequence Number=SeqID_150332
atgaggaatggagtggggaagttggaaggagtgcgggtggaaatgttggcaggctttgttgtcacgcctgcaaaatccattgggaaatgcgtacatcttctgagaggagattcaaatgacttaactaatgacagagaaaagacaatgagttgggataggccacttctgccagtgggacaaaaaattgacttataa

SEQ ID NO: 33555 - DNA, 366 bp, Glycine max
  Peptide Sequence Number=SeqID_150333
atgtcgtccatgctgcgcttccccttctcgtttcttcagccccaacggcctcaattccctcgcccattcactgcattcgccgcagccgccgccgtatcctcctccgaccgctcctttctccggaatgctctgaattccttcttctctgttaacccatcaatgcctctcttgggttctctgagtttagccgacagtggggtttgcgtggttgaggcaaaaaccggaacttcgttcccttcgattttagacagttctcagaaactctgcggaattgggctgcggaaaaaaaacgttttgggattgaagaacattgatgtatacgcttttggtatgacattttattttcctcaaccctcactagtttaa

SEQ ID NO: 33556 - DNA, 135 bp, Glycine max
  Peptide Sequence Number=SeqID_150334
atggcggaattgtgcttggtacccgacgtgatcattcctccaaagtttaaggtgccagatttcgataacgcccttgatgatcgagagagagatgattaccgcgatggtggatacattgccaatgttctactatga

SEQ ID NO: 33557 - DNA, 180 bp, Glycine max
  Peptide Sequence Number=SeqID_150335
atgatgcctatgatgaagttgagttgtggctggatttgtgaatcaaattgccatatagggaaatggaaaggaggattggtgtcatcccttgaagaatttgagtcaagaagcaaggggccaaccaccttaaatcggactaagaagctctccaaattgagtgaaacaccacagggagaatag

SEQ ID NO: 33558 - DNA, 105 bp, Glycine max
  Peptide Sequence Number=SeqID_150336
atgttcatggaagttggtattgctttttcctggcagctataccatgatggcaatgataaacaatacacgttggaggatttattggttgctaaggtagcgggttag

SEQ ID NO: 33559 - DNA, 261 bp, Glycine max
  Peptide Sequence Number=SeqID_150337
atgtcgctgcatgttctctatctttatgcgttttctagatttccccccagggatttccggtccgttgtatctcttgttacgatctttcaaagagatgaacatggattcgaggcttttagtcctcacgggcaggatcatcttgagctaccttctggggggtacttaaggatgaacgcaagcgggggatggggtcacgaccgaccgatcgttgccccttttctgtgcgaaacaaagcagggaatgtcgctgcaaggcagcccc

SEQ ID NO: 33560 - DNA, 375 bp, Glycine max
  Peptide Sequence Number=SeqID_150338
atggaaacacaaacaacagggagaaagtggctcacctcgacaatgtcgcgagctgaagaagaagaagacgaacacaccatgggacgcgtcgcaagcacaaccaatggagatgaggaacaacggcgcacgggctcaccaaggacgcagcgactgaagaagctgaggaagaagggagctgctgaagatgaagcgaagaagaagctgaagaagaaggtgaggcgtgaaaaaaaggaggttgggtgcacaaaaggtgtggtgaaggtgaaggtaccggtgttgagcgttgtggtggtcgtcaacgacatacaaggtacgcaaaaagtggtgcctctgttggagacgtacggatcagttatggatcaagttgattcgtaa

SEQ ID NO: 33561 - DNA, 579 bp, Glycine max
  Peptide Sequence Number=SeqID_150339
atggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccgattggaaagaactctcggttaaaaagaaagagagtacaaccactcttagaactctcagtaactccaagagaatacctttctttaatgaaaaagaaattacagaagctggaacaggaaagaggtataatagcccagcggagagtagaagaaggaaataa

SEQ ID NO: 33562 - DNA, 540 bp, Glycine max
  Peptide Sequence Number=SeqID_150340
atgcagattttcattgaagccataaatttaaacatttgggaagcaatagaaataggaccatacatacccactgtagtagatgaacatgagatgaaactccaacgtcttaatcataatgaagaaaccgacaaaaagaaaagaagtatagcccttaaagcctcatcatcaatgcaagaagaaaatgaagaagaagattcagatgatgaaaaagacttctcattctttgtaaagaagtttcagaaatttatcaagaaaagaagaattgacaggtgtcaaaacttcaacaatggaagaaaatcacaagaagactctcaagttgttagatgttgcaaatgcaaccaacttggtcacaccaaagctaattgtccttcaaatgaagaatggcctgagaaaagtgataagaaaaggtatgatgaaagaaggaccaagaaggcctacattgcatgggatgacaatgattcatccgacggttcagaaaaggagatcaaccttctaaccaaggatgatgagagtgatgagaacatttatcaagaagattaa

SEQ ID NO: 33563 - DNA, 291 bp, Glycine max
  Peptide Sequence Number=SeqID_150341
atgtgtgttgtgccaggtcagtgtgcggccgactacatgaactggttcttcgtcatttctcatccattcaagaccacggcacagccatcagatccgccgcgagatccacctgcgatgcatgatgcctcatttgtggagccacatatccctcaggtcctggagccagtagcaacatcgacacatgcccgttctgaggtggatgagcctatacatgcagtggaggcttatcatgtgatcgctgaaaggttggagcgtcatctcaacctaaggatagtcatgccaggcacatag

SEQ ID NO: 33564 - DNA, 798 bp, Glycine max
  Peptide Sequence Number=SeqID_150342
gatggagggaagtgtccttatattcatgatccctcaaaaatcgctgtctgtactaagttcctgaatggtttatgttctactcccaactgcaaattgacacataaggttattccagagagaatgccagattgttcttatttcttgcaaggcttatgctcaaatagaaattgtccatatagacatgtcaatgtgaaccccaaggcatctatttgtgaaggatttctcaaggggtattgtgctgatgggaatgagtgtcggaagaagcacagctatgtctgtcctacttttgaagcaacaggaacctgtactcaaggaaccggatgcaaacttcatcaccccaaaaaacaaagcaagggaaagaaaaggaagagaactgcagatcagaacaacagtagagggcgttattttggttttattcctgctgatgtttctaaatctgggatgatggtggctccaaagcgacatagacagaatggtgaacttgaagaggaactttctgactacatcagccttgatgttgtgaatgaagaagttgcagatgtggtcgatcaatcatttgagccagcagctttctgtgacaacgattccttggatttacagttggatgattttgatggacttattaaaccagttcttctgttgaaaacaaagttcacattgcaatcacctcagtctagtagcctccaagcttttaggcaagtgaaggggtcgatgtgcaatgttgcgatggttggttcgacgtcggcggcaaacaagataagcattgttggagggtgtgtgggagggggtggttcgtga

SEQ ID NO: 33565 - DNA, 5199 bp, Glycine max
  Peptide Sequence Number=SeqID_150343
atggatcaacaccacttcctccaccaccaccactatcaccacccccaagaacaccgcaatcgatacacctccctcacacctcaatcccacctccacagtcaccaccacaataatcttcctccaccaccgccaaatccttctccgcctctttcctaccaccgcacaccgcaaccctacacccctcctacaccccaaccccaacatcaacaacaacaattcccttatacacccctcccagaccgccctctcgaagaagaaccccaacctcaacgtcatatcccatacgatcttctccctcgccgcaccaccaccctcccctggaaccctaaccctaaccctaaccctagaattcctgatgatttcgaccgcgattatcaccacaaacaccaccgccctctcccgccgcccccgctcccgatcgaatcccaccgctacgaccccgaccggcaccaccaccccgtggatccatatgagcagaaccctagggagcccctcgcgtggggcggcggtggctaccacgcgccgggccagggcgatgtggaccccacgtcctacgtccgtgtgtacaccgtggagtccgacgccgacgtggcggggagaacaacctccaagagatgggtaatgagtgatagggatagaggaagagagatgcacgagtcttcttctggtttagtgagtagtaatggtaacagtgagaagtattatcatggttctgagaataatatgatgggtaggtatagtagagggaatagtagagagtgtggtcatactcacgaatttgaacgcactcctccgaagaaacaggtacagaagaagagtgctcttcttaggattcagacggttaaacctaataataatcataggaaccgcgagaatcgcgaggttgagcagttgcggtacccgggttatggttctgagaatggaaatggtttttacagggggaaggagcagtattttggtcatggggtgaagggggaagagagagaggagagccctgttgagattgatatttcttttgagtccaattcgttggttgcgaaggcgaaggcggttgtggcgccgctgccaccaccttcgagttcagtgtcggttcctgatttgaatgtgatgccggtttcggattcggatttggtttacggggagaggagtaaaagggtttcaggctctgaaggagattattctggtatgcaattgccgcaaccagttagaatgtcttcggttgttgtggatttaaataggtcgccttgcaaagggaatgatagctctggttctaggaaggaggttatcaggtcgaacaagaagaatgttgatgatggttcttctcggtctcgcaccagggaggctgatggttcccgtgggaaaaaggaggtgcctaattttgttaaggttggcaatgttgtttctggtaaattgacctcgaagattgtcaagaagaagaaaattgttaagagagtggtgaagaaaggtactgcaagttccaagtcatctgcgtcaaattcactaccggctaaaacccttcctggaactgtgaaagcggagagtgttgcacgtatttcattgactgcctctggtcctgagaaaattgaagctaatttggatgagaaaagcaacactgtcatccaaagcaacactgttgatgaggaggctaagcctgactgtttgccccctttaccaaaggaagggaatgtattgaaagaagatgcagaggtaggcttattgcagctgagtttggggccagattccaggtcacaagagtgtaagagtgacaaagattctggtattgggaaagtatccaggtttgaaagagatggaaacatttcaaattctctatcttgtgcttctataagtgaagataaaaagagtgattctgattgtttagatgcaaatgattctgtccatgacattggaaatactatttctgttcatgataatgcaaatacatctgattgtttagatgcaaataattctgtgctaaatacttacaaggttactaaatcattaagtggaagtaatatttccgtagtcactaacatcgattatgataataagcaattatgtcagaatgaagtgtctctatcacctgggaaatattcaaatgtaggatccccacagaataggaatcttgaagatgtaggggatgaacttttgaaaagcagtgataccttttcatgttcaggaaaaactaggattcaggatggtctagattgcctacaacatgccagtgcactgaagcacagttccgataatggatcatctaatttagaagatagtacttgtgttgactgttctggaattatgcattgtgctggaaagcaagtgtcccctggtgatgtcgtcatatcccctgagaattgggacacagaaaaagcattcccaaattctaatatttctgctggatctggtgaaggggacacaaataagataaaaaaaagaagagctagaacactcttaaattttttgagttcagagatggagtgcttatcttcaaaccatgtaaatccagacagccttgcaaataatgtggatggaggctctagtctgttgttgaaagatccatctccttcagaagttttagagcaacctgttcaaagcttagattttaactcactatccggcgtgaatggggttactgctttacatggaaaagggggggttttagaggctcagttttgtgttggacatattgacaatgatgatgcaaatgaggtttcaccagcttctaaaaggaaaaaagtcacagctaacccaaatttcacaaaatgtcaatcggaattgagtgctgtgattgtgccttccaccacatctgaagctcctatgagtttcagtgataaccaagaacatcagaaagaagttgcttttgaaagcatgggtatgattattctgtctagtgctcagtcaatgccttattcagaggatattactaaaatgcctgagaatgttttggctgggggatcttttgagtctattgatgcaaataaggaaaccatgagttctgagcatttggaattgtggcattcggatatagtctctttttcaccatgtgaggacttggcatttccaaatgttcagttctcatcattggaaggtgagtgcaaagaaaacactactccaattgtgcctacaagtaatattcaaacagatattttggctgtgggaaatatagctggagaaaagactgatttacaggccgttgaagaaaattaccagtatagagagcatgtacaaaggtcaccaagagctgatatggaacctaatgatcacaatatgaagaatgatttgcttgctcagtggaaccttatgtcctgtccagccagtggtgatgaagtcactacaaataattcaaatgacgaagtgattgaggatgcacctggattatcagatatgttttctcaagggatggtatctgaagtaccggatagaagggttttagaatttacagcaatcaacgatgaaaatatttttggagttcaagaaaatccagataacatatctatggttggacatgattccaacttaaatacttcatcaatacagcagactaaaaaaaatatgaagtcagatcatgcaattgaacatagtaacctgatcacaaagaagacaatgtcagaacaatcccaagtttcttccaaagttacaactcaggctctaaattcatattgttttgggttgagtgggaccaaaaatcagtcaggtagtatcattcccaaaacttttccaggtcattctttcaccttttcaaagacatctgcctcctcacctcatgtatcaaagcctcgaacttggcatcgtacaggtaataatcctccggcttctctacctagaatcaagccttcattaggaacagttcctcccaaaaagccaattctagaaatgaaagggaactttcaaaatacctcctatgttcgtaaaggtaacagtcttgtaaggaaacctactccagtttccactctacctcatatctcctctgttaatcagacatctttgggcatagatgaaataccaaaaagcattaaatctggagggagggctgatgtgacagataaacaaatgtacttgagaacaggagcaacaaatgctccacagcagagaacacctccactaccaattgacaccaaatcagaggaaaatacatcttcctcattggtagaacctccttctggtggttgctgtgaaaatgcatcagaccttaggaaatttatagaaactgataatattgcaccaaactcttctgaagatgcactgaagcattatgaaactttagaaaatcaacctggtccatctgataatggggatagccaaggtgaagcaatcgatggaaatgtttttcctttgaatacaaagagaatagtatacataaagcccaaaacaaatcaattggttgcaacatcaaattcttgtgatgtttctgtctctactgatgacaatctccaaactgccttctctgatggctactacaagagaagaaaaaatcaattgattaggactacatttgaaagccatatcaaccagacagttgcaatgtccaataacacggcatattctggcggacaaggaactagcaatgctctttgcaacaggaggtttagtaagaggcggacacataaggttggtaggagttcatgcaaacgttcaagagcctcattagtgtggacactctgtagcaaaaattcttctgaaaatgacagggactcacaacattatcaaagggctttacctcaattgtttccatggaaaagaccaacatttgcttcaagcttgaataacagttccttatctgcaatcagcaaaaaattgcttcagttgagaaagagggatacagtttacactaggtcaatccacgggttttcacttcagaaatccagagttttaggtgttggcgggtgtagtttaaaatggtccaaatccattgagaagaagtcaaagctagctaatgaggaagccacacttgctgttgctgcagtagagaggaagaggagagagcagaaaaatgcagtttgcatcagttctcagtcaaagagtaggaagcattcttttcacgagtgttcgtcgtatcataatgccgacaactctctgtttttgtgctatttaatacttatgcttcatgagagcgtatatttcgcattggttcagttcgctacagaatggatccttccaggaggacacttcagaggatttcaggtggtcaaattttttatataa

SEQ ID NO: 33566 - DNA, 1119 bp, Glycine max
  Peptide Sequence Number=SeqID_150344
atggaaggcttaccaatactcattccaacaactctagaggaagggggtagaggtagaggtagaggaagaggacatggagatcgaggaaatagagatttcagcaataattctaaagacaataatgatcaatttcaaggcaatggtagaggaagagatcatgataaatcaaaggtacaatgttatagatgtcataaatttggtcattatgcctctaattgttatactagattgcctaatcttaaagaaaaaggggaaagttcaaattttatcaaggagaaagaagtggaaaccttattgatggttgttgaagatgcaaaagacagcgaggcagaaatctggtatgcagacattggttgtagtaatcacatgagtggaattataaaaatgaattcaaacaggttattcccactaaaaattgaaagcattcattcttttttaatggccaaagatactatttctacttggttgtggcattatcattatggtcatttgagttttagtggattgaagacccttgaacaaaaaaacaaggtgataggtcttccacaaattactgctccttctcaagtttgtgaagaatgtgttgttagcaaacaacatcgttctcagttccctaatggaaagtcatggagagaaaaatgtgttttggaattgattcattcatatatatgtggtccaatatatccttcttccaatggaggtaaaaaatacttcattactttcacagatgatttttctagaaatactcgggtctattttttgcaggaaaaatctgaagctctctcttcatttaaaagcttcaaagctcgagttgaaacagaatccgaaaagactattgagtctcttcaaacagactgtgatggagagtattgctcagatgaattttctactttttgtgtaaatcatggaatccagaaggagttgacaatagtatatacaccacaacaaaatggtgtctcggagaggaaaaatagaactattctcaacatggtacggtgcctcttgactaagagtggtgtttcaaaagaattttggcctgaagctgttaattggagcgtgcacattctaaatagaagtcctacatttgttgtgaaaaatatgacaccagaggaggcatag

SEQ ID NO: 33567 - DNA, 204 bp, Glycine max
  Peptide Sequence Number=SeqID_150345
atggggctccagataagatttgatggtggaggacgcacgaacaacgctaggcaatcaattcgtggggctccggacttgatgataagatttgatggtggaggatgcatgaacaacgctaagaaatcaattcgtggggctccggactcgatggtggagaacgcacgcacaacgctaggcaatcaattcgtggggctccggacttga

SEQ ID NO: 33568 - DNA, 348 bp, Glycine max
  Peptide Sequence Number=SeqID_150346
atggggccagcagcgatctcttggtcatcatggaagcaacccattgtcactttatccacaacagaagcagaatttgtagcagcttcagcatgtgcttgccaagcaatttggctaaggaatatttttgaagaagttcactttaagcaacaaggtccaactctcatctattgtgataatagttccaccataaagttgtcaaagaatcctattatgcatggaagaagcaagcacatagattgcaagagtgaagagcatattgctgacatcatgagcaaactattgaagttgtctgcatttcaaaagctaaggaatttgcttggagtctgcatggttaatgaatctcattaa

SEQ ID NO: 33569 - DNA, 476 bp, Glycine max
  Peptide Sequence Number=SeqID_150347
aaagattttgggaaaataacatagatgaaacaaagcaaattcttgcaaactttgatgaagataatgaagatgaagagttacagacaaaggaaatagaagaacaacgaattccaacaatcacagttgaagatgaaagacctcaacgagcaagaagaaggtctgcatggatgtctgattatgaggtaacaggaattgaagatcccattactcgttttgctttgttttcatattgtgaccctacaacctttgaaagtgttgtcaaagaagaaaaatggagaaaaacgatggatgataaaattgattccattgaaagaaatgatacttgggagttgagtgatcttccaaatggacataataccataggagtgaaatgggttttcaaaacaaaattgaaagaaaatggtgaagtggataaatataaggcatgcttggtggccaagggttacaagcaacagtatggggttgattacacataa

SEQ ID NO: 33570 - DNA, 243 bp, Glycine max
  Peptide Sequence Number=SeqID_150348
atggaaaaatccgacaagatgaatttcaaagagaagaaagaaaagaaaggatatatcacttgggaagataatgtcttaaattattcaagtgattcagagaagaaaatcataagtttgggtatcatgatgaaagactatgaaaatggagaagagcaaagtcgatacattgatagcaatttctccaaacacatggcatgcatcaaagtttattcatatttctccccaagaaaagtgaatatgtga

SEQ ID NO: 33571 - DNA, 108 bp, Glycine max
  Peptide Sequence Number=SeqID_150349
atggaggcgcatcccctgatgccactaggcgtagggcctagcagcacgaggtcaccacaagcccatacggccctcaccgacatccaaggtacggagagagaggtttaa

SEQ ID NO: 33572 - DNA, 288 bp, Glycine max
  Peptide Sequence Number=SeqID_150350
atggatgggattctcatttctagtgtggtgttgttggctgattcacgattcactcgaccggatatgggttttcacccaacaaaactcaatttcgtgcctagcgatgcggatgaggcgccactcgatgttttccatttgcctgcatgcctttggtattgtggggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 33573 - DNA, 1251 bp, Glycine max
  Peptide Sequence Number=SeqID_150351
atggttatcattggcaatttaggtgatggttcaataaaatcatcgagcgtattaagtggctatgcatcaggtaaacggattgcatatattcttattggcaagatagggagtaccacacttggcttaggctatgttaccgcctttctggatctgattctttcacccgcgacaccgtcgaatacggcccgtgctggcggtatcgtattacctatcatcaatagcgtggctgtcgcgctagggtcggaaccagagcatacggcaaaacgcgttggtcattatttaatgatgaacgtctatatggttaccaaaaccaccagttatatgttctttaccgccatggcgggtaatatcctggcgctcaaaatgattgaggatatttgccatatcaaattgagctggggtggatgggcattggctggcatattgccaggcttaatcatgctgttactgacaccgcttataacctataagctatatccgcccgaattaaaaaaagtagataataaagccattgccaaagaaggtcttgagtctttagggccgatgaccttgcgtgagaaaatgctctcctgcttgtttgtgatggcgttagcgggttgggtatttagcacttcgcttggggttaatgaatcaacggtggcgatttgcgtcatggcgttgatgctgatattaaaaattgttacctgggatgatgtcattaaaaataaaggtggctggaacacactaatttggtacggcggtatcattggtttgagttctttgctttccaaagttggttttttcttgtggttggccgagttactgaaaaataacatttcatttggcagtcatagtacgctggcattcgttgtcatcgtcgcgttgagtatactggttcgttatttctttgcctcgggcagcgcctatattgtggcgatggttccggtctttgccatgctggcgaatgtttccggtgcgccagttatgttaaccgcgttagcgctgctgtttagtaattcctatggcggtatggtcacccattatggtggcgcggctggcccgaacgttattttatttgtggcaatgttcgtggttggcggcgccttatttgagacaggggtgacggataaaattggcggaatcgttacccgttacgctcgctcagagaagcagctcatcgttattattatgttggtttgcggaatactctctggttttctgtctaatacgggaacagctgcggtactgattccggtggtcattggtgccgcg

SEQ ID NO: 33574 - DNA, 705 bp, Glycine max
  Peptide Sequence Number=SeqID_150352
atggaagtgccaaagctaggaaaaaaggcagcaaaaaaggccgtcgaagaatggggtcaaccaaaatccaaaatcgcccacctcatcgtttgcaccacaagtggcaatgacatgcctgatgcagattaccaactcaccaaagtcctaaaccttaactcaaatgtgaagtgttacatggtgtaccaacaaggttgctttgcgggtagcacgattcttcgcttggccaaagacctagtcgaaaacaacaaagacagcctcatgggacaagcaatctttggagatgttgttgcagctgcgattgtagggtcaaacataataccaaatgttgagatgcccttgtttgaactagtgtggacttcacaaataatagtgccaaatagtgaaggagccttgtcatttcaccttcgtgaagcttgcttgacatttcaccttcacaaggatgttcctgagcttattccaaacaacattgaggatgttttggatgaagcatttaagtcattcaacattttttatgattataactacattttttggatagttcatccaggtggactagccattctagacctagttgaagaaaagttagggttgaagccagagaaaatgcgaggtagtaaacatgtgcttagtgagtatggtgttctatttggttttggacctggagtcactcttgagactattgtccttcgtagtgtggcactctaa

SEQ ID NO: 33575 - DNA, 681 bp, Glycine max
  Peptide Sequence Number=SeqID_150353
atggaaccaaaaccaacaacacctttacactacaaagcagcatggcaaggcttcctgttacgtgcagaacatagtttggttgcgcacaaaaacgaaatcactcacaaaagagacaagagcatgaaacagataatgacaaacaaatacaactcagtagctgagatcaatgctgagaaaaagagttggagaatcatggttagggttgttcgtttgtggatggtattagatgttttgactaataaacaaacatctagcaacaaaataccattttccatggagatggtgctggtggactcaaagtactccactaaggttgcattggtggacaatgcaagtgttccatactctgcgtatgattttgtacatataagagacattgtttgtggtggttatgacactgattatttagttgataaaatacatcttcaaaattgtatttgtggaacaagagttgtgttcaatgctaaatgtgaagaggtaaaggagttggcaacaagaatgatggagtcaccccctcaaggtctaagtcagataattgactctattgcattaactatgtcagaggattttctacataatacaaccaggaaaacaattggtggtcttaaagattgttttgaggtgacctgttttccaatatttggtactgtgaaatatgttgtagatgatgagaaatggtag

SEQ ID NO: 33576 - DNA, 447 bp, Glycine max
  Peptide Sequence Number=SeqID_150354
atggtatattgcagcataccccactggtgggttaaccgaaaattagggttttcaaaccgaaaagttttccttctttggaagggtcctcttggagctagctccaccaagatctccgacagagaaaatcacatgggttttgttctggcgtccaagctctttttgtatcgtttcagttctcacgttctcctcctcctcctcactgcgctacaacttccattctcctccttctcacgactctcactcttgctctctcactgtgactcaactcctcgcgacgacgtgcccatcgtgccaccattgcattctcgctctcttacattgactcaactcctcgtgacgcgtcgtgcccaccgtgtcaccatcacgttctcgctctgtgtctctcgttctcgctctcactcacagctctacacaatctggttctcgttcccgaccatgaaaggttag

SEQ ID NO: 33577 - DNA, 630 bp, Glycine max
  Peptide Sequence Number=SeqID_150355
atgactgaacgtgtttattacgccagcgacgccaccgaagggcgcgcacagattatcggctgtcgcgccgaagccgatggccgttacgccattgaacttgatcgtacgctgtttcatccacagggtggcggccaaccgtcggatagcggctggatcgacgagcaggtcgtgacggcggtcgctacgcgcggcgatagcgtactgcatatcgttgagcagccgctgccgctgggcgaggtgaagatacgaatcgatgcctctgcgcggcagctacatgcccgtctgcactcagccggtcatttgcttggactggcaggcgagcagttaggctggcgaccggtgaaggcgcatcactggcctggcgaggggcggattacgtttgctgccggcgctggtgccgcgttgccggaagccagcacactgctgacgcaggtgagcgcgtggcagcagcaggatttaccgcgccgcatcaccttcgctaatggcttgcgcgcggtgggatttggcgatctgccggcttatccctgtggcggtacccatgttgccagtctggcggcgctggggaatattgttatcagccagttgaaaatgaaaaaagggcagatgatcgtcagctataacctcgagtaa

SEQ ID NO: 33578 - DNA, 117 bp, Glycine max
  Peptide Sequence Number=SeqID_150356
atggcggctttgccttcggcagtcttagactctggaaaatatttcttgagaaatttctccacaacctcatcccatgtggctaagtgtgcatatgggtcttcacttggtaaaccatga

SEQ ID NO: 33579 - DNA, 1452 bp, Glycine max
  Peptide Sequence Number=SeqID_150357
atgttctgcttcggcaacctgatgcgcgaaagcggcgtggtggatcggctgagcgatacggtgcagaacgcgctgatcaatatcgtcaccatcttcctcggactgtcggtgggggccaagctggtggcggataagttcctgcagccgcagacgctgggcatcctgctgctgggggtgatcgccttctgcgtgggcaccgccgccggggtgatcatggcgaagctgatgaacgtgttcagtaaacacaagatcaacccgctgatcggttccgccggggtgtcggcggtgccgatggcagcaagggtgtccaacaaggtgggtctggaagcggacgggcagaacttcctgctgatgcacgcgatgggcccgaacgtggccggggtgatcggctcggcgatcgccgccggggtgatgctcaagtacgtgctggcgatgccgccaaacgaggaaactaactatttaatgtctatcggccctatgtctacccgcaaaatcacccactggtttgcaaggcgatcctttcaaaaccgcatcttcctgctgatcttatttacctcgaccgtcgtcatgttggccatgtcctggtatctgacagacattacagaggaacgtcttcattaccaggtcggacaacgggcgctgattcaggcgatgcaaatttcggcgatgccggagctggtggaagcggtccagaaacgcgatctcgcgagaatcaaagaacttatcgaccccatgcgttcattctctgacgccacctacattaccgttggcgatgcgcaaggccgacgtctgtaccacgttaaccctgatgaaatcggcaaatcgatggaggggggcgatagcgatgaggcgctgtataacgccaaaagctacgtctctgtgcgcaaaggttcattaggatcatcgttacggggtaaatcgccgattcaggacgccagcgggaaagtcatcggcatcgtgtcggtcggctataccatcgaacagttagaaaactggctcagcctgcagataagttcgctactgatcccgatggcgattatcctgctattactgctgtattgcgcccgccgcttctcgttgcatatcaaaaagcagatgctcaatatggagccccagcagctatcgcaactgctcatccagcaaagcgtgctctttgaatcggtgtttgaagggcttatcgccatagactcaaactataaaataaccgcgataaatcagaccgcccgccgtctgcttaatctgagccagccagagccgacgctaatcggcaaagggatcagcagcgttatttcgcaagaggccttcttctacgatgcgcctcacgagaataagaaagacgcgatcgtcacttttaatcagatcaaagtgatcgccagccgtatggcggtgatcttaaataatgcgccccagggatggcctgcagctcagccaggtgcagcagtacgccgataa

SEQ ID NO: 33580 - DNA, 534 bp, Glycine max
  Peptide Sequence Number=SeqID_150358
atgacctcgcttatcgccgatttacgcgctcagggcgtacagcgaatgtggctggaggtgatccgcgataatcaccgggcggtggcgctgtatcagtcattgggctttaccgtgcgtcacgggctgtgcggctatctcagcgcggggcaagcggagccgcgtgaatccagcctggatgagtatgatttgctgagcctgctgcgtcatgcaagcctggagctggaagggcaactgccgtggctgctggatccgctgacctttattaccttgccctgtcgggcgttgacgctgcagcagcaggccttcgccgtactggcgaccaccgccagtaagccgcagctacagtttttatggctgacgccggcggcgcgcggacgcgggctggggcgggaaatgctgctcgcgctggctcaacagtttccgggattaagcacttcggtgaccatcccggaaaccttcacgccgctgtttaaatcggcgggctatgcgccgctggcgctgcagcagtacgagatgtgcctgcgcttgaactag

SEQ ID NO: 33581 - DNA, 357 bp, Glycine max
  Peptide Sequence Number=SeqID_150359
atgggtatccatggagtggtggcgtcttgcggagttgtcattggcaactctcaaagcattttccttcaagctttttcaagaagacttaaccattgttccatattagaagctaaattatgggccatcttttatggattgaccatggctacaaacttggacgtgcaaaatttgattgttgaatccgattgtgtagaagtcattcaactgttggatgagggtgatgtttctagcagccaattcaaatatcttctaattgagattctcaaagtgaaggggcaattccaactatgttattataaacacattattagagaagccaacatgttggttgattccttttcaatggtttatctttaa

SEQ ID NO: 33582 - DNA, 228 bp, Glycine max
  Peptide Sequence Number=SeqID_150360
atgggtcctttcctgaaagataaaggaacggaaacaggggatgagctcaaattgggaaagagaaaaagaatgtttgtgaggcgtggattttcagaatgttcatttgattatatacctgagaagaaaaggaaaacaattaatctatcccgcaagtctaagtattacatgaagaagcttctacctaataagagtggaataactgttagtagcagatttacatcctcttag

SEQ ID NO: 33583 - DNA, 2134 bp, Glycine max
  Peptide Sequence Number=SeqID_150361
atggctgaactgtttaaattgcagcaatcaggttcagtttcagattactatttgaaatttatgtcccttgctaatagatctgaaggattgactgaggaggctattctgaattgttttataagtggcttgaatgttgatattaaacgtgatgttgttgctatgtcacctctaaaccttttgcgagccgttgccttagctaaactgtatgaagaaaagtattgccctacccttaaatccaccaccacatattcaaccagatataataattcatccttcattggcacttctgttaaccaaccacctaaaaatacaccaaaaaccaccctcacctaccctaaaccaaacctaccaccctttttacctaccccttcgagtccaccacttaagaattcaaacattaaaaggattagccctgcagaaatgcaactgagaagggagaaaggcttattctatttttgtgatgagaaattttcatttaatcacaagtgtccaaaccggcaatgctttgtcttacaattgggggatgaggatgctgagaaatctgtaaatgaatccaaggtgataatagaagaaagggagccagtgattgatgatcaccacttatccttgaatgctttgaaaggaggcttaggagtaggcacaattaagttcatggcttatgtgggaactatgctagtgaaggtgttgatagatggtggcagttcagataatttccttcaaccaatagtggctaaattcttgaagctaccaattgagcaggctcctatgttcagagttatggttggcaatggcaattacatggaatctaaagtactgatccaaaatttgactctacaagctcagggtaatattttcacactaccagtatttttacttcctacatcaggggctgatctaatattgggtgcaagttggcttaagaccataggacctcatttagctgattatgagaccttgatggtacacactgatgcaattgctggaatttatagcatgcatgctgtccaggaagatactcattcttttcctttgttggagctgcctgaggacatggaacttgaattgtcactcttgttgcatacttacggtatcgtatttagtactcctagtggcttaccaccacttaggactcatgttcattccataccattattagaaggatcaaatccagtcaaagttaagccctatagatatccacacagtcagaaggaggaaattgagaagttggtggaaggcatgcttaaagagggaatcatccaacccaacaacagtccattctcttctccaatcattttggttaagaagatggttcatggagggagatttgtattggtgttctttgatgacattctagtatacaacagctcttggaaggaccatttgaatcacttggaagtgattggttacttaggtcataccttatcaggtgatggagtggctatggatactgaaaagttggaatcagttaaagattggcctcaacctaccaatttgaagcaattaaggggctttttagggttgactgcagataaggcctttgaagccttgaaattggcccttactacagctccagtgttggccatccctaattttgctgcaccttttgttcttgaaacagatgcttctggttcaagcataggggttgtgctgagccaaaacaaacaccctattgcatacttctctaagaagttgtccctaagaatgcaaaagcaatctgcttatgctagagagttttatgcaatcactgaatcattgtctaaatttagacattacctactgggtcaaaagttcattataaagacagatcagaaaagcttgaaagaactacttgatcaaacattacaaactccagaacagcagcagtggttacccaaatttataggatatgatttcataattcagtattctccaggaaaagagaatattcctgctgatgcactatccagaagctttgctatggcttggtctgaaccttcaaatacatggcttcaaacagtggcagctgcaacaaagaatgatgagtctttgatgaaaatctatcagctctgtagcaacaatgctgggaagagtggcgattatgtattacatcaggatgtgatcatatggaaagggagaattatgttgcctaatgata

SEQ ID NO: 33584 - DNA, 201 bp, Glycine max
  Peptide Sequence Number=SeqID_150362
atgactctgacgatcaagtcagttgaacccgaggtctatatatacatgttcgatcttaaggaagttatgtcttttgaggatttatgtggactaactgtccttctaaatgtcgtgtgtggtcatggggaattgacgattccaatgaaccgagtacttgtcaagtttgtgggctatacggtacataatcccctcaagctctga

SEQ ID NO: 33585 - DNA, 285 bp, Glycine max
  Peptide Sequence Number=SeqID_150363
atggagggtggagagggttggtggagattgatcctaaataggttgccattgcgagataaacttcttcagcgcaacatcatcactaatgcaactgatgctttctgtccgcagtgtaatacgacgcaagagacaaggacacatgtgatcctctcctgctcaaaaatatctcaactctggatggattggtacagacaagaaaatgtccaacaactttgccaaactcgatggagactcacctttggtagcacatgttcccaacaagttcaatctaggaggcaagattga

SEQ ID NO: 33586 - DNA, 354 bp, Glycine max
  Peptide Sequence Number=SeqID_150364
atggccgacaataacacacgcaaagctgccactaaccgcctggaggaagtagtccttcatttcacccaaggccaaaccaccctcaccaccaaccaccaagatctctccgtcaaggttgacgcgatcctcaaatgtttatctgctatgactatccctagcctaacaccaacatgcacactcatgtcccctactttccctcatccacacatcacattagacgttccccgttttgacagtcacaacccattgggctggatttttaagatctctcaattcttcaactatcaaggaaccccaaatgaagaacgtattacagtacctttgttctatatggatgatgccactttaagctag

SEQ ID NO: 33587 - DNA, 309 bp, Glycine max
  Peptide Sequence Number=SeqID_150365
atggtggtgcttagagcaaagtatttccttcatggaaagcctcttaaagcttctccatctcctacacaaagctccatttggtccattattgtggctgccttaccccttgatatgaggggatttatttggagcattggagataggagtaaggtccatgttttttatgacaggtggattctaaatctggcgaggcactctctcgatcctccaaatggttctacaatggatcctattttgaaggttaaggaccttattgagccagggtccaaatcttggaacaacacttccataaactctttattcctataa

SEQ ID NO: 33588 - DNA, 191 bp, Glycine max
  Peptide Sequence Number=SeqID_150366
atggctgatgaatatgggatccctatcataaaaaaggctatgagggaagccatgaagcttatagaccatgtccataaacaaggaagcaaccttaaaggttgtctagtgggaaggaagggcgccgaaatgagcctttttggagaaacgatccaccactgcaagtgtcacagtgtacccctaggagggcagaa

SEQ ID NO: 33589 - DNA, 1092 bp, Glycine max
  Peptide Sequence Number=SeqID_150367
atgagaggactacacgttctcgctttcagagggcaacacgccctcgccttcagaggactacacgtccttgccattagaggggtgcacgccctcaccttcaaaggactacacgtcctttccttcagagggctaaacgtcctcagcttcagagggcttcacgccctcaccttcagaggactacacgtcctcgccttcagagggttgcatgccctcaccttcagaggactacacgtcctcgcctttagatggcatcacgctctcacctttagaggactacaggttctcgccttcagagggttgcacgccctcacctttaacggactacacgtcctcgccttcagaggactacacgtcctcgcctttagagggctacacggcctcactttcagaggactacacgtcctaaccttgatagggctagacgccctcgccttcacagggctgcacgccgtcaccttcagaggactacacgtcctcgccttcagagggctgcacgtcctcgccttcaaagggctgctcgccctccccatcagagggctggatgccctcaccttccgtggattacacatcctcgccttcagaggactacacatgctcgccttcagaggactgcacgtcctcgcctttagaggactacacgtcctcgccttcagaggactacacgtcctcccttcaaaggactacacgtcctcacgtttagagggctacacctccttgcctttagagggactacacgtcctcgctttcagagggctacacgccctcgccttcagaggactacacgtcctcgccatcagaggggtgcacgccctcaccttcataggactacacgtcctttccttcagagggctacacgtccttagcttcagagggttggacgccctaaccttcaagggactacacgtccttgccttcagagggttgcatgccctcaccattagaggactacacgttcttgcctacagaggactacacgtcctcaccttcagagggttacacgccctcgccttcagaggactacacgtcctcgcctatagagggcatcacactctcacctttagaggactacacgttctcgccttcagagggtag

SEQ ID NO: 33590 - DNA, 816 bp, Glycine max
  Peptide Sequence Number=SeqID_150368
atgatgcagtcgttgatgagcatgaaggcttgcgtgggtacgaggttaccagttttaacgaactccgaggcgagtacgaggaagcagcgcgtgaattatccgaaccgtaggtatgggagaaatgtgattgtttcgtgcggtttggagaggaatgggaacgaaggaatgggttcgaacgaaggttcgtttagccataattacgctatcttgaagcaccggatggagaaagtggctaagtccgagtattacgaagaggctgcgaggattcgtgactcgctcaagtgcttcgaagatgaggttcccgttctgcgtcttcggagattgttgaaggaagccgttgctgatgagaggtttcaggacgcagccagatatcgtgatgagctcaaagcaattgctccacattctctcttaaaatgctcaagtgatgcgacaaccttgggaatccgtgtccaagttaagagtgcatatatagaggccagaagtcagccttcagaggaggtatatttctatgaatacagaatcagaattaccaataatacaaaccgccctgttcaacttctcagaaggcattggattatatctgatgctaatgggaaaattgaaaatatccggggaattggagttgttggtgaacaaccagctatctttccaaggagtagttttgaattctcttctacatgccctttaagcacacaaaatggtagaatggaaggtgactttgagatgatatatgttgatcgagtaggctcaagagcatttaatgttgccgttgcccctttctcactctccctacttggagatggtgaaactacttga

SEQ ID NO: 33591 - DNA, 153 bp, Glycine max
  Peptide Sequence Number=SeqID_150369
atgtcgtctgcacattacaacgacaggggagacgctgagcaagggaccgccaccgtggcgtttacagcgacgccgatagggactcactccatgtggcgtctgctaacgaggccatccgaagcgaaccgccaccatcgcagctcggttacctaa

SEQ ID NO: 33592 - DNA, 339 bp, Glycine max
  Peptide Sequence Number=SeqID_150370
atggcgtacgatggtgcaggtcccataggtggttcgggttcgacattgacaataaagcaagtgtttacttggtatggtgcaaccattgaaatggatggtgctactgaaactgattatactgctaatgagaggatatcactgatgaggagattacaactttttgagtgtagactccaatgtaacaatgtagaattgtataaagtgcttcttaaggatcttgcagtgatgattgacatgcaatttactggaaatgctaaatctagagcttcaagcatggtgataaataccacgggatggataaagggtatatgctatgatgtatttggcctttgtatataa

SEQ ID NO: 33593 - DNA, 267 bp, Glycine max
  Peptide Sequence Number=SeqID_150371
atgaccaaggtcactgccctatttttcaccttattactctgctccatgctcgtccatgccatgtccatacgccttgaaccagcttttcaccaagaatccttagccaaaccgcaccaacaggtaaataataaccagtatcctaagcaacaaagcgttgaggcggttgatgagagctgcgaaggcgttggagaggatgaatgcttgatgaggagaacacttgccgctcacgttgactatatttatactcaaaagcataataatccttga

SEQ ID NO: 33594 - DNA, 250 bp, Glycine max
  Peptide Sequence Number=SeqID_150372
atgaggattgatcctcaagagtttattgcccatctttgcatccctggtaagggttttgttcttaatacagagggccatccttggaagcttctaaggaaagatctcaccactcttgcacagacatggagtgtcctctcctacagtaacctgactcccacttcccacacctctaatcttaatatggagagagccaggttggtttacggcttagtcataggcatgtacatgaacatcggagccataatctcag

SEQ ID NO: 33595 - DNA, 1047 bp, Glycine max
  Peptide Sequence Number=SeqID_150373
atgggttttctaacagactctcacaaagactcatggaagccaattatgactgcaaagacagacactcaaagttactggcttaattggagagttttgctttgtgccatatggattgtggtttcagtaattttagcttcgttgcttgtatggaagtatgagcgtttgagaaaaccagcaagaaatggtagcagggaaacacaacaagaaacatcggcaactttgtatgaggatgaaacttggaggccttgcctcaaaggaattcaccctgcatggctcatggctcttagaattgtggcgtttatcgcgcttttggtgcttctcataatcaatgcaattgttgatggaggaagcattttctactattacactcagtggacttttacttcaatcaccatttattttgggcttggatctttgctctctatatatggatgttaccaacatcataagaaagcaacaggggataaggttggtaatgtggatggagatgcagagcaaggaatgtatgatgcttctgcactcccacaaagctctaatccatttgacccagagaaaagcttgggggatccagaagaagttcttgttcgccaacatgccggcatctggggctatacttttcaaataattttccagattaacgctggtgctgtcatgctcactgattgtgtattttggttcataattgttccatttctaaccatcaaagattacaacctaaattttttgatagtcattatgcactcaatcaatgcagttttccttataggtgatacagctttaaattgtctgagattcccttggtttcgaataggatacttttgcctgtggacaatcacatatgtactattccagtggattgtgcatgcttgcatttatctctggtggccatatccatttcttgatttatcatcctcttatgctccactatggtactttgcggtggcattactgcatgttccatgctatggaattttcgctttgttaatgaagctgaaacaccatgtcttgtcaacgcggtacccagactcatatcaatgtgatagatga

SEQ ID NO: 33596 - DNA, 648 bp, Glycine max
  Peptide Sequence Number=SeqID_150374
atggggtttggctatgacgaatcaagtgacacttataaggttgtggcgatagttgggaataggaaatcgcgaaaaatggagttgagagttcactgcttgggagacaattgttggaaaagaaagattgaatgtgggaatgatattcttcctagcgatacatttcatggtaaaggacaatttttgagtggcactcttaattgggttgcaaatcttgccacacttgaatcatatgtagttttttccttcgacctaaggaacgagacttacagatatttgttgccgcctgttcgcgtccggtttggtttgccagaagttagggttttgaggggttgcctctgtttttctcacaatgaagacggaacacatcttgctatatggcaaatgaagaagtttggagttcaaaagtcttggactctattgattaaagttagttacaagcattttgaattctgtcgcagttactttcctcatcccttgtgcatgtctgcaaacaatgatgtcctgttgctggggaataattctaagtaccaacttgttctgtgtaatctgaaaaacaacactatcagcaacattgaacttcccctcagagaagttttcttcatctcctttgattatgttcaaagcttggttttgccttatcgcaattga

SEQ ID NO: 33597 - DNA, 504 bp, Glycine max
  Peptide Sequence Number=SeqID_150375
atggcgcttcaagagaactgtttgagtggtgatgttcctaagggttttagcagcatagttagtctgcggtatcttaatctcagttcaattgaatttgctggtaacattccaataacttatgggttccttagttccttgacggttctctctttgtctcacaatggtgtttctggtgaaatacctcctgaaataggtggttgttggcaacttgaagttttgcagccgcggtcaaattttctagagggtaacattttgggtgatatctctcgtctttcttgtttaaaagagcttaatttagggcacaataggttgaaagggaaaattctggttgaactatcaagcatttctggtttggagtatttaaatgtgtctagtaataaccttgagggtgagattccttacatgctaggtgctacattcaatgaaccttctgtgtttgcaatgaaccaagggttatgtgggaatcctttgcacagagaatgtgcaaatgatccgagtgcttga

SEQ ID NO: 33598 - DNA, 462 bp, Glycine max
  Peptide Sequence Number=SeqID_150376
atgggattaagtcaaaagccttcgtttaaaaagaggttctatcaagtcaaaatcaagagcttagaggtcaccagtttacgaaagttggggcaattaatgggtcaacttcaaaggcaagccttctgcaaagcctatggtaagatttgggacctagctagggtagaagtctccacagagtccattgcctcccttgcccagtattatgatcatccgttgaggtgcttcacttttggggacttccaactatcacccatggtggaagaattcgaagaaatcctaggatgtcctctagggggaaggaaaccatacctcttctcagggttctacccctcattggccaggatttctaaaaaaagtccaaatctcggcgcaggaattagaccgccaaaggcaagtcgaaaatggggtggtcggaataccgagaaaatatttggaggtaaaagcaagaatcttggcagataa

SEQ ID NO: 33599 - DNA, 192 bp, Glycine max
  Peptide Sequence Number=SeqID_150377
atgggtgtcaagtacctcgaagtggtcaaacgaggatcgcatcccaacaatggatggtccccggacgaaattaggttaagtggtagcaataaacttaacagggctaaattccattatcatacattccatgcaatattagcttacaacacagaggagtatggctctaggtttcaaggaagtgacttagggtaa

SEQ ID NO: 33600 - DNA, 866 bp, Glycine max
  Peptide Sequence Number=SeqID_150378
ctggatgtggcgctggagagctttcgcggcgagacgctgcagttgcccaccatgttctcggcgctcaagtatcagggccgcaagctggcgacgagctggaactggaaatccatgtttccaaaggcacctacattcgcaccatcattgacgatttaggtgagaagctcggctgcggtgcacatgtaatcatgctgcgccgtctgcaggtggcgcgttacccgattgcgcgcatgatgacgctggaacagctgcaggcgctggcggcgcaggttaatgcggcggaaacgccggattacgcaccgctggacgcgttgctgttgccaatggacagcccggcggaagattttccagcggtcaatctgcccacgccgatcgcggcctggttcaaacagggcatgccggtccaggcggaaaacgcgccggccagcgggctggtgcgggtgaccgaaggtgagcagcagaaatttatcggtatggcggaaatcgccgacgatggtcgcgtggcaccgcgtcgtctgatagtggacgtagaagctaaagcagagatcgttgctaaatacggtcgtggcgctaacgacagcggttcaactgaagttcaggttgctctgctgactgctcagattaaccacctgcagggtcacttctttgagcacaagaaagaccaccacagccgtcgcggtctgctgcgcatgcctgatcgaaagcctgggtctgcgtcgctaagtctgaagaatctgatcaacgatgtagcgcatgcacaatccggaccaaactcatgtattgttgctgagagtgatctttgcttgcagaggttcgcgcggctaatgagaggctttaccgcaggggcggttaagggttgtcattag

SEQ ID NO: 33601 - DNA, 978 bp, Glycine max
  Peptide Sequence Number=SeqID_150379
atgatgaatgaacatctattcaagattattccaaggatgatgaacttgcttggaaaaggtggtcatgctgaagtctacaaaggatgcttagcagatggtcaagtcgtagccgtaaagaggctaatgaggaatgaaaaagaaattgagggcaaagctggtgatttcttgacagagcttggaatcattgctcacattaaccatcccaatgcaacacgcttgattgggtttgggatcgacaatggtctctactttgttctacaattggccccacatggcagcctttcctctttgctctttggttctgaatgtttagagtggaagataaggtttaaagtagctgttggggtggcaaaagggttgcagtatctccaccacgattgcccaagaagaatcattcacagagacatcaaagcctcaaatattttactcaaccaaaataatgaagctgagatttcagattttggattggcaaagtggctcccagataagtgggcccaccatgttgtcttcccaattgaaggcacatttgggtatttggctccagaatactttatgcatggaattgtggatgagaaaactgatgtttttgcatttggggttttgttactggaactcataacaggtcgtcgtgcagttgattcaaatagtagggaaagtcttgtgatctgggccaaacccctgctggaagcaaagttgatcgaacaaatggtagaccccagattagaactgaaatatgatctggcagaaatgaagtgtgccatggtaacggcttccatgtgtatccatcacatgtcctctaagcgaccatacatgaatcaggttgtgcagttactgaaaggggaagaggtgcctattgaactcacacaaaattcatcagctccaagatcacacttgatagatgcatgtgacttggaagattatacttgctctaattatttgactgacctcaatcgccacaagcaattactcatggagtga

SEQ ID NO: 33602 - DNA, 480 bp, Glycine max
  Peptide Sequence Number=SeqID_150380
atgtttttgttcaacacttactttgtcaagaaaagttcattaggcaaaaacttgtgctattctattatcttcctctcctccattcttacaaaaagcttttcaagagacctacttctggtgactgttttcaagagaagatcttcttggttgcaaacactgaacataagggaccaacgttccttgggttcattgcaagaagtaggatttgcttcttggttgatcactggacacaaaagaccaacgtcttttgggttcattgcaagaagtgggtataacttcttggttgttatcactggacacaagggaccaacattccttggggagaaggagacttccatagaccagatcccagagccatccccaatacccatacctgatgattccatgccatctgcactagcatctgagctagagcagcctatccctcaggattcaccagctgctcaggtgttggatctcaatgagcatgcacaggagtag

SEQ ID NO: 33603 - DNA, 420 bp, Glycine max
  Peptide Sequence Number=SeqID_150381
atgaagacaatagtgcagagaggagatgaaaacaaagagtgttcagattccaacaaagatgaagacaatagtccagagagtaaacatcgtcattttgaagctgagctactcccttactcgcgactccgtgttgtgctgaagctgagctactcacctcaccttgttccgttgttcgagttctgctttgaaagccctcactcacatcgtcatcactggccctcagtcgcgatcctcgttgtcgctggtcctctatcctccgtcatcgttgctgcctcgctggtcttcacttgcgctccaagctttgcttcacgtcacgatgctaagctagaaatctctatttccctggttaagaacggttctgtcactctgtctagtttagcagccaaagtcaatttgattatcaaatctagatttatttaa

SEQ ID NO: 33604 - DNA, 466 bp, Glycine max
  Peptide Sequence Number=SeqID_150382
atttcaaagctcatttagagcacaaaatttcatgctcttctcttcctctcccttcattcatctccttcttcctccaagctcttatccatggcctcctatggtgtggcgtctcctctctcttcctttctccattccgctgccattcatcttccaagaagcaaaggaatccattgacgaagaagatcctaggcctacaagctccaatggagcttacatcaggcttgtaatgagcttcaaaacaaagaaggggaacataggctcaaaggggctatcaaaggaattaattcaaggtaggctcatttggctagaggcttataagaacaaaatgcctaaatcatctcccaacatgcatgtgaagcaagaagtatcaacaagagtaaagccaaggctattgtgcaagcaatcaatggggcaaaacacaccgaataaaatagatgatgatggctcaaattctcaccaagggtaa

SEQ ID NO: 33605 - DNA, 169 bp, Glycine max
  Peptide Sequence Number=SeqID_150383
gtttgataacagtaacacacaaagattgatggaaagcatgtctgaagaagaaaagagggagtttgactttgatgtaaagagcatcgattggaatgactacatcaccaatgtccatatacctggactaaggagacatgtcatgaaggggagaggaatggggagtcagtga

SEQ ID NO: 33606 - DNA, 561 bp, Glycine max
  Peptide Sequence Number=SeqID_150384
atgcccgcaggtccccacggggaaccgcagaacaaggatggggcaaaaaatacccccaccacgggaagcggagacgaggagcagggtaaggtgcggggacgggaagcgggggagtacttcccgccccaaccccgcgtgggttccatgcctacgccatcccctttggcaccaaatacatttcaaaagacaccaatgaaggacattccgttctcctctaatgtgatcatcgaatggtcatgcccgacgtatggactagagaggatgctgccaagatgcatcggtacacaagcgtcatcactactacttacttatcttcagtgtcaaatgtgtatatgccatcaatccaacaaagatatttttgtctctattaggtttccacccccaccaattatccttccaagtcatgaagagcttcgcatactaccagttgtccatgtagcaccctttcatggtaccttttgtcagttacctcctatgcaatttgcgcatgttctcgtggttccggactttgcggtgcctgaggtggacccaatagttgagccacccctagtccaaaggtag

SEQ ID NO: 33607 - DNA, 2502 bp, Glycine max
  Peptide Sequence Number=SeqID_150385
atgaatgcgagaggcgaggtcggttcaccggattcgttgggttcgtttcctccgttacgggttcggggatcggacggtgcctcggacgattccgagttcgagcggtattgcagcgccaactcggtgatgggaacgcccaacactagcatgagcctctgcagcgccgttacgctcttccaagatttctccgattgcgatttcgcttctgtcgccaccggcgagggtttcgaaaatttcagtccgggaaaaggagccgccccggaggtgaatcgcggcggcggcgaccggaggagttttctgtacggttccactggattggagatgtacggtgattgcagtgaggaactatctattactacgctcgattcgttggagattatagggtttaatcatcggatcgaagagtcgaaagggagcggtgaagtgagtggtggaaatggttttgaattggaaattgagaaaagagaagaagtggaagaagaagaggaagaggaagaagaagagttatcggagggggatgattctatgtatgactatggtagtgatggtggaaatgaaatgtatttgtccaaaaatataggttattatgaggagccgaaagtgagaaacgagaactctttgtttatgaactcttccgtggcatttggatcgcgagacctggatgattttttgttgcagagtggtgacatttctgtcatgtctgatctgtttcataatcagcgaaaaaagaataatggagtgaataaaggttctggtcgaaaggaggaagggaaagatgaaaaggacatggtcagaggcaatgaagttgaagaaactaaagatattggttattctgatgctgtagaagaggttagggatagggaaatttctgcagattgtcgtcgtgttcgagattctgatatgcttgctaacacagtggaaagttccccctcaattgattgtcagaactgtattgaaacgcaggtccaaggtcctgaaagttcttatgttggcaaggtggatgaagttgatttggatctgctggcgaaagaagttcctcggaatatgggtttggatgttaatgatggtggttgcatggaaaaagggaatgccaacagtgaagaagctattggcactggtgatgctcatggtgtaaagttggagctggatacttctaagttcgagtttgatcacataggtgatagccaatttgataagagttattccaatccgtcgaaccatattgggaatgttaacacaaaatcagttgagagtcttgagcaaattgagcctgtgttggacaacggaatgaggaaaacattagagaagtctttcacttcaacaaatctcttagaaacaagtcctgtggcatctaagacagaagactttgagctaaatgaattctatgacgaagttgttcaggaaatggaagaaattttactggaatctgtggattctcctggggctaggctttccatgcgtaacagattgactgagcctcaattttctatgccttcaagagacggtgggttgactgcttctacttcaagtacagatgatgcttacctgctagttcagcgccaaagaaaaatagataggattgaagtggtaggtgcaaggcagaagaaaggggatgtttctttcagtgaaagattggttggagtgaaggaatacactgtgtataaaataaaagtgtggagtggcaaggatcagtgggaggttgaaaggagatatcgtgatttcctcactctctaccggtgcatgaaaaccttattcaatgagcaaggctggaaattacctttgccatggtcttctgttgaaaaggaaacccagatatttagaagtgcatcgcctgatattattgtgaagagaagtgttctcattcaagactgtttacagtctattatccggtccaggttttcttcaagtcctcctagagcattgatttggtttatatcccatcaagattcatatcctatttcacctgtgtctcactcttttacaagaggggaaaatatccgaagcatttccaatttagggaagacaatttcacttatagtagaaattccaccaaacaaatctgtgaaacagttgttagaatcacaacatcacacctgtgctggatgccataagcattttgatgatggaaaaactttgatttgggattttgtacagacatttggatgggggaagcctcgactttgtgaatacacaggccagttgttttgctcttcttgtcacacaaatcagaccgcagtcttgccagccagggttttacataattgggatttcacttactatcctgtttctcagctggcaaaatcttatctggattctatatatgaacaggatttgtgctttggtgacctgttggtcatgggttcgaatccggaaacagcctctttgcatatgcaagggtctatcaacagaggacttggaagcaggagatatcttcttgaaagcaatgacttttttgctcttagagacttgattgatctttccagaggagtctttgctggttag

SEQ ID NO: 33608 - DNA, 369 bp, Glycine max
  Peptide Sequence Number=SeqID_150386
atggaagtggttttaggtgcaggcctgaagctggtggaaaatgttgagtacaatgaatctggtcgtggggagtgggctgatggatatggtcccaagtttggacttgttgcggttgaccgggcaaataatcttgcacggatccctcgcccctcttaccatctattttctaagattgtgaatacaggaaaagttacacatgaagatcgtgaaagagcatgggatgaacttcaaagagctgcgaaagagaagaagacaaggccattttatcgggctgtggataaacaccgtttaatgtatgcagttctatatgagggttatatggataagtgtctaacaagtcttcttggctctcatcacacgtggacttga

SEQ ID NO: 33609 - DNA, 307 bp, Glycine max
  Peptide Sequence Number=SeqID_150387
atgggaaaggtgttccgattctgggctagggtggttgatggttttataccagcaaagcgatcaaaaggtggtcaaagggttgacaagacattgaggccaacgcaaggaaatcatcttgtcctgggtggtgcgacaaggatgggagggtgcagaggtgagagaaggtatgcagatgtggttaggaagaacgataggtggggaagaaggatatggaatggttggacaaatgatatgtggacaagggttgacgataataactataacattattaggaagggatctaatatgctactcaggccaatggagg

SEQ ID NO: 33610 - DNA, 481 bp, Glycine max
  Peptide Sequence Number=SeqID_150388
tgagattgttgaggatgtttgcttgatgggatgtggggaacttgtgttaggtcaaaacgtcactgggatatcgcttgagaggaggatattgcgggttgggaggaaaaaggtgtttgttaggcctttattaaatttggcccaagaaagcgtaggatgcactaaagaccagttgggagtggtgtttgaagatgcgagccctagtcaaatgacggggcaagtggataaggcctctatcttggggacaaatgtggctagtggattatctaaggaagatttggaagggaaggcaaagggttcagttgtaaaggttgaaagggatcacaaataccttactatgttgaaggtaactagagatcctatggttaacatggctgatagggtgttggggggttgtttatgggtcatagggttgagtgcgagaggggggtcgagatgtgttgggggcagcagtggaagccatagggatatcataagaaaagag

SEQ ID NO: 33611 - DNA, 644 bp, Glycine max
  Peptide Sequence Number=SeqID_150389
atggaggagtttaaacatttaagggagccacgtctttgtgttgaagaagaactgaaggctttgaaagtcagaattaaagaatggagaagggtacattctaatgaggaggaagggtacagaagggagtgtgtacaacatattgtgcaactgtctcatatgcgatgtagcaagatgagattgagatggaatatgatgttatgtgtgaagataaagggtaagagggttcaggaagctcaaagcatgaaggattctatctgtgggaatgcctacaaaagctttgagtatagactcatctctcttattgggtgcatgtacaaggtgttagctaaattgttggctaatagactcggcaagcttgttgaggaagcaagagtaagtggcatggaaatgattatgttcaaggttgatttcgagaaggcatatgactcgatggattgggattttcttatgatgaagatggaagaaatgggttttcttaagaaatggcatgggttggataagcaaatatcccacttacaatttgtagatgacactatgatttttggagtgggtctgttacctatgaagtatttgggattgcctattggagcttaccctaggaggttgggtacttgggacccagtggtggaagtggttgacaaaac

SEQ ID NO: 33612 - DNA, 498 bp, Glycine max
  Peptide Sequence Number=SeqID_150390
atggagggaacgggatttggtgcagcggcaccgacgccattggttaggttgtggagaactgcgtttttgacgctgagggatgaaaccctaacggtccctcctcgcaattccacggcacaattgctcgataatctcattttctcccactcagacgcgttgctctccgccgctgccgaacttccttctcacgaggttttgtcagacattttgtttatcatggaattggttgctgcgacttcttcagatgaagaagattttactcgtatctatgcacagacttcacgcctgattcatgatatatgtcgttgtgtttcattcgaattaaatttctcctcttttagtagtgttctcaattgtttcgggaagatgctgaatcttttacttagaaaagttgctactagtgacgacataagtggaatttgcagtactactacaataattcctgccattgagttcttacaggctgtcaggtttgctcattctctgggaaagaattga

SEQ ID NO: 33613 - DNA, 648 bp, Glycine max
  Peptide Sequence Number=SeqID_150391
atggatgtcttggcattaaaaacccctgttgtggaagatagtgtcatgtccaggttctatgaatcttttctgtgctgtctacatctgatcctcattgatcctaaatgttcagtttcagatcataaatatgctatacccctaaccgttgtgacatccaccccccaggtgtcagtttttgttgctgttctgcgaatgttcttagtttacggcgtttctggtagaacatcaggtctgcttgttggtcatgaggagaaggagcctaatagtatgaatcccaaggcaaacagggaacaactgaacaaatcagatcgtggtacatatagacctccacacttgcgcaaaagggacagcttgaatgtgaaactcaatagagctaggcattcccaatacatgtcagatagtgagtcttctacggttaatgttacatcttcagattcagagtttagtgatggagatggatcagctaaggagagtggcagagtgcagaactctagggttagagtagcttccataacttgcatacagcctctttacaatttgccatatcgtgttttatggcgctgtttgccatttccaatatggtgcccgctattaatgttgcgtccatggcatgtgcagcagctatggtggaaattgcgggtttgttga

SEQ ID NO: 33614 - DNA, 330 bp, Glycine max
  Peptide Sequence Number=SeqID_150392
atggacattgagaacaataggggatacaactgcaatggcagtagcaagactagggaggaagagattcaaaaggaagatgaaagcgaggtggaggaagactacagcttgagcaataaagttaacaagcattgcatggggggaagttgcaatgagcgagcagaacagaatacagtcagtcatgagcaaacgagggatcgactccaaaagtccacacaacaaccattgattcaaaatttgatacaaacccaaggccgaagaccaccaaagattatgaaagaagaggaaagcagagtgcaggtcttggatcaccttgatcagacctccatctaa

SEQ ID NO: 33615 - DNA, 666 bp, Glycine max
  Peptide Sequence Number=SeqID_150393
atgtcctcgccttttgagggctgcacgccattcgccttcagagggctacacgccctcacttttcgaggactacacgtcctcccattcataggacaactaatcctcgccttccgaggactacacgtcctcaccttcagaggactacacgtcctcaccttcagaggactacatgtcctctccttgagaggcctgcatgccctcgccttcagaggactacacgtcctcacgttcagaggacaacacatcctcgccttcagaggactacacatcctcgcctatagaggactgcattccctcgccttcagaagactacaggtcctcgcctttagagagctgcacatcctcactttaagagggctacacgccctcgccttcagaggactacacatcctcgccttcagaggattacacatccttaccttcagaggactacaggtcctcgccttccgaggactacacgtcctcacctatagaggactaaacgtcctcgcctttagggggctacacgtcctcaccttcagaggactacacgtcctcgcctttagagggatgcacgccctagcctttacagggctacacgtcctcaccttgagaggactacaccttctcgccttcagaggactacacgtcctcaccttcataggactacacctcctcgccttttga

SEQ ID NO: 33616 - DNA, 412 bp, Glycine max
  Peptide Sequence Number=SeqID_150394
aaaaatggttgtgcagtgctagtcacgggaaaggcgatccaatggttaacgaatcagaacgaagagaatgttactgagggtagtttcatgacaaatggaattgaattgtttggatattgtgaaagcttggaggggttgatggggacccgacttgtggaagtgggagagttgatttgcgccatcgcccgatctccacttagtaccacatatgacaaagtggtacctggagatatgtcgcgggggtcaggagaccttggggacgtcaggtggggtgctattgcccaaaaacaagcttggccaatcccgacccaacccgtgcatagtcagtcagtgagaacctgtgactatgatagggcactggtaatcgattaccagttatgtgtaatcgattacatggtgttacctgctactg

SEQ ID NO: 33617 - DNA, 159 bp, Glycine max
  Peptide Sequence Number=SeqID_150395
atggttcatgacatctttgtcatggtgcaactggaagtaacaaggacatcaacagtcctaaatgtgtttggcagtagacgaagcagtgatgtaactcgatgcaccttttgccccaattttttgcaagatgaggaaaaggcaaggatcatgcatgagtaa

SEQ ID NO: 33618 - DNA, 240 bp, Glycine max
  Peptide Sequence Number=SeqID_150396
atggataagagcttgaaggtaggagaagatgagtggagggagaaggagaaaaggagcacgaaaattttgtgcctcaaaagagcccatgggcccgaaatctaccctaaggcttatgagaaccctagagccttctctcgcatctctggctcaatcttcttggagtcttctatccaatgctcttggggggtaggattgcatcaccccactaggagagaccccctggtcgctttagtgcagtag

SEQ ID NO: 33619 - DNA, 345 bp, Glycine max
  Peptide Sequence Number=SeqID_150397
atgggaactcacacgaatgcaggatggaagtggaatttcatatggaggaggccattgtttgacaatgagatcaacatggctgataacttcttaagagatattaaaggcaatctagtccagccacatacaagagatgattgggtgtggaaagcagacccaaatggccaatactcagcacaaagtgcttacaatttgcggatgggggaatccacatatgagaatcaggatggagtgtttgacgaattatggaaattaaagatttcaagggctttcccgcaaaacccaaggcaacacttccttcaacatgcacatgggcaggatgatggaataatgggtaacagatga

SEQ ID NO: 33620 - DNA, 618 bp, Glycine max
  Peptide Sequence Number=SeqID_150398
atgagagggagagagagagtgacacatagagatagagagggagagagaaagcaagacaggcatgagaggagtgcaaacacagagagaacgggagcatatggtagagggagggagagactgagagtcaggcatgagaggagtgcaagagagcactctctgttccgtgactacaacctgtaccagaggaatgttggaggaaggcaacatcgtaggtggagaagcaggggagaaagggggatatctgaacaaaggggttggcacaacagaaatgagaaggaggatagctatgataaggatggaaactggacgaaggtaaccagcaagagatcagcaaaggaaagaaagaagaaaatatcagagaaaagaagtcctgacaaacacgtaacatggagagagcccacataccaccaacccaactggagaaataaggacgacatcacgtctttctacttcacacattttgctgatgatgttactgaggtgcgactatggaaaaattttaaaaaatgggaagatgtgcgtgaggtttacattgcaaaacgacgtaacaaggacggaagacgatatggcttcgtgcgctttaagggagtttcggatgccaaacgcctagaggtttag

SEQ ID NO: 33621 - DNA, 369 bp, Glycine max
  Peptide Sequence Number=SeqID_150399
gggcaaaggcctacagcattcgtacgtaggcaacgggaagttgcccctattgctgaggatgatcctgtgttgcatgaagacgtatatgcacatgctgcagaagctattcatgatgttgagggatttccaagtgggccgcgtgacccatcagtgctaactaactatggtgaccatgttgcagtcatcgtatggaatggagaggaacgtcttgaattgaagttatcctcccatggaaggaaggttcagaaatttgggaggcctgctctagaaattgaagggctagtcgctgccataggattaagtcctttgatcgcatgttcagtagacactggcgattggggacttatatccgcttttgtggagaggtga

SEQ ID NO: 33622 - DNA, 654 bp, Glycine max
  Peptide Sequence Number=SeqID_150400
atgtgtggacgctacgagccaactaggagggatctggtgcctttggagggactcatgggatgtggaattcatttatttgtctatgcaaacactgcacctgaagttcctctgaggaaggtcctatgggaggaccttattgatttggtttcgagtactagtggcgaatggatggtggcagaagatttcaactcctttattttcccccatgagaagaatgggggatcatggagccctttggcaaagaattcccttgtttttaaatctaccattcaaataggaggcctcaaatccccaggagatgatgggttgcaacctattttctaccagaatcaatgggaagttatccgtctagccctatgtgagctcatatgttctttttccaaaaccctgagaatgtggcagactttaatggtgcttgctactaagttcagacacatcatggggaaactagttaacccagtgcagtgcagttttctgcctaataggcaaagtcgtgataacatcataatagcccaagaagttttacattctatgcgctttaggaagggaaataaaggttggatggttgtgaagcttgatatagaaaaagctatagtagtatttgaggaagccactatagagcaagctatagtagtatccttcaagattgtctga

SEQ ID NO: 33623 - DNA, 771 bp, Glycine max
  Peptide Sequence Number=SeqID_150401
atggggttaacactgttgtctcaagcatccttacccattccatataagtggtttgagaagttggcggtgtggaggatttgtgaggggaatcatgtgacttttggtcggataattgttggagggagcatcaataggtgtgggacattaggtggaggagagggtggttccaatgagaattggagaaaggaaattatcaacccgtatccatttgcacagtgggcaacatctccagggaattgtttctatgagcctacatccacttgctatttgatctttgcatatgggactccagttgtgtttggtgttcttctgcaactattacgtaattcatcaaattttaaaatcaggatacaagctgcagcagcattggctgtgccaatgtcaatgcaagcatcgatccttgaagattggttcaagggattatgctcatctggcgagggcatgctcgatgttcaagataagtgcattgcagaccgaaagagggttttgatatctggtgcgctacagtcgttgattgaagtatacaaagaaaaacaacaggatgcgatagctcagaagtttgaggaattgaagaacaatattgtggtgtcgttgtcgcctccacaaagcataacaacacctatcactgtcatttccctccaatcgcaggaagcgatcgatgctgttgtggcgatgacatttagggatacaaatctgcctgacatcgatgaaggaagcacaagatttaaaccatgcatgatgaaggaagtgccaactttgaaccttgcatga

SEQ ID NO: 33624 - DNA, 882 bp, Glycine max
  Peptide Sequence Number=SeqID_150402
atgggatcaagtcaaaagccttcgcttaaaaagaggttctatcaagtcaaaatcaagagcttagaggtcactagtttacgagagttagggcaattaatgggtcaacttcaacagcaagccttccgcaaagcctatggtaagatttgggacctagctagggtagaagtctccatggaactgattgcatccctttcccagtattatgaccagcccctaaggtgcttcacattcgaggacttccagctagtgccaactgtgaaagagtttgaagaaatcctgggatgcccactgggaggaaggaagccatatcttttctctggttctatccctccacgacaagagttgccaaggccttggaaaatcaaggcgaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagcgacgcaagaattttttgttgtgcactggctctctatgtgtggctggtttcacacccttttctccaagaaggtaggcccgtctatctgctacaaggtcaccgctcgtgcgtcgaaaaaggaaaggcgaattgggaccaactcttggctagcatggaggggcgtctgggttgtattaattataatcccgtcctcgccataagacagcttggctaccccatgagaggagtgccatcagacgaaagcatcacgcctttcatcgcacggggtttcggtgaccacaacgcgagggtactccaaggagttcacaaggcatgggatgcggcgtga

SEQ ID NO: 33625 - DNA, 375 bp, Glycine max
  Peptide Sequence Number=SeqID_150403
atgaagatgcacaaaacaataaagaggccctctaagggtccattaatcatgttaatatccttaaatacaaacactaaccggatgaagaacgaagaacgaccgaagaacgatgtagaaatcgattacagtcgtgattcatcgctcgcccaagcaagctgttatttcatcctgcagcaaccttgctcgcccaggcgagctagttacttcaacatgaagttatttggtggcccaaacgagccagaggctagcctgggcaagccaagatcaatggcagcagaatgcaaaaggaggaaaggcgattggagacaccatttcaaggagaagatgagtcaagaacaagctcaccaccataagaagccatggataagagcttga

SEQ ID NO: 33626 - DNA, 363 bp, Glycine max
  Peptide Sequence Number=SeqID_150404
atggattggttctttaggatctctcatctgttcatgacacccacacaggcagctgatccgcccaaacatccacttgtgccacaacatgacacatatgtggagccagatatcactgaggtcctagtggcaccagaagctggaccttcacatgcaccttttgatgtggagcagcctagacatgcagtggatggttgccaagcaatcgcagaaaggttggagcgtctgctcaacctaaggatagtcactacagacacaaagatacatgaggtcatggaagactgcataaggatcgctaggggtgtcacaacagatggcaatgtttatgtcaagtcgcgacgaaggtggtgcatgcatcagccatag

SEQ ID NO: 33627 - DNA, 216 bp, Glycine max
  Peptide Sequence Number=SeqID_150405
atgaatcagtgcaggcctgggggaagtcatgcattacctgaaggcataatcttcgacacttctgatttggaaatgcggaatttgtgggatctttctatgactaagacaatagagaataaggaaaatgcatcaaccaatttgtttgcaatggcagttgggataaagcaaaaggatcttgtgaacaaaatggtcaaaaagtggattgttgattcatga

SEQ ID NO: 33628 - DNA, 300 bp, Glycine max
  Peptide Sequence Number=SeqID_150406
atgtgcaagttccctacatgtggggtatcgtggtacaaaatgaaggatgacaaatgtagtgatgatgcaaccacaaccaatgatcgtccagcaaagaaaaaagtgatggattgctctgacatctggctgattctccccaatggaagacaattgatcatttgtaccattaatgactttccagcatatgagaatttgagtggatatagtgtcaaaggacatcatgcatgtcctatccgtgagaaagagacgagcttcatccaattgaaacatggaaagaatacaatatatactaggcattga

SEQ ID NO: 33629 - DNA, 534 bp, Glycine max
  Peptide Sequence Number=SeqID_150407
atgtttggtccagcaggtcatgagaatatagttgaagatgtgtcatggaatttgaaggatgagaatatgtttgggtccagtggagatgactgcaaattgatcatttgggacttgcggacgaacaaagcccaacaatcagtcaaaccacatgaaaaggagggtgagaagatcaaagagaaagtaaagaaggtagatgagaatgaagttgttaagttgataaaagagcaggaggacaaaaatttggaaatttcagctttgaaggtagaactggaaacaaccaaaagaacatatgaagtacaattctcacagatggaagaagaagctaacaattttaaagcaacattgacacgaaaggtccaagaatatgagcatcaattggaagaattaagaaatgaggtattgtattgtcatcatcaaaaagggggagattgtagatgcaaatgcctttggtgttttgatgatgatcatgatgaagaaaagcaaatgatgcaaatgattcaagaatacaagccacaacatcaagatgatcactag

SEQ ID NO: 33630 - DNA, 804 bp, Glycine max
  Peptide Sequence Number=SeqID_150408
atgctccaaccatgtggaatcggcacaggcttaaaggagcactcaaaccggatgacccccaaggcctacactccgaaaagtccgttaggacctctccctcctgattcagattcagagcatggaattgcaactttaacaaaagggaatatacatattacattgtgtagtgtaggtgggaattgcagtctcaacaaaagaaatatatgcaaagacacatttacatgtggaaggtgtggccaaaccaatcataacatcagaagctgcaaaaatattggagttcctattaggccaaagaaatatgttgcaccaccaacttcaaatcaggatgaggacctactagctcaagatgggcaagctttgaatgaggctgaagaagttgctgctcatgttcaagaaggtccgttggagattaatttatctcaacctaatttgtcacaagatagtgacatggagttcatggtccctgcatctgttgttgatgttccaccagtagcaaggaataagctaaacataacaagacccacacaaaagaacatttcagacacaccaacaacaccattacttttcatgccaacaccgaggctcactagaaggaaggctactaataaagatccacttgacttgtctattttggtttatggtgtgaaagctttatatggtgtgaaagcttgccctgctaaacgattgcttgtaactagcatgctttgcctaatgactagggaacaacaacaaggaaaatatggcaattactctgttgtaccacatctgacagcagtagacacattaatgaatatgtttagataa

SEQ ID NO: 33631 - DNA, 1014 bp, Glycine max
  Peptide Sequence Number=SeqID_150409
atggaggaaaaggtgcacgctgttttgaagctcctagaggaagagggggattcctttgccaagagagcagaaatgtattataaaaggagaccagagctgataaactttgtggaagaatcattcagggcataccgttctttagcggataggtatgatcacatatcaactgagttgcaaaatgcaaacaacactatcgcttctgtgtgcccggatcaagtcccatatatggatgatgatgatgaggattcgcctagaccgaaaaccccgagaaaaatgccagaagggcacaagccaaatattcctaatgttccaaaggttccaaagcctccacttagagatttaaaaagtgtcataacaacagccacaaagaaactcaatcccaagaaggtagtagcatctgcagctgtggctcctaaagttcaaaaatctggattgagcagaaaggaggcgcttgcagaggttgacaagctgcagaaagagattctggcattgcaaacagtgaaagagtttgtgaagagttcttatgataatgccattgccaggtactgggatactgatcagcagatccagggattacaagagaaagtgtccaatttgcaagatgaacttggagaaggtgttgctattgatgacgaggaagcacggtgtttgatggcagcagcagctcttaagtcatgccaagagacattgtcacagttggaactgaaacaggctatatcacttgatgagacgaaaattgagaccaaaagggtaaaggaagcgagggaaaagttaagttctctcatgaatgagttcaattatgatcaaatcaattccaaagagccaagggcaaaaggaggtgtaaaagaaatagctggaacaaaggacttggatgtagatgtggacaaaatgaatcagcagagacaggagttgcagcaattgcaggagaaaataaaagaacactttgaggctggatcctattcaactctaacagtgaaagatatggcagaaaagattgattcacttgtgaacaaa

SEQ ID NO: 33632 - DNA, 1566 bp, Glycine max
  Peptide Sequence Number=SeqID_150410
atggatgataagctgcgtgaggtacaggatctaaaccaagttgttgaagatcagaataccaacctccaaacccatttcactgaagcacattgtaatctagatcatctgtcggagaaagtccaaaaggtgaagccagatctggttgcggaaatatcactaacacaaaggaagtcatcaagggaagcagaatctgaacatgttcctaaaggactagatgcattgaatcaagacagtgtgctattgaatgaggggcataaggtcaatgcaacaatagaagatactgtgaattcagacaaggagcttatggttgcagaagtggcaaaagacggtgtaattccagaaaacaagcctaataatgtcacaggttcaccagaaatgaatgaggaaaccccagtggaaaacaaatctccaatagagttgaaagaaagagagaagtccccggattctaactacagtgatgttacagaatcaacagatgctttgaaaactagtagcggaaatagaatgacaaaagaagatgagtctgattggcagcaattgttgaatggaatgcaggatagggaaaaggctttgctgtcagagtatactaatgctcttcaaaattatgatgatatgaagatcagactagctgaaatagagaagaaaaatcaagatgccctctttgagtcatctttgcagttgaaagaactgaagactgctaatgccttgaaagatgaagaaattagactcctacgtcagaaactaggtgtcctgcagaaaagcttggagggaatggaggatttgggagagttaacttcagtgcagccggcaccaccggagcaacatgacattgaagaatttttaaaagttgaagaacctgaatctacaacatcagccattgaagagaagttccggatgagcattgatgaacttctagaggagaacctagacttctggatgaaattcagtacttcttttactgggatacagaaatttgaaaccactataaaagatttgctgattgaggtatcaagaattgaggaaaaatgtaaatcatcagaaggcagtagtagcgtgaaatattcattgaaatcagacgcaagaccactttataaacaccttgcggagattctaaatgaactaacaatgtggttggaaaacagtgcattgttgaaggaagaacttcaatgtagattctcttccttgtgtgaaatccaagaagagataactacggcactgaaagccagtgctgaagatgatgacttcaagttcaccagctatcaagcagccaagttccaaggcgaggttttgaacatgaaacaagagaacaacagagttgctgatgaacttcaagcaggtctagatctagtaacatctctccaacttgatggtgagaaggctcttgcgaagatgaatgagcgatttgggctctcaaattctaacaaaagccagagatcttcagattcccagaactcagttcctctcaggtcattcatctttggtgtcaaaccaaagaaacaaaaacaatcaatcttctcctgcatgacccctggaatgcataggaaataccgtggtcatagaggataa

SEQ ID NO: 33633 - DNA, 330 bp, Glycine max
  Peptide Sequence Number=SeqID_150411
atggcacaggtattcaaatcattccctcactcccaaaatacaacacgaccacttcgtttggttaatttggtgagaatcttagacaaccctttaaccttgggacccgagttgagctccaagcaagtggggagggccaaagggctctacgcgtcggtgttgcggacggagcttagtcttttgatggtcatgaacttcgccctaaccgaagggaagtacaatggcagcgccatcaccatcatggggaggaataggcctctcatgaccaaggttagggagatgcctgtgattggtggtagtgggattttctgggttgctaggggatatgccctg

SEQ ID NO: 33634 - DNA, 189 bp, Glycine max
  Peptide Sequence Number=SeqID_150412
atggacaaattaatatgccttcctccaaaaattcaatactatagtattcacgagaataatggaggaaaacatggcaaaggtgttgatgggcagccacaaagaaacgaggaagaagggttcgggagttgttcacgcatggggaaggtatcagcaccccacgcgttcgtcacaagggatagtagcctttaa

SEQ ID NO: 33635 - DNA, 615 bp, Glycine max
  Peptide Sequence Number=SeqID_150413
atggaaaccgggtcgagttcggagttcttagataaggggaaagctatgaggggtggcactggcaagagacatgatgttgttagtgatacaaaagttgagccttttgtggcaagaagtgatcataatcctaaagagttgaagtcatgggcaaagagaactgggtttgtgtctaattactctggggaagttgggactagtgccagtgagaattttgatagtagagaaggacggtcctctcccaagatagagattgatccagtgctggggttggtgaggcctaatcgagacaatgagattgaaccgatttttgtgaccaagcatggagacatgaggggtgagaatgagagagttttaaggaaaattggggatgaggctgctttggttttggttggtgatggtgataagaaaattgggttaagagtgaatggtgatgcttatggaatgacggtgagtacaaatcgcaatattaatagtcatggagtttctgcagttgctcctttgccagagcagaagaaggaaaaagaagggatagttgaagacgtcaaggtgaatcattttccagagggggaggaacctgctagtagagggtggcagggagcatctggattgaagtag

SEQ ID NO: 33636 - DNA, 327 bp, Glycine max
  Peptide Sequence Number=SeqID_150414
atgtttggattctcgctagctgaattgcgttgctcgacaccagttgccgaacaagacgaaagatcgttcagtgttttgatcaagaatgcgagaggaaccagcttgcctgagcaagctgacatggtcccaagtgcccttttttctataaataggcgtgaaggggagttgaggaaggggttccaaggctcagaagtggagagaattgagagaaaagagaaagaagaagaagaaaaaagaggaaacgaagccaaagcgctaccgaatcgcgattgtgatcaatccctacttcgttccttgttcggtgttcttcgtgtgaccgtcgattag

SEQ ID NO: 33637 - DNA, 407 bp, Glycine max
  Peptide Sequence Number=SeqID_150415
tgtacatctacttgggttgtaatactgagaacaagatatggtacatctcttgtggatcagttcaagtggagggtacatccacttggttattcaaagagaacaagggagggtacatcccttgtggatatttgcttgtaaaggattttacaaggttattggaaatctcaagaaccggtggttgcttggggattggacctgataatggtaatgggtggattaagaagcccaaagactccacaactggagatgttgaagaaaagcaaatgaccccatttgaggagatgttggctaagatggatgagttgatgagagtacacaaggaagactgcaatgagctaaaagagtgtttgaaaaccatttctaagaagctagatgctaaaggagcacctgatctagatgatatttga

SEQ ID NO: 33638 - DNA, 855 bp, Glycine max
  Peptide Sequence Number=SeqID_150416
atgacttgcgtgatcaaactggtcaacatctatggagccagtttatatagaagtctaatcctgaaatcttatgttcccttgacagttacattaacttggatatatgcgtcgtttttaacagctgggggaggatataactacaaaggatgcaatcccaatatcccaagttcaaacattttgattggtgcatgcagaaagcatgcttataccatgaaacattgcaggactgatatatccaatgcactgttaacttctgcatggctcagaatactttatcctttacaatggggtttccctattttccatttcaggacttgcataatgatggccatagtgtcgctggctgcctctgtggattcagttggaacatattattctgcatctctgcgagtcaatttgaggcctctaagtcctggagtcgtgagccgaggaattgcattggagggtctctatagtatattggctggtctttggggttcgggaactgggtcaaccaccttgacagaaaatgttcagacaattgacacaacaaaggtggcaagtcgtagggtggtggaacttggagcagctttcatgattctcttctcctttatgggaaaagtgggtgctcttattgcttccattcctcaggccttggctgcttcggtactgtgtttcatttgggctcttatagcagctttaggcctttcaaacttacagtatggtaaatgtgccagcttcaggaacatgaaaatagttggtgtttctttgttccttggtccttggtctatcaatccttgcctattttcaacaatacaagcctcaaaccagtctgatactacctgcttacctgttaccttatggggctgcatctag

SEQ ID NO: 33639 - DNA, 558 bp, Glycine max
  Peptide Sequence Number=SeqID_150417
atgaagaaaaataggaaaaaggttgatgggtcgtcatctgtaaaggggaaatctactgagcattctcattctcccaaattcactctatgggggaaatcaattgtgatgacccttgatttggggatggaaattgctggactttctggtgagggaatgattgcgaatgagaagggtataaaggatataggtgtgaaattcaacaagttggccacctacaagagtctgatgaaaaatccaatagaggcaccaaaggagaaaacaaaggaaagatttaggtctggagcactacaaatggaagcaaggttgttggcctatgtgcaacctgtggaagcaatgctttccaagattattttgacgatgccaaagactcaagtcaagaatcaagagtcaagtaagtttcaagaatcaaagattcgttcaatcaaagcaagttttaagaatcaaagagtcgttcaatcaaagcaagtttcaaagaatcaaagagttgttcaatcaagaatcaagattcaagaaaagaatcaagagaagactcaagatatgcaagaaccattaagataa

SEQ ID NO: 33640 - DNA, 1335 bp, Glycine max
  Peptide Sequence Number=SeqID_150418
atggctggtgccacgaattggcttacgttttcgttgactcacatggaaatgcagcagttcggtccatacgacaccaccactcactctcactgcttcaacgacagcaatttttatgggtggacgaattctaagagcgtcatggattcacagagtgagacccaacaacttgcggtgccaaaaatggaagatttttacttcggtgatcaccagcaagatctgaaggcgatgattgttcctgggttcaaagcgttgtctgggaccaactcggggtccgaggtggatgactcgacctccaacaagacggtgactcgggttgcacccgctgcgttgggcggtgctcactctggcgaatctaattgtaaaggatcagctttgactttatgcgatgttgctgcgaatggttctgatgatagtaataataaggccgttgttgccgtggggtttgatactcggaagaaggttgctcatacgtttggccagcgaacttcaatttacagaggggtcacaaggcaccgatggacgggaagatatgaagcgcatctatgggataacagctgtaggcgagagggtcaggccaggaaagggcgtcaaggtggatatgacaaggaagataaggctgcgagggcttatgatttagcagctctaaagtactggggaccaacagccacgactaactttcctatttccaattatacaaaggaattggaggagatggaacatgcaggaaggcaagaatttattgcatcactgcgaaggaaaagtagtggtttttcaaggggagcttctgcttacagaggtgttacaaggcatcaccaacagggtagatggcaagcaagaattggccgagttgcgggaaacaaggatctatacttgggaacattttcaactgaagaggaggcagcagaggcttatgacattgcagccataaagttcagaggttcgagcgccgtaaccaatttcgagatgagtcgatatgacgtcgacactatattgaacaactcgcttccagttggtggcgtagcaaagcgcttgaaagtttccccagcaacggagaacaaagctcttatcagcaccattattcaaccacctcagaacacaaacgcaagtagcagcatcaatttctcagccattcagccagtttcttctataccctatgattctgcaatcacatgttacccccacaacttcttccaccaccatttcaatcctaccaacggtggaactagctcatcagattctgctgctgctgcagcagtgaccgatgcgattgcactcaatacccttccaccaccagcagttcctgggttcttcatatggcctcaccagtcctactga

SEQ ID NO: 33641 - DNA, 165 bp, Glycine max
  Peptide Sequence Number=SeqID_150419
atggctcaacctctaatcttgaggacttatcagatgaatacgagacttgttggctcaaaagccatgatagtgatactgactcctcttccgggcccgaaggaagtaatctgtctccatcccacgaaacaatattcaaacgggattgtagttgacatgctaacataa

SEQ ID NO: 33642 - DNA, 303 bp, Glycine max
  Peptide Sequence Number=SeqID_150420
atgatgtcatctcctattatgcctactttggatctgaatggtcggacaatcctctacgattcttgtagcaattctttgggcatgatgctaatgggagacctactagatctaccttttctcagtatacgaccgttcaagtacaagaaaatgtgtgagatttcagcggcgatgaggatctcacgccattcaagatcgctttctaccgggatgtctgcggtgaagagatatttgaggaaaagatggttttgtccgatgaggaatgagattcctcaggagactagaacaacccttccgaggatatga

SEQ ID NO: 33643 - DNA, 207 bp, Glycine max
  Peptide Sequence Number=SeqID_150421
atggtggtggtggcgcgacaacgatggtgggggtggaatagtggtagcaacgacgatgaaggcgacaataatagtggtgaccatgatggtggtggaacggtgattgtggtggtgacgatggtagttacagtggtagtgaaatttgcgattgcaaagatgggtgtggtagtggtggtcatagtagtggcggtggtaatcgtggaatga

SEQ ID NO: 33644 - DNA, 159 bp, Glycine max
  Peptide Sequence Number=SeqID_150422
atggtttccagggcttccatggcttccgtaaaatttctgaaaaccttgggacagggggctgtttcaaaaatattcatgacccctaagctatgcattttggctattttgggcaaaaaacacgttttcgtgaagaaaaatcgagtcgaagtgcttcggtaa

SEQ ID NO: 33645 - DNA, 643 bp, Glycine max
  Peptide Sequence Number=SeqID_150423
atgaccgcacaaaaagtgatggagagcaagacagcgccttctgataaaccccgccggccgggccgtccacgcggcggcgcaatcaatgcccagcagcgcgagcatctgctggacatcacgctcgcgctgtatgcgcaaaacggcatcgcggaaacctcgctcaacgccatagcccgtaaagctggcgtcagcccggccatgctgaattactattttcagtcgcgcgagtcactgctggataccgtggtcgcggaacgctttgtgccgttacggcaacggctggaagcgcattttgtcgaagagagtagtgaccctgtcgctgcgatcagcggattcattaaggagtttgcggatatcgtgctgagtcatgactggttcgcaccgctgtggctgcaggaagtcgccagtggtcaggggctgggcggcacgctgaaacagcgtcacggtcatgccggacgcgaacggattcgcgcgttgctgattcaatggcagcagcagggattactgaacaaccagctgaatgtcgatgtgctgatgacctcaattctcagcatggtactggtgccctttacccgctttgcccacgagccgggctttgataccgaaatgattctgcagcacaccctgagcatggtgtgccacg

SEQ ID NO: 33646 - DNA, 732 bp, Glycine max
  Peptide Sequence Number=SeqID_150424
atggggttggttggcgtgttggggtttatttatgaggagcgacgcgcgtgggaaccgatcattccgctggatctgttccgcaatcgcagtttttccctcgccagtctgatggcgtttattatcggcatggcgctgtttggcagcgtgacgtttttgccgctttatctgcaggtggtaaaaaacgccacgcccaccgaggccggactacagctgttaccgctgatgggcgggctgctggtcacctctatcattagtggtcgcatgattagccgcagcgggaaataccgtttgttccccatcgccgggacgctactggccacaaccgggatggcgctgatgaccacgctgacgctggatgcgccgctctggcacatttatctgttctccagcgtgctcggcatgggaatgggcatgactatgcaggtgctggtgctggcggtgcaaaatgcggtgacggccgatcgcatcggcgtagcgacttcatcggttacgctgtttcgctcggtgggcggttcgatcggcgttgcgctgtttggcgctgtgttcagtcacgtgctgaaatccggagcgacccgactgatagagcagggtaacgtgctgccgccttcgctggatccggtcgccgtgaaccatttgcctgcagcgctgcatggccgccggcgttatgctattggcttttatactttcgctgctgctgccggagtcgcgctgcgcgataacgtgcgcaaataa

SEQ ID NO: 33647 - DNA, 615 bp, Glycine max
  Peptide Sequence Number=SeqID_150425
atgggcgcgctgatgctggtgatgctgctgtccgcgcttgatcagactatcgtctcgaccgcgctgccgactatcgtcggcgaactgggcgggctggatcgcctgtcgtggatcgtcactgcttacatgctggcctcaaccctggttgtgccgctgtacggcaaatttggcgatctgtttggccgccgaacggtgctgcaaatctcggtggtgctgtttttgctgggctcggcgctgtgcgggctggcgcaaaacatgccgcagctgatttttacccgcgcgctgcagggactgggcggcggcggattaatggtggtgagcatggcggcggtcgcggatgtcattccgcccgccgaacgcggccggtaccagggcctgtttggcggcgtgtttggtctggcgacggtgattgggccgctgctgggcggttttattgtgcagcacatgtcctggcgctggattttctacattaacctgccgctcggcctgctggcgctgctgatcattaatgcggtgtttaaagcggatagccgacgcaaaccccatgaaatcgattatccgggtgcggtgtttctcagcctggcgctggtggggcgtgacgctgtttaccagtga

SEQ ID NO: 33648 - DNA, 432 bp, Glycine max
  Peptide Sequence Number=SeqID_150426
atggctctaaagaaccttgactcaatttcccttgaagagctcgttggaactcttatggttgatgaacaagaactacaacaagatgaaggacttaataaaaagaagtctctagcactcaacatccaaaagacccaaaaggcctcatcatccaaagagtcatcctcaaaatcaacgtttggaggcttgtccagagctcttagagtggataactcctcctctaatgaagaatttgaggataagtctcatgaagatgagcttgctttcatctcacaaaagatccataaaatatggaagaacaaaaaagtcttaggacaagaagaagtactaaagtccaatgaaaagaaaggcctcatgagcacttgggatgacctagacgacacctcgtctaatgaggatgaagaggaagctaacctatgtttgatggggatatag

SEQ ID NO: 33649 - DNA, 186 bp, Glycine max
  Peptide Sequence Number=SeqID_150427
atggaggaagagttccctcagtaccaaacaagcctaacaaatgtttacggatgctctcaaaatcaatcccaaggaattgagctggatgtaaataaggagtatgtgtgtgatgaagcaaaaggaatggatcttgcagaaatgattatggtggatgactgtgtggagaggatgccatggaaagaggtg

SEQ ID NO: 33650 - DNA, 297 bp, Glycine max
  Peptide Sequence Number=SeqID_150428
atgaaaactgtggagaaaaggaaattggaaatgatgctagtgtggttgcttgacttggaattatttgtttctagacaaaatgaatggcatcattcattggatgattggacagaaatggagattaaactatgcagacagatattggatgaaaaattttgcaacttcaatatcaataatcaacaaaacatttcaaaacttgaaattggtttagaaattcaagatgtttgtggagtgacagggaaaaagagagttgtcgttattgtaattcttgtgaattacatgctgcaactatggtag

SEQ ID NO: 33651 - DNA, 393 bp, Glycine max
  Peptide Sequence Number=SeqID_150429
atggaaagcaattttcacgtagatgttgcagactctggcagcagaggcgacactgtgggacaacttagcatcaacaacttccattgcggtaacagtcttccttctctcgtgctcgaggtagggaaccacgccgacgagaaagtcccttgtgacactacagaggaacttgtccttttgggtacgtcggagttgtcaccaaaggtgccccatctgtcgatgacacaagttgcagcgcaagcgcttttgttgtcgtcgcaaccagtatcggcatcgaagttctcgtccaagctgccccctctggtgacgaaacaagttgcagcacaagcagttttgtcaaagttttatcgggggttggtaactggtgattcttcacctactctcgacaacaattag

SEQ ID NO: 33652 - DNA, 195 bp, Glycine max
  Peptide Sequence Number=SeqID_150430
atggccttcgtagcaaatcaacctcagggtttgtgtgtgacatcttcctcaaggcatttgccatggagcaaaaggctaaagttgaagcagtgtttaacaaaacatcacatgattggaagaactgactggcattgcctagtaaagcggaatgcttgtttaaggtgcagaaatgtgaattctggtgatggaaattag

SEQ ID NO: 33653 - DNA, 882 bp, Glycine max
  Peptide Sequence Number=SeqID_150431
atgacctgtagtcctgcttctcataacaggtttattgtttccagtgtagggcctcctttcttttgtgtagccaagctcaaacctttgaggatttcaggcttcaaaggaagcacccaaaatgatgattcaggaatcagggctaatcagttgaaggcacctaagacctctgttagactaggagagagtggggaagctaacaatgttccactctcttatgcatctgaaacaaatgatagcattgaaacatcatctgctattcatagacttttcaataaatggctgaccatgttgcgcacacaaccatcaagccaagaagtggagaagatttttgaagaacctgcatcagaaggaattttaccaaaaactcagcaagagactcaaattaaggaaagacgtgcaattttgaaggtggcatggtcccattttctggccctcgatgcaacaataaagattcctttgttggtattcattcctctatacctggctgttaatgtaaaatatggtgctgaagtttccaaggagttaactcctttatggattttgggcccacttattgtggctacccaaatcttggcaatccgttggctatgtgcactctatgttttcagcttcaatcagactgtcaaattactcaagaattctccttattactgcattttggcctacagctatgtttttcgtggcaagctcaaagaggatatctcaacttatgttttgcagcctatattgcgcgttaaaaatagagactataaacagctaataagaaaaaagttgaaagaattgcaggaatggatagtggagatgtatcttgattatgtggaatctatatggccctattattgtcgaacaatcagatttttgaagagggctaatcttatttag

SEQ ID NO: 33654 - DNA, 1164 bp, Glycine max
  Peptide Sequence Number=SeqID_150432
atgaaaattacagtgaacaatacaggtattaatgtacagcaacatggtcgcggtgagcttgcactggtgttcctgcattactatggcggatcatcccgaacgtggcagagcgtgatatcacagttacctgatcactatcgcacggtagctatcgatcaccgtggctggggattatcagatgcgccgaagtccggataccggattgcggaccttgcaagtgatgctgaaggcgtcattgccgcgctcaagctaaagcgatatatcctgattggccactcaatgggaggaaaagttgcccaattgatggcatcccgtcggcctcaaggccttgaagggctaatgctgattgcaccctctcctccttcgcccatgatgctttctaaagaagatcgcgacaggcttaccagtgcatatagcagccgtgaatcagtcgagtttgttatcgacaatgttctgacgtcgaggccgcttagcccggcgctccgtgagcaggtcattgaagacagtctgagcgccggaactgaagcgaaggctgcctggcccgacatcgccatgcgcgaagacattacaagtgcagttgcctccattaatgttcccgtaagagtcatatcaggagagctggaccgggtcgataccccggaaacgttgcaaagagagctgctgcctcgcattcctcacgcagcaatgatgattgttcatggcacaggacatctttcgccgctggaatcacctcaagaaattgcaggatacatttccaatttcgcagcttcggttgagaggagcgatactgtccatcgatcgccagctgaaaccattgctgcatttgatgaagcatttaatgccggaaatattgacgcattgatgtctgttttcagtaaccgtgcctcgatgagaatgcccagcaatgttgtcatcgaaactgatccttatgcattgcgtatggcttttaccacgttgatagcatcaaggccaattatcagaaaccagatccatactcttatcccttcaggtgaccttattcttgccatcattaaatggtcgctgactacgacattagaagacggcactcaaagagatgattgcggcgtcgccacacaggtgatggaacaaggggcggataagggctggcggatacgcatttcaaacccgacgggaattaactga

SEQ ID NO: 33655 - DNA, 444 bp, Glycine max
  Peptide Sequence Number=SeqID_150433
tatgcactggtcgccgggccgaaccgggggtatctgtggattctgtcgcgtcagcccaccattccggctgaagtcaaacagcgttatctcgcctatgcccagcgactgggcttcgcaaccgatcaactgatttggggaggagccggaggtcagggaggaaatggcggctatgcgggagaatccggcgctgacggtggaaacggttcagatgggggtaatactgatggctctgccggcaggccgggatgtcccggcggcaccgatcctgatgcggacggaaaattttatcttcccggtaccacccaggagtgcaatccaggcaagcatgattcgatgaaggttaagtgcatgttcgggccagggtgtcagttacttccccgtcatgtacggtttaagtcactctctaagcgtcagcagcaggctggcgccgccaaaggccagtag

SEQ ID NO: 33656 - DNA, 780 bp, Glycine max
  Peptide Sequence Number=SeqID_150434
atggggacggatatgcgaaacgagaaaattgacggcttcgatcggctgaatcgcgatgttgtagcgctcggcaacgactatgcgcagggatttttcctgccgcaacatcagcaccgccgtgcgcagcttctgtatggcgcaaccggcctgatgcacgtttcaacccgtgacggggaatgggtggtgccgccccagcatgcggtatggatcccccccgaaatcctgcatgccgtcaagtttacaggcgtaacgacgcgtagcctgtatatcgaacccgcatgcgcgtccagattgcgtaacatcagccgctgcgaagtgattgccgtatcgccgctgttgcggcagctactactggaggcggtggatttgccgccgtgctatgacagcgtacgcgatcgggcgctgatagatttaatgctgcttgaagtggcggcaatgccagtgtgcgcgctcgagatccctttgccgcagcagcccgcgctgttgaggctatgtcaggcttttttacttgcgccagccattcacgatccggcagaacgctgggccagcgcgctgtttatgagcggcagcacatttcgtcgccattttcagcagcaaaccggcatgtcgttttcagcctggcgtcagcgagcctgtgtggtcagcgcgctggcaatgctgctaacgggaacaccggtaaacgaagtcgcgttgtcgctcggctatgacaatggttcatccttcgcgacgatgttccgtcggattaccggccagccaccttcattttatcacccgacttaa

SEQ ID NO: 33657 - DNA, 804 bp, Glycine max
  Peptide Sequence Number=SeqID_150435
atggcaggaaaacatgtcagtgctttagaatccgatttacacgtgcggcttattcagcgctctacacgccgactgagccttacggatgttggtcagcgatattatgaccgctgcaaagtgattatcgaggctctggatgacgcagacagggaagccagtgacattcaggccactccccggggattgttacgcatcgccgcccctcttgccttcggcgaaatgcatctggggaagattgtgtcacgctaccttgagcaatttccggaagtcagtgcaggtgttgtccttgaggataagtatattgatttgcttgaggaacggatagatgtagccatacgcataggacatctggacgatccgacgcttgtcacccgacgtctggcaccctgtaaaatggttttatgcgcatcaacagactttctgaaaaaatacggcatgcctgaaacgccagatgatctctcgcgtatgccgcgcatggctttcagccaggcaatttctgccggagactggacaatctatgacacagataacaggccacacactattgaaagccgttgccggctcacatcaaacaatatccatttgttaatggaagcggccttgggcggtacagggattgtatatggcccctgttttgtttttcgagagcacataaggcagggccaactgattgagctgctgccagattaccggacatcagagcttaccattcaggcagtgtacccgagtgcgatgcgcattccatttaaggttcgcactttcgttgattttattgctgatgctttgaaagcgaagccgctttaa

SEQ ID NO: 33658 - DNA, 726 bp, Glycine max
  Peptide Sequence Number=SeqID_150436
atgggaagcgggccgctggcgcgatatgctgctgcctcacttttgctgatgcggcagccgctgctggcaggaaatgcgatgcatattgccgtggccacctcgacagcggtgatgattttcaacgcaggctgggttagttaccaaaactggcaagcgggcaggctttcttcaaccgtcttgtttccgctgctgtggtttatcgccacaggcgcggtagtcggttcgtggttagcgggaatgataagcgaggcgctgattcgcgcgctttttatcctttatatgctgtcgacgattggggattgtctgttacgcaaaggcttcttcagcggcagcgcgccgcgtcgtttatcacttttgacggttgccggtggcggtatgctaatcggcatgattgctgcactgctgggcgttggcggcagcgtaatgacggtgccactgttacgacgacacggccatgcaatgcgcgcgtgtattagtgcggccaacccgctttccctgccggtagcgctgtgcggtgcgatgacatatgcgataagcggctggcataaaattcaggcaggcggatttttgggatttatcagcctgaaaatattgggcttgctcctggtgaccggctgggcgggtattgctttcagccgccgggctatccccgccgtccccgatgtctggcacgcgcgaatctacgtgatgctgctgtgcatggttctggtagtaatagtgctttag

SEQ ID NO: 33659 - DNA, 156 bp, Glycine max
  Peptide Sequence Number=SeqID_150437
gaggtagctaatgaggctggtttgggtttactgcttaaagtggaatttgtggcagcaaatgctgaagccgacgtcgcaagggaaggtcagcatgtgaaggaggtcattcgtaaccaaagtgtcaaagagattacaacatcaaacgtggaaaagtag

SEQ ID NO: 33660 - DNA, 1317 bp, Glycine max
  Peptide Sequence Number=SeqID_150438
atgccgatgagcggcgaatggacggacataactgacctctcctgctacgtagggactgctgctctccccctttacccggtgcgtgttgatggcggcaaaatgcgcagccgctgcaccggacgcccggccgatcagccttttattcaccgcttactgggcgaagagatcgccagtatcgattccccgtctgacgaacaactgcgcctgcaacaggcgttgcaggatgcgcggttacaaagaaatcatgaagcagagctcgactggaaacgcaacgcgctctatctgctgctgtttgtgttcctgtatggcgcactgggctgctcgctgacgctggatttgagcgcggtcgcgcaagcgtcgagccataaaagcattgcctatgcgctggaagcggtaccggtcctgatcgccttttctggtctgttcctgtcgctgctgtttctgttcgccgcgcgcggcagcgcacgccgcctgcacaactgggatcacactatcgtgctgctggaaaaatacagcggctgcaacctgagcctgcagattaatgaaatgggggcgcgtaccacgcattactcgcagtcggcgattaccgtggcgctggcgatgtttatctgcctcacctgggtggtgatgtacaactacttcaccttcaccaccagcggcgtgattggcagtgtgatctcgctgtttataaccactatgacctacgtgattctggatattcagctactgaaatcgggaaaatcgatcgctatcgatgagccggtgattccgccagaagatgaagttgagaaacgccgagttgcgatgaaaatctggccgttagtcgccattacggcgctgtctgttaccctggtcgcctgtaaatccccgacgccacctaaaggggtgcagcccatcacccacttcaatgccgatcgctatctcggtacctggtatgaaattgcccgcctcgatcaccgtttcgaacgcggtaaagatcatgtgaccgccacctacggcaaacgcagcgacggcggtatcagcgtgctgaatcgcggttacgatccggagaaaaaagcgtggagcgagagcgaaggcaaagcttacttcaccggcaaacctgacgtcgccgcgctgaaggtctcgttcttcggacctttttacggcggttataacgtgatcgcgctggataaagattatcagtatgcactggtcgccgggccgaaccgggggtatctgtggattctgtcgcgtcagcccaccattccggctgaagtcaaacagcgctatctcgcctatgcccagcaactgggcttcgcaaccgatcaactgatttgg

SEQ ID NO: 33661 - DNA, 324 bp, Glycine max
  Peptide Sequence Number=SeqID_150439
atgctaaacgcaacgcggatactgagagcttttatgtatagaagtgaagatgaaaaactggccgacattgtcatgggcgatgccgtgctgcaattgttaaaacaagccggaccggtaaccactctcgcgctgctggaaaaactgcgcgcgatggcggcctcagaaaccgatccggcccgccagcgcgcgtttcgctatgcgattgctgaagtgcagaacagcaaaagtgcgccactgggcgaagcggtggcgttaaaaggtagcgataacgtgacccatatttttcgcaaccgtgataatacgggcaaaaacacccgacattag

SEQ ID NO: 33662 - DNA, 2313 bp, Glycine max
  Peptide Sequence Number=SeqID_150440
atgcacatgctcaaagaagtcacgcgtcagctcagtgcgcgtgatcggctgccggtgctgctgtgcgccgccacgcgcgaggattttcaggccgcgctgcggaacgcggcgtcgctgccgctgggcggactgctgttcctgagctcgccgtgtcaggatgcgcaggagatcgccgcgcacctgctgccgtcgctgcgcgcggtgcatctgtgcccgaacgacagcgcgggcgctgatgtggtggttgccgatgggtatcacgccgggcagcagcttggcgcactactgctgtcgcagggacaccagcgtttgggcgctatgcaggtgcaggcaagtgacacaccgccgcgccaggttcaggggtttattgccagcctgcaggcggaagataagacgctgcacgcagcactgcacgccggtgcccttcaccgtgagcaggcttatcagacaatgatggcttacctgaagaaaacccgtgcggcagaacgcatcaatgcattgatgtgcgaatacgacgagctggcctttggcgcactgcaggccgtgcgcgacttcggtcagggcgcgcatatcgccgtggtgggctttgatgatgctgacgaggcgcgcggctccacatggcacctgagcagctgggcaccgcgccgtgatttactggtgacggaagccctcaaccggctgctggatcagcgtccggaccacagccgcgcctggcagcagggtgagctgcaggtgcgccattcgcatcacggcaaatatgtgcctggcgaaatgtcgcagtgcggctgcgccatccgttttctttacgccttttttatattgccggcggttaaatcagcgcagcaggcggcactgtggcgcgccttaaccttaaagggaaatatcatgcccggcactattctggtcacacataatcagcatcagtcttccacgctggcagccatttacgatcgcctgatggcccgacgcggtggcctctgggtctgctgggatggacaacgtatcgtcgctgcgcaggaagcggcgcgcacgcttagctttcagcagggtaacgaatacgacaggctgcaatttgcgctgacgcgcgcagaatacgaagagggctatcacggctacgtacatcaggggttgtggccggtgtttcaccagcgtccggacctggcacgtttcaccagcgccagcttccaggcctatcgacagctgaatgcggtttatgcccatgccatcgccgaatatgccatgccggacgatgttatctggctgcaggattatcacttcatcccaacggtgaaaatgctgcgtgataccggcttaactaaccgcatcggtttgtttttacatcagccgtttccgtccggtcagctgtttgaagcgatccctgactggcgcagcctggcagaatcgctgctgtgctgcgacctgattggcttccagaccgggcaggatatgaataactttctgctgtggctggagagcgagtttcgcgctgaacgcttaggcaggaaccgtctgcgcgtgcacggtcacatcatcaccaccggcgtgtttccggtcgggatcgatctggctgaggttcaggcgttacttgagagtaacagctgccagtatatggaacagcagagccgcgaacatttgccggccaacacggtgctgagcggcggtcatctcgacgacagcgcaggtctgccgtatcgcatcagcgcgctggaagtgctgctgcgccatcatcccgactatgcgggcaacatgatgttattgcagctggcttcttctgccagcggacacccgcaccggcagcaggcgatcagccacaatctggaaaatctgtgcggtgaggtcaatggcgtgcacggtatgctcaactggtatccggtcagctatctcaaccacgattatcgacgtgaagagctggccggactgtatcgtgcggcgcgggtggcactggtgacgccactgatggcgggcatgagcctgatggcgaaaatgtatgctgcgctgcaggatccggcgaatcccggcgtgctgattctgtcgcagttcgcgggtgcggccgaacagatggatggcgcgctgatcgttaatccttacgatcctgatgcaatggcggatgccatccatacggcattacggctgccgctcagcgaccgtcagaaccgtcatgcgcgcttgatgaataacctgcaccgctacgattgtcactggtgggccgacagcttcctcgccctgttaatggatgagccgcagccggagagtgtgcagctgtgtagccgtcacctgtcgggcgcaggcataagcgggcggttacgttattga

SEQ ID NO: 33663 - DNA, 3221 bp, Glycine max
  Peptide Sequence Number=SeqID_150441
gcgttaaacgtgtggtactgacctctgcgttcggcgcggtcggtatcggacatccagcggactatccgcgcccctttaccgagcgcgactggagcgatgtcagcggcgatgtgtggccgtatcagaaatcgaaaaccctggcggaacgcgccgcctggcagtttatcgctgagcagggtaacggtctggaactggccacggtgaaccccgtgtcggtgctggggccggtgctgggtgccgactattcacattcgattcgcattgtgaaggagctgctggaggggcagccaggctgtcctgacatcaactcatgttttgttgacgtgcgtgacgtggccagtctgcacgtgctggcgatgacccacgccgccgcgcaggggcagcgcttcctcgccagttcggggcacagcctgccgcttattgaggtggcgcgcacgctcaaaacccatctggcagcagaagcagagaaggtttcgctgcagccaatgagtgacgccatggtgcgggcggcggcagcgcaaaatccgctgatgacgggaatggtaaaactgctgggcgttgatatgaacgtcagcgccgctaaagctggctggctgctgaactggcacccgcgcagtccgcaggaggccattcttgccaccgcgcgcagcctgattgcgctggggctggatatcatgccgtctccacaggtgataaacgccgactgctgtatcgtcggcggcggtccggccggcttaatgctggcctatttactgacgcgcgccggcctgcgcgcggtcgtgattgagaagcacgccgattttctgcgcgattttcgcggcgacaccattcatccctcaaccctggagatcatgcaccagctgggtctgctcgacgcgctgctggcgctgccgcatcagcgcgcggagaagttacaggcggaagtgggcgggcaggagatcaccatggccgatttctcccgtctgccgttgcgctgccgttttattgccttcatgccgcagtgggacttcctcactttcctcgccgcccaggcggcgcactatcccggtttcacgctactgcaatccaccggttttgacgattttcttcatcaggatggcgtaatcgcaggcgtgaaaacgttacaaggtcacgaaattcacgcgccgctggtgataggcgctgatggccgtcgctcggcggtgcggcagaaagccgggctggtgggtaaaagcttcggtgctccacgcgatgtggtgtggttccggctggataaacagccggacgaccccgagctggggatgggccacaaggggccgaagcaaaacttcatcgtcattgaccgcggcgaatactggcagtgtggattcaccattcagaaaggcgaattcgaggcgctgaagcaggccgggctcgacgcgctgaaaaatcgcatggcagaggttgcgccgttcagcgtggcgcgcatggcgcagctgcaggagtggcagcagctgagtctgttatccattcgtatcgatcggctggacaaatggatgaagcccggcgtgctgtgcattggcgatgccgcacatgcgatgtcaccgattggcggcgtgggtgtgaacctggcgattcaggacgcggtggccagcgccaattatctgacgcggccgttgcaaaacggcacgctcacgctgcgcgatttagagaacgtgcagcggcggcggcagtttccgaccgtggcgacgcaattcctgcagatcaaaatgagcagcggcaagcgcccgcgtaccacgcccagtaaggttccgcagcttatcagccgctatccgtttttacgccatctgtttggccgattgatcggcatgggcttccgcccggaacggccacgtctcgccggagaaaaaaacgtagccggatataacctgaacgtcaacgcgatctcaacgaagcgtaaatggcgtgaggcgggtgaagagagggattacgcgatgataaaggggcgtgacactaaccataagaaactgaggaagacggcaggtatgaaactggaaaacttatctcgcagaagctttatggccttcgcggctggtggcaccgtggcgctggcggccggcaaggtccatgcccacgatggcaaggtggcgacttatccggcgaatgatcccaaccatccgcgcgaccctggcccgcacgatccggtgcgcgaagcactgaatccggatctggtcgatccaccagcaaccgacagcggcacattacccaacctgcgcttttcgtttagtgatgcgcacgtgcgcaagggcagcggcggctggacgcgccaggtgacgcagcgcgaactgggcatttccaccaccattgctggcgtcgatatgcggctggacaagggaggcatccgcgaactgcactggcacaaagagggcgagtgggcctacatgctgtacggcaatgcgcgcattaccgcgctggataccgcaggtggctggtttgtcgatgacgtcggcgtgggcgatttatggtatttcccgccgggcgtgccgcactcaattcagggcctcgggccggacggctgcgaattcctgctggcttttgacaacggcaatttcgatgaagacagtacctttctgctcagcgactggttcaaacatatcccgcctgaagtgctggcaaaaaactttggcgtgccggctgaggtgtttaacacgctgccctcgccggaagaggagtacatctttgccgggcaggcaccggacggcgcggcggcttcggcggtgagcggtggggtgaaatcgaagcaggtcttctcgcataaaatgctggcgcagaagccgttgacgctgccgggcggcacggtacgcattactgattccagtaattttacggtatcgaaaaccatcgccgccgcgctggtggaactggctcccggcgcgatgcgcgaactgcactggcatcccaataacgacgaatggcaatactatctggaaggtcaggggcggatgggcgtgtttgcctcctcaggtcaggcgcgtacgtttgacttccgcgccggtgatgtcggctatgtgccctttgccatgggtcactatatcgaaaacacgggtgacaagccgctgcgctttctggaactgtttaaaagcgattattacgcggatatttcgctcaaccagtggctggccagcacgccgccggcgctggtgcgccagcatctgcatctcagcgacacctttatgaatgcgctgcagcaggagaagcatccg

SEQ ID NO: 33664 - DNA, 867 bp, Glycine max
  Peptide Sequence Number=SeqID_150442
atgggcatcatgaaaagacattcacaacacagcagcaatgatccattttgtgaagctcacaacagaacaagacaacaacaccaatgcatgatgatgatacaacaaccaaacaatgatgttgttgttgtcccagaacacacatgtgcacaacaacaccaaaaccaatctccaaaattggcttcttcttctttcacttcccaaaatgctacacctgtgctacctgcttttgttgccttgctgctccttgttacttcaattgccccaacagcattgtgccaccccttgcagggcactaaccacacttttaggccaaatcatgagttgctcaagttgaggagagtcagagctcacttgaagaaaatcaacaagcctcccgtcaagacaattcaggcatcttcattttatttttttctttctctacaacctatgagtccagatggtgatttgatagattgtgttttatctcaccagcaacctgcttttgacaatcctaagcttagaggccacaaaatattggatcccccagagaggccaaagggaaaccacaccaatggtgaagctgaaagggtaattgagagctttcagctgtggagtgattctggtgaagcatgcccagaaggaactgttccaatcagaagaactacagaggaggatattctcagagcaagctctatccaaagatttggaagaaaaccaagacctgtacggagagactctactggcagtggtcatgaggtttctttcatttcccgctattttccacctcataaagaaaaaagagagacactgcttttccgtatttatctacagtttcaacatgagttccaaaaacagcagggacagacagtgaatggacaccactcgtaa

SEQ ID NO: 33665 - DNA, 582 bp, Glycine max
  Peptide Sequence Number=SeqID_150443
atggcaaagatgtggacagatcctctatttattgggagagttataggagatgttcttgactctttcaccccaaccataaaaatgaccgtaacttacaagaagcaagtctacaatgggcacgagttcttcccttccacaattaccacaaggccgaaggttgagattggtggaggagatatgaggtcattctatacactgattatgactgacccggatgtccctggtcctagtgatccttacctgagagagcatttgcactggatggtgacagacattccaggcacaacaaatgcctcatttgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtattcacaccgcatatggtgcactctcagtacaatctgctctgatgccgcatagttaa

SEQ ID NO: 33666 - DNA, 1641 bp, Glycine max
  Peptide Sequence Number=SeqID_150444
ctcagttgtctgcaccggctgatcgatgagctgcatctgctgtcactggcggatgccggccagctcacgctggagaaagtccgctgcaacccggccgatatcctgcgcgagcgcctgcagtggatcaaaccgcagctggatgaagcgcgcatccgcaccggtacagagctggctgaagagacgttgctgccggtcgatccattccgtctcggacaggttttcaccatcctgctggaaaacgccctgcgctacgccggaagcggcagtcagctgcagctgcgcacgcgcaacaccgttgatcattacgaaatcatcgtgcaggacagcggcccgggcgttcctgcggcgtttctggcgttgatgtttgagcgctttgcgcgcggtgaggcgtcacgtgcccgccactcgggcggcagcgggctgggcctgtcgattgcgcgggcgatttgccaggcgcacggcggcacgattaatgccacgctgcccgcagcgggaggtttgcagggtgtgcgccacctgcttaatccgcgccacctggtttccctgctgccgctgctgccctgtctgctgctgacggccctgctgctgaccggctgtgaccgcaagcgttcacccacgccgccgccaccgcgtccggtaaagttcatcacggttggcccgcccacgcccgccgggcagcaaaccctgaccggcgagatccgcgcgcacgatgaaacctcgctcagtttcaggctggaggggcggattctgacgcgcagcgccgatgtcggcagccgcttcaggcagggagagacgctcgccgtgcttgacagtcccggcgcgctgaatcagctggcgagcgcacaggcggagctgaacagcagccgcgcggccgaaaaggtggcggccctcaatctgcaccgcatgcggctgctgatgccgtccggggcaattgcccgtgctcagctcgatagcgccagcgccgactggcaggctgcgctggcgcggcggcagagcagtgaagcggcattgaaaaatgcgcaggatagcctgcgctggacccaccttaccgcgcctgaggatggcgtggtgacgggcgtcagcgccgcagccggtcaggtggtcagcgccgggcagacggtgtttaccgttgcgaccggcacaggccgtgacgtggtgtttgacgttgccacacctgaaaccctcgatcgccgggccagtgcccgcttccgcgttgcgctattgcagaatccgtccgtgatggccgaagcgcacctgcgtgacgtcagtccgcaggccgacgcccagacacgcagctggcgggtgcgcatcacgctggacaatcctcccgcggagatggtgctgggcgccagcgtcgccgtcaccctgccgctggccgacacgacggcggatgcggtgatggcgattccggccaccgcgctgacccgccaggcaggccagccggcggtgtttatccttgacccggtgaaaaactgcgttatccggcgcacggttgcgattgccggctacacggcagatgcggtatggattcgcgccggcatcatgccaggcgatcgggtgatcacggcgggcgtcagaagcctgcgtgacggtgaacgcgttgccggcagccaggaggatcagcatgaaaccggcgtttaa

SEQ ID NO: 33667 - DNA, 285 bp, Glycine max
  Peptide Sequence Number=SeqID_150445
atggaaggttcccaacaaaacactcactatcctaaggaaaaattgcctaaaattattacacacaaatggaagtttggtaacctattggaggctcccaacacacttccaacgaaaggcctttttgttacaaaactagaaagcaatgaagtgcttcttagtccaatagctcttaaggtggttggcccctttcttcttgactcaaattcttcaagggatggcaccaatcctccttccaattccctatatggcaacccacaaacaaggaaacaaagagacaagcaataa

SEQ ID NO: 33668 - DNA, 165 bp, Glycine max
  Peptide Sequence Number=SeqID_150446
atgactggctcaaccctgtatcttgacaacttcagggattcttctgacgcacaccaaccaaatgaggaaatatgttgctctgactatcaatttgttttcatgggggtgaaaggtcctatagctagtaagcaaatgtctgtggaaagaattgatggctttttctag

SEQ ID NO: 33669 - DNA, 474 bp, Glycine max
  Peptide Sequence Number=SeqID_150447
atggcctctttctcactccacgaaaatgcacctccggtgatattgatgatacatgcaggagccatcagccatgcttatgtgggatctgcatctgtgttggttggtgatattgatgatgcattggactctgaaaaagttgttgaagaactactctcacattttgttgaagaactactttctgcagagcatagggtgatgaagattgaaccacacaggggtgaatacaaaattgaaatttatctcaaggagaagactgcatggcgcaattcacacttagttgaagataaaaataggagaaaattgattttcagcaatctccttaactatggtttagaaagtgagtttcatattgggagtgtgttctctgctcaccttatctatggttcacaggtgaatggttcagtgatccacgcaccatcagagtttgatgcagctttagtggcttttgagatccctatcctaacctatggttaa

SEQ ID NO: 33670 - DNA, 267 bp, Glycine max
  Peptide Sequence Number=SeqID_150448
atggtaaaggtggtgaggcgctatggcgtggaagattttgaaccatcctcggccaaagaagagaaggttaaaacaactgatgactcgcttagcgaggtagatcctcttagcgaaatgcatccgcttagcgaagcatctagctcgtttagcggatgggaaatcctagaagaggataagtcagagatctgtacacccagtgcgcagccagcccgcctagcgaggacattgtctcttctcgcgcttagcgcgtccactcttgctaagtga

SEQ ID NO: 33671 - DNA, 252 bp, Glycine max
  Peptide Sequence Number=SeqID_150449
atgccagatttggatacaaaaaaaaaacttttgaaagtgaaaaatgaaggcaacacgagatctggacaatggaggtgttggaagggaggtgatgacgtagatgatgttgaagctgaggttggtttaaaggaaggtggcatgttaaagggttgcttgtgtggtggcggaggcacgagggagtcgaagcgggggaggggttgttgttcgcttacggcaagtgcaccgattcgcacaagtagtataaaacggtaa

SEQ ID NO: 33672 - DNA, 351 bp, Glycine max
  Peptide Sequence Number=SeqID_150450
atgagcaaggtaaaggccacctaccatatgccgtccgaagacgacaacgccaccgtcaccatgggcggcgtccggttcttcgacggccagtcggtcgatctcgatgaaggcgagcacgctcacctgatctcgaagcttcgcaccaaccagcacttcaaggtttccggcggcgagaaggccgaaaagaagcccgcgaagcccgtggaaggcctgaaggccgttcatatcgctggtggccggttcaagatcgtcgatggcgacaagacgatcaaggaaggcctcaacaaggctgacgctgatcagttcaatgccttcagcgatgaggacaaagccgcatacgtggctgactga

SEQ ID NO: 33673 - DNA, 180 bp, Glycine max
  Peptide Sequence Number=SeqID_150451
atggcaattagcggtcttaccgtttcctgcttcaccgctccagcggactcgcaggtgaagcgacagagcatcatcggcaagccggtctggagcgaagagccttcttccaacacagccacaacgaatgttgcgaagggcttcaacccgatcttccgcgtctattcgtctgctgatgtctgg

SEQ ID NO: 33674 - DNA, 708 bp, Glycine max
  Peptide Sequence Number=SeqID_150452
gtcgactctagaggatcccacggagacacggtagaaacgttcggtcaggcgcggcaggtgggtggccggaatgccgtagccggaatcgcgcactgccagcacggcgccgtcgccttcgcggcggaattccacggcgatgcggccaccggccggcgtatagcgcaccgcgttggtgaccaggttggagaaggcgctgtgcagttccttggtcgagccctgcaggtcaacgccggcaagatcgtcgatgctgatctggtggcggccctggctgtgcgcttcggcttcgcggcgcagggtggccagcatcggctgcatggccacggtctcttcctcgctgtgttcctgcgactcgaggcgcgacagcgtcagcaggtcttccaccagctgggccatgcgctggctctgcttgcgcatttcttccagcatcggaccggttcccgggaaatcctccgggtccatcatgtccagatagccgtggaccacggtgagcggcgtgcgcagctcgcgcagcagcttgctgacatcgcgggcgatcagcagccagtaatcggaggaatagggaatcaggcgcaggttcaggcggatcgccgggtcgaccggcgagggcacgtccaggatcggctcggcgttgcggcccccggccagccaggggccagcggcatcggttgcaggcgttcgaccagggcctcgccgaggtcgcccggatga

SEQ ID NO: 33675 - DNA, 1572 bp, Glycine max
  Peptide Sequence Number=SeqID_150453
atggaattatttttagtagtagtactcttattagcacttctggctccggttttatctgtcgtacttttcaaaaaaagcaaaaaataccgagaggaaatagctcttttaatctccggcaaaaatacgcttggcgaagaattaggtgaaacgcagaaaaaattagctcaggctgtacgtgaccacgcagaacttgaaggaaaagccactcctttgtggcagtatcaggaattacacgatgcagtattagatgcggaaaaaaagattaaaaccgctgacgctattgccagagaaaagctggatgacgcgcaaaaacaagcggcaagagcggtaagcgaagctcacgatcaggctgcattaacaataagcaacgccaatagcgaagctgtcgctatcacccaggatgcgcgtgatgcacgcctgaaagccaaagaacgactcgataacgcgaatagtaaagcggatgagctgatctccaacgcaaatgataatgcgatgaaaataatcgcggatgcagagatacgtgcaatggaaatagctggctccgcatatgaagcgaaagagtttgcagagacctatcaggctgtcgccaggtcaatgaaaaataaaattgaagggtacggcgatgaatggatagtgccaaaccgaagcgttttggacgaactggcagagaattatgaatttacggatgcaggaaaagaactgcaaaaagccagagagttaactaagtctcttatcaaaacgaacaaagcggcaagctgtgattacgtcgaaccaaacagaagaaacaccgccatcaaatttgtactggatgctttcaatggaaaagtcgacagtaccctctcaaaaattaaacacaacaattacggcaaattatcccaggaaataaaagatgcctttgagcttgttaattttaacggttcagcctttaggtcagccaggatcactgatatctgcttgcaggcccgactcaacgagcttaaatggggagtagctgtaaatgaaattatgctcgaagaaagagaagaacaaagacgaatcaaagaacagttgcgtgaagaagaaaaggcgcgtcgcgagtatgaaaaagcgataaaagaagctgaaaaagaagaaaaaacaattcagcaggcgattgataaagcgactaaagaactgatgctcgcaggcgaagaacaacgtatagccctcgaacaaagactggctgagctacaaattaaatacgaagaagctgaagccaaaaaccaacgagccatttcgatggcacagcaaacacgttcaggtcatgtgtatgtgatcagtaatatcggctcgtttggagaaaacgtgtataaaattgggatgacacgcaggctcgaaccgctcgaccgggttcgtgaacttggcgatgccagcgtcccgttttcattcgatgtacatgcaatgatctacagtgatgatgctccttcgcttgaaaatcaccttcacaaggtgtttaacgataaacaggcacctgcggtaagcgcggatcaggtagcaaaactgcgtaaagatctgccgaaggcagcggaggcggataaggataagagtcagtaa

SEQ ID NO: 33676 - DNA, 780 bp, Glycine max
  Peptide Sequence Number=SeqID_150454
atgataaccagaaaaacgctgatgtacatgacccatctgctactcatgatttccgctgccgccagggcggatggtgacgcacagaccagcctgacgctcggcgcgggggcgcaattcgcgccacgctacagcggatcgaataaaacacgggtgcagccggtaccgattttccaggccagagatggcgcattttttgctgatgcccagaaaggcatcgggtacgacctgcagagcgacagcgggttttatctggaacacacgctgggttacggcctcggccgaagcgataaagattcaacgtggcgggacggcgccagccggctgcaaggcatgggaaacatcagtgcgacggtgaacactgcactggcgctgggctggcagctcacgccgtggctgagtgcagagggcaaagcggtgctgccgctcagcgatgatcagggcgtgaactatcaggcatccgttacgctggtgcctctccagcgcgacagcgataccgttgcactgcagacggcggcgctgtttggcgatgcgcgttatatgaatacctggtatggcgtgagcgatgtccagagcagccgcagccggttttcacgctacgatgccggcggcggcttttatggtgttgcgactacgctcacctggagccaccagtttgatgcccactggggcacgctggtcagcgcgggttacagctggctgggcgatcgcgccgcggacagcccgatcgtgtcccggcgcgaccaggtcaccggcacggtcggctttagctacaccttctga

SEQ ID NO: 33677 - DNA, 1620 bp, Glycine max
  Peptide Sequence Number=SeqID_150455
atgcagaccaaaaatatcctgattattgaggacgacgctgacgcggctgaggtgctggaggcgtatctgctacgggaaaattatgcggtgcgtgttgccgcggatggcctgagcggacttgagctggccctgcgctggcagcccgatctgattttgcttgatgtgatgctgcccggcctgaacggcaccgaggtgctggcaaaactccggcgcagcagcgaggtgccggtgattatggtcacggccatgggcgatacgcccgatcgcatcggcagtgctgcggcgcagcgcggtaaaaacgccgcaggaagagatcctgcgctggcaggggctggaggtgaacagcagcgcgatgacggttaccgtcacacaggcctcgggcaactgtatgccggacagcgacgcgctggagcgggcggccggtatggcgggcgtgctgctcaacgtgcgcggcgtaggctaccgcttccgccagccatgacagaaaaatccccacagacgctctggcgctggctttgtctgcgcattctgacgctggctatcggtaccgtagtgctgattgctttgtgcatgtggctgcgcttcacggtgcagtacctgtggatcacgcaccatatgccgccggcggttctgcgtgaatttctcgccctgcgtgcgcatccggaacgcgatcccgcgcgctttcaccagatcatcgatagctggtggggcatacgctactccgacccgtccattgcctcctcggactggatcaccgtcggcatcctggtgctggtgaccattccgtttattgcctatttcgggctgcgccacgcgcgcccgctttctgcacagttcagccagctcagacgagcggcagatcaggtgaccgcaggcgacttcggtgcgcaggcggcgttaacaccggcagcgcccgccgaactggcgcagttcgcgcacaacttcaacgcgatgacgcgccagctggcgcgttacgacaaagagctgcgtacgtcgcatgtcgccatggcgcatgagctgcggtcgccgctcaacgccgccatggtgcgtctgcaggcgctgcttgatggcgtgttcagcgctgactcacgtcagctcgccctgatcatggcgcagctcagttgtctgcaccggctgatcgatgagctgcatctgctgtcactggcggatgccggccagctcacactggagaaagtccgctgcaacccggccgatatcctgcgcgagcgcctgcagtggatcaaaccgcagctggatgaagcgcgcatcagcaccggggtagcgctggcagaagagacattgctgccggtcgatccgttccgtctcgggcaggttttcaccatcctgctggaaaacgccctgcgctatgccggaagcggcagccagctgcagctgcgcacgcgcaacaccgttgatcattacgaaatcatcgtgcaggacagcggcccgggcgttcctgcggcgtttctggcgttgatgtttgagcgctttgcgcgcggtgaggcgtcacgcgcccgccactcgggcggcagcgggctgggcctgtcgattgcgcgggcgatttgccaggcgcacggcggcacgattaatgccacgctgccggcaacgggaggcttgcag

SEQ ID NO: 33678 - DNA, 807 bp, Glycine max
  Peptide Sequence Number=SeqID_150456
atgggtgcctgctgtattgctcgtcacactctcgctactgctgggttttctggcccgctttcttcttctcaggatatgttgtttattcgctacgatatcaacctgtcgaacaacctgcgtgcgcgtaaaattcgtacgcaattaatctatgttaaaaaagtggctatcgtcatcctggtactgttttgcctgagtttaattctgctcaacttccccggtgtacgtaaattcggcaccaccatcctcgcgggtgccggggtcgccggtattattattggtttcgctttgcaaaagtcgctggtgaatctgtttgccggcattcagattgctttcacccaaccgataaaaattgacgatgcggtggtggtcgaaaaggagtggggctggattgaggaaatcaatctgacctatgttgtggtgcgcatctgggatttacgccgtctggtgctgcccatcacctattttaccgagaatgcatttcagaactggacgcgaaataatgcgcaaatattggggtctgtgtttctctatgttgattactcgatgccgctggcgccgctgcgtgagcattttgaaaaaatcctcaatgagacgcggctctgggatcgcgaaactcaggtactgcaggtgaccgataccacggaaaaaaccatgaccatccgtttactgatgaccgcgcagaactcacccacggcatgggatctgcgctgctatgtacgcgagaaaatgattgaattcattcagcagaattacccgcagagtctgccacaggtgagagccaccctgaccgacgccgacaaagcatag

SEQ ID NO: 33679 - DNA, 978 bp, Glycine max
  Peptide Sequence Number=SeqID_150457
atgccgactgatatcgcggcgctgctggcagagatcaacagcacccgtccgatcctggaacaggtcgccaataagtggtcggtattaattctgaccgtgctgtgcactgaacccgcgcgctttaacgcgatcaagcgccgtcttgatccgattacccacaaggcactgacggaggcgttgcgccggctggagcgtaacggcctgattagccgccgcgtgatcgcctcgtccccggtggcggtggaatatgccattacgccgctgggccagacgttgcaggatccgtttgttgcgctggtgaagtgggccagagagcagggcgatgcgattgaaaaggcacaggatgtttccatgaaatttttgaaaaaaacggcgctgctttctctggtggcattatatgttcccctgtcacatgccgcagcgacggaatataaccttgacccgcaacatacttccgtggtgatcgcatggaatcactttggtttctctcatccaacggctgatatttctgatgtttccggtcagctggcttttgataaagaaaacccggaaaagtcccaggttaatgtgaccctgccgttaaaaacgattgacacgcatgtgccagcgctgaccaaagagtttttgggtaatgagtattttgacgttaaaaaatatcctcaggccaccttccacagcacccatgtggaaagcaaaggcgataataaatatgatgtgcagggtaatttaaccattaaaggtatcactaagccggttgtgctgcatgccacgctgaacaagcaggatatgcaccctatggttaaaaagcaggcgatcggttttgatgccaccggcgtcatcaaacgctcggactttaaaatcgataaatatgttccggccgtgggcgacgaacgcgagctggcgcaacaggttgtctgtacttcttccctgggtgcagcatcactgcctgccagcgcatttctcgtaagcaccctctga

SEQ ID NO: 33680 - DNA, 726 bp, Glycine max
  Peptide Sequence Number=SeqID_150458
atgaaactcgaaggaaaagtcgcgctggtgaccggcggcggcagtggtatcggcctcgccatcgcgcgccgttttgtgcaggaaggtgcccacgttttcatcaccgggcgacgcgaagcgctgctggccgaagccgtcacgctgactggcggccgcattgaggcgatagcaggcgacctcaccagcgcagacgatgttgcccgtctgtttgacaccgtgcaggctcgcgccggacgtctcgatattctggtgaactcctctggcgtggctgaacccgccagcctcgaagagaccagcgcagagcactttgaccgcacgttcggcctcaacgtgcgtgccatggtattcaccgtacagcatgcggtgaagcacatgacggaaggcggtgccatcgtgctggtgggctcgattgcgggcagcatggccactcctggctatggcgcttattcggccagcaaagccgcggtgcgcgcctatgcccgcacctggagcagcgaactggcaccgcgcggcattcgcgtcaacacgctcagtcctggcccgacggacacgccgatgtttgaccaggtcagcgacgaggtacgacagacattcagcgcgcagataccggccaaacgcctcggccatcctggcgaagttgcggcggctgccctgttcctcgcatcggacgaaagtgtctatgttaccggcagcgaactggtgattgatggcggcatgtccgcgtag

SEQ ID NO: 33681 - DNA, 213 bp, Glycine max
  Peptide Sequence Number=SeqID_150459
atggcacaagatattgtttgtctgtgtctgaagtcttattcctattccaattgcatttcatatgatgaacgcatacttttttatttgcagattattcgccctaccttctctgcaatcagacatttctcttctgtcgctaaaaagatgattgtcagaaaggctctcaactccgcactcaatgaggaaatgtcaattcatcctaaattcgagtga

SEQ ID NO: 33682 - DNA, 425 bp, Glycine max
  Peptide Sequence Number=SeqID_150460
atggcgtcaatctgcgacaccgatatccctcttcgactacagaacatcgacgctctcaccgcttcttacagaaactctctccaatcactgagaaccaccgcactcgaaaccgcgcgatctcaatccgaactaacagagattcaagctaaactcagagaggctgaggatgatttgtgttttggtttggtgttgtgttttacttttcgtgcagttaagactcggagagaggcgaagcgaatggcgttgaaagccgcgattgattctgtgaagggaagaattgaagatctgaagacgagtattccgcagcagagaacaaaaaacaaggaatgtgctaccgttgtatcgcagcaccggcttgtaatcctctggatggatctctgcaggcaacctcagcatgccattggtgctctgcccggtagcctgag

SEQ ID NO: 33683 - DNA, 2409 bp, Glycine max
  Peptide Sequence Number=SeqID_150461
atgtatgcttggttcaggaaatgtgaaaagaaggattattccacatcaatattagaacgcaagaagtctcctaaccgacttgttgttgatgaagcaattaatgatgataattccgtggttactttgcaccctgaaacaatggagaagcttcattttttccggggggacactgttctgataaagggaaagaagcgaagggacacaatttgtgttgttcttgctgatgaacaatgtgatgaaccaaaaataaggatgaataaggttgttcgggctaatcttagagtgcgacttggcgatgttgtctctgtccatcaatgtccagatgtgaagtacgggaaacgagttcacatccttccaatcgatgacaccattgagggtgtaactggcaacttgtttgatgcatatttgaagccatactttatggagtcataccggccagtgaggaaaggggacttgttccttgttcggggtgggatgcgcagtgttgaattcaaggtaatagagactgatcctggtgaatactgtgttgtggcacctgatgctgaaatcttctgtgagggagagccaatcaagcgggaagatgaagagagactaaatgaaattggctatgatgatgtcggtggtgttaggaaacaaatggctcaaattcgtgagctggtagaacttccacttagacatccgcagctcttcaaatcaattggagttaagcccccaaaaggaatcttgctttatggaccacctggttcaggaaagactctgattgcaagagcagttgctaatgagactggtgcattcttttttttgattaatggaccagaaatcatgtcgaagctggccggtgagagtgaaagcaatctgaggaaggcatttgaagaagctgaaaagaattccccttctatcatttttattgatgaattagactcgattgctccaaagagagaaaagacacatggtgaagtggagaggcgtatcgtttcacaacttttgactcttatggatggcctcaagagccgatcacacgttgtcgttattggagccacaaataggccaaatagtattgatcccgctttgagaaggtttggaaggtttgatcgggagattgacattggtgtaccagatgaagttggaaggttggaggttcttagaattcatacaaagaacatgaaactttcagacaatgttgatcttgaaaaagttggcagagatactcatggttatgttggatcagatcttgctgctctttgcacagaggctgcactacagtgtatccgggagaaaatggatgtgattgacttagaggatgaaacaattgatgctgaggtgttgaattccatggctgtgaccaatgaacactttcaaactgccttaagttcttcaaacccatctgccctgcgtgaaacggttgtggaggttccaaatgtttcctgggatgatattggaggcttagagaatgtcaagagggagcttcaggagactgttcaatacccagtggaacatcctgagaagtttgagaaatttggcatgtcaccttccaaaggtgttctcttttatggacctcctggctgtggtaaaaccctgcttgcaaaagcaattgctaatgagtgccaagccaactttataagtgttaagggacctgagttgctgacaatgtggtttggtgaaagtgaggcaaatgttcgcgagatatttgacaaggctcggcagtcagctccatgcgtgcttttctttgatgaacttgactctattgcaactcagcgaggcagttctgtaggggatgctggtggtgctgcagatagggtgttgaaccaactgttaacagaaatggatggtatgacagctaagaaaacagttttcatcattggggcaacaaacagaccagacattatagaccctgcattgctcaggccgggacgtctggatcaattgatttacatccctttaccggacgaaagttcacgtcttcaaatcttcaaggcatgcttgaggaagtcaccgatctcaaaggatgttgaccttgcagctcttgcccgttttactcatggattcagtggtgcagacatcactgaaatttgtcaacgagcgtgcaaatatgccattagggaagatattgaaaaggatattgagaaggagagaagaaaaagagaaaaccctgaagccatggaagaagatgacactgatgaggtccctgagataaagcctgcccactttgaagagtctatgaagtttgctcgccggagtgtcagcgacgctgacatcaggaaataccagctctttgctcagaccttgcaacagtctcggggattcggatccgagtttcggtttccagatcgaaacgagaacactgcagcagatgcctcagaccctttctcatctgttacagctgagggagatgatgatttgtacagttag

SEQ ID NO: 33684 - DNA, 237 bp, Glycine max
  Peptide Sequence Number=SeqID_150462
atgacaacaaatgaacatcaagaatctgcctttatgtctgcatctgctccagttttatcaatatcaaccattactgaaggaaatgagaatcaagatgaacccatcaaaggcaatgcacatctccagaaacaagtcaatcgaagaagggtaaaatctcctggatctgcatcatctgtttgtcaatctcctcgtttgaaggcaatttgtgaagggaggcctgctatggtagcgccatag

SEQ ID NO: 33685 - DNA, 516 bp, Glycine max
  Peptide Sequence Number=SeqID_150463
atggaacttacctcctcatactccctaccaccctcaacaagtggtcaagttgaggtgtctaatagggaactaaagaagattttagagaaaattgtgagtgcgttcaggaaggattggtcattgaaattggatgacacactcttggcttacaaaacaacctttaagactcccattgggatgtctccttttaggctagtatatggaaacaattgtcatttgcctattgaactagagcacaaagccatgtgggctttgaagtttctaaatttttatcctaggcttgcaagtagtaacaggctaaaagaagagaaggttcttacagctggtgtctcgctaagcgaggcactcagctcacttagcatgttgggaaaccctagaagaggatcagttatagatgtgttcgcccagcgcgccgcaagctcgctcagtaagtcgtttgtctcttctcgcgctcagcgagcccagctcgttaagccaaatttcactaactcgcgcttagcgagtcaatcttgctaa

SEQ ID NO: 33686 - DNA, 135 bp, Glycine max
  Peptide Sequence Number=SeqID_150464
atggcaggtgaccttgagaatgagggggaatgttggaaaaagccacctaaattgtggttacccttagatagaggtgtgttggaagtcccatatggcagatacctcgaaaggggacatgttgaagtaccacattga

SEQ ID NO: 33687 - DNA, 120 bp, Glycine max
  Peptide Sequence Number=SeqID_150465
atgaggaaaaagtttcaagaagcagtggcacaagggctgaatcagctggtttttgtcaaactgagtagcaggctatgtcaggggaaaggatccaacctggctcttagttcatggctataa

SEQ ID NO: 33688 - DNA, 909 bp, Glycine max
  Peptide Sequence Number=SeqID_150466
atgaaggagctcgaagagtatcatttgatcgtgcttcaacctacgtgcatcaagtcaatcatgagaagcttagagttgctattggaattaaaagtcaattttcttaaaagttgcttgggaggaggaattggagtggattctcaccttgttcataggtatgctcacttgttaaattgttcagttatgtccatgccgtttacatatcttgggattcccattggggctaaccaaagaagagtgagtgtgtgggaaaatatctcggttgaggtggctcataaaatcactagactacaaagggatttcttatggggagaggaggagggtaggagaaaaatagcatgggggaattgggaggtggtttccaccaggccgagggagagtagaggcctaggaattaaaaatattgaacgatttaatgttgctttaattggaaatggagatggagaaggagtctttgtggagagtttcacacttggattccatatggtggagggatttggtggaatattgtgggggaaaagagggaaccttcatggtttggaggaattagtgagtgatgctggtgtgtgggaagatggtaattggtgttggaggttgagctggagaaggcaatggttcacatgggagttaccttttggtggaggcattcatgaaggatttagaaggataggagttacttctacaaagaataaaatgtggaaatcagtgtggtgtgcttgggtgtgggctctatggtgtcacaggaacaacatcatattcaagcaacaaatcattgatttggattcggtggtgggaaacattaagtataaatcatggatatggttgaaagctaatgtgaaggaatttcatttctcttttatggagtggtactctaacccggctacatgcttacaatgcttaaggttgtga

SEQ ID NO: 33689 - DNA, 681 bp, Glycine max
  Peptide Sequence Number=SeqID_150467
atgttttcagaaaacaccctttggcttatgcttgctattttctcccttagtgcttccatcacactggcctctgaccctgatccagtccaagacttctgcatatcaaacccaatatttggtgccatcaaaacagcacatgacatgcactacattctcccatgcaagaactcctccgaagccaccactgaggactttgtcttttcaggactcaaaaaagccacagggaacttctcagacacaggcctagctgtggtgtcagcaagccctaccaattttccaggactcaacactctaggcttgtcttttgcgcgagccgacatcgaagttgggggcatcaatccaccccattttcacccgagagccacggagctagttcatgtggtgcaaggaaaagtgtactcaggttttgttgattccaacaatagggtgtttgctagagtacttgagcaaggagagatcatggtgctccctaaagggctagtgcacttcatgatgaacgttggcgatgagcctgccacattgtttggaagcttcaatagccaaaaccctggtattcagaagataccttctgctgtgtttggctcagggattgatgaggagcttctacagaaggcttttggattgagttctaagcagattgggaccttgaggaaaaaatttgatcccaagacagcaaggtag

SEQ ID NO: 33690 - DNA, 348 bp, Glycine max
  Peptide Sequence Number=SeqID_150468
atggataagagcttgaaggtaggagaagatgagtggagggagaaagagagaaggagcatgaaattttgtgcctcaaaagagttatggttcagccctctaatccaagatcaagtccaagattctccactaagtgtgcttaggtgtcatgaggcatcccatgggctcgaaatctaccctaaggctcaagagaaccctagggccttctcttacatctctggcccaatctacttggagtctatccaatgcccttgcggggtaggattgcctcattccctcccccttgaaaaggatttgacctcaaatcccgagattcttgaaactctgagcttttttcctcaacacatgtaa

SEQ ID NO: 33691 - DNA, 375 bp, Glycine max
  Peptide Sequence Number=SeqID_150469
atgaagggaagaaggcataaatatgggtttaacaacaataaacgtgagaagtcagggaagatcatgggttctcaacctgcctcccctcctcctcctcctccttctcctcctcctcctcctcctgctccttcggacgcatcggctttgccgtttgccacgaagcggacacacaaagcctcacgtctacgatcattgtctactagaccacctggtgttgagagaccagtggtccatgttgatcctgctaccggcaagaccgacggtccccacaggaagaaattaagaatatatttggggattgtggcgcgtgataaggtggacgtcacctacgagaactggaagaaggtccctacttctcagaaggacctgatttag

SEQ ID NO: 33692 - DNA, 189 bp, Glycine max
  Peptide Sequence Number=SeqID_150470
atgcctacgtataagaagccactacatagccattgcctcttcagttcaggtctccatgtcaccctctttgggcagaaggaatacgaagtcaagcataagaaagcctcttcagttcaggtctccaaacgttttcctcatggaaatatcggaagaacgaaagttatatttttcatcatcatcagaggctaa

SEQ ID NO: 33693 - DNA, 1227 bp, Glycine max
  Peptide Sequence Number=SeqID_150471
atggtatccacgttacacatccttattccattgatgatctttaccttcaaagttaacccatgtaaattagtcatcgatctttacttatctggctacaagaacgtagaagttagtgaagctgatgcagtgacagtgccatttgagacagatgatagatataactcattagcagctgatgcttacagcaaaacttatgaagtggaaggcgagtggatcccagaaccaggggatgaaaatggcttagctgatgatattagaagcactgtggatgaaggtataccttacagcaacacttatgaactggaagaagctatcttgttggatgaagagaaatggcgagctcaatatggtcaagttgctgaatcagggaaagatctggtttcggaggttccagttgtggacttgtgggattgggaaatggttacgggatccaaaagagatggaaaagataaggtggcaaggttggttggtagactggcgaaaccatctgcaaaacaacttccatctatcccttctagaggagggaaattaagatctgctcccatctgtgaagcacatctcgatctggacgagtgtacagattgcgaaatcctagcgcaaaatgtgacttcattatcaacttatgattcttcgaatccaacagaacattgggattttccccagctatcaccttatagaaaaatcacacatcactctaagtccagcgaaagctctgcttcggcttcggttgaaacccctattgagaaggatttgtctgcatcgccaagtcagctctctgcatctaagaaaataaaacatcaatacagagataggactgctgaaagaagaatattgcacggtggctttggcatgggtccaggacagaagaatctgccggacatttataatacaccatcttcacctgttgatgattgtctacaagaagctacggcagaggccttggaggtgtcatttggagcaggtagttgtgccagaaaacttctaaaaagcatgggttggaaggagggggaagggcttggtggaacctattcaaccagttggaaacgttggtacttctggtttgggatggtctcgttgaacttggcagtggcgtcacattgccaaattggtctaccacgttcggataattgtcaattttttaacgcattcatacagagaaaaccatgctcaatagtcaatatagtacgcaagtacacgctatccaaccatgctcatgagttgtattaa

SEQ ID NO: 33694 - DNA, 624 bp, Glycine max
  Peptide Sequence Number=SeqID_150472
atgaggattatgacaacgatccttttgcaccgaagaagtctccagaactgtaaggaaacacttgcgacataccaatttttctttatgaaagaaactgaacttttgttattgaagaacccaagttctattggtctcaaccagtggcccaatacagagaagcctattaaggtgtgcacccgaaggcccaaacacccagacattaactctcgccttaggcaagaagtggaatgggagggaaaaaatgaacttgaggctgcaaaatctgagattcagagttggcattctacacttaaaaatgagccgtccaaatctgctgggatcactccagagcccaagatgttgattaattatcttcagaccttgaaattctctgaagagtctttaagagagcagcttgaaaaggcaaagaaaaaggaagctgcgttcattgtaacatttgcaaaacgagaacaagagatagcagagttgaagtctgctgtgcgagatctgaaagtgcaactcaagccaccatcaatgcagaaccccactggttttccagcttcttttgaggcattgtacagattgctcttgattcctttctcacttgcttgtactgcatctagcttaaaatatatgtacatgtaa

SEQ ID NO: 33695 - DNA, 105 bp, Glycine max
  Peptide Sequence Number=SeqID_150473
atggcaattagaggaaacttggcatttgcaatgttggtgcttgctggcattgtagtgctagggaacatgccacttgcctcggctcaatgcggagatgaaaagtga

SEQ ID NO: 33696 - DNA, 642 bp, Glycine max
  Peptide Sequence Number=SeqID_150474
atggtggagggctatcctctatggttatcttttggacttgtgttgatacccagcattctgatggtggagggtcttcctgcatggtttggtccatacttttgtcagcctgtaattgctggattaggggatgaagacaaaccattcatctgcacaatggattgtcttggggcaaaattgtatgttgctttgatggtgccttttatgcaagattatgcttcccttatagtaaataacctggagcttgcaaaagattttgttgtttctgggactgcatctgagtctctgtatggtgcttgtgaggcgatgtttaagcctgacatgacatgtatgaagttaattctaatagttattgacttacaaaagtgcagcattagtgcaatgtctaataaatggggactgaatttggatggaaacagatatcctatggaaccagaggaattgtttgagaccatctcccaagcactgctatcatctgtagatcgtgattgtttgagtggctggggaggacatgtctatgttgtgacatttaactatgactctatgcctattcatattatagtatctcacgccaaccgaagtgaaggaaaggattttgaagggaaggatggattaacttgtaagccacctgagttttctgtttag
